United States Patent 11,001,841 (CCCTC-BINDING FACTOR (CTCF) RNA INTERACTOME) - sequence listing, part 57

SEQ ID NO: 134272 - DNA, 1033 bp, Homo sapiens
aaaattctttttcttttttttgagacagagtttcactctgtcacccaggctggagtgcagtggtgcgatcttagctcactgcaatctccacctcccaggtttaagcgattttcctgccacagcctcccgagtagctggcattacaggcacacaccaccatgcccggctaatttttgtatttttagtagagacaagatttcactatgttggccaggctggtttcaaattccccacctcaggtgatccacccgcctaggtctcccaaagtgctgggattacaggcgtgagccaccagccctggccaggaagaaaattcgaatacatgccacagcatggatgaaccttgaagacattatgctaagtgaaataagccagttgcaaaaggacaaatattgtttgtttctacttatatgaggttcctagagtagacaaatttacagagacagaaagaatgatagttgccagaggctggagggagggagaaatgggagttattgtgtaatgggtatgaagtttcagtttgggaagatgaaaaagttctggagatggagtggtggtgactgttgaaagacaatgtgaatatacttaatacactcaacagtacacttagtggttaaagtggtaagtttaatgttatgtatattttaccacaataaagaatagtgaaagctaacgtttattgagtgcttacaatgtactaggaacagtatgctaagagatataaacacattgtgtcatttaatcctcacaacaacacttcttttgagagcaatgctactaagggcaccaaggttctttatagcttagcagagctcctaggagttgtcacacactaatggtgggggtcagcggggagaggaccattcccccggtcagaagtcctatctgtcactaatgttcctcagatgcatgttctctaaatccttcaagccttttggctttccagagcctcctatcatacatcctgggatctggacttgatgggctgggtcaggagaagagaaaagaaaatagagtgatgatgccttttggg

SEQ ID NO: 134273 - DNA, 1028 bp, Homo sapiens
catctccagctcctggcatggtgcctgtcatatatgagatcaaaccatgggaaactgcttctattttatcatctttaatccaaaaaaacgcaattgcataaattccagagtaataggaagttctgggcaaacatttgccaaataaatgaacacggaacaatcacatacccacaaatcctgattaagcatcaaagaacggaagcgctttaggttttcttgtggccttgggctccttaccacatgcctcaattatccttgcactcttaaacatggtggtgccatgagagattcccaacaggtcaacacacagctcttgtatcattttcttctttcgggaggctggcagtatctccccacagaagaagagtgatctctaacaggtcaaatgcatggttttctgcactgtgtttatgattctggaggccggcagtttttccattcagctgataagtggcagatcccgggatggatgagattagcatctgggatggcaagtgtccaggatggctcagaagtagctgccaaactccacttgactctcagtcccagcatcacagggtggcaagttgctgcagaggccatggatctcaaccatgtatcatttggaagtgaaaactaacagatgcgaaatagctttttaaaaatcaagacatggccagggatggtggctcacggccatattcccagcactttgggaagctgaggcaggagggtcgcttaagcccgggagtttaaggctgcagtgagccatgatggcactactgcactccagcctgggtgacagagcaagactctgtctccaaaaaataaataaataagaaaaagaaagcaagaacggatagaggtggctggttacagactcttcatccctaggcagttgtgccttccaaaacacagcctttggcttcactgtatctggcccactgtcagaggctaaaattcagtgtgaggtttgtcaggctccatcatccaaatggatcccagtggccaccattcacagttgcagagaggcctgaattagtgtttca

SEQ ID NO: 134274 - DNA, 1369 bp, Homo sapiens
tagcccgttcctggaaaagcaagaaatggagcacgatactaagaccccagaagagaaagacctccagcacaggagattcagctgaagactctttgctcctctgatgactgaaaatggaccagggagcatgtgaaagactggcattggaggagactctcagctggtatatgctatctatacttttggtctgttgctgtctgttcactgaaactctttgcatacactcatctgaaggctgaagggagataacacactgggtcagagatgtattttccccagcagagtaaatctccaactccacaggcaagagatctggcccactccagtcagatcacccacaccctctacaaagctgcatttctgtgggcaaccgtgtgagtccttagtagaattcacaggaatatattgcattatttaatgtgttaatcatcaaaactgcacagattctatagaacttattttagaaatacagataaaatatgtataagttaagagaaacaatgtctgggatttctttcaaaataatctagcccagggcccaggcacgatagctcacacctgtaaccccatcaccttgggaggtcaaggagaaaggattgcttgaggccagacctgggaaacattgtgagagcctgtctctaggaaaaatttaaaaatgagccaagtgtggtggcatctgcctgtagtcccactactcaggaggctgaggtgggaggatggcttgagcctggtgaggtcgaggctgcagcaagccatgatcgtaccactgcactccagcctgggagacagagtgagaccctatctcaaataataacagtaatcatcatcatcatcaacatcatctagactagagaggagaaaagtcagcatgcattgatgaaacaagattcgccatgtattgataatttttgaagctgggtgtggatacatcaggtttgttataaagttcttcctacttttttgtatatgctttacatttttcataataaaatgttaataaaaaatagttttcgcggggcccagtggctcacgcctataatcccagcactttgggaggccgaggtgggcagatcacctgaggtcaggagtttgagaccagcctggccaacgtggtgaaactctgtctctactaaaaatacaaaaattagctgggtgtggtggctcatgcctgtaatcccagctactcgggaggctgaggcaggagaatcgcttgaacccgggaggcagaggttgcagtgggccaagatcatgccactgcactccagcctgggcaacagagtgagactccatctggaaaaaaaaaaaaaaaaaaaaaaaaaaaaaagagttaagtgctgacccaggccttcaggtagcccaggattatatt

SEQ ID NO: 134275 - DNA, 1031 bp, Homo sapiens
cccccagcaagagctcttcacctctcccaccgaattccagtttctgcttcattagatattctgtcccttttctcttgcccgctgccccctggctgggttcagatggtttcagcgggtcccggagcccttccacggcccgctccgcagacctcgcttgctcgcttgcaccccatccccccttagtgccgtgacccgggccccgcggcctccccgcactcggaggcccctgcgggagcgccgactctgggctgggaaggagattgggcacctggtgggtgacgggagcgctacggaaactccctctttgttgccagtgtaacaggaggaagaggttccgaatttagtttttctgtgggcactggctgaatgttgtcgctgagggctgagatgcagagatttctctcagcttctaccctgcccccatccaaatttcgccaacctccttctctcggatccgagcccttaacctgggtggaaatgtttagacaactgtacgaggatcaaatgtaatagaactcgactactggccactaataactgagaggacctgtttgtaaattacctaatttagtggattagcgagtgtatttacaaatactataaaaagcaatcaggaatactgcatcaaactgtcttgtggtggtgtatgaaaaataggctctgacaacgcctgggatgtaatctcacagtttcattagcgtagtttcattaactgtggtctgtgatttgtttgttttagggggcagaaaagggctcttgtttttagaaataaaggatggttggttcttggtgaagaaaaacgctagtttggggggaaaaaattcctccagaaagctagcatctgtgataatgccagaagtgtttttgctgctgctaaatgactatatataactcagttttaaataacctgcatacttgttctgaaaatctgagatctgttagagagaaaatgactagaattgcagatgaatgggggacatttgtgttttattaggtatccatcctatcatcctattcctccagtctttttt

SEQ ID NO: 134276 - DNA, 1859 bp, Homo sapiens
ttcctttgctcctgatgacctgcttaatgtgtatgttttagttggagcagtggctacaacatcttaaaagagcttgtctgcaaactctaatgataacctacacaacacatgaaaacagtgtgctttgaggtaatctgcagttcagtttagcttttctcagcagtatcttcagcaactttaaagctctggcaggttttatcaatgtaaataaagtgcattttctttttgtagcagggcttcacttttgaaatataatttattttcccttacagtctcttgctatgttgtagattctcataaaagagtttgtggtcttccaaactttgatctcttgtaatctgtcctggtattattttcattttcttggcagtgtctgggtatcatgattttccatcaaaataattatactgttttaggatttagatcaaagaaaagtgtcacattctatactagcatttcattgctagaggagcagattattggcaaaataatttgtgctgtatcagctatgtacatctaggatcttaaaagtgtctagtgagtcagggctcttaaggaactttttaaattattttttaaaaattagtgaccattacaagttgtttactaatattggtaattgctcaatacaaaccaacacaggacagtctttgcctaaaagtcttttgaggggaacgtaaaagtaagatagtcttgagtttctttttacagtactaatcctccctaaggctcttaaaatttattcccatctccctataattcatttgttctggtataacctgacataatttctatccttgtaatgttaaacttcaaatttcacttgtaaatcttcagatttattaaatgctctttcccattgacaaaccagtttgaatgaatcttttgaaagattacttagcaaattgccgtaagtctttgtccttaatggctagatgattatttctcacagcagtgctttagaggccaggagattttgcaagttctgtgaagttctgtgtccttcagttctaaccttaaatgttgtaagagggatggaggagaatctttcaagttgaacaaactgccgcttgtctgtctagcgttaggagacatttgtccactgtctcatcccattgtcttcaaattgaaggctgtatatttaactgtctttttgtagcactcatattctgttttgggagtaataaaaaacaatcagaagtggtttacaaatgctggttaatatttgcatatgctaactgtgctttaacaattttaataataccatcatctgtatcagctttgtggagtttgaagtgagatggtaaaaattaaatttgaagagtgtagtgggaattacccacagagactaaagttgctcagttaaattaagacctgcaaagtaaacttcatctaacgggaacagaagtcatggcatgaagccttttttttccttcatcttctgaatactgtgttgttagcatagaggatctactcctcaaaatatgtaaatcaaagttaatttcgaaattggaaaataatgtagaaatggtaattttttttttttttttgagccagagtttggctctcatcgcccaggctggagtgtggtggcataatctcggttcactgcaacctctgcctcccgggttcaagtgattctactgcctcagcttctcaagtagctgggattacaggtgctcgccaccacacccagctaatttttttttttttttgtatttttagtagagacgagttttcaccatgttggccagggtggtctcgaactcctgacctcagatgatccacccgcctcagcctcccaaagtgctgggattacaggcatgagcctccatgcccggccaattcccaaatcttaa

SEQ ID NO: 134277 - DNA, 1364 bp, Homo sapiens
cttcagttacagtctgtatgttaacagttcccaaactaaattactgtcctggtcgctgatccttatatccaactgattaattagcatttacactagaatattgtacaggcaactcaaactcagcatgtttaaatctgtcctcaaaatcgtacccctcacccccggctttttcagtactttatctctggttcaccgaatgataccaatgccctggttgtggaaactggagactcgagtcctgtagggaacctgcctctcactcttctatatctagtcaccacatcttgcctctttgaccttctcaacgtcactgccagcactccggttcaagcctctgtcatctccagcccagtaccttggttacagatctctccgtaactgttcatgctcccttctaatttttcttcgtattgcagtcttggtgatctttgaaaaatcccaagctaattgtgttcctctcctacttaaaaccctttaatggtttcccattgctcttaggacaaagaccagaacccttgaccctggacaacaagaccctgtgtgtggctgttctccatctctctatagggtcaccttgtggtgtgcttttctttgctcattgcactgcagcctcacagattcttcagttggttgtattccttcctcttagagggcttttgcatatgtggttcacttgtctaggaggctctttgctttgctccctggcttttggctggttgctttaagtttcagtctgaaagtcacttccttggaaaagccttttctgatcccttcaaactaggccatgtctcctcattaaactctcatagccttatgtgttttccctgtgagcacttaaagcagtaaacacgtaattttacagttaatattaatgtctagactaggtggcggcaaactacagcccatgggccaaatctgacctgctacctgttttttatggcttacgagctaagaatggtctttacgtttttaagtggttgaaacaaatcaaaagaatatgatttcatgagaaatttatttaataaattatgaaattttaatttcattcacaaggttttattgggacacagtcatattaattcatttacttgtctatagctgctttcatatgacagtgtcagagttgagtagttgtgacagaggccttatggcctgcaagcataaatatttactctgtgtccctttacagaaaatgtttgctgacccttgctctaggctgagttgatgaagagaggggccgtgtttgctttgtttattgccatcttggtgcttagctggtaccaatacatggtaggtactcatgaaatatttgaatgaattaacagatattctgtttccctccatggatagaggtgattgaactc

SEQ ID NO: 134278 - DNA, 1094 bp, Homo sapiens
attgggcgtggtgactgggtaggcagccaatactatctgctatggttttgccattttcttttgtctttaaatcagacttctatagtgtttcctaacattttacttatagccccattatgaacttcacagttcgtagttcaaagtcacacagttagttatcttcttgtcctagtgatgctgctcaagccattgctgaaacccctgtctttcttttttgctcacccccactgcatctttcccattctgagctaaggacagcttcagatgaagaagagcatttgaggttggaataatggttaagtggtgagttagtattcttgcaggccatggtccttcaagagcaccttggctgttagtataacctcttctctctctagcttacaatctccttttctacctcttttgaagtctcacttctgtctgtgtttatctctgtttcaaaattgagtatcaaaaaactgatagtttttattttccttattttttttccacctccagctgatacacttaaggagctgtaataatgagtacaatccactaaagagggaaaaaaagagagcctctgttttcttttgttttaacctgcttactttcaggtttttttgtttttttttttttttaataattaaactgaaaagtcatgtcattatttagaatatctctgatataaagagttctcacagtatataaaatgcatccttgcaatacataatttacagaaggaaataaaccagtgtgtaaatatgttcaatcttgttaacaaccaaattaaagcatagaggcatcctttcacagctgtaactttggtaatagttaacaaaataatattaattgcccaagtggttttgactcaaatatactttattgatttgctgaataaattggaatgaccctcttgagatacattaagagccataaaaaagttaacatcctttatttggtaattctaaagttgagtaatgctatatgtaagaatctttttattgtagcattatttataatggcaaaaagtttaatttaaaacatcatatatttgctgtaaaactttcttcctgtttcttaataaaatccatttgaatttagtctgttatact

SEQ ID NO: 134279 - DNA, 1088 bp, Homo sapiens
gaaaatgagtgcaaagagagaaacaaacataaataattagaggctaaattgggtggcaaggagttcaggggacggggaaaccaagagaggaaagaatagttggggagttggcttcctgaaaatgattctccagcaaaagatctggtctggaagaatggggtttagaaaaagtgaagggcagacagattttagtagaaagcagggagaggaattccagtgtaaagaacagttggtcaaaggcaaggaagcagacaataacttgctgcttgtcagtatggaaaggagacctgaccagagtggagtgaagagatgttatgttgcatttggggaaggcattcatatttgaaggggaggaaaatgggcagccatggaggagttttcagagtggtttaaggaagattaatttgacagcataactgcacctgaatgggagaaatagaaggcagaggccgcccagggagctgttcagtaactcataccagtgtaaacaggaaacagagaagagttattgtggagtcaaaataaaatagaccttcctgacttaatctggatatgtgggatgaaagagaaggaaagaacagatgttttgaacgccacatcatggaagaagggtattataatggctagacatgttagttgagatggggactagtttgtggagaggggaagatgaattcaattttgtatggactgactggaggtggtactgatattaatacctccaggcggtattttccatagggaattgaagacccagaactggatttcagaaaatgctttaagtcatgagcatatagaatatagagaacaccagtcattgctggggatttactgtgtggtagcctctgggctaagcgctttacatgcagttctcattttattctcataactctgaggtgggtcccagttagcctcattttacagaggaggaaacagaaactcagaaaggctaggtaccttgactaggatcgcccaagtagtgtaaaactgggagtagttccaagcctgtgcacttcctgctgtatttccctctgctgttccaaggactgctatattaaatggtagattgaatgtaccttagataccac

SEQ ID NO: 134280 - DNA, 1003 bp, Homo sapiens
ttaaaataataaacttcattttaaaaactcagcatatttaagagagttttattccttgcttgctaagcctcaaagtttttccaaatctattttgcatgtggttttgtattttcatgacaattctgaaaccacaggtgttggaagacaattctaaagataccaagttttaagtatattttgacatattttgaaactagccatagttttaatcaagaaaaacatttttcagtgtacactgctgatagaagcagatttcagttatgaaagtttggaaataatactttaataaggcacttcattttaaaactgaaagcaattctagtttgctgctagtttaaaaagtttatagtttaatgtgatctgagaaagtaaaccaagaccaagtggaaacacttatttatcttgaggttgcaacaagcaaattgagctgggagacttctgggtgaggaaggatctgctacttaaatcaggctctaagatatgatagatggtgctctacatgccatcactttgaaagatttaaatgtttcttatgtaagaatatcttaatcaggatttctcccaagtatgtgcttccaaagcaccagggctacaaggtgttctgccaaaaaaagggttctgaggtcagaaaagtttgagaggttcttcttgctcacttcataccaccccctcactggcctcccaaccccatttgaaaagtaatcatgcatattaacatatttagggtcattgccctgcctcccaggaaaccagtttaactttgcttaactggcctttattggacttatctgtcctttaaaatttttttcactatatcttgaactgctctcctacacagcacactttgagtaacactgcttgaaatactgcttctcaatttcattctcccaaatgacaacaaaagtgattatggtgaaaccagaagcaacaataaggttgttggatcaggtgactcttaactaagaatcactcagctctgaaactgactttaagtgcatcacaa

SEQ ID NO: 134281 - DNA, 1092 bp, Homo sapiens
gaaaaattcacatgtaaactcaggatgctgggctcttatatcatttcatggtggatgatttgtgtaaaattgcaactgagtgaatttcattcaagcagtaggaatcttgaagatgtgagtccattactagcaaatgttatgttctgagtatattgtctgagtttttttttttacctgcagtcacagagcagtgacagttcataccattgtacatagccgtatcatacttcattaagcagttttgtattgctctaaaatcactgtttttgcttttttcctcaacaatatgtgtctgagttttttttctcttagtaggattaataataatctactttccctggctgtgatgctctttagagatcaaacagcatttctaagttgcaaggaatcttccaccctgttgtcttctgcttttacacacccacacagtcacatgttaatgaatgtgatagttctgtaggttattatttctttatgcatataaatatgtttcatggtacttaaagacagggtagggtagtaatactgacactgatgttagagggaaaagtagtgaataaagccaataaaaaaaccagtaaaggatatatccatctgtgaggttttgcttatgctcattatagcaaactcttcattcattcactagataaaccactaattcgcattttaccagatgttccccttaagcaatatgaagctactccttttccgctttgattctattttgcaatatatcttttctatcagcattagattcaaagttacccctggactgtgccctcagtttactcatctggcctttgtcactgaacaagaattgtactcgtggaggtgtattggcctttttgaatgagcgtcttcactcctgcctcactgcttttacttatgatgttcttgtttggaatttttcttcctcctatctgaatcctatcctgatgagccagttcatattccctcctttcaagaagccttcctcttcagtccacactgaccacctccttctctgaacacagcataaattaccttggctattgttaactaagtgtttcatgtcacctacctatagaaatattgaatcttttaaagcatagg

SEQ ID NO: 134282 - DNA, 1055 bp, Homo sapiens
aaggcaagcctgcagatctaagagctgcttatttgtaaattatactgaaatgctaggagaagttctctggaaacggtctaaattgtagttctttaatattttctgcttgtagaatttgaatgggaagtacttggtgtggtttaggttttaccaaggaaggccagctgatagctgtgaagaggcgctctgctaagtgtcattgaccttagaatccacaaagctctggggctttggagacttagaactttattttgctagatttaaagtgtactcttctcttaacgtagaattcatgtaaaactacatcataagacacacctatcaacccagcaggctaatttattcaagaatcaactgacaggcagaccagaaattttttgtcagtttggtaagtgtgaaagtaaagccaaattattattatttaagaactattacatttattcttaatagaaaagtagtatggttattttttaaaaatccaatcccaatatgtgcgagtcctttctcattccaccttatgagataacaaatgttagcagcttagtctgtatatattcttcccaagtgtctgtaattgcaataagctccattgctctattgctttatttttctgtagttctctagttatgttttgcactccacttgtcaacctgtggaaggcaagagcacagtcagaaggttgcctgatgacatggaatcagatgaagggaaggggagtaggctggatgacccatggtgcagcctcagttcagtagcctgaattgtctattcagcagtaaaagcacgtctgcatgagaagctaggtgccagagttcactcttctaggaccctttccccaacacagtttggaaggacagtatcaaggtttatctgtcacacttttatttttcactataactacccaggtacaaatcctggcacctaataggtgctaagtaaatagtagtatgtgtctacctgccctatccatttcctattttctgacaaatacagtctttttttttttttttttttaagagatagggtctcactttgttgcccaggctggtcttgaa

SEQ ID NO: 134283 - DNA, 1068 bp, Homo sapiens
tcatgtaggggaagcggtaaggccgtctgttctaacatcatgccactccagtggtaagagacctagcctggtttatttattcactaaataaatgtgctgagagcctatttatgtgctaactgcggtaactattggggacataggagttaacaaagtcaagtccctgtccccaagtagacgataaagtgggaagactgaacattatatatgcaaccatttaggggaagcttctgtacacattgttttgcatggaataggttttcatttgaagaatatttgagtgctttctataaacaatgttaatccctgggttaaacaaaaaatagacacattacacttaccatcaaaaaggtcatctactgggaaaacataaataattataatatggaatgataattactgtgatggtatttacatagtgtgctgtagaaacacaaaggaagggaacctagttcaccttacgggttcctctggtagggatttggttcacttaagagttttatgccactgtcgtagaactgaacacatatttgtttcagtgcgtgactgctgtgaactaaaaacatcttaattgacaaagacaatacctaattttgatttagaacataaatttaccaaattctgcccacctatttgctatattatgatcagtgcaatctttatgttacttctgtataagtcattataagtcagttctcagtgtttttttttgtttttttttttgtttttttgagatggaattttgctctgttgcccaggctggagtgcaatggtggaatatcaactcactgccacctctgcctcccaggttcaagtgattctcctgcctcagcctcttgagtatctgggattacaggtgcccaccaccatgcctggcgaatttgtttgtatctttagtagagacagggtttcaccatgttggccaggctggtctcgaactcctgacctcaggtgatccaccctccttggcctcctaaagtgctgggattacaggcgtgagccaccgcacctggcctgtaagtcaatttttatctgttccatcatggaaaagagagcaagattggagta

SEQ ID NO: 134284 - DNA, 2017 bp, Homo sapiens
aagaagggaggaggctggatggccctaacaagagtgcttaccatggaaaacagaagatacagagaccccctacaacttacttaccctagtagttattgctgcttactatgagctagacactgttcttagcacttgacatatagaaactcatttaattcccacacctgctcaaggacgtatacattgttgttatcacattcccattttacagagaaggaaacagaggcatagagataagctcaataactgtctaagattacatagtggcagcactgaacccagaagagaagaggtagaaggggaggcctcaagaggtagaccccactctgttgcctggaattgaggacaacagaaaaagttgttcagaacatggacctgtaggaccagtaaccttgcttgccagtgaaacgtggtctcatcagtatctcaggctctgaccaaatcgcttggcatcacctcttcctttagtatgttgttaggaagctagggtgaggagcagaagcatggagaaaggagactgcagtcttccacttcatatcttgtgtgtgccatctagtagataagtggtgccaccaatggagatagagtatatggaggaaagggaagtgtggaatgagaaaatgagttgtggacatgtagaatttgtgagtaaggagaagcagttagaaatgcaaagttggaatcttggagaatgatctggaatagagttggatttaggggacatcatctcatagtttgtcccttcagactgctttcaaggaaggaccttttctattttatatagcattgatttacttcccagggcatgatgtttctacctcattaactattgttgagcgtgcagaacagagtgagagattcactgcagtatttagacacctgtttgatgggctgttctttgctgggatcacagaaataagaacaacaacattccaaaaattaccataaggttacctgatccaaatgacttgctactttctattaagtctgtttcctttctttattttaatattgtgattattacttattaatgtacctaacatagtatttaccattttaaccatttttaagtatgtagttcagttaaattcatttgtttttaatctgcttttgctttatttattctcagtcactgtagtaaaccaaacaggtgtgaacttctccctgcaagtatactcttaaaaattgtactctgtgtctgctttcccttagaatcataatagttttgaagaggaagggctttagagattcatctaattctatccttgtgatgataaggaaactgaggctcagggaataaaaagttacttgctcatgatggtaaggagtgttcatggcaaagtgagggtcagttttcagtcttccttgtctgtgttcttttcattgttttagctgcccatgaaattgagcctatgatttcactccctcatgctgattattttcttccctcttgaggacacttcaattcttttagggtaaaccttgcatttgtatatgctcaataaatgcttattgagtagttattccctagactttctatcgttttttttttttttttttttttttttttttttttttttttttcagagtcaaggtctcactctattgcccaggctggagtgcagtagcatgatcatggctcactgcagtcttgaactcctgggttcaagcaatcctcctgcttcagcctcctgagtagctggtactacaggcatgtgccaccatgtctggctaatatttttatttttgtagagacagggtctcactatgttgcccaagctggtctcaaactcctggcctcaagtaattctcccacctcagcctcccaaagtgctggaattacagggatgaaccactgctcctggcctcattctttttttttccttcttctttcctcattcttagagagaggcatcctattacatttttttaaaagtctggaaatctgacagattgatacaagtttataattaattttgtttaatttgtttacataaatactcactctgcatcaggc

SEQ ID NO: 134285 - DNA, 1089 bp, Homo sapiens
cagttcattaatgagtaaattgtctttctccacttaggcagttggtacttatgagttgccaggtcatgcctctgacccaccatccctgtatgccttcatctgatttaagtcacctcctatttgtgaataaatttgtctgttcctcttctctctcttaaaatagcagtgctgaaagcacttccatagctcagtcatttgaacattttagccgtggttttcttccttgctaatagtcttactttctctctaagattgcttcctactccatgcttatgaaagccttccttatgcccttatcatttgcttcattaatgtgatttttccttctgttgaatgccttttccctctctctctgctgaaccattaaattatggagtgtattctgtaaagtttctctcaccccactttaatttcatgtgccacattttttcctttctgaaactatattgcttcccacattcggattttagaatttttctttttaaagagattgtatttttaattatatttggcctacttccccattgtcaatgcttgtaccgtgtgagaagtccctaggatgatagtcatggttttttcccatcttattagcttattattctccttgcccaccccccacccctggcagcttcccaccctctctaatgcttctggaagctactaagaagtttaagtggcctatgtgaaaatatgtcagtgtcccattttagcatatatatgtaacatttacaatttatacccctgcctacatccgagagggttgtgaggtggcttatgatgataaagaaaaaaacccacatgtccaacagtacagttaagaatagtcagaaaaggaaatcagaaaccacttaaaggtatctgtaacacaatgtacttatcaaacataagaagaaaattcctataaaaagtaaaagaagaacataaccttttaattatctaacaactttgctattttagattagtagtgaaagaagattgtaattgtggtctgaaaatatttttgtacggtaacgaaattactggcattctcactgttccccctagaaatttttgttctaaaatagagaaccaaaggggtttttgttagtg

SEQ ID NO: 134286 - DNA, 1048 bp, Homo sapiens
actaacatgtattgagacttgcactttacatgtaacatgtattatttcatgtaattctcataacagcctttgtggtaagtggttttaactttaacttatagatggcaaactgaggcacagaattaagtaagtttgtccaaggtcacccaagaagaaaatggactcatcagtattccattgatcaacacaggcttttctgaccccaaagcccaccatctttcccttatagcatattctcatttctaataatagtacctaacaactataatagctaagactttattgagctcttactatatgccaggcaggttttttaccactttactggattacatcatttaatcctcacaacagcctgatgagctacaattatctcaattttacagatgagtaaattgagacagaaagttgaagctagtgagtagcaaatcagggctagtctctactctcagtctacttttttacgaagtatagcttcacgaagtttctactgactgtagctatgttctctattctttccttgtagctcccttacctgcacaatgaaagtacagggcttatttagaacacagtttgtttgcctttttgggtaagtatatttaaaggggaaatacttttctctgaggaattgcatatgagtatagtattttccactgtaggccttggatctagcagggctatttacataagtactactcgtgatacttggctgtgattaattaaataatgatagtctctgccttcttagccagtttactaaagataataaaaatgtaaccttttaacgatcagattgcaagaatagttcttaacctcagtctttcccaccaatacaatcaatttatcagtagtgattcactttctgttcttctggctagtagcttgctgtcaagcgtaggcttttattgctttgttttggtcagtgcatgcttgacttagcaagcatgatgtgcttctgaagtatctaccatttgcctttagtactgtgatgaagcatattcccatgaaatgaagtgacctttgcagtatacaaagccagtgccttact

SEQ ID NO: 134287 - DNA, 1119 bp, Homo sapiens
gagaatgagggaagctgggtttgattctatgctctgatctttactagctttgatggccttggataacttgtttaacatctctacgcctcagtttcttcatcatgaggattagagataacgtactacaagcacctattaagagtacacaaactggcacagagcagatgttctgtaaaggggagctgctattattactattattattattataaaattcaaagttgaccttatgatgtaaaggttgggatttgttttgttatggtagtaaatagtgtttccctatggacttctttgtactgtttatgtgcaatccaaggaaaacagtggaatagtgtttgcagtaagaaaagatagctctttgttcccttcagcagacaaaaagaagctcattatcgtatcaactagtgactgttggctattgaaatggtttatttgtatgtttttttctgtttctttcctagggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtgagtagacttgctgaatgatgaacacatggaaactttgaaagaggcacagagaaaatcctgctgttcttgctgttttaaagataatatcttaccaaatattatttttatgtgacttctgttggtgtgtttgattttttttcactgaacccttgaatgattcttcttattggtctacaaataacattcttcaggaaacagaattagctaccatgttaaaatggtctacctttacccatgttaatgggtaaaggcttgatttgaaaaggttattcttttactctttttttttctttagcctttaagttatatactagttttaaccctgtaacatattttcctctaagattatgcttaatgggagacagagggatgataatggattttgaaatattaacataatagaaaatattttatgttgtatcatttataagtatacatcagtttccaactttataaaagatacattttgtcagactttaaaatttgctttgggttctcaatattcatctttt

SEQ ID NO: 134288 - DNA, 1013 bp, Homo sapiens
tgccaccacacccagctaatttttgtatttttagtagagatggagtttcaccatgttggccaggccagtcttgaactcctgacctcaatgttccccccacctcagcctcccaaagtgctgggattataggcgtgagccactacacccggcctatacagtttttttcctaaactttcattccctctcatggaaaatattagaagttgtaaagacgctaactaaattttcagaaggtaaatttatggagatttttttgtcatattttgtgaccatactactcttaagcctaaatttttaaactctttacaaaggtaacatctgtattgctagtgcatttctgcctttaggataatacttgctgtggaaaatactgcgagcaatttgaaagaggagatccagctacgtaccttagaaaatgcgggagttcaaagtcaaaatgttttgccaattctaaatagggaagtgaaaacctgtttaacagaattagatgacatgtatgcagctaggcggcaaggaagggatgattggtttttctccgtgttgtttgactaggtgtatatgtttgccatgtctaagttaaacagctggtacaaatgctcaatctgaagtctcactacttgagttggttctaggttacctgacacctgtgaagatttttacaagctttagtcattgttcatgagctgatagacaatgacctttgtaatatacttcaggtaattattaactgcttcaactatgagtttgatggcaatcaagtgggtttgccacccacttgtgtttacctgggtgtcagagttgagggcatctaagaagttagagggcacacagtccacacacaaccacccttatatctgaccccaattgcaagatcaggggtccataaaaccacctatttcctggcaaattatttgccaggaagacttgcagaactcactgaacgctactgtactcatggttatggtttatttttaggaaaggatatagagtaaaatcagccaacaaaaggagtg

SEQ ID NO: 134289 - DNA, 1082 bp, Homo sapiens
aaaaaaaaaaaaaaaagaaagaaattaaataataccaaggtaggcatgtttgattatcaaaaatttgattctctgatataaaagcaatacaatgggaacaacatttagagtttttctatgataggtaagatttttcatgcaactggggatgtatctgtacgagtagatccagtaggcagataatcaaaggacaggttacactgttgaaaataacaacagtaatgtttggcctaaagatcttcatttgtaaaatgaaaataatagcagtacttccttgggtgttttagaggagtaaagatcataaatcatgtatactccttagcacagtgcctggtatcgtgaacgttaactgttgtttattataatcatcttcattatcatcatctaaaacaagcttcaaagttacttaatcaaggcttcgtccctttttaacctagatggggaaaacacagctattttaaccaactgttaaatttatgtagtttacaaagcactctcacatattctgtctcattgattctcactatccctgggaactgcttaaattttttctcaggggaggctttcagggttccgtttttcatagacacagcttggtctttgtcatcacccttaattgttctacctataaaatcaattcagagtaattctaaactttccccactctcaccatggtcttctgtccttccatcttgcattgcatgtccttttttgcccactgcagccattcttcgacctctagtcctttgactcctgtactttctcccaagtgctttttgtttttgtttttgtttttgtttttgacggagtcttgctctgtcgcccaggctggagtgcagtggtgcgatctaggctcactgcaagctccacctcccggattcacgccattctcctgcctcagcctcccgagtagctgggactacaggcgcccgccaccacgcccggctaattttttgtatgtgttagccaggatggtctcgatctcctgacctcgtgatcaggattacaggcgtgattcaccgtgcccggaatttttttttttttttttaaagacagagtttcactctgtggtctaggtggga

SEQ ID NO: 134290 - DNA, 1084 bp, Homo sapiens
atacatatggatttgcacatcagattttgcttatgatttctggaggctcacagatttcacccaggttaagaatcttaaccctacacactgactttggtgatctcatgcactcccaggggaaagctaccatttatatatgccgattattccaaaatcactgtcgcctgtccagatttctctgctagaatcctacagccaactgtataggtccatttggacacttcataggtgtctccaacttaaattctctgcagttggaacgtcatccttgtccttcggtactctgctcctcctcctgagtcccctatcttacagaattgagcaggattccaaaccagaatgtcctaaccgtttagtctgagatgctaagcattatgtttaatttttttcctttccacctatgtataatcagtcataaagttttcttcattgtgtctaaacttttgaaatctcctttttattcacattcccaccctagttcaagtcatcatttcttggtagaaatttagtagcctcctggccagtctcttttctcttgcttgcctctgactcattctgcaccttgcagctggtgagctcccagtggcttcccagtgtctttaagatgaactccagactttctaacatctttttttttgagactgagtctcactctgtcacccaggctggagtacagtggtgcaatctcaactcactgcaacctccacttcccaggttcaagcaattctcctgcctcagcctcccaagtagctgggattacaggcgcacaccaccacacctggctaatttctgtatttttagtagagacagggtttcaccatgttggccaggctggtcttgaactcctgacctcaagtgatctgcccacctcggcctcccaaagtgctgggatttacaggcgtaccatttataaggccctgcatgatctagcatcagcttgcctgtccagccgtctatgaaccatcctgaccattttcttgttttcagctgtgccatgctccctttaacctttttgcctttgcctgctctgttcctgcgctgttcctaccccctttcatccacactggttaactcttactcattc

SEQ ID NO: 134291 - DNA, 1060 bp, Homo sapiens
gttatatttcctgttccagatttgaaaccacattttgcatagcaacagagtttaactgtgtgaaaggctattgacagatgcatgattttataaaacttcctatggactcagtggaattgaaccctggctggagattcattttaggtggaagcattccttcttgtactcccttccttgatccgtgttattgcacttagcttatctcaattgagaatgtttagcccttactttctctttgagcaaatgttagcatctacaatctttatcatctcatctactttataacattaaaaatacatgctttggcgtgctttctaattaatcttcccttttctaaaatacaagtatacaggatgtaaagggtataatttcagatttggggattattttatctatctgtaatggacagtatttaaactattaataaacaatatttactgccgttatatcagttcaaaagtaattggcattctttctaaagatgcggattctgaaaggtaaaataaattaaaaatcactttattttaacacccagcgatgactgtagttgaaatgttggtgtatttccctctggtccccatttaactttgtatattcagttgtatatattcattgatatctataatatatattcatttttggaattatataattctgttcatatgaattatatataatgaatgaattacatttattaactaaagtttacagtttatatataaactgttattcatgctgtattatatagcagtattatgatattccaataattttttttggtacaagtttgacaaaataagaaaaaattaatgatttgaagaaaactaaaatagatgatttctgattatgaaatatgcatgtgcacaatacaaacatttaaatattagaaaaatagatcatgaaaattataagtcctacaattcccctattcccactgttagtctgttaataagcaatttttttaaaatgtatttatgatgagatttttatcgtggaggaatgtggaatagatgttctttgctctaggcttagtcaaatatgcagggacccacaatgtgtt

SEQ ID NO: 134292 - DNA, 1002 bp, Homo sapiens
gctgggactacaggcatgtgtcaccatgcccagataatttttttacttatatggcagtgaggtattgctgtgttgtctaggctggtgtcaaactcctagccttaagcgatcctccctcctcggcctctcaaagtgctgggattgcaggtatgagccagatacctggccattcagttatcctctcaatcatttgaggtgcaagttgattcaagagtagcaaataatttttattagaatctatgtctgcatgttgttacagcatatttctgttagaaaatacacagaccctttagcctcaaatatatagacctcaatcattaatttcagagaggaatatctttaatatataattcaaacttaagtgggaaattttcaaatcagtaagaggggctagttaaaggtccatgaaagagcctaaatgtaagagctaaaactgcaaaaactcttagaagaaaatgtagcagaaagctgcgtggcattgcatttggcaataatttcttggatggtaccaaattgcaccaaaagcacaggcaacaaaagaaaaaatacataagttggattacatcaattaaaaactgtacatcaaaggacaaaaatcaacagagtgaaaagtcaacccatagaagatatttataaatcagatatctggtaagcagttaatatctagactatctgaagatctactataaaaaaaaaacactgaaaatcacacaagtgttggtgaggatgtagagaatcggaacctttgtgtaccgttgatgggaatgtaaaacagtgcagctgctatggaaaatagtatggaggttcctcaaaaaattaaagataaaattagcatatgatacagcagtcccacttctgagaatatatccaaaagaattcaaaataggatcttaaagagatatttgcacaatcatgttcattgtagcattattcacaatagccaagaggtggaagcaacctaatgtcggtagaccaataaatggataaagaaaatatggtgaa

SEQ ID NO: 134293 - DNA, 1040 bp, Homo sapiens
tttttgtaggtaaattttaaacaatatatgttattctgagaaaatagtcatttgatacctgttggccaggtccaatacttttattaaaaaaattttaaagtagcaatagaaatgacattatatatttaatatttaaaaacaacacataggcaaccaacttttcttgttctgacatattttaaatttcatttcttttaggggcttgctttttttgtttttattttcatgccataatttttaagtgcacaaaaccactgaactgctgtaaaatctgcaacaaacttagaaaccaagtctcacaatctccaaagagtttttttgatttatcctagtaatatttactgggattgttttaaatttattttgtaaatttagaaagtctgccagtgattattccccatagtttctttcaggttatattttttaggtaacattctctgtattaggttgtttgctatatcttatccaaggtcttcttcaacaaacatttattattaagtacctactgtgcatgatggatacaaagatgaaacaagaaatgttctttggaaggatctcaaagtagtgataagtaaagcaacatttaaaattataaatagattttttgaaaggaaatgaattatcaagcattgtaaaatatatgctcagaattaggtaggtatacgtatctgtatatgtgtgtatgtatatttgtgcacacacacacccccacatactttggagtgttggtcagatcacaaccttagtgtatattgccaactgtgtgtaacatgagtcaacttctccaggaaaatgtacttgaggccactttaattgtatctcaatatattataggaagctgttgtataaaaaattttgagactcatgtctactttcttttggattacttatgggtgtaacttgggttttattaacttgaatttgaatttttctgttgaaagtagaaaaaagatatatcagttaaatatattttcagctcattaatcttgtcaagttgctattgaaaaatcaaaatttaaagcctgtagacataaaactaa

SEQ ID NO: 134294 - DNA, 1094 bp, Homo sapiens
tgctgttttgttagaggaaacattctattaatggtggcatatttcaagtaaaagcatgtgctttttatttttaaatcgcttatggcaaaaattcattttcagttcaataaagtatgtgtttgtaagctttgtcatctgccccttgactggtagatgtgcaggctaaggagttttaagtgtttggttttgcttttggtagttgtgtgtgtgtatgtgtgtgtgtgtgtgtgcgtttcttttcagaaggggcgggtaatgtcttctgttggaacatgcactccaccctctttgataaggcttgtggtaagatttgcatcactacccatgacagtcatcctcatagcattaagcacacagctcttagctcccataatgatgtgtggagggtggagtgtattgcagccatattcacctttcatttgtgtgtttgatgtggcatttatattaagtaggagtaattttttttctgatttttttttcttgtgtcaccagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactaggtaattgtttttctcattattagctattgcatagtattgcagaagaagactgttttgtcttttagccaaaatatgaatacaactggggatacttgtaaaatgtttaacttcccatagccaaaatcattgtttcagattatatatagttaagaatatgtacatataagtatgtatatatatctgaaactcattcccttctttttttctttcattggagaaaactagtgttttcccaaacgttgtttactaagtctatagctactttaatatgagagcaagaggcttcttttaatgaatcaacaaccctctgtttttagttatgattcctaaaaggtgtatttacttatacaggaggcgacatattctcttatatattcccatttaagaacacagatttctgatagattacttttgaagtatgtaatttttttt

SEQ ID NO: 134295 - DNA, 1050 bp, Homo sapiens
atttgcatttattcattgtacaaatacttaatcaactgcattactgtgtcagtgcaagtcacagaggtatctgtgatgagtacaacagagaagatccttgccctctttaagcttcattgatgttttctgtgatgcttatttccttcctccagcctcctcagcttaaatgctgaggctctttctttgtggtcaattcctgtcaggggtgtatgtttctactggctcgctcttagcttcatagtcaataataaatacatttgaaggaagcttatttgatacactgaaggatttataaatgcttaatgtggaggatgataatagagcaatggacactttctttatgctggcaaaaagttatagctatgtacttcccagccaaatggattgtcactgcattagtcccatgatgatctgtaggaagggtcaagaaaattgagaatttatgttacacattttcttatcctaattattgcattaacagttgggtcttttgtctccaggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgagtttaggctttggcgtgtctttcggttttgtgtttttgtttgcaggagatcattaatggagcagaaactcaaatctagcttttgcattcctaaccctgatctccagtagataatatctctgtgccatagtgtatgaaacactaaaaagtctcttgaaggcttccctcatggatgagtgctatttgatgaaacattttttctaccctgtctgctttttgagagaggattttcacctagaatatttacattaccatttgcttacaagaacatatttcttattgtcataagataattactttttaaaaatggttccctttactgtagaaaagtatgttaaaaaatatatcattccatttacttgtttgctaattatcttcccatttgtctttcaaacttttcatttaac

SEQ ID NO: 134296 - DNA, 1091 bp, Homo sapiens
atatgaatgaaatctcattttaggtacaatttgctgtgccagctgctgaagatgggatgtgggggtgggaggaggcaaagggtgaatctgacacagatcccacttttaaggagctgttggtctaataaggaagatacaaataaaaacctcgtttttgtggtgtatctgtttaaataaataaagagtctcatcctgactgacagtatgttttggttcataatgagtggcaaagggaaaaggaaaaaaattctagaatgtattaataagttgagaaatccttttatgttttgctttaaaggtcacttggtaaccataatataaaattgacaataaatattgcaagagagatacttactgataaagtattattgaaattcaaagaatgctacctccaggtttggggctgaagggttatgttaaaaatttctactattttcggtttctgttttcactacttataataataactgaaaccattctctccatacaggtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggtaagaagataagcttctttctcttagtgacaaacgtgatttgcattccagtattttagaacatcagagagaggtaattcttcagacatttgttgatgaaggtccaatagccatcagaacttgtagtggttatggctcctcaacaacctacttcatattcgtcttttttttttgagacagagtcttgctctgtcacccaggctggagtgaagtggtgctctcttggctcactgcaacctccgcctcccgggttcaagtgattcttctgcctcagcctcctgagtagctgggactacaggcacatgccaccatgcctggctaatttttgtatttttagtagagacagggtttcaccatattggccaggctggtctcgaactcctgacctcatgatcaggtcaggacgcctgcctt

SEQ ID NO: 134297 - DNA, 1740 bp, Homo sapiens
ctgctgtggatcaatatccaaatatttctgagtttttatctgaaaagagcactggagttgacatcataagaccattatttgagtaggatctgttcttttttcctacttttatgaccttgaccttggatctactcttttttttctactcaggtcgggtggcatctgtaagtgtgtttccaaggctataaaatgggatgataatatttgccataaaccattcatagggttattgaaaagctggaataaaatgtattttaaaaaccacaaaaaatttaaaatgctgcatgtgaaataagcatcagagtgggtggttcttgacaataactaaattggctatttcttttattcttttagcatggatgtttttggcaacctctttcttcacagagagtccaaatatacacttcatggcaaattatatttaccacatattctatgtgaaataaaatacgaaacacagaaaaagttctaagactatacatgtttgttgcagcattatttatatctgaaaacaatataaatctctaacagtaagagaatggttacatgtattttaaatcactcataaaatgaaattatgtagctgagtaaatatgaagcatttataatgatacttctatgtatattaatgaaaagcttatagtgatttgtttatataatactatttcatatatgtgaaaatgcttagaaaaaatacataccattacactgaaatatcactttttttctgagtgctaagagtttgtaaattttttctaaaatatgcatacatttatcttaaaaattgccacagattctaaatagattaagttttagggtgcagcatagcatttggaaaacttaattatgtttaaaccagaatcatttaaagtatgattttaaaatttatattatatgataagcatgtataactctgggtgtatatgagaatatgtggattatatttcctcatttgagatggaatggcctcatgcaaccatcatttataaatagtagaattttaagtctgcaaatggtgaaaaaagagtggctttcttcagtaggatattaaatatgatctttgttctctctgcttcaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggtaagtacttcaaatgccgtttcctattttagggataaaaataccaataaaaatattttgtaaaacattctctatatttaattcacactatatgcaactgagtaatttagaattaaccccatagcactgactcataaatgaggttaatctagggtaagtcagggaggacggcttcttggcatggacaagatcatttcagatccacctagctagagcagtactggttaatagtcctaagttcaccctattcttgctgcccctctctctgtagttagatagatttgaattgactttttaaactagcttctagccttttcctgaaatggggctcaaagacaaaatatcctgtttcccaggtcctagtgcctacctgtctttctctatccaccactgccccaaacattactgctgtcaaccctggttaa

SEQ ID NO: 134298 - DNA, 1036 bp, Homo sapiens
tctatctcaaaatgggtaatattgaatactaagcattatacattgaaataacaagtcattttccaggagcatattttatccagttaaatctaaaataagtgtattaataaataagctagatttttttttttttctttttgagacggagtcttgctttgtcacccagactgcagtgcagtggcatggtcttggctctgcaacctctacctcccaggttcaagcagttctccctcagcctcccaaatagctgggattacatgcatgtgccaccactcctggctaatttttgtatttttagtagagatggggttttaccatgttggccaggccggtcttgaactcctgtcctcaggtgatctgcctgcctcggccttccaaaatgctgggattacaggtgtgagcctccatgcccagcctagattttttttttcttttcaatagcaagaattccaaatgatttagctgacctatttggcactgattttctctttttctggcaacatcagctaaattctggacattttcttaatgtctaaactaattctaactggttattttcttaatggaatttgatcatgattattgtatctcttttgtgactaaagcatttagaagagtgttactgttttttaagtcactgatcaaaagcagagtaaaaaataactgttttccacccttcagttttctctgtaggaatggtgaggatatttaatgaagaagttccccgtaaacgttgacagaatagaaatgttccctttgggcacattcccatttcgactactactaaccataggttctggttgatacaccctgtcttcctgcttcatgaagtaatgtcatggtcagattgacactttttttaaaaagagtagtttgtttatggtttggttaagaaaaaaagcattatgtgcttagcagtatcaatgtgttcttttaccttctatggttatttaaaagtggaggcttatggagtaacgtgttcttgttgtttcatttaaccttgatatagaaaaaaacaacaacaacaaataaaatg

SEQ ID NO: 134299 - DNA, 2535 bp, Homo sapiens
tctaggcttcgggagcaagttctgcttgaacctagccgacggttatggaaacccattgacattccaaaacaatatatacacataactatgtatttgtgtgtgtgggtgtgtgtatatatgtatatgtatgtgtgtatatatgtatatgtatatacacacacacacataaatcagccaaaatcagagaaaaggaacagggatttaataccttttttatgcttatttttgtcaaacatgtactcctttcatacgggtggcttttacaaggcaacttccgtcatttaatgttttcaactgtaattgtcttaatggaaatgttaaaattcatatctgattaacatttttaataacttagaggagattttaactttatttaaaaataggtaaaattattgtacctaattatgtctaaagtttattcaggggtaatttccctgatgtctgtataaaatcaagatcttattttactgatgcataagtcctagtgggtcaagactaggcatatgctttcagataaataaggaattactccaatcagttttccccaatcaaagaagccatgtcattttacttttagaaacatacaattgggcccaatatgggaattttcataatagttcatacatttgtcagccaacattaaaaggtaaccaactcctcaggtatttgtagtttaccctaacgcttctttaaaagaaagtaggtaaaaaaagaaaagggtagataatctttcgtatgcaaacttttcccttatattttgtctttctttcctttttgactttagtagcatcctccacacatttgtgtgcctgatttgaaaggaagctggggcacccagcgagtttagcctttaagtttctgtgtattgatttgcagattaagtaatgctgggaggaataaagaagggacagaaacatggaacataaagcattgaaaattccggtgcttgggcttcggcttcagagtaacgtcagtggcttagggttaaacggccattttattcaaatgcttgctatacaatctgaaaacacactggcaggtgctcctctccttggcaattcattgagtatccagagttctacgatgtttaactgaagaattggctaatgttttgatcctccagtgtgactgttgtttttgtttgggggtgggtttggggttttttgcttttttattcctgaagcttaccagatatgaatggctaatactccattgttctgcttgttgtaatggtgaatgctttaagaaaaaaaagtgtaatttgctaagaataattcatgatctgtttatgcgataactcctttttgttacaatttttttaaaaaaagctatttttgttaatgtaaagtaaatatttcagagcaaattttttaaacttattgcactaaatacaggctctgtacaaaaaaaaaaaaaaaaaaaaagcctcagcattttatcattccatggaaggagaatcttttgaaagaaagcattgcctcctaccagaactagacagtgaattagatcggtattatggaaatgcatacaagtaatgtcactagggcttaataagcagccgtttgctaatgtgcttcctttcaaagggttggacctttaaattgctgcaaaaggtaaattgtatttttttttaagtattggtgttctttactctagctaggctaaaatttgctaaatgccttggtttcttttaaaagttcatgtaatatttctgatttttcagaatatttgcaataagagtctggattttaaaaaacacatgcatacacacaattaagagctcatgtcttagcaagatctgggaaaccaacattgcgagagtagctattttgaaagaataattctccagaagttaacatctaatatctagtatcaccaaacagtatcgctgttctcttttattcatttgaaatgaatataattatataactaacaattgtccaaatagatgagagagcaaatcatgtgagaaaattcagaataccatctgtttcatagccgcacagattttggactttcacaaacattgggaactaaatttagaattggcaaaagtctagaagatgggtatcaaaacagaagacattccaggagctagcaattttaagaggtgtccctccaaagtgacctgatggaagtcctgaacttggaaattaggttctactcacttggacatccctgcatcatggactgttgctgctccctgttccatatgctcgcaatctcagctatttggaagctaccaggaatgctttctaattatcatttgcaactagaactgtaatcagaaagaaattttgtatttttgtataacttgattgtgtgccattttatataacaggtcctgttttacaaataaattttgttttactaacattgtgtttagaaattataatctatgtgtaaccatgtcatttgagttgcaaattaattgccaggctgttttccttaagtaaattcatgtgccgtgtagaaatatgcagatatgcattacacaggcacacacagagagatatttaatatgtggaatatcac

SEQ ID NO: 134300 - DNA, 3703 bp, Homo sapiens
tttctaagctcctgcctgaagaataaggtcttccataatatggaagagaaaagttatatttcagtgtaaatccaagagacccatcttctatgagaggcttaccagtgcattagtaataaaacattagcaatttagctagagcactgagattgtataatccttgcatggatgagcagagctcaaagccagttgttcctttaaagcatttaatgcaatggctaatgtttaggattaaagtttttattttatcctataagataattaagtcctaagtcactacaacttaagtagcttaactgtatgttggtacccaaactttttctataatggttaaggaggaggcacttactgagtttattttaaagttatgctagaaatgtttttcttttgtagagatgctctctctctctctctctttttttttttttttttttttttttttccgtgagggcattaggctgctgattgtaagttatttccaataccactgatcttggtatctgccaagggcttccttgccttccctgggcagttttaggatttcaccctagtagggggtatgaggcactgacccctttattctggacccaaactgctttagagcagagttaatacctctccctccctcttcaaaacagctacaggaactgcaggcaccacatatgtgtgaggccacatcactgcccctgaggcttcaactatttccaccatgcactattactagctactaacagccattttaagagatctcctagcctgcaaggtagaattctgggatcagttccaaaaccagaactgccagtaatggtgacttgaatattttatttgatttttggtcagtaaccttgtcatttaaattggactttccaatagccttaacatggcctctgagaagtttcctccagaaaggtctttaagctttcgcttttcaataagtaagttctttactgcttttctactgctactttaaaaaaaaaacaacaacaacaaataaaactctcagagtctggaggcttatcagtgcacctgccacagttaatttctgtattcttttcatacattccatctgacacatacgagtgcactataatggcttgcctagaactggtaagaagtggtctgtgaatgtatattgaaaaaatgtgggttcataagtaaaagcgtaacgcagatatttgtgtattctgtattcacagcgtaggctgccttttgctttaaatgcatattcatgtatctttgtgtgctaagaatgcatgttagcccttttgaaaagtaggcactattcatacacagtagcttcttggaattaactcatctttgttaacttagtggcacatagtccaaatttttaaaaagcaagacccttgaatatgccaagagaaaatctaaagctagcaaacttaaaaaacaaaacaaaaattacacgtcgtgtacagttatgaatttagaatagcacactttttccattcagatttcatacatttgagccaaattcttatactccatgttttaattttaaaaggataattttaatccaagatttaaatctttgaaaatatctttcttatagaaaactttaatgcagtttttaaacttactgatttctgtggaaaacctttcttttctatagaaatactgtagtgccctttcttcccatcttgattttgtacatgtaaagacaaatgatgattcagtttcaatattgcatgaacaattgccactttgtaaattatatggacagaatgtgttctaaggaaattcgttagtaaatttgtgaaaaacatgtgagattgttcgagacctattaggctattcttcagttttgatgctcagttttacaacttaaatgattttctccaggacacggagctcagaataataaagcttttattaatggtctagtgaagatctagttgaacatggaaacattgtaatttacaaatgtctcagaaatttctcacttttatttgctaagacctgaatttaatatttgatattcaaaaacaagttattttgaagagacaatgggtctctttgagcttaagaaagctatggactatctttccttcaaatgcacatcacatgtctgtgaacactcaaaatgctcatagaatttcagggccctcagacggccagcttccacccctgtaccccctcaggggctaatgaacccaagtcaaaaggctgctctaaagttgttctgataatgtgttttgaaatgaggaagtgattaggcctccactagagatacttttgagatgatgcttaccaccttctgacctggaatcatttttataacttaaagactttatgtaatttagtagcaggttagggaatagaaaccacactaatctgaaggaataacaagatgatcaacactgaatcttcatgacagtaagattttctttccttggaggtatgagggtgtgtatgtgtgtgtgtgtgtgtgtgtgtttgtgtgtgtgtgtgtgtgtcctggcggttatttgggggcaaggtaccagattatttgcagtgagccaaaaaaaaaaaaatatccaagaagaaataaatagggaatccttgtaattaatccatctaccaaaacacttgattctttttattgtagctcagctatgacattatgacattatgtggcttagtgttatcagtatactactgtcttaaaatatatttgtcaacatgtccagttccaacaacagttgaagatgatgataaattagcaaactcaagggtagtccatagttggcaaaaaataaatttggtagaaagttggaggagcagatgctgaaggtagaaatgcaaaagatgttttttcttcctgcataaatcacggaggtgtgttctgttttagtgttttccagtcacccactagagcagcttcagattcctctgccaatagaactccacccccagtcccttacctactctatcttctttagggaagcatgtggatttcttcacatctgcaccttactattaggtaagggtgctgcatctacatggaaggctccctgggcccttgaaaaagcaggcagaaactcatcaaggggtttgaagttcttgtgaaatttgatcccagtggctcatgacttatagtcaggcatcaaaccatttcctactttttcaggctgaagaaagtggaaatataactggctggtgaagaaaggagaaaagtcagccccctaccccaccccacactcctagaaaagtttgggggttttttttgtttgtttttggtgtttttttgagacggagtctcgctctatcgccagcttagagtgcagtggctcaatcttagctcactgcaacctccacctcccaggttcaagtgattctcctgcatcagcctcctgagtagctgggaccacaggcatgtgccaccacacccagctaatttttgtatttttagtagagacggggtttcaccacgttggccaggccaatctcgaactcctgacctcaggtgatccacccgcctcagcctcccaaagtgctgggattacaggcatgagccaccgcgcccggcctagaagagttttaatgaaccttccacagtagtaaatgcagagaccactggtggaaattcccatgttggatagaaaagggcgtaagtccagtctaagtatctaaatgtgatatgcccttttgtcacagaagtgtaagacttaaagggaatattctgaccttcgtgtatgaatct

SEQ ID NO: 134301 - DNA, 1199 bp, Homo sapiens
agctcctagaataataaggcggccaaatttaaagatcagtcaatacagtagggacctgctattgatctctcaggcactgagtcttcacatccagtgtcaagcccagcccagcatatggggtgatatgagcagaaaacacacatcggtgtgtcttgatttctcgcagctgtgtaatgtggcatgagaagtatgttttggtgccacatatttctcaatctgatgcctttttgtctttttttttttttgccatttgcatcctatttcatagtgccaaaatgaatttttgtatcttgtcttgtctttgtccattataaactggaggatcacagttaagccttccatgaattcatagtttggaatcatttaccttaccattattttggatttttttcttattacagtgtcactacactgtattcatgtgggggaacaaacatgtaggtgcttgaacatgccccacagacacagttgtagccctagtatttgtgacggtcattattgacacagtgcagactttgcagatggagcattatgctctcagaggactttaaaaatatgtatattaagcaattaactttctggagttggagttatcaaatcttgctgggaaattaacttccaagagctctgaattggatggaattccatctggcttcagagaacaatcagcctatatgaaacggagctttgaaatgtttttcttgtgcagaaatacgaactagaaagaaaagtgctgatctaatgctaagttttctctgtgtactgactcagttgccagaattataatgaaaactgtattttagtctaacaaatgtatagaattttttatgtaataaataaaattttataggaaagaatgttattgtctactgtgttgtaacacttccccatgcccagggtggtgactgataaaatcatgggcaacatcttcgtttcaaattaggtcagtatgctgcaagggtgccccagaatttcccagctgttcctttctgtctctcgcagcatgttctgggggcttcggaatagcaactataaatgtacctaaaccaatttctgaagtacaaagttcatccactgccaggccaggcttcatagctggagtctgagttgccgcgtgaatgctaagattgcaactgaactcaatcatcaggcagagtagaaaagcctccactgggccgggcgtggtggctcacgcctgt

SEQ ID NO: 134302 - DNA, 1045 bp, Homo sapiens
acccacatatggctcttaaattgggatttggggatgctaagctggggaagtcccagcatgtaatttcctgatgctttcactgaagttgttacctcataccttatttagatctgtttctactatgagttacacgacatggttcttgggtgtaaataaaacagaaagataagtcttcatttatttcggatacattcactgagttctacattagctaagaataccagaataagagacccagcctctgctctctgaaaactcacaccatatttaggaagcaaaggagtaagcagatgattgtaatctagtgtgccagccactctaacagagttaactcaggagtagcagggagacccacctgaaggtgggagggccagggaggtggggctgtaataagcaaataagcctttggggaaagggaagtagagagtgttccaaggaggaatagcgtgtgtgaagaaatgatgatgtgtctgtgaatctgtactgaagtgtaggtgtggggacatgaaattggagcggtcagtagggatcagatctcgagggtcttgcaggccaccctaacggtcttgattttatgctgcagaaaatgaggacttgctgaaagattttaaccaaaggaatgtttggagatatttgcctttcaggggaaaaattaccctgacaacagtggggagtatggcatggggtgagttgcttctgggccaggaaaacaaagtgaagagaccattgtaaatataccatgtgattcagaatgagaattccaactagggcactagcaataagaatggagagaaaaggcaggagaatcgcttgaacctgggaggcggaggttgcagtgagctaagattgtgccactgcactccagcctgggtgacagagcaggactcatctcaaaaaaaaaaaaaaaaaaaaaagaatggagagaaagggatatatttaaaagctaatggagggatagaatcatcaaaaacggatgattggttggtgtaaggggccaagtgaaagaaagacaggagtgaagcgtgaatctccaggtcctggtttg

SEQ ID NO: 134303 - DNA, 1973 bp, Homo sapiens
gaaaaaaacttttgttggatatattgtatgtaaatataaaagggacaacagtttttacttgttttttattattttgtgtgaccatgcagccccaagtaaatagctgagttccctttctaaacttgtgcttgcataaaaaaaaaagacaaaagagataccttatatataggtttaagttggtagcatgtatgaaatcatcatggagaaagaccccattgctagaagtatttctctggtctctttgtgtctgaatttctgccattacaactttctttggagtaaaggtttatagaattgcagcctagttgtatttgttagcaggcaaactctgagaattccttgccctatagaggcatatagagaaaacttggaacaacgattatgaagtagtgaaagagatctctgaagaaaaattagagagtaaatttgacatgtacaagaaaaccatgaaggaagttgtcccatgaaggagattggttgctctagttgatgagtatcagactgaatgaaagtggaggtgtgttttgataatcttaaggtaagaataaaacatttatagtcacctggaatttgttcgaagtgttaaattttcctcctaaaaggtgatttttgtggggtctggattttctactataattctaacatcacatgaaagcttatgtgaactatacacataaattttctatagtttgtgttttggtgaatatgaactaatctgttgcagggtttatatcctaacttttcttgcatgtcactgccattgaaacttgcatgaaaagcactaacttgccttctttctcttctccctgattggctccaaggctgccagacagatcaaggataggtatggtataaaacacatttttacttaagtataaatattgaagtcagaaatgaaattcagaaatagttttttaattaaaattgtgttagttaagataaaagtacccaatgaccaagtacaaaataaaatgtcctctgtgtattttcttggaataaccattgtatcaataaaattttttaaaagcatagttgtggataattatgtgcttcagaagaatttcatttctggtgtagaaatatagttagttttagttttagaacagttcttaattagttgtactaatgaaaagggaactattttgaataacttaaaaatatatatttctggaatgtgttttttgttgttaaatttaaatgtaagtgggtcttattttctttgaactcactcattttaagtagtcctcaagaactaaagcgctcctatttcactgccctcctgtttaacaccttgtattctcattccatcctgttcctggtgccatctctttctatttctaatgccaccactatctagttaatattctgtgggaagagaaaattaaagaaaattattaaaggttttggtttaaaagttctttcttattggtagagccaggcttaagaaaaggaatttagtacttgtaatgaacatagattgctaaaggagttgctggcaacatttggattgcattaacacagaaggaacagtttggatctgcctgtctagtcactgagtattgtctgtattgagattatagcaagttttttcatctgagggtcatgagattctctgaaaggcacagctcttcaaagtgccactccaaatcctagattaaattattcttcatcagataattcacaaaaattttcattatagattatgtgaaaaacagtgcctctattgttaatcttggctgacagttttacttctgggtttctcttttttttttttttttgaggcagagtcttgctctagcacccaggctggagtgcagtggtgcgatcttgtcacactgcaacctctgcctcatgggctcaagtgatcctccacctcatcctcctgaataggtgggactacaggcatgtgccaccacacccagctaatttttgtattttttgtagaaacagggtcttgctattttgcccaggct

SEQ ID NO: 134304 - DNA, 2391 bp, Homo sapiens
gtgagccactgcgcccgaccacatatcactctttttttttttttttttttttgagacagagtcctgctctgtcgcccagactggtgtgcagtggcgcgatctcagctaactgcaagctccgcctccccggttcactccattctcctgcctcagcctcccgagtagctgggactacaggcgcccgccaccacgcctggctaattttttgtatttttagtagagaccgggtttcaccgtgttagtcagggtggtctgtatctcctgaccttgtgatccgcccacctgggccttccaaagtgctgggattacaggtgtgagccactgcgcctggcccacataccactcttttaacaaattcatactcttcctgaatacagagacacggttcttaatgcctgaaggctcatactcttacttttgggaatagaatcctttactgtacatgtctgaaaaccatgttttcgtttcttcaggcttaaaatttgattcaaagtatatgaatttcagagtgcgagcttgtaacaaggctgtggctggagagtattctgatccagtgactctagagaccaaaggtgagatcagtagctctttatacagcataaaacaaagcttaacatctgaagttattcataactttgtaacaggaagcacttcatgtgatgttgaattacttctctacttctcctagcctagctttctcaacagtaagaattttaagggaaaataggactacagtagtggttttcattgggttttcttatatgattttatttatacagataaaatagactgagatgatggtattgtattctctgggagatgcttaatttataaatttcaatcttgttataaataggtaagtatcactgagatttgcccagagttttcccatagaatggattatgaatcaatattggggaagtatctgtttagttcaggtcctctctgttttcctgtatcttattgcaacagttaacgtttatatagtttattaatggttacaaaacactttcaattctttattagataattaaagtcatcttgagagatcaatatgctagatattattgatacccatattgcagatgaaaaaatagagttttcatatattaaatgactttcccatgatccctagacctagtttggaaaggtgtgaataagaatccacttctgagttttgtgccagcccttactatgagcctggaacctaggttcttctagtctctgaaagcaattggggtttaatgaaaactccctagagtagcagacttgaatacagaggattttttagatatttaccaatttgaaggttataatgctggagactttcctagttgtgagatggttattgactgggtttaattccagaaccagactctacacattcttgtaggcacttgggacttaaggcattccactgacctctagttcatatagcatttgaataggtttacctgccagaaatttgattggatttggaggatgacaaaaaaaatcatataataaaacaaaatataaggcctataagttattgatgagacaaactcagaaaaatgtttgcatcacaaaggtctgaaataaagtctatcttgaagtaatttgtttggattagcagatgtttctatttgagaactataggtaacttagccaaggaatgcagttaactctgtattacatgttatcaaactgagatgttattgtggtttctgtagaggtttttaccattttaaaataatagtcatatgtaggcagataatcttttctatataacttgaactgtttttagcccatcaagtaaaattcattactattattcttcctcaagagcatcatatttttaaaatttcttttgtttcttttcatttactgttcatatttaatgaccaaagttggacctaaatgtggtgaattataatttctatgcaaatttcatagatacaggaaaatgaatcactggcttgtggttttcttccagctgggctggctgctcctattagcagtgattggatgttactggtcaaactcttaatcatggggtttgtagagagaaactaagttgattctaggccttttcagcacttcttcactgttgagtaaaccctctgcggtaggaatagactgaaactcaactctgagacccacaaaacagtgattctgaccttcagggagttccagaataaagttagactcctacatggccatgagtcacagattttctagggttattccatagcattagtggggctactaatgagagtaagagctgcagaggaaaagtccacatttttaccaatgacacactgaacagttgtttaccaatttatttggcttgttgcagcctttttcaaccaaccagtagaaattagggtatggacaaaaaactggagagaa

SEQ ID NO: 134305 - DNA, 1030 bp, Homo sapiens
acacagtgctgggtaggacaaaacataattgtttttcattatctcagattaaaggcatcacaatcacactggtggactttccactcaaagtgactgcctgtatattgaataaatctttgcaagaaatttctcccaattgaagcctaattactttggggagttttcagattgtcttattattattgatacttttaaaactctacttcagcttacgtagtgttcccacatctttatatataagccgggaggggggatagtaaggaagaaaacctctgaagcgttttatattcaagaatagtactaaacgtaaaggtaaagttagagcaggtactcagcatttaatgtctgtgtgttaacatgattattcttataggaaaagtacttgaataaaaatttttgtgtctttttttgggacgagtggtaggtaaaactgtgtgactcataaggaagagatgagtcaaatctacctttctgatcttttgtaggagacactgctattgaaagtggacaacattattgggaggtcaaggcccagaaggattgtaaatcctacagtgtgggagtagcatacaaaacgttggggaaatttgaccaattgggaaagacaaacactagttggtgtatccatgtcaacaactggctacaaaacacatttgcagcaaagcataataataaagtcaaagctttggatgttactgttcctgaaaaaataggtgtattttgtgattttgatgggggtaagtttattttctcgtaggttatttcatcatagttgcttgcatttcagtacctttcactggtaatcatctatacaggatttccattagtattgtgggaaggacattttgatcaggtaggcttttgattgcaatcataatctcaattctagaattgactggaatggtatatgtgatgtctgcctggagccctataaaagcactcatttataatatactaagtctgaaagattttgctaattttagtcttcagcactaacatttcttctgtccattttaattccttccttacc

SEQ ID NO: 134306 - DNA, 1056 bp, Homo sapiens
acactgataataattatgctgatttttagcatctcttataggaatcaaagtttattaaagttacatagaggattgaaaaatgtatatcactcaatttttatctaagaaggataggttataaagggaggtacctaaatactcaaataatgtatatattctttttcataacatatggaatgctttaagcaattgttttgaaaaaaatctgcgtatctttgacttaattggcacatgactttttcaagcagccattcattcagaggtttgttttctctcagtccttttgctacattcactttcttttcaaagaaatgttaattattacaaaaattgacatagatatctttcccaaacttggggtaaaacccatggttatgtggaacataactgttcttaaaaagtcaattataatttgtaactcacatcctttgagctaaactaaattaaaattacagtatttaataattctttgggcatttttaagaggtctgaatttgtatttttcttcatttttgaaactttacatttgttgactttttttcattctcatttaaaatatattgtgctatgataaccaaccttcttccaaggagtgaccattactgcctacatttgcgttgctttctacatagagacttgtataatagtattaatagtagctcattctctctaaaaatttactgcccactgataggatgttttgtttccttgataaaacaaatgtaaatgaggaattttatttgaattggaatattgtttttctagaggacattcatatctgcactattatctgatgacatgttggtaattttaaagactgcaaggcagtttagagaatgaagtaaaccaatagatactcttttgattctccaaagaaatataattttggtttttgttcctcagagagagtttgaaagaaattttcagatgttctgttccctatagagggcctattccaggatctaaatgaatgggaatttataattcctttcatagactcaaacctgaaagcagaaatttttagtagttgagttgctttaagtgaattttaacaaa

SEQ ID NO: 134307 - DNA, 1585 bp, Homo sapiens
ctggagtattataagagatcatgaatgtttccttaattatcatggcaagattacctcacgttcagtatagtttagttttgtgtgtatcttacagtatgcatgttctgaaattatttgtgatcctgatatgtcacatataatagctttgttacctggagtatttgattaacctaaacagtttaagcattttgaattagttggagtttaaatggattacatttggtgtatattgtcttcattgaaaagatattgttggatatgccacatcagagttagcattgacttataaataaataccagaatttaccagagtacacttttctcttcagatgactcaattattaaataaaagaatatttcttatttctgggtcaatataaggtactgacttctgatgcataatcacttaagctatgtgagtttaaactggtatcttttcttagtggtacccattcaatgtaagctggtccatgggaatggacatgaagaggatttcacagtatgtagagcagaaggcacgtgaatgtgtttgctttggcttggagcttattaagttttgactacggttaaaataagtcaaatagtaagtggtaaaacacatttttgttagtattggaactttctggagaacataagggctatgagaatgcatatatatattttttaacatttcctatatatctaaggtaccaaagcactgagtctaatttacctattaagggagactctttaaaatcaactttataactaattcatactataagacagataatagctaaagttttggaataatttatattaaaagccgcaagtcttaaaaatccctggatatgacataaaaaggattttggcttcttttttgaagtatttaaaattaatcaccttagctctaccatatactagatctgtgaccgctacacaaattgtttatcatctttgggtctctattgccttctttataaaataagtgtaagttgttcagcctgcctcacagggctgttgtgaggaaataaaatgaaatggagtatgtgaaattgcttcagcaacagcaaagtgctacgtaaatgtaaagtgttgtttttagctaataatggatttaagtgtttggataattgtagatgcatttactttgataaagcgtgtgcttaaagtggtatcaccagtgatttctaacatgattttaaaaaaataaaaccccaattaaaatgttctttaatattcatttaatttgtgcatgacttgtggcctttttgtattttctcaagcctattactctagagctgtaaaagctcttgcacagcattgttgtgtcagtgtagaatagtggcataaataaatgaattaagctacatttccatgcaggcatttgcactttgaagttagggctgcccagtgccacatgcaaagagtgtatttggtctaaacagttctttccaaacaaccaaatggctgggcagcttgttgtcacggataaatgatataaaatgtaaccactgaacatttgacaactttgttgcattatcatttttaaaaaaagatgaagcatttcaaaatcttgttaacctggttatctcttggtatctct

SEQ ID NO: 134308 - DNA, 1009 bp, Homo sapiens
tcctggctcagacccccaagtagctgggactacaggtacatgccaccacaccttggcaaatttttgtttgtattttttgtagagacaggttgcccaggctggtctcaaactcctgagctcaagtgatccacctgcctcagcctcccaaagcgctgggattacaggggtgagctatggtgcccaacctataaagagagtctttggctatatctttcctgctacatactttgtatttttgctgctttcctttattctcccaccactaccttctgcccatcaccctcattaaaaaatgttcttacagagcagattagcacaaaaatatggctcaagttcaatataagaatcactttagttttgctactagtatttggctttaaatattcaatgtttaagtgttgtttcttgatgtttgatgcttctttggttctaggaaggctggtttcggatagctgagaatatgggatttcagtgcctaaagattgagagtaaagatccccggctagacgggatagactcactctctggaactgaaatccccctgcactatatctgcaaactggccactcatgcgatccacttggtagtctttcatgagaggagtggcaactacctctggcacggccacttgagacttaaagaacacattgacaggaaatttgttcccttccgaaagttacagtttggtcgttatccaggagcttttgacaggtaagttcagagtcaaaacgtgaaatgtgaaatgagtgttgttcagtcataattcttgcagtgtttttacatttgagtattgaaatctaatatataatttatataagtatttacagtaacattattcttaatgactccaaattagaagccacccaaatgtccttcaacaataaaaggattggctgggcactgtggctcatgcatgtaatcccagcactttgggaggccgaggtgggcagatcacctgaggtcaggagttcgagaccagcctggccaacatggtgaaacctcgtctcta

SEQ ID NO: 134309 - DNA, 1902 bp, Homo sapiens
ctatttatgtatgtggctatgaggaatgccactttacttaagtacttattgattgttatgagagacttatttcctgatagttttatttggattattaaaggaaataatatttctttggttcttttccttttttagtcagaaagctgctctggaataggatatttctattttttttctgcagtgataattaccataagtcatttactctgagttatcatcaattgtaagaaacattattttagatgcagttaagaaattaaatgatatgttactgatgcatcccaatttcagaggtgccttaacttgaaaaaatgtgcatcttagaatgaatactctatgtatgtaaaacttaagaatctgtttctttatttttattttttaaaaaaaggtttttaaaaatgtatttcctttgtttcagtgtgtgaaggttttcatcttccccataggtagaagacagcttggaactatccttccagggaaaagatgatgtaaaacttgatgtttttttcttctatgaagaaactgatcacatgtggaatggaggcactcaggccaaaacaggaaaaaaattcaagtatgaatcaaataagtacttatttataaaggtactacagaaataatttcaggaggtagaaataaagaagtaactgaaaagaaaaccaaaaatctctttcaagactccattattagctaacactttcttagcttacccatagagtccagttatgcctgtgaagtaagaatacctgtaaggacggtttgtgaggaggaagtgtccctgggtttgtcagtccaagttgatgatacagctggtctattctcagttctgagagagagaatgagaatgagaacctgaagagcatgggttttagagtcaggctgacctgggaaaccttagctccaccctaatttgtggcctttagattttctgaacgtaatcattttatccattacattgagtaatactactgtgtgtcaggcactattctgaacgttttacatatattaacccatctagtcctcaaaataaccttcagaggtagatattctgaagccagtgtgattgctgttgaatctcagctctttattttaccagctatattaccttgagcaagttatttaacctctctgcctaagtttcctcagctgtaaaatggaaattatagtagaaattgccacatagagtggttttaaggattaaaagaattaatacacaaaaagagctttgaggtgtgtcaggaggtcctgggtgctaagtaattattacctgctgttactaatactactatagtagtagtagtagtagtagtagtagtagtagtagtagtagtagtaaagaaaactatttctcttcttattctcatgagaaatttacagattagagacatgtataattatctcaatattaaactgttacatctattcttagagaacttctgtaagagtgtcaccttttttctaagaaagataatttctagagccagtattagagtcctgttattcttaaattactttctaaggcttgaattttttctctcactgacatgatccgaaacctgcaaacctcaaaagaactgttcatttccaactactacatttctggagagaaaaagcttctttcattctgctttaacagctctttatagtagcagtgtttgggaagtgtgaagtgttctgattatttaacaagagaaatgagcagtgatagaactgtctggacagatggtgtgagtcccagattttctatcatgttactgtgaccttaaaaggcagagaaaagaacaggagatggctgagtagagtagtttctttggaagattcccccagccatatgccatttttattcttttcggcactatttactttaagaaaatgtagtatttttaacactactattccttg

SEQ ID NO: 134310 - DNA, 1056 bp, Homo sapiens
ctgctatgtgctaaggatactgatgtgactgtaacttagtttctgctcttaaggatctcatgatctagaccatgagacatgttaaagtactctgatagcagtactgtaatcaaatatgtataatctatagttgaagtaccaaatcagccatatctagaaacaatggcaaagaagtgtggcttacaagtagagaaatttgttaggtagacttaggagaaatgtgggaaaagtcctaaaaatagatttatttaatgatttttaaattagtttatttctattttttaatttaaaaaattctgtgggcatctgtatacgtaaagtaaaaactttaaggggttgtttccttcaatagatacccaaaggtagaattattaagtcaaaagatatgagccttttaaagagttttgatacatattgccaggttgcattcctaaaaagttatgcaaaattttatacagtcaccaacataaatgagcatgcttagtttgctatatcatactgagtgttgcattgtactcacagtcattcatgactcccctgatagtttctttgagtaacttttcttttcactttcttcttattatcccaaggtatcttctatcataaaaccaggtcagtcattagtagcaagttaccaacaattattacctttctggccaggcacagtggctcatgcctttaatcccagcacttcgggaggccaaggtgagagaactgcttgagcacgggagtttgagaccagcttgggcaacagaataaaccctggctttatataaaaattttttaaaaattacccaggcatggtggcatgtgtctgtggtcccaactacatgggaggctgagacggtaggatcacctgagcccaggaaatctaggctgcagtgagccacatttgcaccactgtactccagcctaggtgacagagcaaaaccaaaaaaaaaaaaaaaaaagaaaaagaatcattacttttctcttaactattcctaacatcaactggcttttagtatacatctaaccccctccctgtcgtcccagtctccctttcaaaatccagct

SEQ ID NO: 134311 - DNA, 1094 bp, Homo sapiens
agtgatttttggtgaataaaaagttattttaatgtagttcagtttatctattatgggtagtattatcgtgtcctgtttaagaaatctttccctatcccaagataatgaagctattcctcttgtactaccttctagaaactttattgttctatatgtaatatgaagtaaagatcaaatttagactctatactttatttggattcactagcttttctaccaatgtgctttttctgttctaagatctaatccaggataccacattgcatttagacactctaccttttgaaactttattttggtccaagattttaagcttgtcactagtaatactagattatcatacatcactgcatgtcccacttctgctcattcaagggccttacgttgctgtctgtttgaactagcttcttggtaccttgatctggaaataatcttctcttcctctgcatttctatagattttctttttctttccctctctcatgctttattggagtacttttgctgatttgtctgtcctttctatgtgatagataaaatcaggcctggtacatgtttggctaagtgagacctgagccctacatgaaactaagtcagatcctcttaagtgtagtctacactgttttgttaagatgataaggtgacactgggttgatgacttgatccaacctaacgtggttggagaattaaaactatagaattaagttagcctagttgttttcaatcattctgcttcacaagaagttaaaagactagaggtatttgttgaatcctcactcattgtctctctcagcttcacagattgatactgtgctcctacagttgtaactccaagaaacacatttgtctttttagtacttacagctgtgaagctaaaggcaaatttgaataatttctttaaatgagtgtatttaaaacattgacttttctatgaatgatctcgtattttctgctctgtttatgcgtttatattttacaacatacagattatgtcttaggtctccttaattatacctccaaaccgctagtaagtagcaggtgcaaaattgaggaattgagggaagaactttgaatgcatgttatatgggaattgta

SEQ ID NO: 134312 - DNA, 1036 bp, Homo sapiens
aatgcaataacatggatgaatttctaaaacatgatgctaagtgaaagaagtcagataggaagagtatatactgtgtacttgctgttatttgaaattgcacaggaaaaaccaaccaacagtgtaataagattagtggttgcctaggaccagggtgggttgattgcttgactgacaaggggcacagggaactttggacgaggggttggtagaaatgttctatatcttgattattgtggttacacaggtatatacatttatcaaaactcatcacttaagatagatgcatttcattatacttaacttatacctcaaaagaagttaccttaaaagtttaagactgggcacagtaacccatcagcatttggggaagacccggtgagaggatcacttgagcccaggagttcaagataagcctgggcaacatagggagaccccatgtctacaaaaaaataaaaactaaacttaaaaaaggttaaaaagataaaaaacagtttgtgacttagaaaactgatgctaagagaaaaagggtctgagatcacaggttgaaacagagggatatatgggaccaaaagcaatgaatttggtcagggcagacctaattgcaatgataaactttgagactttcacatatgattaaacaaattgtgtaatctgatagtaaagccttttgtattgagtatgaaaattgaaactataatttaattcttttaaaaattatccattatatacaaggagaaatcctgtaaaagtctgaaggaaagcaagcacaactggagtctaactggttgttgaagtgctattagatctagttctgggaagttatgtggttatgtagagctatagagtttttggaagttatgtagttatgtcccaaggctttgtcctctggcattgaggaaaactttagtacttgttttaaattgatagtttttaatgtagtcattatgtgtatgtatatatacatgctgctctaaagacacatgcacacatatgtttattgtggcactattcacaatagcaaagacttggaaccaac

SEQ ID NO: 134313 - DNA, 2165 bp, Homo sapiens
gtagctgggacgacaggagtgtgccaccacacccagctaatttctttgtatttttagtagagatggggtttcgtcatgttggccgggctggtctcgaacttctggcctcaagtgatctacctgcctcagcctcccaaagagctgggattacaggcgggagccaccacgaccggcctggtttaatttctaaaacttacctactaatcgacttagttctgcaataaatatagttacaatcattataactagtattccttgggctggtttaaagatgttctttagcatttgagatgaaaggcagaaaccacaggtaggatcatgtaagctatggaaccaaaggaaaagcctggaaatgcaacttggagtcctgcttactctgtatccttggaaaatccagattgtgaaagaaaagaaaaagatcattttcatccatcttttgacagctttctactttgacacttctttcctctacagttccaacagaaagcccaaggctgactttgatttgcctgacttgggtatgttcccatccctgcctcaatcattaacttactggcctgagtcttagtgatggggtcagcctctcctcaatcctatgagcttggaacaggaaaggaaaattggagaagaggaaagggattctggacagtcaaaaataattaaatatccactctcttcccaaagctgtgtaatgggagagcactgtccttcagccaataatgcactagcagctagattccttagctagaccttcttccactgttgaagcctaatccctctgttttgctgcagatacctgtttccgaagtttacactgtgctggactgagtttgtagacatgaaggtccatgtaccctgtgaaaccctcgaatacattgaagccaactatggtaagacctggaagattcctgtaaagacgtgggactggaagcgctctcctcccaatgtgcaacccaatggaatctggcctatttctgagtgggatgaggttatccagttatattgagatagtaggttgaaatgggagaatttctcttttggaaaaaaaggtagataactgtttaaaaaatacatgtctatttgtcaaacataagtgggaaccaaagaaaaaatgtgacaagtttgaagacacagaaagagtcatctgatgtaattctctcacttagtactgaggaattttcatgtgccacatacaatgctaggttacagtggagaagcctagatgaatgagacaaatacctacttcttttattcctccttttggtaaacaactcaattttcctttgagggaaccctcccccaccctttgaagagttcaagttctgtacaggtttttaaaacgtgaagtaatgtttgaactggaagatgagctcaccaggcaaagctaaggaaggatatactagttgaaaagaataacccactcctcttctgggcatttaagctggtatgttagtgctacttttaagattgtggagtctgagttaatattcaagtgatcagactttgagtgacatcaagaaaagatgatatcaggttcatttttcaactaatcttatgtggaattgaattagagaacaaggcattattcttttagggaaggtgagagcttatttgtatcagagcttattacttgtcaggataagtaaatttctgtacatgtactgttttcatatgtgaagtgagaagaaactttatgcttgtttaatgcttaaatttccatccattgtgagaatattttcactgacctctgatggcacttgttgacaaatcattcaagtgagaccatgttactagacatgatcttgaaagaggccatgatttcacaaaactcatttttattttattctcagacagtctgttaggtaaaaatatgagaaattcatgtacattttatattttctgaatttataatctgtgcactcccaattttaatgacactaaaatattaatagaattttttaaatatactctaatttttaaaacatactctttattatcttcatttatcaattacagcttcgtatctctaatttatggtctatataccaatttaaatggcatgtaaacctgcctgtttcttctcctcttctaatatatcagatctccaaaatggaagctaaatggtggacttgacaactattcaccctacctcagatcatagagtt

SEQ ID NO: 134314 - DNA, 2030 bp, Homo sapiens
acattagtgaactggggaaatgatacatacttctaagggtttttagggggattaaatgaagtatacagttcttagcctcaggcctaggattaagtaagtactcaagaaatgtgcaattttctagttccatgtttcttttctaatcttcaaatggaattatagaaaccatgggtcagaacatattcctttactcaaaagattgcatgactgaatttgcttaagaaaaaaaaaattgtatcaagtcattaatacaattatacattaattatattacattaatacaatatatggtttgtgaattcagagacattaccagtttgcctccttctctcaatagaacttgtattttcattttcttggttaagcagttgtctcctaatattatcccatatgctacctagtttgctggtcccaagcagtttactgtacttcactagatttggtacctgctctcccctggacttctttttcaatattctagcctttcctagatgtaaatctttacctccttgttagtgaaattagatataagccatgatttggagagggaagaaatctggaatacttaatttcatttaattatctatgctgatgaatgcctgtatcattgttaataaaggagaattgaaaatactcatttctactttctgccctcaaatttctgtttctatctcaactaggcaagaatcagcagggtgcatgatgccattttaagctgcttcacatcagactgaaatcctaattacagttcataagtgaaacagactaattcaatggcaataccttttgtataggtcctgtgcttaaaggaggcaagtataaattttctaataagaaatccctgcttcttttgggtgcagtggctcacacctgtaataccagcagtttgagaagctaaggcaggtggatcacttgaggccaggagttcgagaccagcctggccaacatagtgaaaccccgtctcttctaaaaatacaaaaaaattagctgggcatggtggtgcacgcctatagtcccagctacacaggaggctgaggcaggagaatcacttgaacccgggaagcagagtctgcagtgagccaagatcgcggcattgcacttcagcctgggcgatagagcaagactctgtctcagaaaaaaaaaaaaaggaaagaaagaaatctctgcttccgtactatcaaaacttctaccctagaataccccctggcaccttctaacccaacctaatacagagattttgtagggacccattaacaagctcctatataattataagcagctctcacagtagggttgaaagagaatataaggaaaattagaagtactgtatttttgctattggaaatgaaatattgtttcatgcacctttgaaaaaaataacaggattttacagccttctgatgattcattcaaagcatggggaatagttcatatgtttgttaaatgaaaatcttatgtagctatttgtgtgtccctcccacttcataactacaaaaacatatatatgaatttctaaacaaagtgatattttaaagatgaattgattcaatgtgtacttaccagtttactgtgtggttttatcttcaggtacagatagtttgtggtactacttgaaaatacctttaatattattttcatcagaatttgtaatatataatccagtttgggatgatgaataaaatttttctaatctcttgagatatcttgtatttatttttgagacttgcagtagaaataacagacactaacattcacagacaatctgataaaatagtaatcttgccaccagtacagtatttctaaaattcaactatggggaccctagtagtctgcacacatatacctgggtatccaaaagttctcagagataaaacctgccagccaaagaccaccaggaacacacctgtaatcaaacaaagttaggtttattagcttgttgtagtaagaggaaacagccaccatggggaatcataacatatttcagggagaaggaactagaaaggtcttttataggctttgagctgatgtca

SEQ ID NO: 134315 - DNA, 1040 bp, Homo sapiens
ccccttttcacagtcacgacggacactgtacaagcaagagttacctggcgtagtttcactatctgcagaatggggatatagtcttgaaacagcattttgagttcttttagcaatgcgatcaagggacagtagttgtattttattggattttacaccagggtgcgtttgctctaatactgctttacttttgtagttattctactgtgcttttagttgtatggacctcttctttctttgaggtcagacatttctttgcctactttctttgtgttcttgctgtctttcatctgccttgccctacggatagttgatgagtgaggtctggaggatgatgctgtatctttcttatggactacttactggttttaaaaaatccttagacctcagaaatatttttcatttatgttgaagtttgtagctcagtttaaatcgttggtacaaattttgacctggatgaggatggtattactgcattaaagtagaacacattatctgcataagatattatttctttgatttgaaaaaagtaagttttgttgctactacatgttcagaatttgattaaaaaaatttttttttgtataggctgaatcagatgttcacattgtggtccagggacccatgggattctctgacactgccagtttaaaattactttcgtaataatatgcagatgttatctttttcactctcattttttcagaagtgtacagtggagttttccagaggctacctgagttgtgatactgtaacagaaggaagtagatatgagaatctaacagttttctatttgaagccagacatttgttagaatgtacacagtgtgattcttctcactaaatgttttttgttttggaaaagttatttttcataaagaatacattatcattattattattattatttttgagacggagtctctctgtcgcccaggctgaagtgcagtggcgcgatctcggctcagtgctgcaacctgtgcctcctgggtttaagcgattctcctgcctcagcctccggagtagctgggaggcgcctgccac

SEQ ID NO: 134316 - DNA, 1186 bp, Homo sapiens
taaaaaatctcataatatttttacttttccatgaaaaaatctattaatttttttctcctatgtcactattgggatttgtgcattttaagaaggggtttctcaggcctaaggttataaaaatactcgtccttgatctttttttaaaaaattctatagttctataaaagtataggttcgtaatctatctgcagtattttttgttgtatagatgttcctttgcaagtctggtcatggctggatagaacagttggaactcaatgatctcagcagagtatgctctatgctcattgaactggttctgctctagacctttactaagatcatcccacgtgcatagacctctggaatgtccttagttcttgtttgttttctttagcgtcccattttttttttttctgtgagctactgaagtccttccaatgaattctttatggcttaagtttgttggtttttgctgcttgtagccaagaacccgggttccatttctttttctagcctcttatatattaaagagtgttttgttgaatactaatgatagtgagtgactttgtcttactcctgatattcctgaatttaatgagaatgcttttaaagttttctcaagagtgatgtttgctataggtttttatgagggacactttaaggaagttttactttattcccaactttctaggatatccctatatctttacaccatcctggtggagaaggtgacatattttatcaagtgctatttttttttcaaaatctattgagatcatattgtgtttcccatttaaaaatgtaatgtagtgaattacattattacgttttttaaaaaatgatgaatcatccttatattcttggactaaactacttgatacattattttaattcattagggattttgatttggcagtacttcatgtaaaatttttgcatttatgtttataatagaaatgagcctattaggttattttattgtgtgaccctcagtttgggcccaaggttatgctgtttttgtaaaatagattgggaagctttccattttttaagcttggaatggtttatttaataggcattgcttgttctttgatatttggtagacttcaactatgtagttttatgtttcttggtatattttaatgggtaaatcttattttttttccaatccagacctaagtcattttggtaatttatgtctctc

SEQ ID NO: 134317 - DNA, 2562 bp, Homo sapiens
tgagttggatgctatttggctggcagcagccgttttcatcatgtgagaagaaaagtgaagcaaagtcaccttccaatggcgttgggtcattggcctcaaagccggtagatgttgcctcagataatgttaaaaagaaacatactaagaagaatgaataaatttacgtgatgagctctacaaggccaaaaattttttttcttatctacctgttatattgtgctaatttttctatgtatgtgatgtgaaatgaagactatatatatggaatggaggtgacagaaagaaagaaattctttgtttgagggagacttcccctttctggattgtatttgtagagtgttacgagtgtatcatgtgattatgctttaccggtataagagattctgttgtgattatttgaatagttttatattaataaaagaagacaaaattttttaaatgttagaaaaagcagatctgtcattgcaaagtaacaaaaattttaagcttttaaaaatgtagatttttcatatttttaaaatttgaatctatttgagctttagttcagcagaattaaatttttacttgacattatcattaaaattgctaggtatggagaacaattcctattttattttgaacactgagaagagtaaacttttcctaaaacactttatattataaatgaaaataaattgctagtttatattttagatataaacatcatattttttattaatacctacatcaaatggaaaatatctgaaattttttttccatagcaggtattttctactagaagtagttttactacttttcatttagaacagagtatgagtcttaatctgaagtctttttcatgcccttgttttaaaaaaactactttttttggcctcaaaaaaatcaagggtgtaatttttaataaattgttaatcctatgttttgtaattttcattttaggagcttgacttatttttttctctctcataaaaacacatttgttttaattgtaggagaaattttctcagcattttgcatgttctttctaatctttgttggtctgaatatattggtagtaattactgtaattattcaacaaaaagcatatccgttcaaaaatttttccactatgtcttttttctagtggctactgttttagttttctagttgaatatctctgacaagctttcgtatggttttgttatattttcatctacatgtaatgtgttattaattttattaaatgaaaactaatcaccttcatgtggaaatgctctgagaattgtccttaggcatttggtagtaaccagctaaccaagaagaaacagagaaaccagaacttcatatggcagtccatttagatgaagaatgatgatataaaatctggttccttcttagcaaaataaaaaacaaacaagaaaagatactaaatgatgttaattttcttactttatgatttagaagtccagttataatattaaaactctgtgacatagtttcttttaccaaaaccatgaacctactccccgtatcaggtattttcgatggtttagaagtactcaagtcacatcacattcaagttagaagttttttttttgttgttgttattttaaatttttaacaaatataaacaccagcagatactattacttgcttaaaaaattgggagggggcacttttcatagtcttggaatgctaagaagttttatttttaatattgtgacagaaagctttaagtatttaagagctctgtattatatttgatactcttacagttaaaaacttttcaaaattaatacattgttaattattgaccagttttgaagtttgggtttaactgtagttgaaatggaaggactcttgttttacacttgtattaaagataaatttattaaaataagttatttagcaccaatggagtattacattatttttatgttttatatttttcttgaggtagagtttcagaactcatctagtattttgactaatatagtatatattcagtgattactgttcaaatgggacattggtagaaactttattaatctatgcaagtatcctataaccctcaattcaaggctcttttgtaaaaaatgtactggagaacatggcttaggcctgaaacccatcctgaatctattcaggtcacctgtagagtcttgacttggatttgcaaagcagattgttagactccttacccaatgtgaagtgtgaataaggcctataggcctgcctcacacagctaatcagaggtggcactgagaaagtcaagtcctaataggtctccttaaaaaaaaaaaggagacaaaaagctggcaagaacatgagccagcttccctcagtgctgtcactctcaagtaaaacatggccaaatgaatatcaaactggtttatcagattagtcactcttccttactgagggagtatcaagtaagggctggagagagaccagatatgtggagttgttggctttcagtggaaatggtagcctccctgtgggtagagaccaaaaggtagagagatgacagaagggagactctgattagtgtattttttttttgtctattccttaaagcccaga

SEQ ID NO: 134318 - DNA, 1026 bp, Homo sapiens
agcttttgagctactttttcctctcctgaaaatgggagagaatatgaatacccacctgaaagggagggtgggaagaccaaatgacataattcataattgatgtagaagtgccttgtagcttgtaatggatgtaaaaaagccctctccaaatcttcattgccttgtgagttgtatttgcaacttcagcagataccagataaatttagaaattgcccctgcaatagacatatgttgccaccaggtggcaggagaaacctgtgatgcaatcaacgaggacaaacattctcagagagaattaataaaataaattctgattgttagaagcagccaactctttagtgtttattaaataaacaacaaagcttatttataaatcacagaaacccggaatacgccaaatatgaattctctaatagagggtgtttcaaacagtttttaggctctggtgctcattttccagccgaaaccttacatagaaccccaagtatagaaagtagataaaagtggcagaactttttctgaagtagggcagggacactgggagttaattcactcatcttccttctttgtccttgagccacctctgccaaacctcaggtcttcatgggacagagttctaaaccactgttctaataactgtataatgccctttaaaaatattcctttgtcattgtaaaaaatgcatgttgcttaaaaatatatagaattttagatagagtttatataaaatataagttataaatgtatataaatgtatgtaaatataaaattataaaatttgggccaggcttgatggctcatgcctataatcccagcactttgggaggccgaggtgagaggatcccctgaggttaggagttcgagaccagcgtggctaacatggtgaaaccctgtctctactgaaaaatacaaaatattagccgggcatagtagcgggtgcctgtaatcccagctactcgggagagtgaggcagaagaatcccgtgaacccgggaggtagaggttgctgtgagccaagactgcgcca

SEQ ID NO: 134319 - DNA, 1026 bp, Homo sapiens
aaataaaaacaagaaaaaaaaaaagcccattccccttatgtttaacctctttcaattattttcactggagagttaaagcgtttgtgacttctaaaaagtcgaaaagattacgtgtatggcatcattaattgaatttgtatcgcccccacattcaagaagcaagagagttttgcgatagttcgcttcacagcttcaggaagtcaatttgcttctaaaccagaagaccgagtgtgtcttctcaagaccatcgtgtggtgccgtatttttgatggaaagttaaccattgtacctttcccccatgcacccacaccagaagcctgaaagccaccatctccccgtcggtctctggatctcctcgctgcctttgtcccttctagacgtggaggcttggagaggaggtttggtttccaaggattggagcgctgtgaagggcggggccattccaagtccatctcccctttttgtcctcttctcccgggacgggagggtggagccaagtccccccgcggccggttcgggagctttctctatctcggtcgctcgaggtgagtgtgaaagggcggcagcccgtttaattgcagcgcaggttaatttcttgagttcaccgcagtcggtccgccagccgcttccccggtctttgccaagtgggtttacgaggtctgaggcgtgttggggcgcgctcacgttctcgcaaaaggctcctccccagggctcaattccccgactgcgggaagccctttggtgccccaggagccttggaaacccaaggtttcctctgacctcgtcgctcctttctccctccccaccgcctggttccctacgtccctgcccccagggaaggacggcccccatcttaggacttacgacccaagccaacccagaaggtaccttcacgtcgatgaagattttatcgcagcctccaaaacccagcagtaataggagctttcaacctgaaatacgattgttattttcccggtgcagagcttgacagaaaaagtcagctttttattaaagacaaagaggtaa

SEQ ID NO: 134320 - DNA, 6093 bp, Homo sapiens
aagggggagtcctcccaaagccgcacaaagccgggatcatttcaatccggaacagcctcagcgtcctcctcctctctcctttcttctttctcttctcggtgactcccgttcccctttcgcctctgtcctttctgcgccttgttctcgtctccttacttctcttccctctcctcgcctttcctctccctccccctcctttcttctccaccgcacgcgtagagtgtcatttatttatttatttatcacccccgccatcaacacccttttagggatcccgagcttttcaatgtgagtgggaggagaaaagggcaggaagtgttgactggaagtgggtgaaatcgtgcctcggggtgagagattctgctcaggaatatagggtcgggaaaatcttggaaaatgaggatttagatctgtttatgaagccccgctatcggatgggaaccaactccgcgcgcgtctcctcctcttcctttattgtatggatttataggtatatatcttctcggactgttgcttggggggagggaggagaaagggcgagtatttaaagaggacagacttgcccaggatccttaacaccgcgccttcaccggatgcgcgctcctcaatgcaaaggaatccagcaacatccccaattcagacgcggacaaaagaaactttaattaaggtctctttctgccccgcgcgctgcgcgtttctctctcctgaggctgttgatgtccaactccaagatccaagaaatagaaatggtacaatcagcccatgcccttgaacttcaattgctcctgacttgctgcattgatttttttgatactgtagaacccccatccccaacccccaccgctcccagtccaattaaaaccgtaggagactttcgacctggtggtggagggggggaaccactcctttgcaaaagagatagttcagaatgatacgggagagattacactaaataaaaattcaaggtgtgaaagcttcatcttggctcgcgtgtcttcaacaccatgacaccttatcattaagagcgctgattgttactttccgagcctttagatgatcagccagaaagtgcaaacaacgcggggctggagggtgtaaagttatttaagcaggcgttctttttttcttttggtgcgcagtcaaaacatttcacaagttaggaaaagaaagtggtggttccgaagctcggaatgatgggctcttttcctcctccacccccccaccttccatatcaggaaagaaataaaacgcacaatgagcctttatttcaggagagaagacttcaaaatacgtgccagtaatggacaatttgagcttttcactggaaatactcacaccgcaagctggaaagggattaaaaagccccacgtggttgatctgggtttatacttgcaacctccagttccccacgtatgttctttgcaaaggttggcctctagatggatgcaagtaagggaccctctggggctcgggctcggcgcctcgggcagggctgacgttgggagcgctatgagctgccgggcagggtcctcaccgggggcttcctctgcgggccagggctgccgggcgccaccgggacgcgagcgcgcacgcctcggcccggcggccgcgctcctcgcaccgccttctccgcaggtctttattcatcatctcatctccctcttccccttctccttctcctttgcctccttctcctttgcctccttctcctcctcttcctccccctcctccaccaccacctcctcctcctctgccgccgccacctcctcctcttgcatctcactggcctggctctgagtgacaaagacaatgtcccagccttaactttgcaaccaccttgcctccttctggggttcagcaggggggagggggaacagcagcagcagcctcagcatctcctccagcttctccttctgctcttctcgagctcttggataattcttcctcttttttcccctagcctttttcctcatttctttctttctttctttttttccttcctctctgctgcacgttgttgttgttattagaaaggcttcgcgcaccccctggtgctccggcgttttgtgtggcaggagaagattgtcttccttctctctttctgtcttgctttctctctccccctggttgctcattattcagagagagacacagagggagggagagagagagagcgcgcgagggagagggaggagaggagagagaagaggagagagaggggagagagagagtgagagggagagggagggagggagagagagagagagggagagagacggatatctcaggtcatctgcagctgcagcgagtctgaggagccgaggaaggcagggaagatggcgatcctccattgctgagacccggcagaagcacatgagactcccaaacaacttccacaacaataacccgagcaggaagaggagaaagagaaagaggataaggaggcggtggggctggagaacccgaagcacctcccggcgccgggacgcttcttctgtaagttactgcaattaacaaccacctcggggtggtccgagtgctccggggaagagagcgcggggtggtggaggcacaaacgcgctcattcattcggccaaggagggttggaggagcggggaggagaggaagtcccctgcatggactggctgttggaagaggagaagaagcgagagagaagaggaggagggggaggagggagagcaggagggggaggaggaagaggaggaggagaagcgagggaggaagaggaggaggaggaagaggaggagaaggtggtagtggtggcagtggaggtggctgtgcttttcctgctggctgctgctcctgctggggggagtgagcgcggtggcttaattaatttcgtgtagttctatgaagagaagagaaaatgaaagatgagtgagaagagagctggaggcttaggacggatgctccgagtgtggggacaggagtagggacagaggggggcggagggcgggaggccggagacctgagccgagagccagagggagcgagcgagggtcagaggagggagagctccgtgcgagcggccccgacctgagcgggttgacctctttctttctctgtccctctccttcctttcccccttctgtctgcctgtcccccgcccgatggcaaagccgtgcggattggcagcccccctcttcctcaggtatttggctctctctctctctctctctctctctctctctctctctctctctctctctctctctctctctctctctctccctctccccgaagttgggatgcggggtcgggatgtgtcggggggtggctgctgcagctgctggtgccggtgctgctggtgaacagagaggcgaggagcggggggcaccggccgggtggggggcgcaggttcaggagcggctgaggagctgtctccaggctggaggttcagaagcgtctggtggaggaggacaacggtttctggagaggagaagccattacacacgcttggctctcctctgaggaagggagaaaggaaggcaggggcctgggggggcgtctcactcctggtgcagttcccaggggtctgccctccttccaggcacgaggggaagccgcagccgccccccattggagcagcccctctttccctttctttatctccctgtcctccatttgcaagctgtctgctttggttccagtccagactccaaaacacaaagctccttctcacgttcattctccaggctgttcaccattcctgaaggaaccctcgttttcttttcattgtggcttctaacctacagagagggagggagggaggctgcctggagttccttttatattcctccccaaccaagaaaaaaaaaagtttcatttttaagcacgcgtctgggatggggaaagaccaaccagttggggctttctcccagggctcccgggggctgtgtctgagtgtctgtgttggctgtttggtttgctttggttttgtttctggaggttgcttgcaggtttttggaggaagtgactagtttggttaagagctgggaactgagtcaggtaagccgtgtcatgttgtaactccaccagaaaatggaggagagcgggtttccaggagacaaagctgagatgagaagtgtttataaaattatggatgtctccattttgaagctctgttggtgatggctggaggaggaggaggcttgcttgcctactccttctctctttccagagggaaaccttgtggtggttcctcactgtctattcattatgcaaggaaatgagggcttttaagggttcctcagatttttctccaccaaagagtgctttcacaagttattgaggcgtttgtttccattttaaagtaaacttttggaattttttttctccttttgagtggacctgaagggttttgacctccttcaggaaaggcaaggcaaaaaccttaaaacagttccactgaggtcttcacacaactttaagctgctccaggtctcctgaaagtcaccaggaaatgtgatttcctccttgtgaagatggtgatggccctaagctgagatttttttgagttctagggtttggttatcatcatgttttgatgcattgcaagactttattgtctgatttgagttgatttctgcaaatataaaaaataataagaataatcctgcaagatctcagaggaactctaagactggctaacaccagtttctccaggttctccatttctcttcaggtcgttccatttgtatgttaggccttctttcagtttctttgtttcccctttccctttccgtcggctaattttttctgtgttctgaagtactcttaagtcttcagaaatatcagtatgtcttcttaacaatgtcgctatggaaacaaattttaaaaacatgatgtcagttgagaaaaccttatgtccaggtatcttcacctttttaattgggaggaatttattaatcatgtaggaagacattttgtgaggataatttgaaaaaaggacccagtgctaccctagtccacacacattgatgggagctcttcacatattagttttagagaatgtacataattgacccaagcaaagaactaaatcccgaaatgcttcaggaatttttaaaagccaaccatgaagatgttgcttttccattaggtgaggtagccatcttgaggatgagggaagatgttggaagaattttagatgaactgttgaagataggtgaggagggctccacggtggaatgaaaacttggaggagattcagaaccagttaatatattctaaggaggctaattggaccttgctttcaactaagaagaaatatagaaaggtaccagcttcaacagaaataaggaacacattggtgagcaacttacaacagcatttttcttgctttgctttctcattatgtgtcagatttttttgtgtaaagttccttatgtctaaaatatttttgtacatattgaagtggttttagattccagatgtaattatattctgttgagtagctggtagcactgtcactcagtaaatgcacagtgctgtatatgacaacatcacatttttcaaaccaaactgttgtgtcattaattgagggttattgttcttctgaggggtgtgaaaggagaggggaaatacatggttctttagctgataattgtccatggtcaatgaagtaaaaccatgtttgtgcagacaaaaatgtatggtttcagttgacgtgtatgcttatttaaaaatacttctgttagatctctgctcctttatgaaaaacctaggcctctccaagagcacttaaaaaaaatcctacttggaatcataacttttattattcatttttgaacattatcttttgataccattacttttgctcttaagtgaaatttcgccaatattatatttaaatttgctaatgcataaatggatgcaccaaactgggtgtccaaactgggaagttcagttgcaatggataaagagttatttggaaaagtaattaccagataattttacatctaattaaccatgtatgtttatgtaaacataagtacattatatattgatcttgaaacaaactttcatgatatctttttttattgttattgatagcaggacaattggttcatt

SEQ ID NO: 134321 - DNA, 4055 bp, Homo sapiens
attccccgaggaattgttttttcccccttactctttggagttggagacaacttttagagaaaaaaaaaaaaacaaacttatctgctcttcctaatgaatcttccggaagacagcagaagaaaaaaaatccaactctactaatggactttagagtacttgtggtcggttttcctgaaagaaaggaatggtaaagttgcaatgggaaagagtccttttttctgtgtgatggagtttaatagggtctagtctgtcttaaattattccttgatgttgcaattacttggttaaggtaaccttacttatcttctttatggtatgtgcctttttcagacttacacttcactgcatcatgaaattgacaaaactgtatcagatattctaaattgataattggagaacagagatgctgtttcataatgccgcagtcacaaataggagatacataatggactcttactgctaaggatctaacatgaatgtatgactgggatgattggtatattcagcagaagtggagggagactatttccatgactgaaagctaaaatccagtgaactgaaaaaaaaaaaaaatcagtgtgtgtaaaagcaagtatcttgtgagtttcacatacttatggagtatgatggctttgagagaaacattagctaggtgttggtgacctattaattgattatgagaaaacagagaggagagtagataatgctagaagaaaattcctctccttgtgtgatatgccaagacatctggcagatgttatgttgggccctaaggaatggacagtttaattttagcccttgcaaggaaatgggaagttctaagctcttttaatagcacaagtcttagtttggggaaggttgcttacaaaaataagaaagaaaggaaaagaggcacttagtgttatgtggaagaactctagggagtagggagtgaaaactgaagtttcggggtgaggagcaaaaatattatttctcatgcagaaattaccaaaattattttaaaagtgacaaatatgtacactgtaagtaaggactattagttatttaatattcaccaggcagaacttccaacttagaagctagttgttttaggccctagatcatttagatgaagtctcctccttccacttgcattatactgaagaggaaactggcacaaagacatgaagtgacttgcacaaggtcagaaagttcagttgtaaccgagccaggcctagaactcaggtcggccgactccagcctagtgccctttccactaccccattgcatttgattgttgagggttgtgaaatagctgctctcttctccagggcccacagctttctgagaaactctgtactcatacactagtgggcaggagtatggatttttcttagttggatttaacacgttggggagcccagggttgagcgtggtttcattcatagatccagagcccaattttgttcatgtgacattcagtaaagtgttagctcccgggtttgtagctgtacttttcttttcatctttcctgctctcatctctcattccatcatccaagggcttgggagcccttctcaaatgcccttctttggaagtttgtgtgagtctattgcaacttacaatagtgcccacaattggactctgaggatctattttgcaacgtggtgcagatttaaattggctcctttcagagatgccattttgtaatactgatgaatggctgagagggtgaaatccagtctgaaacaattactggtggttttccaatgttcttactcattcaaaatgtgccctccgtgtatcttcttggagcccaactctcttgcagactaatggctaaccttttcccattttcccagtatacatgaaatcatccttaagatgacttttaacaacacagacatttaaccatgagcaatgggacagtcctgtaaggaagggtgcaatgggtttccacttctgtctcttcttggatgagcaaaagtgattttgtaaagaagaagagtgatgtttggaagtttccacattttctaagctccttccaaacgaatgcatcaatttttaatccaggaggcagtctggagaaggtagtgctggatgtggacttctggcagaaacacagttaacgctgtaaacagttgaacctcagtgtggcactcctccaaatgagttgactgtcgaaaataaaatgttccagaagaactgggagaacaggaaagaagttaaaacagcatggtttgcatgccagtactaaaggaagaaaaaaaagtttgggttgggagggcattggagagaagataattgtaagttgaactgtctcttggatttataagacccaggagaagtttccaaatgtgggaaaatgggtttttatgaatttagattgtatttgcagtatgctaggaagctcttttggattttttttttccccttgaactttgcatttggagaactgcacacactgataaaagggaaatccattggaagcaatttggatttacattttgtgcttggaaatgctatcataaaatttatcttttttctaagtcctcctattctcatcagctgaagcacgtacaggatttttaaagtgtttggatgtgtgattccaacacaaagttaattattttcacggcttagaaggacaaaggatagagtggtgtggtgtgaggaggtgctagtattgtcacctacaaatgcattgccttttacttctggtgagcacattacttggtgtcttcaaagcattcttgcctaattcctagctggagacattttttcttgagttattcttggagggaaggttttttttgtgtgccaggtcatgggtattttggtattgatttccttgctttcatgtgtttgcttgttcagttcactgcatgttgcttctggatattaataaaatacttgtgctgcgcctgtccacatcttacccccaaccttattcaaagagtagaccctgttctttagggtgaaaggaagtttgacaggtacttatttgttcaaaaaataaatacttgaagatgagaactgtgtaattcaggaagttatttgctagaccttcacatagacaaattttaacaaagaccacaccaggaaaaatggagaaaattctactaggaaccaatagatcctgattagaatgttttaggatcacttagtaggaaattaagcatttgcccaagatgaggaagcgaagtcttacctttgggttcagcttggttggagcacaaaaggagctgtaggcccaggtgagacaactgtgtcagaagtaataaagcccaggatttgtggagagagcttagccgccacagagcccagctggggaaggccaaactcactcttaagttctcgtctgagcagttgaaccagaacacacgctaaggcctccaaattttggaattcttctttttcctgttcagatttaagaaggtaatgccattattcttcagttttgctcatgtcagctgagtgtttctcttttgaactgggaaatgccagaggctggggggtgggagccgatgtcctctaagggaaaattctccccgttaacactgcaaatgtgccttaacattgtacttattcctccaaaaataattgttcagtggcacaatgtgggatacttgaaagatgtttgctgcacaaaggttccaatacttacctgcagattaagaaatgagtttctaaaccatctcatttctattgctaatgaaaagctttggaaggcacctgtgaattagagctccagctgctatcatggtagggaagttaggccttgaaaggatacgtggattagcctgtcagaaaagcaaacagtagcatcagcacaagtagaaaatagacaaggttgttaaagctaacaggaaagtaggctaaagcattgctgtaattttatagtggaaatttgctgggaaggagtgactggttggatgggagaaggaaaagaagagaagcaggaaaataattgactagccaaattgaagaagtctgtccactggggaagatcctacaggaagaagtaaggcattgcttttaagaaagcgattatagcaagtagaaaaagaccttgt

SEQ ID NO: 134322 - DNA, 1143 bp, Homo sapiens
ggccagttcctattgtaaaaaatagaattgggtttggaggacaatttatgtgactttggggttacaattacagcctttctgataaaggacagatggaaactcaagggaactggttaagtaggcctaggtggagattttcctggaaaacgaacgaagtagagaatagagcacagcagaaaacagctgcattattaatggacagaaaatgtgatagtcctctctgaagtgatccatagagcttctctacctacaccctgggtgttagaagaaatgaagaacaaagacatgccttttcagaggggaaaggaatggactatgactactacctggcgtcagtttgggtttcagccattgacttgagccaagcgtcacaggctggtctgtccttccagtcccagcattttaaaatccaaaataaggccactgtggtccagaatgtttagccattctaatccctaattacatcatccctctgtgttatgactaattagtcagcaattgagcaccaatcattcaacccagattgccatgggcctgatggagggtccttcgtttggggtacaatttgaatgctgggttatagctgaagatgaccaaagatagataccagctacaagtacttatcacccagaatcttttctcttcagtggtttctatcttaaatagtcttctctgaagactaattagtatttgataacaataagtgagaagggagtctttgtagaagagaccattttcttttttcttttctttttggagacagttttgctctgtctcccaggctggagtgcagtggcacgatctccacttaagcaactgctgcctcccaggttcaagcaattctcctgactcagcctcccaagtagctgggactacaggcacaagccaccatgcccagctaatttcttgtattttagtagagacggggtttcactgtgttgtccaggctggtctcgaactcctgagctcaggcaatctgcctgcctcggccttccaaagtgctacgactacaggcatgagccaccatgcccggcctcagaaaagaccattttaatttaaatatcggagttcagttgcaagaacttcccccctttctgctgtcaattgaatattgtctgttctaatactgggtaagaacaatag

SEQ ID NO: 134323 - DNA, 1117 bp, Homo sapiens
gctgtcttccctcgtggactgactcatagttaatactggacaacggtttttatttttttttaacatttaatatgaaccagggactgttcatacggtagaggaaactgaggtttagggaggtaaagtaatttagccaaagtcatgaggctgcaaagtgggggagccaggattcacatggagtggggactgcctccagaggcctggctctcagctgatgggacccggccttggttattacttagtctgctaatagcttatgttcttgatggtttatctcttccagttgcttatgccaggagtatatccttggagttctagaaggaaatctgagaataatggaaaattaattgtaatatattatttgatatgagagatataacttattgcaatagcttgaggaagtgtgtttaacttaagagcgcccttttctgaattgtagaggagatgatagggaaaaaaagcaagacaccatgtaggggacactttaggaaataaacattttaaaattatatcaaactcagaaaaaaaggagccacctacctgttatggcaggaagatatgctggtgactttttttttttgtagaaaaggtgttgtactttttttcttcatagggccccttttgaagcctcagtgccctgtattggctctggttactatcagcctgagaaatgttctcaaaagctacgcagatgtttgaaaattagttctattctttaatggtcatttttggaacatggtgcagattctcttaaaagtgtgggtgccgataccccctccacccctttttgtgatcaccatgtgctctatttagatcatggagatgtgatgagtgctttggttttatttgcctgtctctgaaacatcacaagatagtaaggaagttcatggatgagcacaaatgtccctaatagagtgacacactgtgctaagggagatggagcagatccagatatccctacggtatccgagagagtagcttttctgcaaatggtggttggacattagttgctgaatagactcttcagcccccaagaaactagtggtggttttataaaatcctaacattgctatggatctatccagttgatctctggtctccagacagacccataatc

SEQ ID NO: 134324 - DNA, 1050 bp, Homo sapiens
gtctcaaagaccagttctcaatgggtttcttcagttttccttttaattctttgaggaaacctacccaggctaccctcaggaactgctttgcaggaaacaaggtgaactgggtcaacatatctttgtggatacagtgagaactgggaatttgcgaacacattcaatttgaggggctccataggagaggaagcttgggatatgttctaaggaggtaaacgtagaaagtttatgtatgcaggcctggcaaaggaatcattcattctcttgaaaagaaaaccacattttcaaagacagattctatgataatttaaaaagtacactgtatagatcacataaaatagcacgtatttaaggaggtggaattgtatccttccacttgtgtggaagtttttgtcattcattccatcttctcccgtggctttgcctccaattagcaattttgcaggcctgagaactgaagtggtgttgaagaacagatgtcagctgtttgtgaaattcatccctgccccatggttgactcagtgtttcagaatacctcacccattcttttctgaccagtggctgtagcttgttaataatgaatgaacatcacccataggtcctgaaattaacaagtgttaaatgttaggtgattattaggggaaaacaagataatctagtcagtgggcttaattaggtggtgattgcccaattgctgcttcatgataattatattcataaccccatttctagacatcaactacaattatcaaaattgaccccagcataggtaagtgttaggaatcttatttgaagcagcttctcaacggtaaatatctgatgtttccaatgtgcttctgcctgttctttcttcccctcttgccccctttccatgatctttcccccatcttagtagaaaggtcgtggcaatattattttgtctgtgaccatgcacatattgtatagcttgtgttggtgtctacagaaaaagaaattcttaagtttttaggggtcaagtataactgcaaagctttcataaatcagcaataggaatcttgaaggataaaaatc

SEQ ID NO: 134325 - DNA, 2013 bp, Homo sapiens
aaagaacgtgtcattactagggacgttgtttactgtttatctcccaaatgaagtcaatgatttccaggaaatactaacaacaacctgtatcagaagtgatacagtgtgggtatgtcagtgtgacactgtgaatcactgggccagattgtcatttggcaggcttccctttctgacatgcagttatatgggaaaataatgcacttgaaacttgcacaccatggctgaacttcagagcaactaagaacaactaggaactcagctactgtatatattgctttatatgtgtatatatgtatatgtatgtatatgtacacacatgtatctctatacatagagaaagatagatagatagatactctctaggcacttatttttctctaaaacatcaagagtgcaaatagtcatctcttagaatttctggggtgaaaatgcagttctctgtgcaggggtctctgttaagaaagtgatgtgtagtaggtggaatatactctttggggccacacaagctgaggctgaaatttgtctctgtccattactagctgtgggaccttgagtaagtcatttatcctttctgtccccatgatttcctacccagtaaaatagaaattattataatttgaatctgtagaactaacataaggattaaaaaataatatgtgtctaagagtcctggctcataatggccaggaaggaagaaagtgatagtttcttccttcctcactgatagagaaactgaggcagagatcttctccagggctttgccccatttatctatggtcagtatattaggtattttgttcttggtcttaaagtcagcttttggaatcctgcttgtttaattttgtgctgtgtgtccctttactgatgagtagtctttgctgcagttgtccattcccagctagactttattacatcttcaactgatgttctgtggatgaagcagcactctgtattgctgtgtgtgcattcagtaggagcttgtaaactacccgagaatgatgccatttcctcttggaaaaagtacatttatatggtaacaacgccttcaacctgaccttgcagagctattccctggagtgttgtaggggaacaatttttaataaacatgaagttttctgagcttttcagaagaaagatgttattactgttcctattgtttggcatcattctggcaaaaatgatatgtcgaagaaaattgtccttattgcagagaaaatattggctgtgctgtttatataaatgttgtctgcctcactgttgctctactcacatacatatctcttagccagtttgaggactgccccatagcctggcttagaaatgctttggttttctctgtgcaaatgtttatttcaatagtccacatctacttggtcttactaatgtactataatatcagatgctttgagacctcacgggtaaggagactaattttagagtgttttaagggtagatgatattttaaaatgtagaaaacgtggaatggtgttggtagggcctaaccagacttaccttattgggtctggccaaaaggacattcattggtagctttattggtggtggtggtggtgtggtggtggtggtgtgaatgttagtgggaaagatgaagaacatgtaagtggttctttggtaaaaccatatagtgatttttcacctgtacaagcaaactactcatgattttttttttttttttttttttttttacatttgggaaatttccagagaaataaatatgtcattggaatgttgttgttattattattattatcattattattactatttttgagataagatcttgcgctgttgcccaggctggagtgcagtggcatgatctcaagcacactgtaagcccggcctcctgggttcaagtgattcctccacctcagcctcccgagtagctgggactacaggcatgcaccaccatgcctggctaatttttagtagagatggggtttcagcatgttggccacgctggtcttgaacaggagttcaagtgatctgcccacctcg

SEQ ID NO: 134326 - DNA, 1909 bp, Homo sapiens
gttaccaccgctgtgacgcaggagataattcagctgggcaagcagcagcatgggggtggatctacagtacaggatgtgtaatgtcaacatgaaggattggagctggcagaaggaagggaagcagtcatttcatgccagtgcaggaagcctagagagatgctttccacccccccccccaccccccaccttgtctcttgtcctcttctggagctttcacattatgtgttaaatgattaccttgtgcatggtccatggcaaaacttcagctgatttttctgcctcttttggaacctgtcagcataaacagagtaaaccacattccacacacatgtagggcgggcaaaggaaagagtttactgcacagactgggaggaggagaaagggcttcattaggcaggagcatctttgtgcttgagatggaatcccattgtatgtccctttgtgctcagatttgagaccggccatccattcaaagcctgcaatcatctcggaacattgtgctgcagctgtagttggtagaagcctgcagaatggttccagtgattctgcagaagcttagcaattatataattgctatgtaactggagagagccatcaggattgtctagttcccctggaaagaaagcttctacaatttgaggggtagattgttttcccttgttaaacctgaaagctgatgagcaagtacatcataccactaggctgaaaccaggtcctctcactggcatgagaggggaagaaattcacaagtacacttggctggatattcagtggacttcacagctgtgttaaagggagagagagcaactcactgactcttggaatcgtggatccttgtagcagttgaacatgatagttgaattgtttctaatatctgagactgtgttctatatgcattcaaggcatggagtattccagagctttcctaggaatgggacaaacagagttgctcgtaaccaccaagagccctctcaatttctgccgcccgctcaggaggattttcacagcctctcttgaatgaatacttgcctcagatgctgatcagtggaagcactgcaaagcctgactcttcagatattcccgaatgctgaaatcttctctgcatcagctcatgattctgtctgggcctgtgcagtccaggagctgggacagactgaacagtttgcctgtgagaacttaacagtgcagaaatgaattccttctttcagctaccttaccacttgttttccatagttgagaaaactttgaagtggtgttggctaaatgtaggtacgagggctgcattaaaccagtgagaagtccaaggctccatttcatcccgtgtaaaacactcatctaaaattagccacatctcctaacccaagtgtggactttgtgtttgtttatgttaagtagctctaaatttcagtgatcctgcctttctggtgtcagttttgtggagctgctagaatagaaagagtggttgttgggatatatttttattaatggtttaagttgggccttttataactgatactcacctatatttctctatttaaatgtgtttgtagtcagaacttcagtataagggaaaagtaaaacattttggttcctttgtgaattaaaaaggaatgtctagtaggcagtgtggggacctggactcccaagatggattgggtccacacattcctagacctttgacctttatacctgtacgttactctgtacctcgtgggtttaactctgaggttgatagatacaaatagtttctttaagaattctgattcctacaaaacaatattggcaggttttcaaggagccagcctgtctcagcactgagcttttattttgtaacaatttggaggggtataggatcacccatggtgaccctttcctgcgtcattccaggcaggccttggcatgcttcgcc

SEQ ID NO: 134327 - DNA, 2579 bp, Homo sapiens
gctgagttcatcttgcttcgtatcttaggaactggcttgaccctgctccatcatcagtgtttgggccctctgagaaactctagaccatcttttcaaacactaggcttggagattattatgttgggagcagcagcgtgccctcatatgagggaggagcacttgattctagcgcagaggacacatcgaagggggacccttttctgtcagtattggtaggcctgtgaggaccttggtggtgagggccatggtgtatagtggaaagatcgtagacctcagagtcagtgagtaactgggtgaccttgagggaatgatttaatctttggtccccaatttccctatctggaaaaaaaatccactttgtaaagttcttttgaggaataaaggaaatcatgaaaagaaatctctggtgcagagcttgacatatagtagacacacaaaaaatcctaattttctttcctcccatctttgagtttgtattaaacactttctataggtagagcactgttaaacagtgactatctgattagaagtcagaatatacctgagttttacatgaaatcccaattgagggctccttgaagcttgtactggtaaaattgacaaacatataccttcttggctaaagaggctgagcaatattttttattatatggtggcttttcaaagccagtgtgctcccctatgaaacatgactccaaaatctggtaaaagggaagcaaagtaccttaccctctgtttgtgctatcttgaacattctataatagattatatattaaattccttagatgaagttctggttttttgttttgactattgctacacgactaactcctctatagtaaacctgaaattttccaggaatagcacagatgtaagctatttgattatctagaatccaaatgtcttaacagttttaatgtcttacaagccttttttctatcacctctagtccagtgtgcaactcttcatgttggtgtgcaggcagccttattgactggtttcagggaaaaagatcttattcagttaaaatttagctgatcaactttgaaggccaaccactgatttgtttcataatgagttcctgaacaggactagactagaagctacagaaaggcaggctgagtctcccttgctcactagtgccttgagcaatgcctaaaacagatgtacacagtcaaaatgtatggagtctgtaaaccaaacctagcatttttaaaaatgtcatattgctcctaaatatctgttccttaaaagtgcctacatatctgaaacagaatagtctcttagttgcttctgagcagtcatttctgcctgaaacatcgctagatttatagcattcaattaaaaaatgaaagttaatgtaagttctcaatcaaagaaaactacccatctctacaatccatattatgtacattttgaagtaagaatgtctaacagtctaggttaaagaagccaaggaaaatttgtttgtcggtagcttttgaaagatactaatgtgaggatgacatttgactagtatgatcctgaatgatcttcagtgcattatagagttaaatttcatagaattgagtctgaaacattggataagaaaaattcaaactcgaatattcagtgattcaaggccattggttctggaggaaactcatttgcggttttatgtgaaagaggaagacaggtctttttccaagactttctttgacctattaagtctaaatggatggtggcatgtattttgtagggtaaattggtggtatggaagcctcaaggaatatagggaaaaacgttatggaaaaaaatgatgagtatgtagtgtttcctatcaatttaacaaaattggaaggatgaagcaacggaaccaggatgatagtcatgttctttgaagatggtcaagcagattcagaaaacatccttcttcacctttgactttagttcttgaacatttcaatggaatgatttagatcattgaaagtctactatgtgcagaagccttctaggtattaggtgaccttgcagtattaaagaaacccatgggtcctgttagtcccaacctcactgaaggacatattctgaagagccagctcattaagcaagcttttgaagggtgtgcgctgcagagcagtttcctgttatttggttaatggttgacctagttctaatgccatatgcttcctggaacgcattctaatataaagtatgtgttaaagcaagactaggataatagcgggaaagtcaaagcctttctaaagcagagaccatattaatgctggcccagtgaaggcagaatagtgtgcggatggaaaatgaaaagacttttctcctcatgatcctgtttggtaattctgattttaatcctcacattttatcccagttcattctaaggagttgcattttccccagaataccgtatacataaggcctgcgtcattagttcatttttcagtgaatgctaggccaaggttagtgttgaagtaccctaagtaaaattattactgcaaggaaagattagattagagttggctaatggcaggtgattttgtttttgtgttattatttttgtattgtaaacaggggattagtaa

SEQ ID NO: 134328 - DNA, 2619 bp, Homo sapiens
ttgggaaatgtcatctcggtgacaggctacatactgcaaccaccaccatccacctctgccctgtccccttcctcccaccatggaggcagtggaaacagaatatctgtcattcatcagttaaattggatgcaattttttcatattaatatatttggcagaaacaaaggaaacacattatgttgatttctgtatacaaagaaattgctgtgaattcacccaagtacatttttggtttttttgtttgtttgtttgttttttctattgacaataagagatgcacttgttgaccgaggacttgttccatatggcttcctgcctggcctggtttgaagctgttgcttctgatattgggccactgctaactgacctagttgtaaattagagtaacgttggctagaggatcaacacggtctagggtctaatagtatgcctgatgtgtagttgatcatcaatgcttattagtgaatgactgagccagctcagtagatgtttcttcaaaagataagaagtaacttggagaggttaagattctgcttcaaagcaatgtatgtgttcaacataacctttctagagagatttctgctttaatctcaataaaaaggaaaatggccctgttgcaaaatttggcaggtcagacacttcagcttcccaagaaaatgcaaggaatttatttattttctttacatgttgtctactcctaaaacaactatcactactaccattaaactctccatatacattaaaggaagtgcctctagaataaatgttgttaagagaatttaatcttcactttccttctaactttaagagcctcatgggaatgaaaagaatgttgttttagaagtagaagagaagaaacaattgagtagaaaaagaaaataatttgagaaaacttgtctggttgacagtaattttttagtaacagaaagcagcagtcatggcccaagaacctgtggttcttggttgtgtccttgccatgcttagaaggttcaagaaagggagtatagtctctttaaagttattttgaggagttggacactacctactaggttcctaatgcttacccaagttaagaggttgaagtgcctccaagactttaagtagcagctgaacatgtgatcttgttaaccctgagatgttgctgaaaagtgactcagatcaccgtggcaaacaatcctgtccagttccagctgccccagcagaactcagcattaggtcaccctttaggcgtatggtgcagagctcatgctaccatcaagactttagaacaaggacaacttgaagtggctatcttgcacatgggactgatgttgaggactgcttgatgttttggagcccacctgattcttaagagtttccagttcctctatccctattccctgtcatcacataaaccacttggagagaaggggaggatgccagagagagtcatgttctgataattatttgctctttggatatttcctcatctagatagacgggactttttgttttccccaggaaaaggtaacgtatgctcaaggtagccttaaaaaaatgtgtgatgcctattttaaataaaataacaaactagaacagtttgtattttattaaataataatcaagaggtaactcatacccaagaagtgggtttgttggccttagcctgataggtggtagccacataatgactcattgagcactactgacttagtaaaaaagaaaagtaggggtggggtggttaagaaggtggctgggattgttacctcactggaccgctctttaaactttctctgtcttttcatgacttgggtatgtttatgtagatccaaaattattttaaagtttgaagtgtctttctgttagctgtgtgaatgtgctgcctatttcgaaagttgataatgactcaagggtatccaactctcaggattcaagccactgcatgttggcaatgtagtagatcctggttttaaaaataaaatgccaggatgccaccctgaggatccagacataggctgtgagcacatttgaaatccacatcctcaaatatacaacaatgtcagctacaaaaaaaatagaagagatagggtctgaaaaggaaggagctcctgtcatccgcagtcaatgtgaagaaactggttatatggacctaggaaatcatcccacttaaccccttcattttacagctctggaaaggctgaaatgatgtgtccaaagtccacaatgtaggaagttagttaaggaagcctgaaatggaatatcagttttctgccctggtgatccatgcttattccactacaacagtgttggcagatagcttctatttctcgtgccaattttgattgattggtggagaatgcctggagcttcactttgaggattctgtgccttgtctaggcttgttggaaaagagtgtggagatcaagcagagaagtctgcaataggcgggagagggtaaatgacaggcggtggcacttccctatacttgctgtcccttacaattatgtgacttaaaattacagccttactctttaccaaaacactttctcccttggtgttcatgaagacatcctatttccaaatgttttcaaacaaaaaagagaatatttagtcaagggcagagaatctcattcagaatag

SEQ ID NO: 134329 - DNA, 1040 bp, Homo sapiens
tacttcctgacaggtttcctacttattacaataaaactagaaggaacctttgaggttatttttttaatgttatcttatagccagagaagtcgaatccaagaatatttaagggacttgctcaaggtaacgaagttgtttagtagcacaaacaccctctggatcttgaaagctaaacccacattgtatatacatctatttctttcctttctctcctttactttaatgagacaaatgaactgtttattgttgaattcacaggggtcatgattgcgttgcaacatactagaatctctagatttcaaatagaatgatgaaactgtgattaaaaaggactttttgggttatcgttacatagtttatgtagtacatttagaaagaaagactgataataaattttctcgtaacacgaccctcacaagtgtaattttggaaccctttctacttccaaagacaagctgttgtgaagatgaatgtgggagataaatgtgcctggcagtctaaagcatgccatgaattcgtggttgtctagcccagtgctaggtacatgatagctgttctgtaaatgtggattttttttttttttttttgagacggagtctccctctgtcgctcaggctggagtgcagtggcgcgatctcggctcactgcaagctccgcctcccgggttcacgccgttctcccgcctcagcctccccagtagctgggactacaggcgcccgccaccgcgcccggctaattttttgtatttttagtagagacagggtttcaccgtgttagccaggatggtctcgatctcctgacctcgtgatccgcccacctcggcctcccaaagtgctgggattacaggcgtgagccaccgcgcccggccaaatgtggatttagatctaccaccagagctctgtcatggttatctttttatgtacgaactgacaatactttgccctgaatagggttagtgtttggcagggaggaagctatgtttcactggtagagcagtctgttaacgtctaatttgagatgaatgctattgataacagcat

SEQ ID NO: 134330 - DNA, 2912 bp, Homo sapiens
gcagaatgatcccctttcactttaacagaaagattctctttctagcttaaaatattctggatatgctttaacttgccttggggtcatagcacacatctcccaggactgatgagtcttgtcagttgccccagggtgagaactttaataagcaaattgcacacacctggttttgcaaaatattggcctaatggggcacctaggtggaagtcagtaagtatgtccactccctatgtacacacccttcctccccaccccttttaaaagggaggcctcagaaatgctacctccccatttatcttgtaaaactttcctgtctctccttcgctgtgctcgggtagctcagagggttgtgatcgttaacgagctcagggtgttactgtcactgctgctgtcttgtggatttgaaagtaatgccgtgatgggatgtggtataggtacgggggagtctggttaaaagggaacagggctggagaactctctttgtcagactgtgattccccctgctctgctctttgatttgtggctgccattggtgtttacacagcctttccccgctcacactttccttggttagttgaaaagaaacagcctgttttcctgttactgaatgctggaccgtgggcttacttgttttttactctttttcattcatttgttcattcatttaaatacttactgagcatttgactgcttcccaggctttgtgctaaatgttggctctacagaaatgaaagacctagaccctgcctttcagaggctcataatctagtatttacatctccagttgtcaacaggtctaacacattaccaccaccactagaagtggtgcgttttaatgcattttatttggcttatgtactatctttatttgctgacgatcaactcccccaaataaagctatttggatatctttcttgttatccattctttcagacatattggcttacccaggtgattagagtgcagggtaactgccttaagaagctacagtggcattgatacttacacatatccaggccaactaataggtgtgaccatttctttgttttatgctctagtgtagagcttgactccaccttactttccggctgccatccagttaacatacccacaggattcttagactaggcatacatcattgtatatattctgcctaaaagtttgtaaaatctagtggtggcatttagctcttttggcaataaaaactatatgtgagaatttcgtggccttgactgagctgtgtatggcctcactcttcaattctgttgtcagcctatgttccacaatcatttgtgtgtgtggacctcaagaatttcagtcaacccggcaacacatgcagtgccccttccgggaacactggtgatcttctggtctcttggtttggagttaattaaacattgtcgggagaattccttcatttccttctggagtcctttttgggcatacaaaaatctagcacttgaagccacttaatcaaatatcatatccacacacctgcagttctttctctgtgtccacaaacatggttttacacttggatgatgtagttaggctcaactccatttgtagtgagaaacatttgaagcttgtccccactcaacaatgatgatgcacttaggcttaccttcgtaatatgggtaaatgtctcaggttagccaaatgtacctagggtcagagggcatatgctctgatatggaattttggaggtcattccctgcctttgtcctctgctctaaggctcatgtcactcgcatcatgctgtgacatgaaacaatattgcatcgtagggagtgcatagtagactatgttgttcaattatcatgagattaccacatactcttgcctggaatcttgccagcaatagtgaacaaagagatgacccaagcaactttctcacttttattcttgaagactaaatggcatccttaaaatctgatggttttctttgtacctttctggttgagtaaagaataagatagtctttttcttttttggaaaaatcgtatggctagtacaggaaatcaaggagatttttagctaatttagtaaaaaagtcagaggtggaacagaaaatacaccggctgaaaaaggagatgattgatttctaggaaatgggagattgtttggtatatttacagtaatgaagaagagttcttcctggaacaaaagtactgaataaataacaacaagagacaaaaaagaaaaatgcatttccctggtacacaaaccttgaagctcatgctttttgccattaggaattctgaacatgtcttgaattcttagactttcttgatttttaaaatctaatatttaattccaaaataatttttattcatgtctgcgttttctttgttttccccctgagttatctgtgtcctctgaaagtttaaaaacaagtgatttttttttctcatcttgttggcggagacatacaataggctgcctctccccttctctgtggaaagaatggaaacatagtaagtggccagaggagctccatacggattgacattccttgcttctgcttttgaagttaagatggtcacgagagagaaaaatatttttggttccaagcctaagaaaaggacattccttttagtcttggcattcttgttttcatggtgttgatttctctttgaattatcattagtaccattaataaatcacatctgaacgtgaaatcacttttgcaagttcttcccctctccacacccttgattatagaaaaggtgacgtttcttgatatttatctgaagtagcttagagtatgttttcctggctttttgttcccccctctggatgggttcccattgttgatcaagcatattcaagagagttttttcccaagagtcctgagagacccatccatgcattctattctgttaaacaaggaaaataataataataatgtt

SEQ ID NO: 134331 - DNA, 3949 bp, Homo sapiens
taaaattggtggtggcccaaggtcattggtagaactaatggaccatttgaaaattattagcagctggtttaatagagttttaataactacagctgtgagaaaatccaagtacaaggtatttggaatgttccctctgaggtcctttccttttgttctataataatcctggcatccatttaacgaaagtgcaactcagaagattaggtagctatatacgtaagcatatcatgcaggctttatttgctttaggtttttaccattaaaaatatttttaggcatcatcaaacttgtcacacaacctgcacatccccatgccccactcaataacaccacaatctcagggtctcacagtgttggagaatttccatggctcatctaagagttcttctcacttaacattttttattgaaaatttttaccgtatctaaggatttgtggggttcaatttgccaaactccaaggcagtggaaaagaagacaactgcatcaagtcagtttctggttttatatagtttaacagaagaataatttgcttagatcttcgccttcatatttggaggcatatactcacacacacacacatgcacacacacacgcacacacacacacacacacacatgttatgcatagatgaataatatttagtctgcaaagaaataggcctgtttcctccgtcatctgtaccttgctaacccagagacttgacatggaggaggaatgcagagagcctttcacccttaatggattccacagctgtgagtcaccctggccccaggcttctcgcctttgcctcatcccattcctgctctcacagtcagaggtctggatctccagttactgactttggaactagggggaagatgacacaggtgacataaaacaagagcccccttctatatctcagagcaaattcctgaaatatactaccaaaacataaaagtgtggacgtcaactttagacaaatccttgccttacattgatttgcagagctctttagaaatcagaccatggctttcagtatacattatataaatgtgttcttcacaacacgatgccaagaagcagatgtgctctctgagacccacagaggtcaagcaacttccccaaaatcatagctggttgattgccaggacagagacccaaaccttgtcttctgaccagccctttccagtacaccatggatgactcacccacaaatgacaaatgctttgtagtcttttaaaggaagttggggatattcaggggacatcctctaaccttgtgagaatgtatcatcatggaaggaaatcaccatccttttcatagagtagtccttggagtcagttgctgagatggcttgctatggcttttgcaggatggattttagtgatgataaaggacatggtaaatatttggtaatataacaaatgcccatggaacttgtaaacagtactatcataattgtttccatttgtcttaaccgcactcgaagcgatatctcctaactcatccccaaactaatatgtcgaaagcaacaggctctgatggagagggaaaggggtaatgctaacagtactcaggagacggcaggaactatattttctaagagtcagattccctgctatttctgttgtctcatttaatcctcactatattgttgtgcagtggatgtaattttattgttatttctatttagcatatgagaaaacagaggctttagacaggttaagtaacttgcacacttgtactacgtggtaggtgtcaaaaaactgggatgtgaacgcaggtcagttgcgctctatgcattgtgaagtgctgcctacaaacctctttgagattattgagaaatgtgatcctgacatttctggaggactagagaagtccatgaaaatatatggctaggaattactggcaacagactatgtgcaaactgacttttagtatttcctcatttaatccttgttataatcctatgaaatagtaccatctttacactttctacagtgaggaaatggaagcagagagaggttatacaacttgccaagcaagatctgaccattgttaattgataaagactggatttaaaccggtaggtgggctgcaagcccatgctcctcactgccatactgggtgctgctaggccgaggttcaaaacaacccttgttggctgaaggtttttttgagctggctcagctctggggttggtgcattctgtaaatgatcagtttgacagtgtaggtagtagagacatgctgctttaagaaagaactttgtatctctattacagagagaagatataaagatattagttcagtcttccataacacgatataacagacttttcatttttatgcgggagggatctctaactctttagtctttatcttaaggaaaatgtaaaggtattacagggttgtaagcatgacaacagatgtgattagattagctttttaaatctctcactccagatgttcagctgcattaggtaactacctcaaggtgagtaccaatgaaaactcttaaataagtactttgttcaaaggaatccttcaaggttttctaggtctgtgctgtccagtgtggtagccctgagccacaggtggctgttgagcacttgaaacagtgaaacagcccttgaaacagtgcctgatccaaatggatatggtgctgtaagtctaaaataaactgaattttgaagcttattagaaaaaaaggatgaaatatctcattagtaagttttatattgataaatattgtaagttttctattgataaatataaaaatattaagataatatttttggatatattaggctatgtggactgtgttattgaagttaactacacttgtttctagctgctagaaaatttaaaattacatacatggctggcatgattttttaatctgacgctgctggtctaggtaatttccttgctctctagttaaataggaaatttatgggaataccattagcataggttgatgcactgcttctgagtaccctttgtttaaactattccaacctaaggtctgttgcttcttggataatattccatacctttattggcactgttcttttaaaattcagttaaaagtatcattttccatttattaccaaagagtagactgttcttgacatatgttagaaaaaattgagcttagaccacagctcattagttaactctggatgggtcagaaagtggtgacctggttattagacagagtgcaccaagcattagcttctgcccgtgctcccttctaaatatcatgtaggcttgacccctcctcttcatccccagtgcgtcgtctggcccaggcttcctttatctcttccctggaccatctcagcagctgcttagcagcctgtttcccaccatcctcttcacctctaggagtccctcatgatgctagcaaaataatcttgatagggcacagctttcgttatatcacattgccctgattaaggatgataagagatccctgtttctgtccgaatgaagggagggagggaaggctctgacatttgaaactggatagatcttacgttatttaatccctatgaaatggatattttttagtcccattatacaggtcaggaagttggaggtcctgttgtctttctttgctaaaacctatgttagttctagtgacctgtgctgattgctagctttcaagaacattcatggaaacaaaaacttggaactcctgtaatgccatctttttgggggtgggaatatgtattgggttcttctttcttacatatgttcatggaattattcatagacaaaccattcagtctggttatgatgttcacctcccctctacatcctggttttatttacttatgagaagaaatgcaatgcaaaaaaaacaagaacattcattatctaacccgccctttctagccttaaatcatgtccttttctttcccaatggtctaatcataactgccctctccatctctttacttg

SEQ ID NO: 134332 - DNA, 1647 bp, Homo sapiens
ggagcacagtaatataatatgcacaaggatatgagaaaaggaagacaaaggtagaagtatccttaagtttgaaaatgccagatctgctagacagtcttaagacaaggatggcattgagattagggaaggagaatagagagggaaagaggccagcagcagggccctgctgatccatggattcgcctccagccacaagccagtccctagctcatggccatatgggactgaggctaaagccgtgctctaattctgatcctcagcttctccaccagccctctccctccccctacaaacatacagccttgcagttcctcagcattagcaaatgtgtaattccttatttcgtcagtgctaagttgcacttttccccacatttatacatttctcaaaagggatgcatgttatcatcagtttatatttaatgtgcatggagtcctctcttgaaactttgttattaaactaagtcttataataacatttggaggaagaactccaaatagaggaagaacaatgtatgggttctggactctgcctggagatgggtttgaacagaacagaacacagtccctgctttcaagaaactcacaatgcgctgtggggaaagagacaactaagtggatggtgctgtgtgaaaatgtttgggagattcaggggtccctaggaagggtctaccccagccttgaggtgccaggaaaggccttctagagaaagtggtactcaattgggtatgattttgtgctaacccttctggaggtggagggggggtcatttggtagtgtctccagagagacagttgaagcactgttggttgtcactactggggatgagggaagatgctaccagcatctagtggggatgtcagggatactgctaaatatcctacaatgcccaggacagcctctcacaataattatcaggcttcaaatgggaatagcaccccgagtttgagaaaccctcctgtaagttgagattgagggatgaatacaaattggtggtgctgggggaggaggtcagggtggagagagtcataggtgtccaggaaagggagttatttggaggaagagtttgccatgatggagaatggtacagaaacaatggttttgtatggtttagaagcaaaagtatcctattattgctcctaagaaggttgttgctgaccatgatgaatttggtttagcagaatcagagttacaaaagccagatgtagaagactgaaggagaagtaaggaacatgaaagcagtttgtgaaaaggaggaattaatgataacaatggcaattgtagttaagtttttgtatatgccagaaactatgccaaatgctttatgttccttatccagattattctacacaaccctgtgatatatggattacttggtatggatgaggaaacagaggtttggagaatttaaatagtttgtcaaggattcatgtagctaataaatcatagagtcgggattcaacctcaggcctctttgactcttacctataatttccctagagaagaagttaggccagagggacatggagagagagagagagagagagaatgtgtgtgtatgtgtgtgtgtgtgggggggggggggtgtgtgcatgcatgcatgtgtgttttctcccctagatgggtgagagtttaaggtggggatgac

SEQ ID NO: 134333 - DNA, 2735 bp, Homo sapiens
ggtgtgtgtttgggagaggagggtctccctttcccatttctgcagctggggcactcacagtatttgcagtgtctcctgggtcctgcaggagcagtctgctcttttcagagggcctgtggggtcctcttgggattgctggtttgttcttgcagtcaatctggagctaaaattcacaatgcaagcctccgcatgctgctctgcctggagctacaatctattcctgcctcccttctgccgtgataacagagatccctgcttttcctttaaaggtatgggtagagcaatgtgttgattgagaattgatgatataaagatataatcaccaaaaattatcttcataaccttaaggctggagtttctaaaatcactgaatatggattgtctgaggttattgatttagaagtagtcattcaagaatcccagacagggtggaaaaaaagaatgtcattgtcagcagaagagtcaacattcttagtaatctgaaataagaaagttgagtttattgataactagtactttatcagtcaccccagttgttttacatttgatgattatttttaaatgtttaacgtgttgaaatttgttgaaaatttttcacatcattaagtagaaaatgaaagtgttattcacttgggcccacgcctagataatttaccttatttgtaaattttgaaaactttatctcctcttttctagtagttgtttctcttactttgttttcttgtacaaatgcattggctagcatttccacaacaatgctaactaccagtgataatccttgtctggttttttactttaatttttctaatgtttcatcattaagtataacactgagtttatcttgaattgcatcaagtgctcttcagcctctttggtactgataaaattattattttcttttttgacattttaatatagtggagtgttgatagattttcctgtattgaaattgacttttctcagtcaaccctacttgatcttggagggatatttgtttaatgagctcctggattttattttgaatttctgcctcaatatttctaagtgacatttttctgctttttactagtatttattgtggactaagctctgtaatctgtgtcacactggatttggaaatacattggtaacaatcttgtgcttgagactttagaccagtttaaaaagcatctgatttactgattccttaatgtcacttaagatgttttggtgattaggttggctatttgactgtttgctagtctttcattgatattgtttcttcttggattaattttggtaatatatgtgtttctagacacattacattagttttacatatattgccatgagttttacatggtaattttaaaattataatacattttcctttacatttttggatagtgtctacttcttatacttattttctatatttatgttttgccctactccctttttgttgttaattaggctagctaattgttttaaattaattttatatagcatatttttaaaaaataaaagttactgaggaaattaccttatgatgtaatatattgattcctgagtttgtttttaatgtagtcaaatcttttcttcgacttttcttcttctgtctttccatttccccctgtacttgagttagatgtttgattcatttagtattattatttcttgctttataattttcatagatctgtgaaatttcctctaagtattgcttttaccagattccatatttaaatacatagcattttaaaagtcatactctactggtgagtttttatttctggttaccccagaaattacttaggagaatgttaaaaaattttctcaaatgtttgggatttttctttttttcttttttttaacatacctttatttcactgtaagtagaaattgtgtactattttttaaatttgtaatgtattatctcttaattgtggcattaaagacttctataaacctccacgggcacttgaaaacttttgtagatgtctcacagatacttgaaatgaaaatatgttttctatttccagatatagaatatgaaatgtacctcttaactcagttctatgaattacatgaattttatccttggtggtctttctccaattaatctgttaagtgcttatgcctatttcttgtatctgttgccatctttatttctttatttatttggtgctgctagagagcagaaatattcataataaatctccattgtggattgtacttttacattattaagtgttcatctctatcatgttaaaagcttttgtatcttgaatttaaccatgaataacattaatcatgatttcttccttcttttgcttggtatatgtttaatgatattagattttcaaactttttgtatcattttactatatatgtgtctcttacagacagaatccagttagagattgtttttcaatttactctggggatattttccagaggaagaattatccaattcacatttattgatatatcacatatacctaattctaattaattttatgcattctcttttatatttctgtgcaatttcctttgtcctcttcattttattatataatctgcattttctttgagttctttcctctagtaattcaaagctatagtctgtttttatttttattactgattaaattaatgttcttacacctttatttggaaatttgttaacttcagaaatgaaatagtatgagtatttctgtcctgctgtgaaagttgagaatatttgcccatatata

SEQ ID NO: 134334 - DNA, 1042 bp, Homo sapiens
tacttttatagttattgttacggaattatttattgttataaccactacatttaaggaattataattttattttgtaagtattatcaattattcaattttagttctaaatgtaagtggattcaatgctcacagcttctgcttacctctaaattacctattcttgagatcttgattttgaaccttccgttggttgtattttgaagaaaagttacttacatgctgcattctctgactatgctgattagaaaatcattttttattacttttatatatttaaaaaactggttgtgaacttagttgggaattgaatacttcggtattgttctctctttcttgagcctctacagacacagcttcactttttttctgtcatcaaatgttactgtgaaaaagtcagaggacacctgactttttctgttataattgactaattgttaaaggtcttgatgtatataggattcaatgtttagccttgaaattctgtaacctcaccaagatgtttccattttactgattcagtcttactttttcttggaataacagatactcttttatttcaactaagtattttctaccacagatttaagcatattttgttttgctttgttttgttttgctgtctacttctacgaaaccttttatctgtatgttcgatctgttttcaaaccttcttatctgtcatcttctccacttgctttcatctacttgtccttttcctctgcattttgtgcagttttttgaagactgttttccacatcatcaacattgtttttgatttgtggattttgcctcttataactttaatatatttattacttctgcaatgatattatttttgtcatcattttctttcttcaactgccagcctctctttcatcttgtgctgatgtcttgtcatcttgtctttgatctcttctttcatagaatctctgttaattgttgtatataattttcttctgtgtcctgttcctccaaaatagattttttcatgggtcgtttccatgctacatttttctgtcgtcctccaccccttgttttagtt

SEQ ID NO: 134335 - DNA, 1222 bp, Homo sapiens
taaaggatgggaattacttagaccttccaaaagcaggtaaaagtgttctacatggaggaaaaccgtgaacaaacatagagatctcaacatcttcctgattttctaagctattctcttcagaatgataacaggcttttctaagagacccttagggaagatagtttaaaagttaaagatgattcccagactttctgatacatttagatttttttatatccaacaaatggatatagataccctctaggaataaagttagataaataaagaatggataaagataaattaatatattagtaaagagagaaaaatattccaagttggtttcagaatgcagtatataatttgaagcgaaatccagtatgaacaatattctggtatcattagtctgagtcattcactagatgttccacaaagaggctggcttttttgacagacattcgtaaggctgactactcctttcctttccattttacatgaaccgaccctgctatgtccagatcctcctaaggctcgttcagctagcctcttcagtgactttgttggcagtgcacattttccataagaaacaagatgatgtttctcgtggggtagatttggcaggcataaagctactacataacattgttccgactccatgaggttggattctaaagataattcagtgttatagctcttgttcttctgtgtatacctttgtcagcaactttcagtcttccaaacatgtttccaaagtataaacacactgcttgcatgcctaagaagttctttgaatagtcaatctgcaaaaaaatggattttgtaccttttcagttactctcctgggtgtggattcagagtagaggagacacttgtggttattctgaaatctgccttcctgatgaagactcattactgagaatatacggggcatggaccttaagtgtgaatactgttgaacaactgacacgtatggaatgtctttacttgtgagttcctgtctcaaattatgaaattcaaaagattttttttctggcttcagaaaatgcatgtgccagaaggcttgggcaggttatttttcttgagacttcagtttcactctctggaaaatgaagatgttggaccaggttggactatatggtctttaagatctcctctccattggacatgatgaacctattgatggttaacttttagagtagagtcttctctttgacttaaggaaggcacaaataatatttcaata

SEQ ID NO: 134336 - DNA, 1239 bp, Homo sapiens
tttttttgagacaatctcattctgtgacccaggctggagtgcagtggcatgatctcgactcactgcaacctctgtctcccaggctcaaacagttttcctgcctcagcctcccgagtagctgggattacaggcacctgccaccaagcccggctaatttttgtgtgtgtttttaatagagaagaggttttaccatgttggctaggctggtctcgaactccttacctcaagtgatctgcccgcctcagcctcccaaagtgctaggattacaggcatgagacactgtgcccagctgacttgaccatttttaatgacatttgccccttactcacaaaactcacaggattatcaactgtgcaaaggtggatacaaaggccgtatcactaggaaagacagaccagtcacatgccttcgcctaggatttttttttttttctgaagagatttttggtaacatacccaaattagaaaaataaaactgaaaactcatcatgatatcatatagcatgagggctgctaagatcatttagaaccacacaattctaaaatcttggacctgggctctcccaggttgttgaccctctaaggatccagagactccccagccaggaccccataaagggcctctgaagacaggtgggttatatgcagagaacgaaaatacctggagatcattaagttttcagtctcagcactattgacatttggagctagataattctttgtcgtggggactgtcctgtgcgttgtagaatgcttagcagtatccatagcctttacccacagatgctgggtatgataactaaaactgcctgcagatactgccaaacagccccaagttggggcaagcggggaataaaattaccgctcgttgggactactgctttatgacaacacagggttagtagagtcatctaacactcatgaccaatctctgttggttggttggaatcctatcattcagaagctctagttcattcatttgttccttccttcattcagcgtatatttctgagtacctgttgagtacactgagtgttcccaaggctgaagagccagacagacctagactccttctaagggtacttgtgttctggtgggaagaaaagaccacaaacaaacaagggtcatgccaatagtgaaggaaataaagtagtggattgtggtagagagaaactgtgtgtgggttggtggtgtgagtaggggtttcaattttgtagattttgtaagggttgggagtggt

SEQ ID NO: 134337 - DNA, 1038 bp, Homo sapiens
cttggtctttcatgatgtggaagatgacttgtactgcagcttctgcttactctgcgtcttaatcagttctgtaatgaagacccagcagcatatctgcaacttccctttaattttacaatttttgtaatgagagttcttgtgtgaaaagtgtctgtagaaacccagccagcattctgaagagtcgataaagcaacaccgtgattttctgtctctgctgtttgggcgaggtttagctctggggggggagaaatcagttatctgttgttctaagtacaagggcaagaagagctgcagtttccaaggaacttcctggtgaacccatgacatttcagagaattcctcaatacttattatttctcacttactcattcttaggacaccaagaatgggttcccatcatttgaaaggacatgatgagctggaatctcatttatcatggttgcattttgagaatttcattgagggggagtcgtcttcattttgttttgttttgtttctaaaccacatctcaagaaaattgtcaagacgcttctcagaattagaattatccagtgaactgcaagttcccctttacagacaatgaagtctaaagctactgagatatcagcctgcttcctccctttcttttcttgtcccttctcttcttttatctccttattcaaatcacacgcttccttttctacggacaggagagctggcagactgcctattggcctgttggcctcaattagccttatatcattgcaaaggaatgcatgaattctccagaaggtatgtagtatctctttctgtatgagacacttactacctgctttcataacaggtcactcagccggaatgacttcttatttacatatccaacatttttagccacttggattacatccctagatgctcatttcattttaatgatgattccaaaggtatctattaagaaatagtactccagcatactctgtagtacttgaaaactttatgcaggagagcgatcctaaaataaaaagtaacctgaaggctagcatccttggccagtaggtg

SEQ ID NO: 134338 - DNA, 1007 bp, Homo sapiens
tgaaatagactctttttagttagttcagaaacttcctcttttacttttgattttgctgattttggtgagaaaaaatattgctaatttcataatcatagtattattaaatgaagtcaatagatatgagatcaaagcttttaacttaaaatcataattttatagcagatcagtgactaggttagcctcttagggttgctgctcttcgggattgatgaagaagatatgcagagcttatttctcaccttttttttttttcctcggttttggtttcttagaggattaccatctgctgcaaaaacatatgaatgggtcatcgtcatgtccagtgtgtttttgtctctgtccttctctactcccttcccctccacttgctgtcactttttgcacatgtgcccatgtaccatctcataaacatatcaagtttctctctctttgattgggccatgccagcaacttctattttcttcttctgtcagcgtcttcaggagaaatgtgtacacaaaagcaagatggctttcaaagtaggctacatcctcctttcagtacttggtgcagacatgaaattgaaggccattcagctctacctgatgctggttctctcagcggcctggagattaacctcttctaaggctctgagctatttttgaggcagaggctgcaacaacattaaagctagaacccattaggaaatcactttcatcatctcttctttttccaaatcagtgactctttttctgatctcataaccctttaatctcctttgtagcagaacaaggagattgttagtttatgtttgtgtccagtgaagttagcatccttgataatagcttcagaagacaccaagatattagagaactacatagagagatgaatttcatttctaggtggatgacttaatgccgaaggtgccctgctttccttctgcagaaccgtaacttctgttgatgttgtgcaaatcaggctcaaactttccaaaagacacacagcagaaagccttttgttgcatt

SEQ ID NO: 134339 - DNA, 1201 bp, Homo sapiens
ttggaatctggcaagcagagtcggatggtatgtcttctgtgtgtggaaggacgacttccaagaagccaaggcattctggaggtccccccactgcacccctaaatcctgatgtagaacaggatctggcccagggtcatcctgctctgaccagggctctgctgggactaacaaaccagcatatcaatcatggaataaaagaacctttggagatcttggtgaatgacatttgaggaggagaaaggtgctgcttttcagagagaaatgaaaacagttaattctttgttgggaagagaagagcataggaggagcccagcctgctcttctagcattcatttctgattgttagcctagcagactccaggagaagccatgttgtgcacggaggagaagctctgagctaaaatggctgcccctaaagctcagaggactagggcagcttagtgagtcttagagcttcagtgacgcaggagctcatatctcttgaaagtgtgataaacacattcagcagagctgtggcttgtttggctgagatgaaaggactaagcttgggggatggggagtgcacactggatgatctgcttttttctgtgaagtgttctaaatgcaggagttgtctgcaccatggaaaaatttgttttcaggtctaatggactgtgcgaaaggagaagtggggtggggcctcagtgactgctgtaatttgatccagagctgatagcaacctcttccacacaatttgggttggtgcttagacataaaagcttgtgtatctggaatattgagacttagctgaaaagagtctggtgcacagttcaatgtttattgaaaaaggataaattgctgggtgaaagaagaggaggtaaatatctgcggctcactctgcaagctcagtctgtccagaactggacttgccagaagttattttagcaggcgatcaggaggagcattctttgatagaaaatccttgtgtgatggctcctttcactacattgatgtattattactggacttttttgttcctgcagaaataatttatcttttacagtaaaagtatagagtattacatcataaaatacattggctacggtgttagttcttggacatctggttctagattacagtgactcagtagagtttgtgatgatcttactgaagtaacttactcattagataataacagggtatctcaacttaggatatacat

SEQ ID NO: 134340 - DNA, 4429 bp, Homo sapiens
tactaaataaacagctaatgaaggttgaaattttccctttcttctgtgtggacatcctctttacttttgagatggttccaatttaaaaagaaaatgagtccaaggcagaaccaaagccaacattaagttaccaagaaatttggattcagtggagaagctcagaaacttctaaaacttttgaagtattaagcgtttccttgacaaatggcattggaagacatatcatgctagaaaatgtttatctggtatttttccttctttgaagttatgaggtcaaggacatcatctccattatgtctgattgcctctctttagccaatgttccaactggcaaagtccaataagagaaatctactgatactggaattttttcccattaatggatatatagccccatcagctcgaggtatgtgattagtgcattccttaagatgttttgttctgacttctgccacaggttcctaatgtgagaggctagacccagatcatggaggtgcttcagtgtgatggctgtgatttccgagccccgtcttatgaagatctcaaggcacacattcaggatgtccacacggcatttctgcagccaactgatgttgctgaggacaatgtgaatgagctacgatgtgggtccgtgaatgccagtaatcagacagaggtggagttttcttctataaaggatgaatttgccattgcagaagatttatcaggtaaatctatactaaacttggcacggccgatgtattttaattgctcttgtttccttttagcctgtagccatggttcttaatatacgtggcttttgcagagtttcttgtgctttgctagccatttttgtggtttgggcatcatgtatctctccttgagtaccttaggttttatcctttcgaaagcttcctcatatatcctacctttcaatttggagaacaagatagttgcttggaaagttctagaaaaagtagtacaatttatgcaacttgtatttttatagctgtgtggctcatttatggagatgaggagaatacctaaagctatacactgcatctttatccatgagaaggtgcagtacgtatatcttcattgatgctttgtgaatactcttcaaggcctcatcttgagacttcaggccttttgcatgtgatgtttagtaatgaagaataattggaatggtactgatttgcatgattggatattttaattatcttttgctttgtcactttccttatgctttttctttaggtcaaaatgcaacttcattggggaccggaggttactatggccacagtccaggatattatggtcagcatattgccgctaatcccaaaccaacaaacaagttttttcaatgcaagttctgtgtacgctacttcaggtcaaaaaacctcctcatagaacacactagaaaggtccatggagctcaagctgaagggagttcatcaggaccccctgtcccgggatccttaaattataatatcatgatgcacgagggatttggaaaggtcttctcttgccagttttgcacatacaagtcaccaagaagggcaagaataattaagcatcagaagatgtatcacaaaaacaatttgaaggagaccactgctcccccacctgctcctgctccaatgccagaccctgtggttccgcccgtatcactgcaggacccctgcaaggaactgccagcagaggttgtggagcgcagcatcttagagtctatggtcaagcctttgaccaaatctcgaggcaacttttgttgtgagtggtgcagctaccagaccccccgccgagaacgctggtgtgaccacatgatgaagaaacaccgcagtatggtcaagatcctttccagtctcagacagcaacaagaaggaactaatctacctgatgtgccgaacaagagtgcccccagccccacttccaactccacctatctgaccatgaatgctgcaagccgggagatacccaatactaccgtctccaacttcaggggctccatgggcaactccatcatgagacccaattcttcagcttccaagttttcgcccatgtcttaccctcagatgaagccgaagtcacctcacaattctggtctagttaacttgacagagagatcccgttatggaatgactgacatgaccaattcttctgctgacctggaaactaacagcatgctaaatgactctagttctgatgaagagttaaatgaaatagacagtgagaatggtttaagtgctatggatcaccagacatcaggcctgtctgcagagcagctgatgggctcagatggcaacaaattattggagaccaaggggattccatttagaagattcatgaataggttccagtgccccttttgtcctttcctcaccatgcatcgacgtagcatctctcgtcacatagaaaacatccacttatctggaaagacagctgtctacaaatgtgacgaatgtccgtttacttgcaagagctcgttgaaacttggggctcacaaacagtgtcacacgggtacaacgtcagattgggatgctgtgaattcccagagtgaaagcatttcttcctcactgaatgaaggtgtggtgtcttatgagagctcaagcatcaatggtagaaagtcaggagtcatgttggatcccttgcagcagcaacagccaccgcagccaccaccaccgccgccgccaccaccaccatcacagccacagccactgcagcagccacagccaccacagctgcagccaccacatcaggtgccaccccagccacaaacacagccaccaccaacgcagcagccacagccacccacacaagccgcacctctgcacccatacaaatgcaccatgtgtaattactccaccacaactctgaaagggctaagagtccatcagcagcataaacattcattctgtgacaacttgccaaaattcgaggggcagccctcaagcctaccattggaaaatgagacagacagccacccctcttccagcaacactgtgaagaaaagtcagacctcaattcttgggttgtcctccaagaacaattttgtagctaaagcctctaggaagctcgccaatgactttcctctagatttgtcacccgtgaagaagagaaccaggattgacgagatagcaagcaaccttcagagcaaaattaaccaaaccaaacagcaggaagatgcagtgatcaatgttgaggatgatgaagaggaagaggaagacaacgaagtcgagatagaggttgagttggacagggaggaagaaccgacagaacccatcatagaggttcccacttccttttctgcccaacagatatgggtaagagataccagtgagccccagaaagagcccaacttcagaaacatcacccacgattacaatgccaccaatggggctgagattgagctcaccctttctgaagatgaagaggattattatggctcctcaacaaacttgaaagatcaccaagtttccaatactgctctgctgaatacccaaactcccatctatgggactgagcacaatagtgaaaacacagactttggtgactctggaaggctttactattgtaaacactgtgactttaacaacaaatctgcccggagtgttagcacccactaccaacgaatgcacccatacattaaattcagctttaggtacatcttggaccccaatgatcacagtgcagtgtacaggtgcctggaatgctacatcgattacaccaacttcgaagatctccagcagcattatggcgagcaccacccagaagccatgaatgtactcaactttgatcactcggacctgatctaccggtgtcggttttgttcatacacgagcccgaatgttagaagcctgatgccacattaccaaagaatgcatcccacggtgaagatcaacaacgcgatgatattttcaagctatgtcgtggagcagcaggaagggctgaatacagaatcccagaccctgagggagattctgaattcggctcccaagaacatggcgacttccacacctgtggctcgtggtggtggtttgccagctacgttcaacaaaaacactcctaagacctttactcctgaatgtgaaaatcagaaggaccctttggtcaacactgttgttgtttatgattgtgatgtttgttcgtttgcaagccccaacatgcattctgtcttggttcattatcagaagaaacaccccgaagaaaaggcttcctactttaggatccagaaaactatgcgaatggtgtctgtggacaggggctctgccctttctcaattatcatttgaggtgggtgctccaatgtctcccaaaatgtccaacatgggttccccaccccccccacaacccccgccaccagacctcagtactgagctttactactgcaaacactgttcctacagcaatcggtcagttgtgggagtgcttgtccactaccagaaaagacaccc

SEQ ID NO: 134341 - DNA, 2618 bp, Homo sapiens
tggtcttcagtgtttgctacatgaacctaacgtctccaggagtagattttattttatcaagaagttcattaatggcgcaactatgcaacgtttcacctgcctagttgaaactggtttgaaaaccagatgacttagtggcagtgacgatgagcttctgcacagaaatcttctctactcacaagccgtaatgtatttgggtttcaaagactttgcatagtaggcagcgtgccatgatgctgacaaatttgttatataaaaatactcgcctatatctcccttggtttttaacctgctaatcggctttaaaataaagtatgttagtaaactgcaagaataaattctgacaattgagggagggctcggagtactgatggctaccactgtattttaccagccttttggtcacttagaagaggtgccaaagatcaaggagaggaaagtggtgggctacaaatgtaaattctgtgtggaagtgcacccaacgctccgagccatctgcaatcacctccgaaagcacgtccagtatggcaatgtcccagctgtgtcagctgctgtgaaggtgagaactggaaggtctggatgagcattgtgtgtgagcgattcgagttacttattaaccccattgcctaaagcagctcaggaaagagcatctcagaatgcgggcattcctgaattatgcttggattggtttggcttgttttgatttctttgcaggttggaccttcctcatctttctgttcagggaaaggtcgagtttcgatctggtttccttccacgcggatagtttggtggcagcagaaggtccaggattctcggtctaggaggcttcgggtcgtccttctattctgcgtttagtgccattagctcttcgttcttccaagttgcccgagctcttgagaggaatcaagtgggttctgttcccatcatcttctgctcctctttcttcctgacttcttactgttctcatctggctgaggatgcagagagcctaggagaatctctttgtcttcttatcctgggtcctctggggactgcaagagacattaaaactaaaagcgttcaagtcgcaattgaccctgaaagccttggtttgtctcctccatcccctctcccatatgatgctgacaagtgtcttcccttttccctctgacttttattaggccacctgttttgaacatcataatcctaatagcagccaccatgtcagtaaccaagccaccatccccgtcttccaggatattgctaagccctattatttattaaaacagaagtcattttggggttctgccctttctctaagggtacacgcgaacatatttttgtcatctgcccttcttgagcttacatcctattttgccaatttaacatgaagataaagtctctacttttcttcactgaagactgaagctttctgtcttttggcagaacagtggcaacccagggatatcagcagtcactttctttcagacaccactgcggtgtgtcccaggctcgtttcctgggatcatgtgagagagacagaagggcttttcctgtgtaatcagtaacccaaggagctatctcgaaaaacaggtgacttaaaactaggctgctccttaattttttgaattgattatgcagcagtctccagtcatagagtgaagtcaccatctacagggtagggggcagacagcgggatcttttgctttgcttcctttccagataatggcccaaggctcctcaatgaccatactactttgcttttctttctcttcctttcttcctctcctttctgtgagccacaaccctagcccaactttatgtcaacttagatggggttgcagtttgaattttcttttaagatggggaagaagtgagtgaagtgtcttcagagtgggagaagcccttgttcacatttcgcaaacagtagcaacctgtgtccgggtatgttgtcctaaaatcacctccactgcatgaagaatggcagttgggcttgctctccctctaggggtagctggagaggcaggggaggaagctttgacaagaagtgctgttgagtttgggagaatgtagggagaaaaagaaagctggaggcaatgatgatggatatttattttgttggtggggcatgtgtgtgtgtgtggttctcttagcaggaggcggatgaccctgcccacttgttcctggatggattggaagcagccaaagacgccagtggcgccctggtgggccgggtggatggtgaacactgcttgcttgatggaatgttggaggatgaaacccggccggggggataccattgcagtcaatgtgacagagtcctgatgtccatgcaggggctgcgttctcatgagaggagccacctggccctggccatgtttacccgcgaggacaagtacagctgccagtattgctcgtttgtttctgctttcaggcacaagtaagtgctattggggggtcactagtggttactgggagatgatgtcatagtggaaggcactaagctaaagcagaagcttggatgagtaagaaggccccactcatggttcacacctgctgctatgttacctggagcctcagtcaccttttctgtaaaatggggctgagaacaggagattgatcggatggcgttagatttg

SEQ ID NO: 134342 - DNA, 1900 bp, Homo sapiens
tgttcacaatgaaagtagaattagaattcaaaaagaaagtcagctcttttcaaatgctaaatttctctaattcccattctgttatttgaataagttagaggactaattgataggcactctcactggcttggcaggaagcttgaattcacccatattgtaccttctctttagatacactcttccaatgatcagagctctaagaagggacaataaagattcttaccatgacctgttaccactgccatatctctaaatccaaaaaaaactcttgatctcttcctttagcttcctgtcctcttagagtaggtacaactcttgaaaattaattaattaaattgataaatgccattattggaaagtaaacaaaaggactttgaacgacctagaagtaggattcctggaaaaaaagcaatgagcaaatcctctatgcaatttttaattttgtcatttttctttttgttttccttctacatcaagtttggatcgccatatgcaaacccaccacggacaccataaaccattccgatgcaaactctgctccttcaagtcctcctataacagccggctgaaaacacatatactcaaagctcatgctggtgagttgtgcattgatgatgcacaagttctttagcactctctgagtttgaaacctgatgatctttattgagtgaaatactgtcctgccttacacttgagaatgttattcttgggatggatgtatattcagttttatttttacctagtaaagaaaaaataaagaaaaaagtaaaagttaaacaaaatcacctaaatccaaaataatacaaagcctatgtcacccatgttatggttagttcgttcgtcctactgacaagttagaattagactgttggtgatttttacagaaatttctaaactgcctatactttctaattcaattgccaagaattgttatatctattaaaaagactttccagctaaaataaagttaccaacttaaggaagttagaaagggcaaagggaactcaagatgtgtgagatttttcaagagatacccttagatatgtttccgtacataagacagaaatgactttgggttgtgagtgtccagcagctgtgctggtctctatcatattgttgttccatctcattactcattagaaaaaattggaaatgaaagaagaaatacagtcagtcatctataatcttatctgaagaccactgttgttgacgtctgatgtgtcatgacccttacccaccaggctgtgcactaggcgtgttatatgcatcatcttctttagtcctataatcgtcctaaaggggaggcattgtgtcacattccttgtgccttgtataacccttggtcacagtttgaacagtgttgtaagaactgctcagaacctgggtccttcactttcgccagctcctcatgctctgtgtaaacaggaccatgtctcttcattgtcttctgagtgttggattttgttgaactgacttaatgcagtaagattacccaggtctcccagttgcctcaaactccactaggagtaaggaatgggacagggaagttagctataggggcttttctctatctttttgtatttttctgtctctgggaaatttctactaaagtccttgaagtgagtggcttcagggttcaaatcactgttttctaacttgtgtatattgtaaattatccagctgggacactatcctggtgagttttgcccataggccttagccttgtcaaaagcacttttaccagcgagagctgggaagagatgattcggcctgtgggaaagacttgaagagagcatcagagcctgcacactgatgccagcgtattaagctgaagtgtctgctcttggaactgacccaaaaaactggcctccctgtactcactggctggcaggaagagagc

SEQ ID NO: 134343 - DNA, 1063 bp, Homo sapiens
tcttacttttaatccttagaccacacctctgttcattttcactggtccacaaaactttatgattctgttttctcttttttcttctctgagttttaaatgtcaccttaaaaattaattttaaaaatacatgttcattagagaaagtttggaaatgaaagaagaaatacagtcattcataatcttgttatctaaacgccactgttgttaacatttcatatatttcctttcagtcattttctctgtaattatttttaatagttgtaattctaatgcaattgaatatatatatttagcctttgtatttacttttatttttatgttattataaactccaagaatttattttaattgaataaaataaatcatcaataggatatgcccagatttacttaatcttttccttatggttgtaaatttaggttatttcatacctttttcaagcataaatgatgtatatttctaagtaaaactttatatttattaaaggatatcttcttattactctttgaaatggagttactgggttggaaacatgagcatttctaagtctattgttcttaaaagcaaaatggctttctgaattgatcttaccagtgtatatatgtccaacaatttaagcctgcccacttcacactcttagttcttaaaatgtaattaatttaacaggtaatatatggcgaaggtaaatcacactttaacttaatttggtcatggtgatctgtgttgtatttcagtggcataaaattaattttaaaagtagtgcttatttttactgagaggcagtctttattgaagaatattggagataaacacacacactgtaccccctaaacccccatgtttacatatacagctctcttccttagagaaatgacttatttttacccatttctgtgctattgactagataaggaaatggagttctatgctgaggtttatgaactggtccaaaaatatatatatgtgggatgagaatgtgtatagttagcaaggaagtacagaatagaatagcacaacagagcttgcactgaatgactttgtgattaaaaagccactaatagat

SEQ ID NO: 134344 - DNA, 1614 bp, Homo sapiens
aagagtttcaactccaaaggagtactgtggttgtggcaggttgttggtctgtgaggttcgttcatagaacatgaagcttgagatgcgcttctctagcatgagttaactgagttatcttgtttccaccctggccttatacccttctcccctctttttcctgttctatttcttgtcaccatcctcttccaggtgagcatgcctacaagtgttcttggtgctcattctccaccatgacaatcagccagctgaaggaacactccctcaaggtccacggaaaagccctgaccctccccaggccacggatcgtcagtctcctctcctcacactcccaccactcctcccaaaaagctaccccggctgaagaagtggaagactccaatggtaaaaatgggcttccaagctggaattaaccactcagggttgaggtgggctgggattcattgccaatcattttttttagaggaaaatcttatgtgaaaacatgatggttcaagtgaaggaagaaatatgaaaaagttgaaatggtgtggaagttggagtgggaaggggaaatgaacttgttgagcatctgtgtgacgccatgatgaaaatggaattcagtgctcatgggagtgttgctagtggaaagagcctgtcaagtgggatggattagttttggatcgttccactgtggtttcaagcaagaaagcgaatacagtaccaggccaatttgtttgtttttatttatatcctgtcttgttctaaaaatatgtgctgcgaaatgtttggggagacaggtatgtacattaatgacacaaaattcagagtaggagtgcaaagggtgaatgagtggggaagtgtgtctgactgagccacgtgataccttaggggtgacatagggatttcttacagctaaaggatgctaaggaggcatgagttgggaggagagttttactgtttagttttggagtttcagaagaaatacaggaagccagggagagggtctcctcgctagcaatgtgaccaaagctgtaggggagagaaagagtccagaccttagggcctgcagatatggcatagtaagcaaagggatagtttattgtttttataagaccaggaagcagacctgcttgatttctcatctcacctcaaatgattgcagaatcagctgcttagaagagaaggagaggaagtctgcagattcttcgaggtagacctgctctcttccaaccccttctaattcttgaatcccttctgcgggagccagttagctaccatcagcttgagtacttcccaggtcaaggaatgactgtctcccaagatctactgttacattcttgggaggagcttagtggactggaaagaaagcagaacaaaagcttgggtttgaatctcacttctctcgatgatggtcacgtttccctgggcaatcttagcttcttgtagccgtatgtaaaattgtatagtgatatctgcctcaactgattatcttcagagattaatgagaaaagatacgcacctgtaaaatacctaatacagcctctgacacatagtaggaatttaataaaaggccgttttatttctgtacttttcatcctttggttgcaattctggcctttgggaccatttataaca

SEQ ID NO: 134345 - DNA, 1073 bp, Homo sapiens
aggacttctgtttaacaaagaaggcttgttatgatggctacgacttgtaatgaagtgaccacacaatctccttagctactgtgtagtagtttaaaatggggaaggaagcctgtagtgttttttttttctcttctgggaaaattcagagtcacacatctagggctgggtgagagtacctgtggaagggtaaagaaaatgtccccttttcacctgaaatcttctattcaccaggaaaggttggtatattgcaaccagaagggcaaaatctaacttgactcaaattgtaggatctgtattaatgtgatttttaattaattgttttcatctgacatggaagctacatttgtggagctgtttggatgaaacagattcatctcagtgccattgctagcaaaggcttttgctgggacatttttctcaatgtcataccttctttttcctttgtctgtcttccttgaaaggtgggtctcagtcagaggtcaagggaatcctttaaacccacccactgcatgtatcatcatcctctgcatagactgagaagagttgagttcagttatactcttgagcctgtactctcttctgagggctgtactatgcacggaagaatcagaaatgagtatagtatttttctggccctccgacaacttaaaatcaactgtttagatgatactattagcgcttacatttgagctaaccataaccctaagcctcaggcctaatctatttgtggagtgatttcagattcttggaggatggactgtggggaggagtgggtgtcacagaaatatgacaaagtgacgttgagtagctctctctataacatagatattctgtttttgtttagccacagggaaataatttgcaatatataaaagggattcttacttttatccttatgacagaacacagtaactgaaagctctgtgtggtaactatttagtgatccgtacacaaaagtcattgggcctgtactgtttttaatgtatataaatgacctatatcaatggatcagcagtgattaatttgatgacataaaagctgattagatgaggtaaacaaaaagaaggctattc

SEQ ID NO: 134346 - DNA, 1048 bp, Homo sapiens
atgtttcaccagcacacgaatcctctatatattcatgatgatcagttgttggaaagaaaagcaacggctctatggtattggttttgtgtataagataatgggcaatgacatgtaattgctattctaaacaatgcattaagaggaaacaataaggttgtcaacaaagggaaatgctctgctgtgtttgtgtttactgtgttccttctcctgccatatacaacacaggactagcttttatccggctatttccaagtctctgctttcagtacagaaaaatacacatataggcacagctgtaaaataacaaagaaactaggacagcgtagtttagctatgagatttgttttaggtctgagaagctacacaggacatgggcaatggatacgtaacttaaaattcaactatgtgttttataagaagtcaagccagtggtgacattccatctttttcctccctctagtttctcccggggactaataagttattttgtttcatctatctatgcagttatgctatggaattgcctgctttagaaaatagttactatgatgcatttaggacaaaaacaaaaatcagaccaggtgcaaaatgaataaggtgaatgatggtaacatagttttgttttgcgcgcgcgtgtgtgtgtgtgtgtgtgtgtgtgtgtgtgtgtttgctggtgccttagttagcaacccagagaaaacagaaagaacacttggttgtgatacccctccatttataatatagaacttgatatagtcctcccaaaagagaagtctgtgatattgtgaattaatagaaaaatgttgcaaggagcttggcaatttccttttgtaccgatttttaaataaatttcaattggtttttctgctctaaactctagaataatatttgacaaacactatttttatcaagacatttctcatcaaggaaccacatgtacttattgtctgtcatatcaaagtcttcagcattgcatccaaagttcaccatttagtcatgctttctccattgcacagtggcttcactagcaaatactgacattcctacc

SEQ ID NO: 134347 - DNA, 1130 bp, Homo sapiens
atatttgtgcatgaattacatttaagcttaaaaggaaacccttctctaagaattatgttgagtctatcaactcatttaaccttggctgcagcaatgcttgacaactaaaaaattaagatctgggatgctttatttttgaagagaagcttttcagatatctaaataggtcagacataaaattcagcctttaagaggatccagttagttgctagggcatcagcccttccacacaggttccaattgcaatcagattaaaagaaaaaatgaggtggtttctttaaaaacgacaatcatgaaatggagactcccaagtgaataattaattgtaaaatacaaaaatttacatcgtttatagcacatgcgatgtaagacataattttaatggcttgactataatttttaataggttctgctggtctcaaaattatctgaccagatactaactaaccttctctttttgacatcagaatttctccatcaaaatgtggcctaaagttcattttaacacttactatgtttctatatttctactgtaaagacttaagaggtctgcaacttcagtggagcaaagtggcattgaagaccccgaatcttctgttattacctggaaatctacagggattaaatgttaagactctgcctcagtggcaaagagcaaccctccaatattatcaccactctgaactcaaaggtcacgtgatacacgcttcccaagataccaacctgcctgggatttctgtgactttgaattagccatagttttgtggctgctatcatcctttgtgccagagatgaaaacatttcaagtataggctttccatgtcctgggaacttagtcaactaattcatctccctgttcccatgccaacaaaaacattgttcatcagaaatgtaaccatatactactaaacttattcagaactagttcccagcaacactggagtttgcttcataattccacatctgactttcaaatctctgggtgaactgcttggagattacttcaagtcttccagacctcatttgtggaaagtatctaaaagagaagaaatctactttattctttagcagaaaaatatgtcagtcattagctgaatcatctaaagcaattaatctcagttattttttaa

SEQ ID NO: 134348 - DNA, 1971 bp, Homo sapiens
aatttttaccttctgatgacaaaagtaataccaactcgtgactaacgaacagctttatggcaatacataataaaatgtaagggtcacccatcatgccagcctctccctacccagaataatctctattcacagtttgttgaagtcatctagatatttgttctatgagtatacaaacataggttgtcatttagtttagttttttttttttcttcaaaactgaaccgtactacacaaactatttttctttcatgtgtttttgctctcactatataggttccatcaccacatgacttactatagctttgaaatataaggattcatatcgcaaaaataattccttttcaaataataaatattgagtacttaaaggtttcaaatatatttttatgtataataaattatatgtatattatatttaaggtgggattctcagagttatagaaggcctttgagattttgccaatcaaaaattcattaattttatcttaaggctcactcacctcctcaaaaattactcaagtagagtctgtttccccactacttacttgagacttaatacatttacagtattggtgaacagttcttaaaagacaaaaatcaagattacagactgcctagactgttcagagtaatgggctagaaataagactttgtgaaaggataaatacaaaataagttgggtagctgatgacccttggcatttatttccattcctggacttgccaaatattcttataattattagctaccttacctgtgtctccagctaaactgtgtgctctccgaggtcagggaccatttcctattcatttctagagccctagcactgggtaggccattcaatagatatttcttaaattgttttgaattaggacagcaaaagcaaccgcacacaaggaaagccaagagaacaatttatgtgtgaacaagcctgggaatctggaaaaagccaatggaatctggctgtgtgtatagcaagatgtgccatcccatgttactgcacttttcatgcatcattcccttgtccttgagttaactaacttctcccttcctcccaccccagtggcaacaccatagccctttcaactttctgcaaatgaagcaactaattcctttttttccaagcagccacggagacaagtgggtaccttccttactttctgccacctcttcagagtacttctacttcctttgtttaatgatcctttttcaaatgcctgcttcctgcttattttcttcctctcttttggagtattcttttgtcttcctctatgaactcagtgactggctcacagccttgctttccaatccaaatgtaatcttcatgctctggaattacaatagactagactcaatggtaataactcaacagacacttcagtcgcctaagctagggaaatttgtctccttcctgactgtcctccagctgcccacctgtggccaaattcaccataacagctccgtctccagcacctcaaatttgcctttactctgaccactgtgggtggatctccttccccatccaacctagacctgaccagagggttagccgtttcaaaggggctttctccagcatcctggtttctctcgtcccctcgtcctctggtttccaacttaccagactccaaccctgaataaccttcactcctgcccttcctctgatgttagccagtctttctgattctaacctccatcttttccaatctgttttccaggatatctttgttaatcacaaatcaaatttacttttcaaaataaatttgagctgagtcagacttatccctatgtaatgtcagtttacacctaagtatttcaaggtattttcttaagtgaaagagacaggaatagagccacaaccaatgtgctagaagttgcaaatagctgcagtctatcttacttgtcccaaactaaatggagtgagcagctgtgtggttagtagctgtggcaatcacaaattattgtccttgtgag

SEQ ID NO: 134349 - DNA, 1437 bp, Homo sapiens
ggcttggtggcgagcgcctgtaattccagccactccggaggctgaggtgggagaattgcttgaacccaggagacagaggttgcagtgagccgagatcacaccactgcactccagcctgggcaacagagtgaaactccatctcaaaaaaaaaaaaatttaagttcaaggtttaagtaaaatattgataagatttgctttttctgttttaaaatgaaagctttttagttactttttgaatagcttcattattatgtgcctctacccctataacttaacaaaaaggtacatagtacttttcactgtacttctttctcttctgattttttggggtattttctaaatcacggcatgcctaggagagaacgttgagtaaatagatatcatccactatgtgttgccaagagcagaataagagttggagaacttgaggtcggagaagtaattctgtgcaagtgtaggtttaagatttatttatttatttattatctttttccaaattgagagaaagcaaaaaacaagggtaagaaagaagctttcaaaactatactgtgctgcacacgttggtggttgtttttatattaattatcataatcccaatgaacagaggtgactctactgggactggccatataaagccactgttaataaagtactgagagcagcccagccgcacagcactagcccaggcagagcagctttcactgtgctcctgggcttcctgtatccaaaaggggaaggagggttgttgacagcaacggatctgcaacatttgagggtaccataagcctgtccaagttccaccccaggccttcttgcttgcctcagccccaatccggcactctcaccctggggaagcatccagatgttccatggaacctcttctccaagtcataacagtgttgtgtttttttttttttttccagtggaattttggagtcgcggtgctgtagcggcatcaagtgtgactctttcggtgtattgctgggctcattttgattgagcacataccaggagggattgttttcacccaactggagctagtgaacattaggggcaaatgatctttttgaacccacttctccgtatagatcatctttacttaatggtgtacagatcacacgggagatgctggaaccatgagtttgagatttggcttgaaagctgctgcaggctcaagtccaggaagtaccattcacattgttgttaatgaaatgtacagccttaggtagaggtcctgtctagctccctatcacacatgcatgtccttagttaaagcatttaccctctctgagccttggagtttctaatatgcaaaataatgatgccgactttatggggttatttcaaggatcaaatgagataacacaatggaagtactttcatattctaaattactgtagaaatagtagctattattaaaatactatagtagaagca

SEQ ID NO: 134350 - DNA, 1035 bp, Homo sapiens
actgattgagtactttgtaaacattgtttcattttatttaagccatacaacaatcccatgagacaggaacctccatgactagctccttgctgtttaggaaggaggaaaataggcttaagcaagttaagtggtgtgccctgggtcatagttaaatccagcagagttgaggttagggggcacatcagcctgactccaaagtctgtttactgtgccactgcttccctaagcctcagttcttagatgtactgtttttccccaggcaaatcttaaaaaggttatacatgaaccccaggaaagtgctctgtgtttgaaatattaaaaccattcttggatgtgaccttctgcgatcttatcttccaaatctcttggaaggaaaaaaccaataatcccaacttctactttctcaccactcactctttgcttttcgtaaactgctagactcagtgttctgccttcagcattttattgaaaccactttcatgaagtgatctaatacgggctaactgcagtggcattttctctgggaaggagtcattccttcttgctgtttacacctgctgcctccttggctccccctccctctctctggaattccttgcagcatgaccttgatccctatgactataatgaaatagctttcacaaggatcatcagtgacttcagacaaacaaggtcacggcctctgctcttgcctcatccttctttttttgtctgtggcatttaaaactgctgaccttcctcctggggaaattctcttcccttggttttggtcttgctatgtgtttcaggctctcctccagcctctctgatcatgccttccctttaccttgtttttgccatgtttctcctgctccccttacatgtacttggttctcgtcctcagttctctttgcactctctctctctctttacagatatatgaagtcaacttgccctcttctgatgccaccaatacttccagtgctaacctctcatgttaagtctgagaccctctgttctaactgctccctaccttctccacctgcgggtctcatt

SEQ ID NO: 134351 - DNA, 1045 bp, Homo sapiens
ttccatcatcactagggaatgtgctgccagttggtttttctcacagtgggaatgcatttctaccaagcctcctttcccatctgagaggtcaggactgtgggtacaatttacagacacagtaaaggtaaaactgggaggccactatctcacctgctccctgcttaaagcccttccgtggctgtctacgttgccttcagaataaattctgagcttagcatggaaagctgttcattgggccctgcatttctcactgggatcattcctcaccacttcttcccttgcactgtagctacactgaataccctgtctttaaaagggtcctactatctcacactttagcccttgctattccttcttcctggaatccctttctccacttattttctcttcaaattattttgtagatctatagtgggaagaaagcacctctcagcacagagcctaagatttctcaaaatgagtagtaagcaaacacccctaaagagtaacccatacttagctgtgccagaagttcctaaggaagctgagatgcccttatcaatcatgaaataaaatccaaacatccatgcacactaagaaattcgcgataacattcctcgtgggtagcagggagaaccagacagtcaaccaatacatccactgtagatgacgtggcaagaagtgctatcaagagaaagaaagccatggtgaagggtagaaaggatgggagttggagtgtcaggtaaggtggttggggagggcatcattgatgacaggaatgattgaggccaagcctatcaattggatgccaagaaccttgctcaaagctgcaggtaatcttgaagaatattgaaaaggaaatagaccccagaatcattgccaggaaagcctgtccagtttgggaattgaatttgccctgagatgactttttgaagcaagttgatttgtgaccattccatgtgcattgttaactaacaaaataggagtgaatcattctgtctgtggtattactcaggttgagccctgcctttgagctgaatccaagtcccacaatcaatcccctccc

SEQ ID NO: 134352 - DNA, 1463 bp, Homo sapiens
attcttgttcttgatcaaccatagcctttctcacctgatttccgtgtagcatcacttagagctctacgtgtatctaaatatatatatgcttatacccagatgtgctctttcctcttgattatcgaatcttttaagaaatctccacagttgttccctccgggctctcacagcactgttcatagcaagccatcaattgtgaccaactccttgaagtcagtaggcatcttccctccagtcaggtcttgaggaggaagcactgtggccttgcccacggcctgtgagctctaaataccatctgaggttgctcacaagctctctacggttgaggccaagtcatttatataaagaggcttttgtgctcaacactttttgttggattttttcagtgtggtaaagacatctatatgatctaaacgaacagcaggaaaccttacttcctcatcacacaattcaaaagagtcacaggtgaattatgcattcggtattgtgagagcttctcaattaacaatggcagatgccacccagagtttcctccaaaaaacattagaaaaaggatccttcaccacacattcatttccctacaagtttcctgcctgtttcaaggagggtttttaagaacacacactttgaattacaaatatcatttaatgaagaaggaatagctacagtggcagaaaaaacaaacacacacatttttgggactgggcattcaggatccccaagttatgcttctgtttcttcattggttacctgggcaacataaacccatatctgcttttctgagccactacaagtctttaggcaaaatggatagtctgtatgctacatatctgggatgagtgcatttctaatggaggaaaataggtaaaacagtgtatacagtgaaaatatagttctaaacacctgaaggtaatccatgaataccttctcacagattgcaaagggctctatttgtatggtctcaggtgttgattgtttatcaaaaagctatgatgtatttaaatacatggtacccattacacctgagcatctcacaaacatcgatgcctactgatgggtgaaaaaaatgagggatagagagctgcatactgaataatctcaagtggcttccagatgtgctgatagcatgtgttttgagttttggcttatagctgatttaggggcaagactagaaattaatgcctttggtttcttgagacagccatggattctgaattacattgcattcaagttcttaaatgttcagaagccattgtccgtgtaattaaaaaagacccaggcttatttcagcaaacatggttcagtgtttcagtgggaagactcttaaacctcagtatccaaagagagagtagcatttggtcagttgcattttctttttaaatctgggttttccagaacagtattttcagtttgtactctttttttttttggatgtttgtagcatgtttgttgagcacttgctt

SEQ ID NO: 134353 - DNA, 1484 bp, Homo sapiens
atgcacacatggatacatgaatggatagatggatggatggcctaatttcaaagagatcatagtctggtaggggtaaaataaattaaccttaatacagcatgatatgtagtagtaggggagtctaaggggggaatttaatatgtgtatctagaagggtcaaggaaaatcttcgtggtgatggcagatttggactgagttcagttttgaaagatgagtaagagtttgtcagactgaaaagtataagaaggatattgcaagaatatacaacaatgcagggggaaaaggcataaaaagtgaatattagaagccttgtatgtgactggcattaagcacagcatggaaacagtgtgggcaagggagtgaggatcggcctggaaagatgaaggagagtgtgagccccatggttcagagtttgggcttttttctgtaagaaagtgagtgtcatgatcacatttgcattttagaaaagaaaggaatcatagggggagaagaaactggaaaatggaatgccagttaggaacatgttgcagtagaagttcacacagcaaccacgagggcctgaacaaaagccatggcagtgggctagtgagtggatcacagagatagagtttctcaggaggctgaaccaacagagcttttgactcattgaatgtgtggaatgaaagagagaaatgaatcaaggatttattctgatttcattgactgggtgaatgaatggtgatgtcattgacaaaaaatatagaaagacaaatgaatatgttcccaagtatacgatctagtgaattgaaaagtccaggaatcctccttggcctcaggtcagacctgcctggattcctcaaaaatataaagaaaaaacatgaggcttcacacaaaataaggtctttgagaaaccttttcagtgaatgtaagtatgatgggaaactagatctcaaaaaagagaaagcttgcccattttttgccatgtttgtatcattttgcaggctaatattttgttttgttttgttttctcaatctattccctgatcatatttcaaggttttgtttttactcatcagaatgacaggaagttttcagtgtgtgtttccttcaagtttggcctcaaccttattttcaggattaggcgtttgtttttccgtttgcctccatgacaacggagtccagaattcctatatatagtcatccagcatccattgtccccctggccattgtatcataatcttgtgcgtccaggccagagagctccactgatgacagtagacaaggaggtgccagagtccttggcctggagattttcaaggcataatcaaaagaaggaaataaaataatgtgactgcctttagaggcgtatgttcccccttagacactatggaatggaaatggtttgtattctaaagcttagtttcgaatataattttcttttggaatagcccatagataaagaacatttttgaggctcttcagaggaaatacttggaaagttgcat

SEQ ID NO: 134354 - DNA, 2180 bp, Homo sapiens
gttctccctcaacctcctcactttgggcatttacaatatcttaagttatccacagataatattctgtttctaatggcccatgctaccaaccattagttgctaaatagtctgcttttcagaagaaaattacaatccatgtattattttgaacttcctatgctattttagaacttggcgattttaaattgtcccttacacaacctaccccaccctctgatgtacatgtttttctgttcagactcatcatttctttaccctagggaaattaagtcattttttttcattgtgataataatgtagttgttgaatttctgtttagtttctccaaaatgtacgacttaaggtggaggtgtagtgagttgaacgtttaggtagctgcgtgtctagtgttgatttcattaattagcacactaattaatactagttatatttattaatggacactcatagttctcttgacatcccctctccatctctctcactcccacattctgtgaggcacaaagtgctgctgatttttccttccttcccctgcctgtttataaatacctctattaaaacattttgtttgcattgtatcacgatcaattatttacatctttgtctgagaaagtgagttgcttgaggtcaaggctcaagtcttactgtcccagaacagggtctcctatttacttaaatgctcagtaaatatttgctgaatgaatgggtgtaattgaatcatttgccccttggccacctctaaaatttgcttgcctaaaattccttgtcttttattttttcttggtacttgattcacactgaccaacaagcctgtcttccaagtctgcacaaaaatctagctcaaatataattaaatgtactcgctggcaccaaggtacttctgttccctttcaccttcactcatattctctatgcagggctgcagaaaattgagaattgatcctctggtatagcttcctctttgtatcacttagagcatgcaagggggctgtcctctgcggctcctacaatttgctgcccaattgactcttattcttccttgtgtcttccttaaacttacaatagctgaactctcctgttactgttcatttgttctctttgcctcttttattccttcaatcagtggagtaagtttactagacatggagaggcctgtattttcataagtcaactgctcaactgtctcccctaataaatatgagtttctagaaggcatctctcatgtcttctttgactttggatccccagagccagcacgtgacctggcactagcacaatgttaactaaatgttgtggaattggaactgtgaatactcaagaaagtctcattctctcaggcttatggtccatttatttgtcgtttgcctttataaagtcaaatttcttgtgattgtttcatttttttctctaagttttggagaaaaaaaggaaaaaaatcaaaacaactcaaactgttattctagagagctggaattagcaaaaaaaaaagtccaatttctccaggaacatgaaaaatgagagggttaggacatcccatttagaattcagcccttacctggtttgaaatcctgagctgttcaagagccacgaaaaagcacccatctctcatttgcatttgtgtatctttcttttcccagccaaaccccacttgaggaatgttagagtgttattatttgaggacaatttatcaagcatctaactaaagcatgacatttagacagataggtttccagttctgggtatttgcagggcttatcttcacaacatgcttctagaaatgtctcctgtgtggtcccttattttgtttatataagcattttgaaatttcagatattctttctctttttgagtcttgctttattttttttcataatgcttcaaaatgttagtgttttcttccctattcattttagtgttattttctgtctattctattatcatttgcatctgttctaatgttattttcttaactatttcaacctttctatcactttctctctttcctctctactatgtgtttattgctgaagcaacgttcatgttctttttggctcctctgatttgtatcacagaaccctagaggtcaccattgagaacagatgcctaagacacaagactcagactttataatcagacaggtctttgttcaaatcctacctctgcttcttcgtgtctatgtg

SEQ ID NO: 134355 - DNA, 2062 bp, Homo sapiens
tggtctctgggtggattgtggatggtagacagatcacaggccagcaggacctggctttggccttgctggttatagaatttctattctgcagagctaagagtgcaaactaggaccaacattaccaagaggacagaagctatctggggatcctggctggcagtgctcaacttacagctcaagcctgtgataacaggagaggtggagtgtgttttgtgcttcattgtgcatgtgtttcaagcagaaactagacttgagggcttaaatagaaaacatctcaaacaatccatgaaatggtaaacaaacctgctattgaatgagaagaatgaaaagttgacaattgcattattgtgatccagagtgggttcatcagctagggtagaggaataaagaaaaaggagataaaagaactgggtaaaatgaattcagttgtcattcctttcttcctttgtcttccatttacacctggtaatgaacctatggaggcttggagacattgttcaggtttccttttgttttatttttgtgtgtgtggcaggtttgtttacaatttccaaaggggtttttctcaatcttgaggaatatgaattgaggaggcggggaggagaacaagaaggggaagatatttgagtgttttgcagacaggcggtggcccagcaatcagggaggctgctctgcttttgttttcctgttcgaagaggctgacgggatggatggtgctggtttcatcaaatatgggttttagagaattcctccatgtcctgccttagggaattatgctttggaaaattaagtgtccatcaaatcaggaggaggcttgtacagtttctatcccctttcccccctgctttttgaaaggcttaagaaaagagccctttgttttcttttcaaggaaagttacactgaaattcatctgtgtggtattcatggacttcatttgtgtcattcataggcagctgtaggttatataggacaatgtttttgaatttctaacctccacattgcaagcagcatgttgggaaaaggttcaagaccttttacttttcctctcccccaacccctttatttatttatttttacttttttttctcttctttttttttaattcaaagaagaaacgctgagatttcccctcctccctcctagatcagatttctccaccgcatgccattgaagcttctcggggttaagatttgtgcctgtcatttccgacattttcctcagaatcgcaaactttaaaatacctttcagggaaacttgtttggaatttcattttaatgggatttatgaataaatctccatcttaatgctgactaagctttaaacatccattccaggagaacgctattggatttttatattttaaaatttaaatcacttgagtgtgaaggcataaaacatttttatatttgtgtgagtgccttgtgcttgagcatttctgttaaagactgattttttttttaaatttggttgcttgaataaatctgggctgcaaaggaggagatgttgcatcatgtcctttcctttctcgtgtagacgcctgtgtacattatgcaggtttattttctcacctacagggaagggtattctgtggcaacctgttgccatgctgcgatttcctttaaaaaaaaaaacaacaacaacaaaataaaacaaaaaaacggtttactttcttcctacactttgaaacctttaacctcaaaattttatttttaaataccatgagccctcaaagtcagattaaaagaggtgatagttcctcccggcatgcattccccaaatctgtgttgtagaatgtaaatgaagataaaagatggaatcataatcatccctcttaaaaaaaaaaaaaaaagaactctcaaaactaacattggtcaaaagatgcaaacattccgttataaaattagtaagttctagggatccaatgtgcagcatagtgactataatttataatacttgaaatttgtgtggtgtacttgaaatttgctgggggagtaggtcttaggtgtgttccctgcacattacaaatggtaactgtgaggtgatggatacgttcattaaattg

SEQ ID NO: 134356 - DNA, 1053 bp, Homo sapiens
actcatcatattcagagcccccagatgttcagcagcagttgaaccactatcagtcagctgccctggcaaggaacaacagccgtgttagccctgtgcctctttctggggctgctgctggcactgagcagaaaactgaagccgtgcttcactgcgaattctgtgaattctcctccggctacatccagagcatcaggcgtcattaccgggacaagcatggtgggaagaagcttttcaagtgcaaagactgctccttttacacaggctttaagtaagtgacgtaatgaacagctatggaaaacaaggcggccgcccctgctccacccctcactgcaggcttcccttacactttcctacttggagcttatgggaggccctgcccatgtgatgatgtaggggttgggtccaggcttcatggaaggagggtagtttcagaagactgctttgggatttgggaagggatgaagagctatatcagaacaaatgagttttaaaattggagcaaatgggctctcaagtagtgtaagattgaagcaaatgatttcctcccatgcgtggagtggtgtttcccttcagagaactgtctcctctcctttttttagctttggaaaaaaaagtatgttcttggaagcaaagtcaaagtcaagagaaaacatccggcagtagtgtcttccctgctcccctgatagaaaattctttaattcttaagatcgtagtattgaaagacacatagagaatcaagaccctggcacttccaacactacacttgagcaatcatagggagattgctccagtctagaaaaagagaatccatagtcacccttgcccctgtggatgacagaattgatggactcaattattaagaatggaatgcttcctatgatgtaatctaagcttctgcatttgaatctcatcctgtgagatagcgtttaggttagtggttacaagtgtagagtgtggagcctgactacctgggtgattctggacaagtcactaagacactatctgtgtccctattttgttaacctataaaataaagataataatagtacctac

SEQ ID NO: 134357 - DNA, 1653 bp, Homo sapiens
ccccttacctgtgaagaattatacaggcagtttctaagtcaacctagctttaaaatagtctctctcctcccaagcatgatgaaaaatagttccttttttgggattttgttttgatactcttaacagacaatttttaagaataaggtgtttggggaatttgtttcttttcaaactaagctctgaacccagcccagggcacagtttccagaaagaagttactaccatttgacagtgttcagattcggttgagtgaccaagtttctgggtggtcaacaaacatgatgaacagatttttttttagccccacaagcaggagagccgcacttggacatatataacgggtttgccagcaggaaatgtgaaaatgcaatgatccctggttacacgcatcacctctcctcccaaactctctcctagatctgcttttactatgcacgtggaagctgggcactcagcagttcccgaggagggccccaaagatcttcgctgtcctctctgcctctatcacaccaaatacaagcgcaacatgattgaccacatcgtgctgcaccgaggtaacctttctaacttggttttcttggatgcagcggggggcaggcagcagagatggccttctagggatgctctctcagagtggcagtagcacctgtgccttgttcctcaccttatcttcaggcaagaaaccacagtgataaccacagtgacagccaaaagggcaaaaacaccttcctgctgggagtatttcctccacctggagggaggcaaaggtgatggattctgcagtgaacatttccgtagggcttcccagcatgggggatttgtacattctgacaattctgccacccacagccttgcgtagactgcatagaaggaatgaacaagaaacaaaatgggtgggtgaaagcaaatgtgaaatgtggagagctctatggctgtgagagattctttcaagaagaccaaaatgatttccaaagcagaacatggaacttcccttgaaatggttgaagggagagagaattctttaaaataatgtatattatacattctaataatagtctctattatatattctaataataattagaaaatccatgggctttggatttaaattctggttttagagcccactgtgtttaacctctccatccattaaaagagatgattgtacctatgagataatgggtaaagtgtccagtggtttttcataatggatgcataatgactgctcaataaatgttggttcctgctgataaacagtgatacttcttttaagtccacttcggtctttctttgagttgcatttacccttggccaattaaaacactgttaaacaacagccttcctctgcattggaaggaaaaatatgtagaatctgtttcgtcctgaaaagattcaagctacaggtggatagaaaaagattactggagtactcattgccagtcttgattggtgtttctactgatctttccatctacttcattctttctctccatcccttcttttcatcctcttccctcctatcttcattccttcgcctctgaccttagaaagccttccaatatttgtcacatatgcctcaaaagcaatgagtgtcatctgttgtcttgctgggatgtcactcactctgaaatgctgagtatttgggggccattg

SEQ ID NO: 134358 - DNA, 1129 bp, Homo sapiens
actctcatgtttgtctccatcttcatatgggctttttctctatgtgtatctctttgtgccctcttttcttcttataagaacactagtcattgggtttagggcacaccctaatctagtctggccttaactgattgccatctgcaaagaacctatgtcccaataaagtctggggttccaggtagacttaagtttatgggggacactcttcaacccactacacgagggaagagacaatttaataaaccactgaggtcggtggaagcaagacatgtttgcagaatgttattagacatttccggggtcctgaagagaataggaagcataccagagaagtatgttctggccaaagtatgaagcgcctggatactaatatagaagttggaactttagtcagtagacagatgggaagccaggacaaattctgatcaggttactgatgagacacttattgaatactaatttagcaaaggttgaagcaaaggattggtagacccatctcattcaggaactgtgaacttaggtcagatcaacgtttggtgagattgaccatgatttgatgagtttaactagggaaaaattaagccctgaacttctctttcaaggatgaagtcagtggtaggacttttggtaggttttcattcatgcaacaaatatttattgaacacccactatatgccagccttattttgtttttggctttttgaaggagactttttattatttttatatacagaaaactgaacagtgtacatttaacccagtttagtggcaagtcttttagcttctgcctcttacagcttggcaacacaagccacagattttggaccaaggaccttgcctcctcagtgatgtgggatctcatcatatctgtcattataattggtcctgatggcttctaccagcttagccaaagcgcctttgtcttccaagttaatgtgtgtgaaggcaacagtagtgcagatctccctgtggactagacaccccaatttggccatctccttgataatacaataggggactcccttcttaggactcagggcaagcgggaagacagccagctccatgggatccacatcatgtgcagtcaccatcggctgagctttcttgttctctactgaggtggtaagag

SEQ ID NO: 134359 - DNA, 2369 bp, Homo sapiens
gagtcattctgagctgcttatagggtagccctttactactatagccagaagtagtgggaatatttgacaaaaggactaaggtccctttggggctggaggtcctgtcttatgccaacattcttaagccttttctcgaacaggggattcaccaccctcttggcctcctactttttaatgacagcaggagccaaggccgtcttcttccccttggcctttttttcttttgacatcttgggcagctggaggagaaagctctagcattgttttaagctgtagggatacagccatgaagagtcaggcaaggtttctgcactgaaggaatttgaacttgaacgagaagagagactaaaaaacaggtgaataatagttttatgagggtattcctattgagttgatcaccattggaagcacaatgtttcatgcttagctttgcccatgtatatgtatcttgcacatccatagtgagccttaaaaactggccacagattttagggatgaaacacagttttgccacatatttacattgtaattttggaaccatgtaatcactgctatgggtctttaattggcatattaacttaaagtttctgtttcccaatacatagacaaatgccgcatttaactgaaccttgcaagtgggagccttgggaacggaaataatctcccctaatttatctgatcagtgtcatttttcttgagaataaagtctacagtgagattgccaatctttaattttattcagtgaaattacatgtttcctttcaacttctccaaatacctttgcctgatagaattagaggtgccatttccagttccttctagcttgaggatggcagcctggctaacatcaaaacctcatacttcctaccaggaactgttttgcttgtgtttatgtttgtctatttatggctatgttttgggatgatttatataaaaataatgttattttcttcatagctttctctaatactcagactttgtcacttctttgctttggtgcaaagagggactcagtcctctagagtggcaatttgcacgcaaagttttggtggagtgaagaacttccaatctcattgcttcatgtagacttggcatgttctgggaaggaaacccacctatgttgtggtgtgcctttcaggaaggatttttgctagttgaatctgggctctgcagtggtgtggtttctcgccaatttgagcagaagtgaaccctctgtattgcagctgtgcagaattttccactgacctccatggaggcttgaaagcatgctattctcagctcttgttgcaccttagtacacatgtgcttcaatgtgacattactctcgggcccaacctcttcggttttatgtcctgctgcagcaccaagcatcttttgagtaggaggagatgagagacacaatccatcttgtagttgaactggtgaagtcataatatttttgcagccagtgctagaagctgagtcacaatgagtgtgattcaggccttgagttttcacccaaggtaattttgagaggtgtgaagtcaaaaagacccacagttgtcactgcccccatagaaaaagccctgagcactgagcttctgtaaccaaggcagagcccagtctatacctggaaccattccagtttttaacttttatgtctttcatttgcctcaagaatgaatgacctcattcagaaaacactgtcagtcatttgcccaccttttaaagtctgtctttttttatttttatcttggtcatgttaaccatgtttttagaaaggggaaaaagctaactttttttctaaaattaatatctcagtaaaaactcacataattaagagatttggtagactggcattgtcttagtttggaaatgggaagttctagatttcagatttaagttcagcagggatttgaccctttcctcaaatgtagaaggtgcttgaaagacattcagatataaagggttaccttagaaatctgtagcttttgcattttttaaatattatgaatgaaaggcttataagcacacacatacagactggagagttcttatcaggggtccaagaggagggccctggcagagatcagaagacctgtgttcccaggtcacagctttgtgctgaaccagaggtgtgactttgaggaagtagcttaattgatcagttctcggtttccacatcaacaaactgaagaaaatagaactgactttgcagggtgttatgagaacaaaaagttatgtcaagggtagaacacctaacggtgcttgaaccgtagcgagcacttaatagtctgcagtggtgttcacatgaataattacttgaacttcagggtgttattctgactattcatgactttgtgtaaaattcacttagacacacatagtga

SEQ ID NO: 134360 - DNA, 1048 bp, Homo sapiens
ctaatggttgttgtcagtaatcattaatgttggtaaaaattgcagctacttctattcctcccccttgccttaatcacctccattcaggaattagcaagcacctactagcccaccccacctctatttataggtcattctgggtattaagtacacaaagagcttttggtcttaaaaacacccactcattcctgaggaatatgttgtttgggggttaggggaggggcagggtgcatgtgtgtcagttcaaggaaccagatccacgaggagcagcaagattgggtgagtttcttcttgtattccaaagaaagaacttctgttttgccatcagtaaaaattcccatctttccattcaatttgtttccacagaagagcgtgttgtccccattgaagtttgccggtccaaactgtccaaatacttgcagggagtagttttccgctgtgataagtgtaccttcacctgctccagtgatgagagcctccagcaacatatagaaaagcacaatgaactgaaaccttacaaatgccagctctgctactatgagaccaagcacacggaggaactggacagccaccttcgggatgagcataaggtacttaccaggacttcctgctcccgcctcagcacacttgtggggaggggccaagggggagacaccactgcatttagtcacgaccactgtgtaccagatggagatgtggactcaaagagcttttaaagtgaggtctagtttcttctattagaaacgtaaggtcatttttaaaaattgcgaaacacaggttgggtggaagggaaatcacccataattctaccacactagtccaaatgctgaacatttctggtctgttctctagacccactttcatttgttttacgtaattgtgattatactatacataaaacatgataccttacattttttaaagcttattctaaaagaagtattttgctatgttatttgaaatgttaatacattttaaatgacagggtttggcagtttctataaaggaccggagagcaaatattttagcctttgcaggcctaaaatgt

SEQ ID NO: 134361 - DNA, 1075 bp, Homo sapiens
ttcaaacttcctgggcatttcttccccaaacttaagggtaaattactcatctttttcaaacaaagctttctataattattcacatgtatcttatttacgtaactacctcagacctttttattacagtgtttaagcctccgggctgatattttcagacagaacaaatcagaaagaagattcttctctagttgttgcacggtagcttgcaaatcactgaggaaatccagaaaatgttagaaaccatagaaccagagggttcctcagcagtgggcggaaggctgaggctttgaggtatggatcatggaaatgagttgctcaggaacatagggcccaattaagagcttttgaaccaaaaagatctgggttttaatcttgtctccaccatttactgtgcatatttcaacaaattacttaaatttctgggtctgttttccagttcgtaaatgggaattgttatacctttctcagaagttttgtaagattaaatgaagtcctgtatctcctccactttgagacccaatacattccttagagtatttgttaattgaattgtgttcaaatataataatagatgtacctatcataatggcagctgtgttcccaaagacctaaaacatattacaaaaccactaattatactttgcatcttagacacggtcttttttaaaaattatttttccattgagtattgcgatacaagtggcatttggttacatgagtaatttctttagtggtgatttgtgagattttggtgcacccatcaccccagcagtatacactgcaccctatttgtagtcttttatcccttgcccccctccacccttcctcccaagtccccaaagtccattgtattattcttaggctttttttcctgatagcttagctcccacatatcagtgagaacataccatgtttggttttccatccctgagttacttcacttagaatactagtctccagtttcatccaggtcgctgcacatgccattaatacattcctttttatggctgagtagtattccatcatagatagatagatagatagatagatagatagatagatagatagatagata

SEQ ID NO: 134362 - DNA, 1073 bp, Homo sapiens
aagggctttaaccaaaatatttaaagaaatcttacaactcaacaataagaagataagcaattcagttaaaaatgagcacaagatttgaatagacaccttaccaaagaagatatacaaatggcaaataagcacatgaaaaaatgttcagcttgattcaccacttgggaaatataaattaagacaataataagattttactccccaaccactagctagcatggctaaaattaagaaggctgatagtatcaaagtgttggcaagtatgtagacaaactggaatctcatacattgctgattggaatgtaaaataccatagccacttcggagcagtttggcatttgtttataagttaaacgtacacttgccatctgacctatcctaccttcacataaaatggatggataaataaaatacggcgtatccatgcaatggagtactattcagcgatgaaaaagaatgagctattgatacatttaacagcattgaggaatccaaaaaatgttacgtggacagaagctagacacaagagactacgtattttatgattctgtttatatgaaatttctagaaaaggcaacatgatagagacaggaagcagctaagaggttacttgggcctggaagatgggagcagggattgattacaaaggatatgaaggagcttctcagagtgatgagagtgttcttaaacatcattgagttgtttacttataatagataaattttatggtaggtaaattatacctcaatacctaaaacagatgcaagtttcccataacccaacacacagtaggtcttcaataaatgttaatttcctgtagtctttttatgacgttcatcctgagaacagttatatcaacaagatactcaagatccggattaatgtggaatagacttagcaattggttccaaacagggattcactttttttcccagtaaaacagtgcattgctcattatattcttctacaaatagcattaggtgatttgtgtggtggggagaatctacagaataaactataagacacgtagaatgtattttcagttaaaggatttcattaaaaagaactgaaca

SEQ ID NO: 134363 - DNA, 1071 bp, Homo sapiens
ccttggcttcccaaagtacaggaattgcaggtgtgagccactgtgcccagcctaagacaacatctttaggaaccttaaagtcatgaagaaaaacaaaccttgcacttctcacatttaaaaaatacacacactgtttttaaaagaaagtttatatgcaataccttgttagtgttctttatggttctgaactctctttgctagtttaaggaacataaaaatatattatctctaacttggtccgctcgtaaaattgtcatgttcagtatattaaatttagaaggatagtctattcaggcaatacacattcactaattgaatttactttgaaatgtttttaattttttatataaatggagccttaagcagttgaactcttaagaaactcatatcttactttttgccagtttggggaaaacagcaaaacattaagctcagaaggaatcatcaactttttagttattctaataaaattgctgagttttttggactagtgaaatccacagtggccaaaaaagtcacttaggacatttgtttccagaaaaggaaatgagaaataaacgaagaatctttctccaaagattcttcccaaataaatcataagaagaatttttcccaaatcataaaacacacctttggccacatttttttttggattgctttttatttctgaactaaatgctagcagctttagctttatcaacagcaatgatttctgcaagctgaaggcttctctagaagactatgccatttcgtttctgctttccctcatgcagttctgcttcttggtttgttaactatagctctgtctcttccgtgtgttgtagaagacagagaaaccagaattagatgagcaagaggtgtgaccgtttttcagaggggtgtgtctggcaaaaccttaaacagtatttctcaaatagacatttgaagatgttctttacctgtgccttcgaaaccatccactaaactccccagtcaaaattctttgtcccagattcaaagcttccatagaacttttctctttcctttcttaaggcagatttatttatctcacctttctttcaaaatctaacc

SEQ ID NO: 134364 - DNA, 1100 bp, Homo sapiens
ccattttgctgaatagttaaaagccaacaaatagacaagtgtggaagtggttttgcagtgtcctcacttcattgttaaaggataaaacatttgacacctcatctcacttttatttttatttatttatttattttttgagatggagtcttgctctgtcacccaggctggagtgcagtggcatgatcttggctcactgcaacctccacttcccaggtttaagcaattctcctgcctcagcctcccaagtagctgggattacaggtacccgcccaccacacctggctaatttttgtatttttagtagagacggggtttcaccatgttggccaggctggtctcaaactcctgacctcaagtgatcgactcatctcagcctcccaaagtgctgggattacaggcgtgagtcaccgcacccagccctcatctcacattctcattagacagatgacttcaccaaactctgggttagtggccttcacaggggaccttgagtgaatgggcattcacagatagctttcacaggaataaagatctgcatataggtttctagtctgaattattatgtatctgaacaatccacccttcaagaacatatacggcttcttttgcctgcagaaagagcctggaaggagctgggttctaaatctcaaactcttaagcttgctccttctccctttgttgtgggcctttggggaaatgataataaactgcttctcatctttagaggaaacaagtgtgtttctctcaatatgtcatctgcatcatcaaggagttattcaaatacccaccaatctccgggcccaaaaagtagtgtaatcagttcaaaatatatgggaacttttataaagtctataccctttgactttgaccctgtaatttcacatctggaaatttagcctataaaattaaaactaagcatgaaagaaaggcttaaatacaataaggtttattactttttgtgacaaacatgtttaatagtggaaagccagaaatcatctaccgtaaattcatacgggaatgaatagtcaagtaaactatcatatgcctacttgatgaaatgctatgtagtgattaaaaattatgtttattcagagaatgat

SEQ ID NO: 134365 - DNA, 1074 bp, Homo sapiens
acattattcagtctcagtgtctaaggcctggtacgctgaggctctttacatttgtcacagtcgataatgatgttcccatctgccaggcacatggaattggtggcattcagcaaatctttgttccagtctggtcccaaagactattttggaattgtcttgtaaattatctctttcctctcctgtgtcctcatcatctagctgtgtcctcatcatctagctgtgccctactgtggcagctagggaagtcggcctcggaatctaattaatgatgtctgtcttccctcttcaactcaactgtgagcctctggaggccagaaccaggtctcattcatcttgtatgtcccctccccaggcctccaacaaggggagcataacaccttacatagaaggcgtagcccatggcaattttttgactttagccctgcaccagcttgtcatgcctgaacattctatgcatgcaactggagaggttctgaaaatcgattcatgatgaaggtaaattttgtgctgccattgatctgagaacccaaaatggaaaaatcattaaagacttttcttagtgtagatttttgttcccctccaatgatactttgaagaaagcttggattcccacattattctgaccacattttacatgaataaaaaccagccatagttaacacttttaaagagcttttaggggttagtcatctaggtttttctcagataatcccagccttgatacataggctgtggtcagcttcaaaaacagtagtaacactaacagtaataatattatcttccatttaaactagagttaaggatcagatggctgtcatctggcctaagccgggacagcctgcaacaccctggttgatgggatcgtggcaaagaaggttgtattgtgtctcactgctagtggtcggcatgcttgcagaacttcttcacctgcagaagtatttgaaacttgggttgttataagagttacacctttgaattcaactacaaaaaaaatgtgttttggatatttactctatactctagccttcattttacttttggtctcctgcgtactatagctcatgtttcttcaca

SEQ ID NO: 134366 - DNA, 1102 bp, Homo sapiens
ccctgtgcctgtattaacctgaaaaatacatggacaaataaaacatccttaccatataggttgattgttcttataaagttattatttttattagtagaggctgtattaatccatttcttacaaggaaaacggttgtgatcggagaagcatggcttctttcttttttctttttcaaaccatttcatgagtatgttctttacaatgatttcttaacatctctgcactgttaccggagttttctgggagaggatacttttgacagaaagactcctttttcttcatgacgctctgtggccttgccttttctcctctggaaataaactgtttctcattggatattattatggctttttaatctctaaagctgagcatgtgtgatttcaaaggttataagcattataaaggcaaaatacccttctaggcttctgctcccctatgactccttataaaaaagaaaaggaaagaaagaaaactcgaatttaaaacatggtggttgagatgtgtgtggtataccaggcagacctccttattttaccctacttggcagcccccttttacttggcactgtggcattacactggagtggtttggctggaaagaacttcagggtctcctcttctcactggaaaaagtatagtgtccacattcgtgagctttaccacatgggggaacaaaaagccctcagggtggagaagcacgtattcctctcagagggtgggggatttacatgagtaacttccagtcacattaatgggaattacaagcctaaaccttcccttccccctcgccgatccttgaaagagcagcctcctttgtcccatctctcctttgaatagaccaagaatcaactttccaccatctaggtgtattcttggcaggaaaaagaaatacacacaatagcctcgggtgtttctgctagacatcccagcttctaggagcagagggcaggaggtggcttgcgtgcagctctcaggctggtggagagctcttggaagtgtggccagtgcccagtggcctcctcctttgaggatggaacttagtatgtgccattggaaaggacagatgactggtttcctatttacagattaagggtaaagaaaca

SEQ ID NO: 134367 - DNA, 1003 bp, Homo sapiens
atgctgacttacctattctgctgattcccacagcacacaggtaacacttctgctttctctttgcagagctgatgagattttctgaccacggggctgctcttaacactgagaagcgttttccatgtgaattttgtggacgggcgttttcacagggctctgagtgggaaagacatgtgctgagacacggcatgtaagttgggccacttcaaggatgcctttgtccaaagcaagaggtagggagggagggaggggctcttgttttggttcccctgacagtatgtacacccctctgtgtcacatttctgggccgtgggaggagaggcaatggtgaggaaccaagtttctccttttctgttgttttttaaaatggtcacccagccgcaagtcaaatagggaaaaaaatcgtctttatgaatgatcagtcctgctcaagcctgtgtgcagaagtatagtgttttctccagccaatatccctttagtcttcattagcgtgacattctataatagaacgtgaatcgaggtcaaaagatctggcttctgttcctgcctctctgactgatcattccctgagtggccctgaacattcccatgtactgcctcggggacagagccagcttctgcctgcctcccaggtaggtgagagcatacttgtaaaatacttatgagatccctgaacataaaatcagcccctcaacaaggcacgttagtccaccagatgcagagagaacctaggatgtggtcttttcaggaggaaacatggcttgtgtggtgataggaagcctgaagcttggtccctgaagcctcaagggtctagacctcagagaatataaccaagcttcccgagacatgggttccatcttcaggtttttgtttttagtttgttttcgtgatttgtttcgggacctgacaaataaatctttagtacctgagttactcttttagacttcataaatataaccaatctccaagcttctgggttcagccgatgactctgagcataaga

SEQ ID NO: 134368 - DNA, 1078 bp, Homo sapiens
gaaatatatgacttaagcaaaacatagcagggatgcatcacttggtattttgtcatacacccatggcatttgttcaaaggaaaccccaaggctttttgaggatcaggaaaataaagacactcgagggtttttattatttttttgtttaaaaagagaaatatatatactatactcatctgtctcttcgataaatgtttttccagggcattgaatgacaccaagcaggtgagcagagaagaaatccacccaaaagagatcatggagaacagtgttaaaatgccctccatagaggaaaaggaagatgacgaggccattgggatagacttttccctaaagaatgaaacagtagccatctgtgtagtaactgccgacaaatctctcctggagaatgcagaggccaaaaaagaatgagcgtttggtgaaattcttaatcaaaccttacttgaacagtgatgaaaaagtgggagggctggcttgggctgagaagggagggacagaaaagagaagacagaacaaagctgctttttaggactgaacaatctattttcaaagcactggtacctgtgtgagtgagtatgtaaattaaagttatttaaatggttggaatatgtggctccttttccatcactacatcttttcttccggatcttcatcatggaagtttcatttgttgcggaatatggaagcacctcccaatggtacggtgcaccctgtggtggtcttggacagtatgtggaaacagaagctccatgacggtagaagacttctcattggggagcaactttttgacgcacaacttttggtgcgtttttctagttttaataccttaagctttttcaagacctaactgcagccgctttgggaaaaaaaaacaaaaaacaaaaaacagaaaacaaaaaaaaaaaaactgctttgcataaaacagtcacctgtttcctagtacctcaaacttaaccaagggaactctctgcatttgtcagtactacctgtcgtcgttgtggttaaatgtagagagaactgctgggcaagatggtgaatggagaaaaaaaaagagttttaaagaaaggaacacaaattg

SEQ ID NO: 134369 - DNA, 2103 bp, Homo sapiens
tttttttaattattttagtaaaaaacaaaacaaaaaaaagaaacagactttaattattagataactgtttgtgaattgtcatcctttattccaggtaagctgtttattagtgttcaactataatttagaatttggtagattcatgtgagctaattttaaggtgattgtggagttttgtttgccacatgtttattttctatcaatttgagtgttacaaacacagcacaattcagtttttcatatgaattgtttttcgtgtgtgtgttgttattgttgttttaatttcggggcaagggagatttagttttttgtgaataggaatgtttttattttaaacatggaaataacaaagaagttaactttcttttttttttttttttttttttttaatttaactaaagaaccaaactttcggcacagctatgcagcttgtgggccagacgaggaggtcctcctcacccttttgttgcctgtcaaattcacgcattatccgtctcataaataatttctgttaggattggctggcttttgtgtgtgattttaaaatctgtgttttgtttctgctggcattgtgttttgttgggggttttcatttatttaggggacgaggggatgtactagaatcccatccctttcgtgagagtggacaagaaataacatatcctacaaggagcctggagaactactttctttctttctttttttttttttttttttttttttaaatctagctgccagctgctctgtcccccatatcagctttttcaggagggagcagcttagactaaatctaagcctacatttataatatgttctgattgtgaacaaagggtttcgttccaaaaaatagaaaagaacttttcttgaagcctaggttttagaagcccgtgtgtgtgtgtgcttggatgtgtgtgtgcgtgtatgagtgtgtgtgtgcatgtgtgcacgtgtgaatcctttggttttcatgtttttttttttttttttttacttggaagggttgtgggagggtgggagggaagaaagggaaggggaattgctgagatgacagtgtcccacacagcttcaaataaaatccatggaaagatgttgcatttgtggaataagtgcttacttgaaaagcatgttcttcttttattttcttactgttaagaatttttatttgtaggatgtttgttttaatttaatttttttaagggatgggggccatcatgtggaaaccagaaaatggggaaagtgtgaactatccagacaaagattcattttgtgtctatatttgtttttaattggcctcatttcaaatgtattaaacagttccatacctggattgggtgtttgtaatggttaccaaaaaacaaacaaaaaaagaaagaaaaaggaaaaaaaaaaagaaaataattgtgacatgcttttatcactactttatttttcaaataacatgtaaatattgtaatccattggattttgttttgctaacctgttaataaaaatatgggaccattatccttttaacaaggctagaatgtcatttttttctttttcaaacatatacctgatattttgtggccgcacattttggatgcattattataattctgttgactgtaatgacatagaatttacaacattttttgttgttgtttaatttatacagaggacatttttttcagagcttgagagaagaaaataaatagcaaaatgataacctattgactccagtaatcagtgtttcccaatacttcataagagatagggagaccctgagtccttgaagccaagggtttaaaaacaaaacaaaaacaaaaaaaaccacaagtaggttattcaagttgtttgcaacatacattttgtaatgaaatgtgagaaattaataaagaatttttttcacatgtgtctatgtgcatctgttgtaaatcatttacagatatgactacagatatgaaatctagaaatattatagcactacctttcaatgcttgtacacgagatattttaagtcattgaatctacacaggtatggaaagcaaaggtaaagctgaggtgaggttgaggttgagctgggattttcaaatgttaatatttctgcatcaggtattcatcacc

SEQ ID NO: 134370 - DNA, 1017 bp, Homo sapiens
ttgactatataccagcctctggtacaccaggcccagaagctggttctgtgatctcctacaataaaggttcatctctggtcaccaagacccactaggattcaaagtcaagctagataagagctcaactgcttgggatgaaagtaggatgacagagcagcctctgtatttttctaagttctaggatccaagatcggggagccttcagatcttcccaatcttttgactcttactctgttagtccaaaaacgagttcattgctctttatgaattatgatcacctttgccctaaatagagagcagctgtcattccaggccacttctgcctgcaccttttcaacctcaataattcctaatggtttagacttgtgttattaatatgtagccaggattaagtggctaaagagcaaaactgcaatgaggtttcacattgctagaggcgagggaacactgctggcacaacacagaaggtaactgtggagtcaaatgtgaaacacagccatgcagaccctaccctgtaaagggccaggcagacacaaaaaatgctcagttctgagaagagtcaatggcaaattcagtatggattctgggagaatgcctgcccatcctggacatcaactgcagtgggcttgagattgtcttaggaagagagaaaacacatctgctttcagttcttattgtcaactagatgatgaaaagcagctcaattcagtagaaagggcattagcctgggagatgagacacttggttcaaggccagccctgctactgtcccaggacaattaacttggcttctctggcccctgatttttcttcacctccaaatgactagatgatcactcaggttgcttcctgctcacggatttcccattctctgaatgcccaggaaaaaagaacacatcaccccatctggctcctaccatatatgcgatgaactgtggagctgtagttctttggagacagatggtaggcaggtatctgtttccatatttggtatgaagtacgaggaggagggaaagaa

SEQ ID NO: 134371 - DNA, 1186 bp, Homo sapiens
atcatttgaaagacagataatatgaagagtcactttggctggcttaaacttagcaccttgctcttgcctgtaactcattgcaattgcttcttcctttgggtaaatagtcattcagttattttttttttaatttaactgaaaatgtaaaaaaaaaaaaatcaaccctgttgtcaatcagactgtaataaataatgtttctacgcaaacagagtcaaagccacattagagataaaaagttacctctgggagattactattattactttttttaccaacgacatcccagtcccattttgttcttcctgcttcctcaacaagaatttctcagataccaagttgctgaattgtcctcacattctaataacatctaatacaaaactggctcttgtttctctagtttttcccttacagtcacctagcctaaacccaaatccttcaataagcccctccaatgccctcttgttgagaaaccacgtgctcttccttactgcagcaagatcaataaacctacacgtgtttgactataggtgtgttcctcgcagtctttgactagtaggcttcaatacatcaaatatttattgagcatctactatgtgctaggtactgtactaggtgatgagagaaagtaaggagttgattacagataagaaaatggaggaatctgggacaattccagagcaactgatgacaagaatggaaaaaagaaatgaggaactaaccctcatttcttgagccaactgtgtacagggcaactagccttcccttatctcccactgcaggtccccgctgggtagacacagactctgtaccaagtggcacagaataggggtagacagcagccccaggtgggaactgtcttttagactaggagcccttgacttgtgtggcctttatcgaaaaatgatgagttaggcctattatattcctacgtaggatgttgagctaaaattcacataggccagttccagctgacaatgaagtcaaaccgactacgaagcattacccatctgtagagggaactgggtggccattgtgaactatctgcaactgaaggaggagaaaacagatcagcggacagttgagactagaggtcatgtgcagagagcatcagagatgtcttaagtgaggtcatgaagccctcaagagatagagcagcctttttgtgcaatgatattcccattcacat

SEQ ID NO: 134372 - DNA, 1047 bp, Homo sapiens
tgacattgttttccttggaagagcagaacatctattattcaaactctgggtagaagagtgaaatggcctaggtctagagataaggaacaatttactactggccagctgccgcccttgccatctaacaaatataggtttaaaagaaaatatccttggcccgttgctccctcttttccaaaagagaaccagttattttaagctgttttttttcctatctttaatatgttttttgaaaaatgatgtcaatttttatctcactgtgtgattcccccctccctccgagcctgtcccctttctcagaagagtcttacaaccactccttagattatttccaaagcctaccacctcgctcccttgaccctagtttctcccttcattcttcccgttcatcctccacgacacacttttcctcaagttcagccctggcctccttgtcaagagctcccatggttcactgaacaaggcccacatatttgaacatggccttcagggctctctaccttttttctttcctattgtgcttttactgctccagccaatttcaccaacagctgctttgtaaaaatgttttttctttttctagaacttttctgtttcctcccttggaatgtgccttttttccaattctgtatgctctaccttcctcacccttcaaagcccaaaattagaattgccttttccttgatgacttccccagtctctccagctgaaagtgggatgtcactcatcatagggctgtggaaagaattgaacaagatgatgcataggagcagacagtagaatggtggttaccaggagcggggaagagggggaaatggggagttgctgttcaacaggtataaagtttcagtgatgaaacatgaataagttccagagacctgctgtacaacattgtgcctgtagtcaacaatactgtattgtccagttgaaaacttatgaagagggtagagcccatattacgtgttcttacttccataaagaaagattatgcatgtggatatgcaaggtgaaatgcctagcacataccagacacaaaatagttctttc

SEQ ID NO: 134373 - DNA, 1188 bp, Homo sapiens
gatggcgtggagcgcacgcccgcgggcctgggcctaggagctcgtgctagcggggccggagggggatgggaaggtccaggccgtctcagccgtagagcctggctttctggtatgggtgcacaggtgggggagggagacgtaggcgtcgccactacccctgtgtggacctggttagccgcttagttcccagagttggtaacccgagaagatgagccttaagaaaaaaaaaagtatcaggttccgtttgccgccgagaggtgagtggtggtgaaaatgaatttgcccctttcccctcagaattgtttacccttttatttgcaaatgaatcgttctgctgccttcctcccgccaccaaacccacacccttgcgtagattgcactttgaggcctctttggtgatggttttagctgttagagctcttcacagccatccaggctcaaactaaacttcagatttaacgggttttctgtgttagaaatcttggaattgtaggagttggaacgctgcagccaccctcccccgatgccccaaacagtagcagttcaagggggaaaaaagaaaaaaaaaacaaaaaacaacaactttgaatcctttctgcagttaaagccttaaacatttcagaagtccacattatacatttttctgtatttgtgactgcataaagagacactgttgaggtcagtacaactttatgccaagaatctaaaaacgctgtgagtgtaaatttactgcttatgttcggaaatacaccgccaagattgtcataatactaagtttaaaccagcagctttctgcccaactctatttttaaaagtagttgattctattttgggtggagatcaggggctttggtgttaagtagacctgagttccatttgtggttttgtaacttatttgctatgaccttgggcaaattacggttagtttcattctctgtataatagggataatacctgccttgcagagatgtgaagattagatggtatgtatttacttggtggtcagtaaatggaatcgattatttaaacaatggattcctttgagtggagatacagtgttacgttttacttatctcatttaatcttaagttttgtacatctttaattttttaagaaacagcctttttgggattttggtacaaaattatttgatttcagaatatttatatgtgggtgtatgctgtgtga

SEQ ID NO: 134374 - DNA, 1034 bp, Homo sapiens
aatatgttatacgtctggaagtatatttttgaaaagcccattgttagggagcggtttctacagctttcgctgctatttatataaatataattttgttgctgttagtataaaaaaactaatactgttagtccggggcaagaaattaaagcatttcctctgggatatatggaacgtttgcatttaatgacttgtcagtttttattttaatgactttaggaaatatttttcatgacaactgtttcaattctatgtttgtagtgggttttaattagtatgtgtttttgatacgacaccttagaattccagtaagaaaataaacaatgaaaattatgttttctagggcaacgctaagtgtcctgtttctaagttgttgtgagaacgaggtaaccaaggatattagaaatagatctaaaataagataggatcttattgagacctgtttttggtctggtcacagatttgtccttgtttaatttttacctagaaggaaccaaggaaattaagtaacttacgtagccagtatagcaactcttgtgagcttgagatgagcatgagcaaaaatggaagaaaggactgtgagataagtggaatcatgggaatgattcatttgttgaacaagtaaatgtttagtgagctttgctggcaggactggaggagtacagggacctgtagaacgtggtctggggcttctgggagccttattgacttagtcaaagctcattggctatagagtagggggatatacaaaatggaaagagcaagataatttgttttaaggtgtttttatttgccctagttttaacaaaactttcttagacttattaggcattttgtaccatttacttgactattactgtgatacattacatgaccactgcctttagtgttaatctttgcaaagatctttttgtttctacaattgtaatgcaagccttcttataaaatattcaaacaatatagaaacaaaatgagaaggtggtatgtgtggggtagggagaccattgctaggagattttcttcattatgtgcttttt

SEQ ID NO: 134375 - DNA, 1601 bp, Homo sapiens
ctaccgtagctacctacctgctagcctcttcttactgtagatagttctgaattgtgggcggtgctatctaaggcaggtccttccacttttccactgtacctcatcccctgtcatgtgtgaaggacatcactccatcagatcttttctcttcatcactgatttttcccatttctagggtatacaaacatttttccccatcttaatgatacactcccttgtgtccacatccctctttagctgctgccctatttccctgcttctcaagaaaattcaggagtatctcttaattctgtttacttttttccacatcttgctcttttcagatccaccatactgttcctaaaagggagtcctcacaactttgtacttgtgctttgtccttaagcacaatacttttaaaaaagtctttctcctctttattaaaatgagagtaataataattgaactgctttcctaacagttgtgaaaatcaggtgagatcatgggcatggaaatatttagtgaattgtgaaattagaaataaattttgcagtttttaaacaaatcctgctttcatcagtttttatttcgatcatttcactattctttctttaaaaggtttgtatgaatgagatattctcattttcttagattgacataatcagcaattttgaacagtgtgtaaaatcaatgaacaaggtcctgccgcgatagatgccgtataggattccagttaatttctgaaagaaatttgctaaatttaaccctactgtggcacagtgaatcgtacgaaggacactacaccatctgttccctgtaagtttagataaataaatgttttttatagtgtcacgaaagctaattttacaactgaatgagctttataaaacttgtaaacattgtataaacttatttcgaggaggtagaccagctacaaatgactgacaatacatgaacagattctggaggcttaaacaggtagataaagttgttctcaccaattattccccacacacttctggttgaattaggtaggcaccttgtttttgctagtgcactggcgagatccattctttgcctatatagaaacttacaggtatcttgggaattctgcttactcagttttcaaattcctgtgtttcttttggtcttgttgaaatcatactgttaggaatatattttataatagattaaattggcatgaattggttggcttaatttctgtgggacaaatgggttttggatttcaaatcatatatttaaaataatagccttttggatcataaccccagtttgaggattgcctttgttatagtgcctgcctcttctcacataattaatgttatgctatcagttattgtttcaattgtaaaaatctcctgtactaaattattttattccttgggtccagtgaggagatttttcctatttgtactgaagtcagctgacatttttaaaatcaaatttgtatttgtagaaatatcaggaacctaccttgggacagaaattccccaggaaatactctggtgcctgtaccagtttctcaagtggaaggagaagaaccgaagaaccaaaaaagaaaaagcattacctgtagtgtaaacataagaaatcctttagta

SEQ ID NO: 134376 - DNA, 1277 bp, Homo sapiens
taacaccaaagcactgaaaagactgacactgttttacttttttttttgcaaatctgatgtttggctttaaaaaaattttacttgtgttttacctttgaaatggggaacagtggaaaatagtggattgagatttttgtgatggatttctactttggggaacatcagaatagcagtgatgctactgacccatttcaggaagatcagtgcagcaaggaaggtttatatggtatttgcaaaatactctgcttggagtcataaggggtggtaacctctttatttccgtctcctcatctataaaattgagtgggtgacatttccttttgtcccagagttttgaggattgtgtgaaattgtatgttaacatctgaagctaaataagctttttttatctttgaagtacacaccatcactttttaattgtacaaaagaaacctttatttgtatccctttctgtctaaaactcaagagaactgtcaacttagataattttcaagaagtattgaatttttctccttggtttttgtgcctttaaagtaatgaaagtagttctataaaggcaaatgggaaagccatctctgccttttttactcctgtacctccctacttaacaagttaagaagttcattagactcatttttgtaaatactgtataatgagcctaattgtcacacaattttaggaaatgaagagactataaaggtcatggattccagctcctcttacagatgaatgaagctgatgctgagagaagctaagctgcttgtttaagagcattgaagttgtctggaggttttcagcctgggctgaactttggaaacacctgtaaaactttttaaaaatactgatgtcaaggtcccactctcagagattatgttttaattggtgtttgtaaagtccccctggtgattgtaatgaaacataacacttaaaatgaatcatttgccttttaacattcacaatttaacctttaacattgaagtattcttattgttgatgagactgttttatttcttagattttttaggtgatcaagctttactttcttgctccgtgggaaataaacccatgaacagtatataaaccaaaactttgatgttgaaaactttattttaaattatcagttcaactagtaaatttttaaaaatctgtgtgtatcagatggtgttaaagtttatggctatcataactagtaatatgagttaatgttgaatcttttttgatataaattggaaaaacataatatttgaggttttggaaacattaataattatgtatat

SEQ ID NO: 134377 - DNA, 2487 bp, Homo sapiens
atggctctatttccagttcagaaagtgctgagcgtgtggaggtaacttaatttggcctttatttttctgcttaattacatatatgtctgaaagtattgtgaacctttttgtacttggatctgttgatttgtagtcaattttgggattttcctccctcttctaaaaatacagtacaacagaatatttgacatgtttataaataaacatttatactgccatttcaagaacattattttgggctggatgtagtagtttatgcctgtaatcctagcgctttgggagcccgtggtgggaggattgcttcaggcccggagttcaagaccagcctgggcaaggtagcaagaccctgtctttaaaattaaagaaaattattttattaatgcttttaagtggtattaggtaccttaaagttacaacttaggtacataaagtttttttgggaaaatgatacggtttatatctatatatatatatatatatatctatatatctatatatatttcaaattttttattttatattaacttgatatgaagatggaaattgttgggtaaaattaattgtggttgatagttaagattaacatacgctgtcatgagctttgaaagagtaaccatgagtcagattgttaatattgatcatttattgtgtcattttacaaaattattttcaagttataggttgttattagtgctatgtttgtggcatcctgtaacggtacagtctaattagagatcaggcagtatgtagtattttattgtaattattttgtcttttaatgtgtttagcccaaagcagtgtccacaccagcaccagctacaactcagcagtcagctcctgccagcactacagcagttacttcctccaccaccacaactgtggctcaggctccaacccctgtccctgccttggcccccacttccacacctgcatccatcactccagcatcagcgacagcatcttctgaacctgcacctgctagtgcagctaaacaagagaagcctgcagaaaagccagcagagacaccagtggctactagcccaacagcaactgacaggtaggaactggattctaggacattctatctcaaaatccgtgtttaacaggaacttcatgcatttattttgattattgttttgatcaaaccgactatatctattacgttaagctttttttaaatgtttgactaaaacatatgctgcgtctgttttgatagcttactaaggagaatataagtacaaattttcataatcagatttctgtactctgttgatttgggcagggtggggggcagtggaaaggagaaagcaggtgaaagtcatttttttttttttgagtagaaacgttaggaaatacaaataaccaaaatgaataaggattacatcatgacattgccaccctgatcatcatttgtacttgatctgtattctttgtggtcattgtcatatatatcataagcatccttccatgttagtaaatctttcccgtagttatatagcattgtgtttggttctgacatttgttagctcttgtaacctgaacctatggactatttcagtttttcactgttgtatctgtatctttgtgaacttgtgagaaattcaggcttctgcctgtgtggatctttaggggaaaaaaaaggaaaagagtgttgagatatttgaggagcaagaaataatttcttgtgggaagttgacagcagagacacctcaactaagtggctgcttaggcagttaggattattgagcagtttaagacaagacttttgtttttctccccagacgatcaggtaaaatgaccaaagcaaatgcttaagtcagagttctcttggttggaaatcatacagcacaattccttgatctaagagcatgagttatattatgaccagccttcactggcactacagctgtttgtattttgtgacttagtgcaactcaggacctcagaggcagtagttatatgatctttggagtcagaatcagacacagtggaaaactatgcagtgactggaagggtttacagacatggaaaggggttaagatatatatgacaatgatcagaaagatatagttgtgatccttcattttagtgttctgcctttgagtgtggtttctgtgtctgacttagtcaaccatgtttggaggagtctgagccacctggttcattgcttacttgggggtctctttctaaataattgattccctaagaagacaacatgggtttaggcaatagaatatttgccctgttacttgcctagaacactgctttaagcattctatgacaccattgcctaacttgatccatctttcccatgtacaactagaaatgcattcaaccatcttatcctagtggataccacctagagtcaggttaagctgttacatcaaagggctgttgatcaggtctgtatatgagagggaacttacgcatttaaaaaattggtttactaaagcacttaaatattacaaacttaatatgtcttaagtc

SEQ ID NO: 134378 - DNA, 3532 bp, Homo sapiens
aggggagaagtagtgagacagaatcaagattaaagaataatggttaaagtctatgtacatccagtcttatctgtggtgtttaaagagaactttttaaaaacaatgtgtgggccgggcgtggtggctcacgcctgtaatcccagcactttgggaggcagaggcaggcggatcacaaggtcaggagattgagaccatcctggctaacacagtgaaaccccgtctctactaaaaatacaaaaaattagctgggcgtggtggcgggcgcctgtagtcccaggtactcaggaggctgaggcaggagaatggcgtgaacccgggaggtggagcttgcagtgagccgagattgcgccgctgcactccagcctgggcgacagagtgagactccatctcaaaaaaaaaaaaaaaaaaaaccaatgtgtgataatagtgtaaattattctaagggagatgtgtcttaccggattttaaaatgtattatacagtaatgattaaaacagtttggaatggctcatattagaaagattggtcagcgaaatcaacaatagctttgaaatagacccagatagatacaggaacttaatataaaggtacagtttcagaacaatgtggggaaaatgctattgagatctcaccatctagaatgaaaaaagaatgacccctcatactgtacacctgcaaaaataaattatagatggatacggatttaatgtaaaagcaaagccataagctaatggagaacaaggaaacaaaagaatagtcttcactgtgagaagtcattcttaagcaagacaaccaaaaaaaaaattataacaggaaagattgatgaatttgactatagaaagaatttaaatgcaggaaaccaaactacacattgcttaataagagcttgatttggtcttttaaatggaatactgtgcacatttgggaagaaattgaagtagatttgattgtgccgacatagaatgattgttaagttaaaaaaacaccaaagcaagacacaagttgttattcttttaaatagaaattggtgtcatagtggttgtctctgggttaggggtaggaaaaatttagtttttatgtattgtgcgttttgaaattttattttctctgcattagttttacagtatatttaatgaagaacttaaattataccaagggattatattaatcatagtattcttattgggtgttacgatgccagacactttgctaagcactgtactagtgtagccctacccacaacactttggagtatatgatacggtcgttgacattgtactgatgaagaaacaggcttagaaaggttaagtaatttatgcatccaaacttgagttttctgctcttattatgtactaccaagggctttctcagaactgaaatataatgtgtgtgttgtttttaattgagatacaggtctaagtgtgtatgtgtgtctgctttaatttaaacttctaactactacctttaccactgttgtaaacttaagtttatatttctttggcttgctcttggtctttcataattttctgtcttttattgcagacttctctgtagtttcccaacagaaacttaatctctttaaactgattttcattacattcaaacttggatttaacccatatctaccttttttgcatatgctatatttctttatttgaatatcttctttcagtgtcctcattcagaacttacctataagacttcattatgtaaagactttatagcctaatttggtttctccatgtgctattttgtatactgcttttgatatttcttctggtgtgacttgatttataaattatttaacttctcatgtaaattatttcaggtaaataattgtgcattatcttttttgtattcaatagatagctgttaggatattattttatatattttgatatttaaagtgatggagtctcagaatagaaggagtaccaagattgaaaatttttcccaaaccacaaatgttgtagataaagcttttggatttaatctagaagagacagtttaaatactgtagtcagacttttatatttaattaaaatcaaagaatctgtttaccaattggatagttactaaactaatgtaaattaaattttatatactttttaaaatgtgatttttctaaaatccttttgtagtacatcgggtgattcttctcggtcaaacctttttgaagatgcaacgagtgcacttggtaagtatctgcttttccttataaataacctataaagagataggaaagaggtttcacttttctagatcatgataaaagtgttaataatttgcatggttgtttataatcaagctgtaagatgattgatttaggtaattattcaattaatagtgttactaaagacttttaatgtttatgtattgagttctttaaaacttgctctgagttgagcctacttggttaaagcaaataaatttccattttccggatgtgaattttaaatgtgatcctaacatggttgatctgtgtatggatttattacaaagggtctttgaaatgggtatgaaatttttctaagatctgcctcacacttcatgtgtattcaccattagacttaattcaacttgatggcactatacattcccatctacatcttgttgcttgcattggcttgcagcaaaaatgcctttttatcccaacttttaattttacctactgaataatgcctttccatctcccatcaccccaatctgtcaaaatgaagcagcattttttttctcccattgtagcatctctgatacagttcctgctaattactggtttattggctggcaactccattcctagtttgttacttttaaatggcagggagggagaaagcgaggaataggtagaaacagcagctttggtgcagtacaggcttctggattcctgcttagcttctacagcagcagggttccagcagcagtaccacctcctagcatctgagttggttctctgagctagttggactggaactccgtgatgcccttgttgctgtggaaaatggcatgtacatttagtggcaaaacggcagtttaaattatctaagatcgcctgggtgtgacaaccccagattttcatctttgaggagcagtgtcctaaaaccactctgctatcaaatacagtgtgagttagtctctagccaggaaaacagaaaccactctatttcaaagagggaaaggcttaatcttaggaaattgttaggaattggaagggctggaaaataggattacccagagaggcagtaaactgtctgtggcctcggctccagctggagccagctagcacttgcccctgatggtgttgaaggctctggctgtggtcactgctgctgcagctggaatgcattgatgctcctgagttcccgggagcctgggaggccatgctgtagctgctgctactcaagcctctgtgacgatgtcttcccattctcagctttatggtctcgggatccctctacattttcatctttaatttacccaagtctctatgttgattccctgcttttttattttattttatttttctgattta

SEQ ID NO: 134379 - DNA, 2256 bp, Homo sapiens
gtttatccagtttgtttggaattgtggaattaataattgttgtgaatttgtttggtgaggagtgtgtaccctaaacagattgtataaaagtattagcttttatggagtggctttcatttacacctgatttagaattctgtataagttcaacagtatcagttattttgatctaatagatgtggagttttgaggtataaaaatacagaatcattgttaccaaatgctaaaactgctgtagagcatcaaatgcaaataaatagatgatacatgagttcatcaaaaacaatttataactaaaatgttttttatatatttgctctttgtttcatagactgaaggggaaaagttgcttttaactgttactagttaagagataggttaaggtgaacggatggaaagaagaaatgttgagcatttatataagaggctatgtaatgtgtgagaatagaggtcgatctatagcaataaagatgaactttttagtttaataaaagagaatttgatggacgccctggatcctaaatttgtatgtagtttgttagcacttaaataactgcccatctgagttaagggtttgcgttggttaactcattcaaaaacattggttttaatgcctggagtgacatctaatccatgcagccattttcctgctgtgttactcttcatcctttatatgttgttgcttttggcttctggtttattagggaatggaagcatttatcatcttattcaattgtaatacttggttctttattctcttcaaaatctataagaacttgataaagactttttaaaaattttaaatgacaagtctatcaatcatgtgcatcaaaataggtgtcccaaaagagtttagtgcatgcagttttaagctcttaataactttaaaagataagtactataaacttacaaaaggcatcacctaaaaactaaatggtttcaatttcttttatatcgattttatgaattttgaaaaattaaattttttgagatactttatctcattttttgagatactttaagtatctcatttatgagatactttaagtatctcatttatgagatactttgacactttaagaaacacttcactgaaaagtacctcaaatttatgagatactttctgagtgacactttctcagtaccatggatcagtaggggagatcctcctgcctggccactgtgtacctggtctgtatccattagatattttttcccccaggagtcatttcagaactgtcaagtgtgcatcaaaacctctttttggattatcttaagctagagttgcaaactcaatcctttttatcactgagtaacagctgataaagatttctaagaagttaaaaagtcaactgaactaataggtagcacaaaaacctttggttgtgttcagttttaagaaggtacatgtatcaatatttttcaaatttgatgctaattacgtgtgcctggtaggtgtcttattgaacaacacagagaatatttccatcatcatggtaagttctgttggacagtgctgctttgcattattatagcaatgtgggtttttctataatgcacccaggtcatttctaatctaatttgaatccatgcagcttaataatcctttacttttaattgaagcagacatctgtttgatgcttttgaaaatcaaacaagatgttaaatagactataaatcttttactctgtataatatttaattttgcatgatgggatatcttaaagcttggaaattctattacagggaatccctggagatagagaaagtcaggctgtggttgacccccctcaagcagctagtactggggctcctcagtcttcagcagtggctgcagctgcagcaactacgacagcaacaactacaacaacaagttctggaggtaaagcggaatcttctggatggggagggaatggccctgaatttttagtgtaaaataatttaacctgaaatacttcagaaatgacgttcattcccagagcagtcgaataattcgttaagttctctcttcactaatgtttgagaaaggcccaaaagaaactttcccaagtggatgtaaaaggtatccttgctgatattaaacatcagtgttgcagttttgccgaagggcatattctgttttatttgttttaaggaaaagatgctttccagtttgtatttagtgttactttctgatgccattcagaatggtttgctcactttgtctcttactctctccataaatgttacaaagtgtatgtaatttcaaagccagca

SEQ ID NO: 134380 - DNA, 1763 bp, Homo sapiens
gagtaatttttgccgtataaaacttgcaagttggtacagttggaagatttcatcattatttacttcattttattacatctgagaactcaaatcattttttctttgatagtgtttgctgtctaaatgtattatttaaccactgtttgtgtatgtatttactgcttttgtttagaaatgtttatgtgtattttaggacatccccttgaatttttacggaatcagcctcagtttcaacagatgagacaaattattcagcagaatccttccttgcttccagcgttactacagcagataggtcgagagaatcctcaattacttcaggtgactaatcagtgtcagtttcacaagtgatttagagtgtgtcacaatttgaaaaagtccatgaacggtccttcccctcctcaaatacaactctgtatttgagaatgtgaatgttttcttccaagctacacttagatattgtaatctagataggtgtactaaaaaaacagttgggatatggaggttgggttaaattaagttgaccaaatagtagtaagtttgggaaacattttatatttcctttttggagattcccactacacattaatatgttaaagaatttgggaagctgtttaacagagaaactgcctaactttaaatcacttttcacaagcttattactcagttcctttttcttaggaacttttaagcaacaggaacaacttactcttagaaaaaatagctgtggggcttctttagtgatcagatcaccaagtatttgaattttatacagcattttaatgcccactagtgtggaaggtaaaaaatacatgcaagtattaagaataagttctattcttatagtcccacagtagttttttttgtttgttttttgtttgttttgtttttttaagcacaggaggctcagagcacttaagaatttgaatttcttcactgtttactttgcccaaaagtactgaatttctttactattgtataagaaatcacatccttccaaagactgaataatccagaatcactaaattacgtttgcaaaagtgtagccttttctcttagtaatatttagaatttctctgttcctgcagatacttaatatcagtgtattatttttctctgtccttcatatcaccacagcaaattagccaacaccaggagcattttattcagatgttaaatgaaccagttcaagaagctggtggtcaaggaggaggaggtggaggtggcagtggaggaattgcagaagctggaagtggtcatatgaactacattcaagtaacacctcaggaaaaagaagctatagaaagggtgagtttaagtaaaactttaaaaaaattagttcttggctgggctcatgcctgtaattccagcactttgggaggccaaggcaggtggatcacctgaggtcaggagttcaagaccagcctggccaacgtggtgaaaccccatctctactaaaaatacaaaaattagctggcgtggtggcacatacctgtaatctcagctacttgggaggctgaggcaggagaattgcttggacctgggaggtggaggttgctgtgagccgagattgtgccactgcactccagcctgggcaacagagtgagactctgtctcaaaaaaaaaaaaaaaaaaaaaaaaaaaattccttagtcacactagccccatttcaaatgctcagaagtcacatattaataataaggtttttctataatttctttcaatagtgtcctgtagttttcagtgtagaagttgtgtaatac

SEQ ID NO: 134381 - DNA, 1406 bp, Homo sapiens
tctagtttgttcttccttttttaggttaggtttagtttagttctttgtttagttttagtttaagattaaattattatctatctttgttagcatagatgtttatagctataatattccttctgcgtttatgctatagtagcatcccataagttttagtatgttgtatttttgctttctttcatctcaaaatgttttttaatttcccatttggtttctaatttaattcattcgttatttaggattgtgttaatttccacaagtttatgaatttcccacattttctcctttcgatttctaaattcattccattataatcagagaatatactttcaatacttttcaacttattgaggttcgttttgtggcctaacatggtatttctgaagaatgttctatgtatactgaagaagaatatagtgtagttcttattaagtggtctataaatatctgatagatctagtttgtagtcaagtcttcttccttagctgttttatctattattgaaggtggagctgtagttgtctctattattgttaattgccaatttctacctttaattctcagtttttattttatgtattttgtggctctgttatatataattgttgtgtcttcctgaaccctttttatcataaaatgccttttgtctatagtaacaatttttatcttaaatctgtttcctctgatatagccattctagctcttttttggttaccatttgcatagtatatacctttttctatcattttactttcaacctacttgtgtctttgaatctaaattgtgtgttttgtagaagcaggcagttggattgtaccctttacttcacctatcctagctttaatctggataaaacccagataacaaactgattttttagtttcttctgctttcatagatgaatagttattcgtgatgaattgggatttttgcccaaattttaagggttatttccaaatataatctgacacagcagtctttaacctttttggcaccagggaccagttacgtagaagacctttttttctaccaacataggtggggtgggcgcagtgattttgggatgaaactgttccacctccgatcatcaggcgttagttaggttaggaagtggggtggggcggtggttttgggatgaaactgtttcatctcacatcatcaggcatttgttaggctatcatacggagcacagaccctagatccctctcatgcacagttcacagtagggttcatgctcatatgagaatctaatgccgccactgatacaacaggagacggagctcaggtggtaattcgagtgatggggagtggctgtaaatacagatgaagcttcacttgttcgcccactgctcacctcctcccgtgcggcccagttccttgctcacccactgctcacctgctcctgg

SEQ ID NO: 134382 - DNA, 3221 bp, Homo sapiens
tccaaatgaaagacatgagttgacattaataaataaaacataatttgcttttaatttagaaataggtgaggtggttaaactatactgcaggtactctcatccttatcttcactcttaatatactaaaagccatttgatttacatatttctgtagagtcatttatttttaaaccatagcagttagcagctaatttttaattaggccaaagagtatttgcatagtatctattaagctttaactagaaacaaagacttttttaggtgattagtaaaggaaagggtctagattccatctaatcccttgggttgggcagtaaatccatattgatagagatgaattcatgtaaaattctcaagagcttttttgggttgcagtatgtttttgagtaatgatttatctttagtgctatgctggaatctataatatgtaaataaaattaaatgtgccataattggtgtgttggatttatatttttttcctttttcttccagttaaaggcattaggatttcctgaaggacttgtgatacaagcgtattttgcttgtgagaagaatgagaatttggctgccaattttcttctacagcagaactttgatgaagattgaaagggacttttttatatctcacacttcacaccagtgcattacactaacttgttcactggattgtctgggatgacttgggctcatatccacaatacttggtataaggtagtagattgttgggggtggggagggagggatctaggatacagggcagggataaatacagtgcatgtctgcttcaattagcagatgccgcaactccacacagtgtgtaaaatatatacaaccaaaaatcagcttttgcaggtctttatttcttctgtaaaacagtaggtaacttttcctaggtttcactctttttagtgtactagatccagaaacttagtgtaatgccctgctttatatttctttgacttaacattggtttcagaaagaatcttagctacctagaatttacagtctctgtttcatggcaacactggataatggctttgtgaaatttaaaaaatttttgtagcgactgtaaacagaaatgccaaattgatggttaattgttgctgcttcaaaaataagtataaaattaatatgtaaggaagcccattctttcatgttaaatacttggggtgggaggggagaaagggaaccttttcttaaaatgaaaataattactgctattttaaaatttcttgatcattgaatgtgagacccttctaacatgatttgagaagctgtacaagtataggcagagttattttcctgtttacattttttttttgttttggggaaaaaattggtaggtgtctaattactgtttacttcattgttatattgcagtaaaagttttaaaacaaccattgcatgtttgcttttgatgtatccctttgtgaaattagcacttttggggccaatggagaaatgcagcattcactctccctgtcttttccccttccctcagcagaaacgtgtttatcagcaagtcgtgagtcaaactgctgccttttaaaaaacccacaaaatgctgattcagttcaaaattaatgcaaatgtttcaaaactgggtttctgatatttgtaaatgtgtttctttattagataagagtgtattaccattaaagtcattagtataatattgctttcaaaaagaaatggtagacaaaactataatccagcatcttttattgcattggaaagactggcaaagtcttttggatgggttgggagatgtggctggaaagtactttggaaaatatacaatcaagatatctcatggcatattaaaagaaaaatcttaatagcagtgttggcttttatttggattttttcatctcagttttttctgtggaatctccttcattggcattgttatttaatcataaacggggcagatgtctacttgttcagtttttcaaatctgttttcctgagtataaataagagtatttaaagaaataatttggattgcttttgttttttgtttccttttttttaaccatctgatactaagaagatgaatttgcacagatttctctgcataatttctcaatatctttagcacagtatggtgatgatgacttttaagcatttacatcacgtactcataacctattatgaaaataaatgaaactggctgggtatggtggctcatgcctataatcccagcactttgggaggccgaggtgggcagatcacttgaggccaggagattgagaccagcctgaccgtcatggcgaaaccccgtctatactaaaaatacaaaaaatagccaggcatggtggcgcacgcctgtggtcccagctacttgggaggctgaggcatgagaattgcttgaacccgggaagtgaaggttgccgtgagctgagatcacaccactgccataaacatgacaggcttttggactttgtattacctgtatgttttataatggatcatgcataatttctcaggagaataaaatgagaattcatatatacgttcatctttcaagtcagagcaatgagttgggaaaagaggtggcatttctgatcggataatggaatactctcatttattttatgacattctctgtctactcagatcatagtgaaaactggaaacaaaaaaaaaaaacagcctcttcttggaaagtgacagcagaaggtggcatggagcttgtgtccttggacaacaaatctggatatactaggattaattatcagaagacagctcaggccaagttttgatcgttccatacagtaccttgtttatctgcttcttaaagaatcagccgagacaccataaaagaaataggctttttgtgccttttgctgttaatgtttaatttacaaactgttttggtaaatctcttaatgtaagtagctatttgactttggaattttgcattcgaggtatactgtcatttcttgaaatctttttctcgtttagttgctctgtgggaaatgtgaggaagcctaagtttgtatttgtaaatttcttatgccatcctctagtcaaattttttttcattgtttaaaaatacggaagtgttccaatataattttttcctgtactggatggctaggattctagagaattgattataaaatattttcaatacatccaacattgcacttctcattttttaaatgattctgtcacgtagaatcagaattgaaagttgacaatgcttctgtcactgat

SEQ ID NO: 134383 - DNA, 1021 bp, Homo sapiens
aaatcaaggtatctggatccaacagccaaccctgtttccattactcattctttcattcatcgacttgacatgcatttactaagcacttcacacaaggtcaatcttgtgacgggctctaaaatacaaagatgagcaagacatggttcctcccttgagtagctcacagactgatgagttgggagacgagtctgcaaagcattaatggaaacacaagtgctgtgctttgggaagagagaggagaaagcaactaaatcggcctgggagagtgcgggaaatgctcttagagaaacagatgttggagtagggattttcagagcaatagaaagggagagaaacctgccaggaaaaagaacagcatggaaaaggcacagagtcacgggcactgggaagtccagtgggattggagactagggtcatgctggggagtggagggagatgcaatgaaggagttagagggacgtggtaaggaaaggtacaatttctgagtggagttgggcttgacccagcaagtaacaggccactgagtagtcagtgtgtggatgttctagattttcctgtttggttaatggtgtattggctgctgcttgatacacagccacctacacagtccaattgtctcctcctccctgcacaggcctgacttgacctagttattccagagcattgctcaatcaccaaatagcttccataagaggtgagagagagagagagagaagaaggaggagagggggaggaagaggaggaatgcttgagcaatccaggagaccgagccaggatcgggcctctgagaggcccatgtgggtttcacattctcaggacaatatttgccatcctcactggcagagggagagtggagactatgcaccgagcacaggtctaggcctgaatgggaatgagtcagtggccaaagggcagggttgggagggagtgggtggctgatggtggacacaggtggaggaagaactgggagtgtgcccctctgctgggatttccctgctcctgaggctcccttcagccatcc

SEQ ID NO: 134384 - DNA, 1017 bp, Homo sapiens
gttcaagcaattatcctgcctcagcctcccaagtggctgggattacaggtgcctgccaccacacctggttaatttcttgtatttttagtagagacggggtttcaccatattggccaggctggtctcaaactcttgaccacaggtgatccacccacctcagcctcccaaagtgctggggttacaggcgtaagccaccgtgcctggccattctactattttctaaccctgtgctttctactcccccatcctgcctctaatgaatgctcctcgaagaaaatgctcctctgagaaatcccacgagaactgtgacccctcacagcacgacgtcaacctggaaaacataaggctttggaaatgctcacccctgcacatctgcttcctgacctcatactcttcagattagatagctcttggaagaggcttgatgtatcagaaaaacaaaagttactaaaggatgcttggtacagtggagagatcatggactgtggaatcacacagacctggtttccaagagtccccaaacctcacccccaccagctcagccaaggggaaaatcagatgcacccaattggctgagcaggaatcccaattggctgagcatgaatcacagccaggaggaggagcagaacccatagggtcaggggggcagagacatttaaaaatcaaaaacaaaaacatgaggattgtgaggtagaaagaaaaaggggcaaccgaagagaggaagacaatttcaatgtctagcttaggtgggctcagaatgagcagggggctactcaatgaaaagtaaagaactgtttcataccaccgttgagacttagtgtagatgcacaatcgtttactagggcctctgtagcatcaggctgtcccttgccaccctccctttcactaggaggataaagtgttatacttgcttaggcaaactcactcccttgctggaaggatgtacaaccaagtggaattgggaaaagataccttggagtctgcatccaggaacatatttactaattatgcatctgg

SEQ ID NO: 134385 - DNA, 1029 bp, Homo sapiens
tgtgagtcttctgacacaaagcattgattgaaaaaaaccatgcccactaactataccaaaacaattccatcagcaaagtcctctgataatgggttaaatcagatgaagaccaaaggcttacagctccccttgtcctgacagcacccagtcatgactgagccctgcaacctgggtcaggatataatagtgacaatggcaatgggagccagaaaagaaagagagagagagagagagagagagaaaatacagcttccagggcacagaaccagatgggagagcagggaaatcattcggagagacagaacatgcaaagagtgagccacatttaagctgtgaacggtgcttgagttggtgttcttgaatttgatagtttttttttatccaccttcccggctatggcagaggtagcagcttccctggaagcccacttctgtgtgttgttctaggaaccatttccggagactcagcccagagctgcctttcaaccctaacaattattttttaagcatgtaattctccatatcatattgcctttttacttaaaatagctagggtgtttctttctacaactgaactttatggatacaactgcattagacaaaaactgatggacaggactagtttataaactaggatgacatactaagagcttagaagggcccctcttcgcctccccttctcttcccacaaaggctgagattaaaacttctttggagagctcatggctgccacaggatcatgcagcctactggtggcaaataaacttgccacagggttcaggccaaagctggtgcaaaggaataggcttccaggtggcagagaaaggtaccagaaggtacaggcaggctggagtcagttaataagagcagcctctgggggaaagtaagactacctgtaatcttcccactacttattaggagtgtaagtttgtcaaagaatttgtagaagaatccaggctagaatgtagtggcgtgatcatagctcccttgaactcctgggctcaggtgatcttcctgcctcagcctccca

SEQ ID NO: 134386 - DNA, 1055 bp, Homo sapiens
ttcacagtaggctgacgcctgagcagcagcagagacctttgaggtgactctggctttctgagtttcatccttttataaaaaactgtggttccatatagataacatcaaatttaccattttaaccattttaagtgtacaattcagtggcatgaagtacattcacactgttctgcaaccatcaccattatccatttccagaacttttccatcttccccaactgatactctgtacccattaagcagtaactctgaataattccccactcctccacctggcctggagaccccattctaattgctgtcttcctgaatttggctattgttggtacctcatgtaagtggaatcacacacagtatttgcccttttgtgactggcttatttcacttagcaaaatgtcttcaaggttcattcctgtcgtagcatgaataaaaattgtcttcctcttaaggctgagtaatattctattatatgtacataccacattttcttgatctgttcaccagtcgaggtacatttgtgttgcttccacctttcagcccttgtttggaatattggtgtacaaatatctgtttgagtctctgctttcaaatcttctggccaggtacagtggttcacacttgtaaacccagcatttcaggaggctgaggcagatggatcacttgaggtcagtttgagaccagcctggccaacatagcgaaactctgtctctactaaaaatacaaaaattagccagttgtggtggcatatgcctgtaatcccagctactactcgggaagctgaggaaggagaattgcttgaacccaggagacagaagctgcagtgagctcgcaccactgcactccagcctaggcaacagagtgagacttcgtatcaaaaacaaaacaaaacaaaacaaaacaaaaacaaaatcttttggagatatacctggaagtagaattactggatcatagggtaattctgaagttaatttttctttttttttctttttttgagatggagtctggctctgtcgcccaggctggagtgcagtggcacaatctcagcttattgcaac

SEQ ID NO: 134387 - DNA, 1027 bp, Homo sapiens
ttgacccaggccagggctggagaagcagaaaaaaagcatcaagcctacaaatgcatgcttacttgcagcagaaatagactaattgcatgggcgtttccctgggatccctgtctccaggcttctctcatccatgcctttctaggcagcccacatcagcccttgcttaaaactctccaaggtttctcatgccaagctccctgcaggacatcccaggccctctgggacagcagctcacgggcctctccagcctcatttgccactgtgacccattctccagcactgattcatcaattagcccatcacaggcgtagctacaagattagttttgagactctcattctatatatttatgtacatcctccaaaactgataaaacaagaaagccgtcaagttgtaattgataaatatgtaattaaatgtctacaaaatgtaacatgtcaattgtctttgcaactggcctcaaccttaggtagccatatataactcatatttcctgtgtgatgtgggtgaattttaataagcatggtatagtgtgggggtggggccttggaaaataacagtgcctggggcctctaaggtctaaagtcgtccctgcccttcacaacctctgctttagccatcctgaaacactggctgttcctcccacagactctgctttccctagattccgggcctttgcacctgcagttcgcctgttctgaatgtcctctctttcctcctcacccttcactccctcccccttgcctggctgagtcctgtgacagacatttcaggagccactttggaagctttttcttttcttcttcttcttcttcttttatttttttattttttgagacggagtttcactcttgttgtccaggctagagtctggtggcacagtctcagctcactgcaacctccacctcctgggttcaagcgattctcctgcctcagcctcccgaggagctgggatttcaggcatgcaccaccacgcccgactaattttgtatttttagtagagatggggtttctccatgttggtcag

SEQ ID NO: 134388 - DNA, 1032 bp, Homo sapiens
acctttttttgtttcctactaaatcttcaaagtctggtgtgggtaggagcacatttcaagcgctcagtggccacatgcaggtacctagtggctagcattgggcaggccagtgtgggtggtcctaggagccttgggagggttttaagtcaggggtcagaactaatggattctaatgattcagaacatcccagctagttcttggaatctcagaggcgaaagctctccttgtactctttggcgacgctgcctcctggcgcaggtcgctgcacacagaagggaaagcccccagctctccttcccggcggaggcttcttccctccccccagagtctggttcagaggaagccaacgcctgtgcacgtgggaaagcagcgtggctggccctgggcctggagccacctcccgggcccactctgccaggccccattctagatgccagcaggccggccccgccccttggacacggttttggttttcgggtgcaaacagtctacattcctctgaagaggcccgctccggcctcatcagagctggcgaaatcaacgagagaaacaggggacgtcggcccgcagttcccgcgagcgccacgaggggcgcacgcagatgaggctcgcagcgttggctgccgctgaagctcctggaagtcccccttgtcctcttccccgtggagaccccaggcgtaccaccacgatgttccttccaccagcctcaccctgaacccagtaaactctccctcgagcgatgacttaggttctccagggtcccaggccttgtgggaaagtgcccgcagagcaggccagagacaaaggaaagagcgggtagctgagactcgggaagcccatccgcttgatatggggataggtggagactacggtgaatccaaagtctgtgggttccgagactggagccaggaacaaaaaaagattccactgttcggatgttttcatccctgaggctgaaataacagctgaggcctgactactcacgtggtgtctgtggccagaataggacccacataataatggcttagctc

SEQ ID NO: 134389 - DNA, 1056 bp, Homo sapiens
ttcaccatgttggccaggatggtctcaatctcttgacctcatgatctgcccactttggcctcccaaagtgctgggattacaggcgtgagccactgcgcctggcctggcctagagagttttaagtcagggattgtgggcttgtattattcccacttttttttttttttttgagacagggtctcactctgtcacccaggctggagtgtagtggcacaatcacagttcattgcagccttgacctcctgggctcaggtgattctcccacctcagcctcccaagtagctgggagtacaggcatgctccaccatgcccagctaatttttgtatttttttgtagagatggtgtttgccatgttacccaggccagtctcaagctcctgagctcaagtgattagcctgcctcgacctcccaaagtgccaggattacaggtgtgtgccactacacctggcctattattcccactttacaaatgagaaagctgaggctcagtaaggaaagcaacacgtactgggccactgaggtgtcaaatttgatgtcaaagtcgaagactgcagtcctggttcagtttcaaataagggactgtgatgccacgaagcagaacgaagactgagcctggatcacaatgcaatggcctggctggagagaaagttgcatgggtcatttatagctcacagaggcaaaggtaacctacctaagaatggatccagaaggcaaaagggactgccctgccctcaagagatgtcggtatctccagtgtgctgggaatggggctctaggtagggcaagatgcctcggcatggtggctctgagatctgaatccagagatccacagctgtggattagcaagctactctgtttctctatatgttggtttcgccttctacaatatggagctagtaatcatatttgcctcctagagctgacatcaatattaaataaaatatgtttgaaataattgagcatagtgcctggaacatagtgagccttcaatgaacattagctgtcactattattactctcaaagatgagcatgcatacctcttggggagttccaa

SEQ ID NO: 134390 - DNA, 1025 bp, Homo sapiens
cacatcaaagctcagagaagttcaggaaccagaccaaggttaggatgcagccagattcaaacccgggtgaaacccattctctctccagcactccgcatttccccacagtctagattctttaggagcctgccccattatttcaggtgctttgaggctatgtgtgctgtaggcatatgtgttgtgagtgctcagtgtgtgtgttgggtgggtgtgtgttccgggtatgtgtgtgtcgtgtgtgcacgtctaggtgggtgtgagtatgcagtgtctgtgttatgtctgctggatactgctagatagttgcctcccaatcccctcctctccctcttgtcactgaaggtgaaagagtctctttggaaatattcatggggacagagagagccaggaagggaggactttcccatgcattcagtttttcccatgatacatcaggcagtaaagaagaatgtcatcctgaccatcggcttccctgacataacgctgaataattctcagacactcgcaggccagttgaagacagcataaagccagccctgcaaaaatcccggggacaataggaatagtggtgagaacttacttgttaggtagaggtttttttttcatggactcaactcaggaaccagccaaagggagagatgtgaaataatgaaagaggaaaggatggcaggccgggaaggatcactgacttggagtaagaaaagctgagttcggccaggtgcagtggcgcacgcctgtaatcccagcactttgggaggccaaggtaggcagatcatgaggtcaagagatcgagaccatcaccaacatgtgaaaccccatctctactaaaaatacaaaacttagctgggtgtggtggcgtgcgcctgtagtcccagctactcaggaggctgaggcaggagaatcacttgtacctgggaggcagaggttgcagtgaatcaagattgcgccactgcactgcagtctggtgacagagtgagactccatctcaaaaaaaaaaaaagaggccgggcacggtagctcacgcc

SEQ ID NO: 134391 - DNA, 1716 bp, Homo sapiens
aaatgcgaccgagcattttccaggtcggaccacctcgccttacacatgaagaggcatttttaaatcccagacagtggatatgacccacactgccagaagagaattcagtattttttacttttcacactgtcttcccgatgagggaaggagcccagccagaaagcactacaatcatggtcaagttcccaactgagtcatcttgtgagtggataatcaggaaaaatgaggaatccaaaagacaaaaatcaaagaacagatggggtctgtgactggatcttctatcattccaattctaaatccgacttgaatattcctggacttacaaaatgccaagggggtgactggaagttgtggatatcagggtataaattatatccgtgagttgggggagggaagaccagaattcccttgaattgtgtattgatgcaatataagcataaaagatcaccttgtattctctttaccttctaaaagccattattatgatgttagaagaagaggaagaaattcaggtacagaaaacatgtttaaatagcctaaatgatggtgcttggtgagtcttggttctaaaggtaccaaacaaggaagccaaagttttcaaactgctgcatactttgacaaggaaaatctatatttgtcttccgatcaacatttatgacctaagtcaggtaatatacctggtttacttctttagcatttttatgcagacagtctgttatgcactgtggtttcagatgtgcaataatttgtacaatggtttattcccaagtatgccttaagcagaacaaatgtgtttttctatatagttccttgccttaataaatatgtaatataaatttaagcaaacgtctattttgtatatttgtaaactacaaagtaaaatgaacattttgtggagtttgtattttgcatactcaaggtgagaattaagttttaaataaacctataatattttatctgaataatgttttttattgttttgttttcctcctggaaaaatatgaacagtgtttggtttaaacacaccgggttaataaggcatgtaagaagcacgcacaaaaaagccaactttatgtcaacaaattaaaatacctttttttattaaaaaaaaactatttagttttaccataaatactatcaatatagggctgagaactcttgattattgtacgtttaaaaattacaagattaaaaacccagttcaggtttgctctttccaaatgtacgtaaagctacgtgaaagcagtttccttacctatgattttcccagtagaaacagcttaatcatccttaaatttgctcagtttagtatgaaaatatttatgaaatatatacatttcagtttcatatttgaaaaaaatctttatggtttgtcttttaaagtaaataaaaataaaaaagttttctgtggaggcctgtcccagcacccctcacatctgagtaacaaaagaaccttcctacagcagacaaccctaagaacgtagttccacagtgccctcctgaggattaaagggttcatttatgcttggtgtgtgttaaagatacatcacttctactagttacagccttaaagaggtcagaaccaaagtttctggcagattgttttaaagctaaatcagttcccctgactgaaggtgggaaaacaaactgaaataaaataatttaaaaattattcaaattcataaaactaagtgtaaagtaagatggtgttatggt

SEQ ID NO: 134392 - DNA, 3168 bp, Homo sapiens
agagaacgaacgtgtctgcgggcgcgcggggagcagaggcggtggcgggcggcggcggcaccgggagccgccgagtgaccctcccccgcccctctggccccccaccctcccacccgcccgtggcccgcgcccatggccgcgcgcgctccacacaactcaccggagtccgcgccttgcgccgccgaccagttcgcagctccgcgccacggcagccagtctcacctggcggcaccgcccgcccaccgccccggccacagcccctgcgcccacggcagcactcgaggcgaccgcgacagtggtgggggacgctgctgagtggaagagagcgcagcccggccaccggacctacttactcgccttgctgattgtctatttttgcgtttacaacttttctaagaacttttgtatacaaaggaactttttaaaaaagacgcttccaagttatatttaatccaaagaagaaggatctcggccaatttggggttttgggttttggcttcgtttcttctcttcgttgactttggggttcaggtgccccagctgcttcgggctgccgaggaccttctgggcccccacattaatgaggtaggtgaggcgcgcggcgctgggagcagggaggggtgaggaccggtgggacgcgccggaacgacggccgaaagccgcccctgactctcctgtctccgctccctgccttgctcgcaggcagccacctggcgagtctgacatggctgtcagcgacgcgctgctcccatctttctccacgttcgcgtctggcccggcgggaagggagaagacactgcgtcaagcaggtgccccgaataacgtgagtatcgctccgggccgccgggaacgcccggtgggttttcgtgggtgtggtgggggcgggcggagccttggggtcaccaagagccactgaacgagggtaaggagcggccaccgcgcggactccgcaaccttcccgggatagcttccgtgtccttggctcagctgtgtatgcccgtggtgcgagcactgcggagccgcctggggcgcaagccgggtcttcaccagtccccgggcgcgctgtcggtagggcgggcgctctcgggccaccgggcgggaggtggccgcgtccccagacactggctgggccagagtgagtttagcgcgtaggcggccccgtggcgagagcgcaccgagagagcctcggtgtgccaattccggggacgtccacgggacctggagggggagggaccagccgcggcgctcgctcacacgcaattgggcagacaggacataacacccgcaatacagacgcatcacctcttcttcgacccgggagtgggccgagattgcagcgctggcgccctgggttcccgggtgcttcctgcctgaccagtccccatgtctgggcggtgcagtcgcgcgtggcccgccagcacgtcagtatgtcgggtggcaacaggggaccaccactgacaggtctctcccgccctgtccccgcagcgctggcgggaggagctctcccacatgaagcgacttcccccagtgcttcccggccgcccctatgacctggcggcggcgaccgtggccacagacctggagagcggcggagccggtgcggcttgcggcggtagcaacctggcgcccctacctcggagagagaccgaggagttcaacgatctcctggacctggactttattctctccaattcgctgacccatcctccggagtcagtggccgccaccgtgtcctcgtcagcgtcagcctcctcttcgtcgtcgccgtcgagcagcggccctgccagcgcgccctccacctgcagcttcacctatccgatccgggccgggaacgacccgggcgtggcgccgggcggcacgggcggaggcctcctctatggcagggagtccgctccccctccgacggctcccttcaacctggcggacatcaacgacgtgagcccctcgggcggcttcgtggccgagctcctgcggccagaattggacccggtgtacattccgccgcagcagccgcagccgccaggtggcgggctgatgggcaagttcgtgctgaaggcgtcgctgagcgcccctggcagcgagtacggcagcccgtcggtcatcagcgtcagcaaaggcagccctgacggcagccacccggtggtggtggcgccctacaacggcgggccgccgcgcacgtgccccaagatcaagcaggaggcggtctcttcgtgcacccacttgggcgctggaccccctctcagcaatggccaccggccggctgcacacgacttccccctggggcggcagctccccagcaggactaccccgaccctgggtcttgaggaagtgctgagcagcagggactgtcaccctgccctgccgcttcctcccggcttccatccccacccggggcccaattacccatccttcctgcccgatcagatgcagccgcaagtcccgccgctccattaccaaggtcagtcccggggatttgtagctcgggctggggagccctgtgtgtgctggccccacttcgggacacacgggatgatgctcaccccaccttcttcacccctagagctcatgccacccggttcctgcatgccagaggagcccaagccaaagaggggaagacgatcgtggccccggaaaaggaccgccacccacacttgtgattacgcgggctgcggcaaaacctacacaaagagttcccatctcaaggcacacctgcgaacccacacaggtagggggacaaactgcagaagggaggggggttagcttccagccccataggctaccagtggacactcctcagtgcctccttgacttcccaggttagcttccagccccataggctaccagtggacactcctcagtgcctccttggcttcccagggcagtctatcgccttgatctccgggatcactggagagaacagcaaaccggcgcctacttttctgcccaggagccttttgcttgatggatggtatctgtgtttgaatgtgcaattttgttaggcttttaaaaggcaggagattccccgcggtctgtgggcctctcctagcttggcattataatcaagaaattatactttgctatgcaaaagcatgatggcttttttaaaaaaatcgttttttaatgttcccttcccaggttcaccctccctttttgttattttgaattctg

SEQ ID NO: 134393 - DNA, 1561 bp, Homo sapiens
tgggattacaggcgtgagccactgcctgtaatatttgatgactaaattgcactgtagaataataataataatagaagacacccattaaagaagaattaaacactcactgatgacttttcaagccacgcactctcctttccactttatggatgagaaattgagtcataaagaggtgaaatggccagtaaaggtcaaaggacaactcgttccttcggctcaggctccgggtaggtcaggcccccctaaagggacttccctgggaagtgaccatgtgccaggaagtggagcgatgcggtgggatcctagctctcaaaaagtgcacaccgagcccgccgcaggcgtccttgcccaccgggaagggaataggaaacggcgatctttacttcaatcttataacgctgcctcccccacccccactctccccttggtttgtgatcagtaattttccagctgggaaatgttttgctctcatcttcttagcaaacagtatttttttttaaaacgtgaatgtggtgttcggtatcactttctaaacgtaggtttggcgaggtgtttactttggattccggcgttcggcgcgggactccgcccccctctccacggagccccctcaccggcgaacgctggcgcttaggctggtgtcaacctaggaaagagaagagaggggacactggggaaagtggtggaagctcgggcaccgggcagagagtgcgctcacccctttttgagttctagttgccaatgtcctttgtcgttgtcacctgtttgaaccctgcgattctggtacctattaggtttcctcagaatatttgtgatacctgatttttccactcctcgccgaccacagaagcattcttggaatgcatctcgccccgaatgaattgactcggccctccctgccaacgccaggaatccctctaagatccagagtcggacgcccttgagtgtgacttccatcctctagcttggctctggccaagggctgccagggttgcagctgggggatgagagtgttttggcagggaaaccgaggtcctccttcctatgacctcgaggagttcaaccccacccccctatataggatcaggccagttactttaactctgatttttactttaagcccttttcaaacggaggaaccaaaaaaggaagacacctgccacttcctcccctactcctttaattgtgatggcaacatcttgggatgctgtgatttgagggctgcatgggaaactcaccactttttcaggaaagccaaagtccctcaccctggatgaacagtggatgagcccttgattggcagccatctcccttgggatgtaaacgtgggtcaggacttggaatttccaacttaggtaggcagcacactagattatttctgctttacttttatttctctaaggcagtagcccttccccctcaaaaaaaaaactatctgtaaccaccacaatgaaaaaacaatattgcacagaagaattggaaagccaccattattatgtcacataatcaagacaagattctgaaactcgattgaaaaagatgaacttgtttccaaccggcc

SEQ ID NO: 134394 - DNA, 1080 bp, Homo sapiens
ctcccaccttagcctcccgagtagcgagtatcttgtggcactgattcttttttttttttttttattttgatagagatttcgtcatgttggccaggctggtctcaaactcctgtgtttaagccatccacccacctcgacctctcaaagtgctgggattacacacgtaagccactgtgcccagcctcatttacagatttaattatgtctgtacactccaaatagtcctcttgtctcctccctcagagccccactggcattctccagctagatctaatccattttgctaacagaccaccacagttctgtctctactcacctccccaccagccagtctttcaacagctccactttgcctagaggaataaaaccaaactgtttggcttgatgtacccaacacttactactctggccctagacaaactttccagaatcttctctagagactgacctcaccctctctaaactcttaactggatgttctctcaaatccctgaatacaggatgtgtattttcatcagctgtttttcctgtctgaaatgccctttctcccctcagggccctcatcgtacccaaactccaaaaagtccctcttaattgttccttggtctatgagttcccttttaagccagtccttttttctctgagctctaacaaagctgtgtaatgactgctaggatgtttacccagtggacttgcatgatctggttgtttgtagctcctgttcccctatggcatcttcaggacaaatgcccaatgaccattaattgtagaatgaatgaagagagcaaaactgacttggtaaactattaatggggtagaggcagggagggagtcaggggacctggtccttgtcaatagcatttctctctagttgagagggtcattggtttggtacttcattttccatcccttctctttcttcaccacttcatctctttctttgaaaagttctatgaaggaaaacttttcaaagaaagttatgaaggaaataaaatccttcataactctgtactctcaaaaacagttggacaaagtaatagaacagtgctggccaaggcattgtaataaaacaaacttgaa

SEQ ID NO: 134395 - DNA, 1067 bp, Homo sapiens
acttccctatgagcaatgcaaagctgactaaagttcaaaccatgttatcaatgaacatttcctacttcacagagaatatgaaacactttgaacattagtgcctcctcctctgaacttaaatataacagcggtagatatcccagagttcagcgcggcaccagcccttccgccacggccgcctctggagagcagcaaccatggctctaggctaccctatggccatgggcctcttcaagggccacaaggtgaccaagaacgtgagcaaacccaggcacagcagccgccgcaggcgtctgaccaaacacaccaagttcgtgtgggacatgattcgggaggtgtgtggctttgccccgtacaagcggcgtgccatggagctactgaaggtctccaaggacaaacaggccctcaaatttatcaagaaaagggtggggatgcacatccgcgccaagaggaagcaggaggagctgagcaacgtactggccgccatgaggaaagctgctgccaagaaagactgagcccccttcccctgccctctccctgaaataaagaatagcttgacagaaagaaaaaaaaattatatatatataaaacagcacccattccttttgatctccttccctcacatgtccttcctcacttccagagctagcttgtcaccctatggacctgatcctttcccatctgtctttttccaggactgtgttccatcagccatgccctctcattcctgtcatcaattacttccactctggcttcttctcctcagcctgcaaacaagctcaagtattggaaatcctttaaaaaaaaaaaagaaaataaataaaaaccttatgttccccttccagtttttcccttgcaaaatgtatcgaaattacattgaaacgtattgaaaaagtaatctgcacctgttgtcttgactgcctcaattccctttagccctcagcccatcacaatacaaatcccctaagcctccatttaaacatcacactggggtcaccagtagctgataatgaaaactaataccttactagtgatcatgagtaaacttgtcaaacaacacactggcc

SEQ ID NO: 134396 - DNA, 1011 bp, Homo sapiens
tcttactattcttttaatgttggtagatctggtgatgttccttcttatattcttttttcatttttgagataggatcttgctctgtcactgaggttggagtgcagtggcatgatcatggcttattgcaacctccacttcctgggctcaagtgatctttccacctcagcctcccaagtagctgggactacaggcatgtgccaccatgcccagctaatttttgtatttatttatttatttatttatttatttatttattggtagagacagggtttcaccatgttgctcaggttggtcttgaactcctaggctcaagtgatccactcaccttggcctcccaaagtgttgggattacaggcgtgagccactgtccttggccttaaattcttgatattggtcatttgtgtcttttctttcttgatcattctgactaaagatttatttatttattttttcaaagaaaaacctttttgtttcatggaattttttctttttaatttgtttttctgggttttatttcataggtttctgctcatatctttattatgttgctccttatgtttgctttgggtttatattgccttcctttttctagtttcttaaactgaatacttactcactttagatcattcttcttttctcaatatacagttttttctaagtgagcataaccgcatgattttattgttttcagagttaacaaaagttgcagctcagatctggatcattggccttttctcttattatgtcttctcagttcaaaatgcttgtgtctgtattaatagccagcattttcttagatttgcagttggagtttcttagatcaagcattcaagcctcagcataatcttctacatagtttcagcttttcttctggaaattgggcttggtctgtttaccatagccaccctgcctcccattgcaacactgctctccctgggcatacagagtttgtgccctcctgtgctgtgtcattttgtgggctcagtgcttgctactcttcttactgaaagc

SEQ ID NO: 134397 - DNA, 1002 bp, Homo sapiens
gaggcccagctgcatggacttgatgagagatggcttgaagaacatctccgagcagaggaaccgttcctggcacagctgaatctccttcccatccggcagcacgtagcggatcgtatgctcactgagagggactttcttctcctcaatgggatccagggccacaaagcagcatttcttcttgatgtcctccacgatgcccatctggtcctgggtgaattcgttccccgcactgttcagcaggcccagcaggtaggctgtcaggtcagagcccgcgtagtccagccttccggtgatgctgggcaaaggataaccctcgtagatggggaccacgtaggacacgccatggcccacctccaccaccaggccggaggtccttccataggagtacatggacaggcgcgactggtaggcgatgtgcattgcaggggtgttgaaggcttcaaacagcatttcagcatatttctctctgttggtgtgtgggctcagtggcgggtctgaaaccaagaccgcatgctcctccggggcgatcttcatctcttgtcggaagagatattcccagatatcctgcactgtatcccagtccacgatgatgccatgtcgcagagggttaaccagcttgagatgaacgtttgtgttgttgagttcctgccccacgaatgtctccttgcgattatccccagtcttggcggtctccatgtagggcttgcccaccgttgttgagatcttgtgggtgggtcttggcaggccggcaaagccacatttacagtagccagtgcccaggtccacgaccactgctttggtcacctcctgcttgggcctctccttggctgcctttgattcagtaggttcttgtggctctgaactcgtatggcggacccacacggcccgcttcgccgggccatcccttaaagaggcagtctggagggcctgtgtctgcaggggggcctggttgcccaccttcttggtgggcccatcccccatgattgctgctggtggagccca

SEQ ID NO: 134398 - DNA, 1043 bp, Homo sapiens
ttattttcatggtgagtctagaaaacgcccacttcattctgattaaaaattcttccatgttttaaatatcagaaccagacctttcttactgtgtatcttagcccatttgtgtctctataacaacaaccagctttcaaaggaactaatagagtgaaaactcactcattaccacgaggatggcacaagcgattcacgtaggatctgcccctgtgaccaaaacacctcccattgggccccacttccaacactggtgatcacatttcaacatgaggtttagggaaacaaatgcctaaactacagcactgtacataaactaacaggaaatgctgcttttgatcctcaaagaagtgatatagccaaaattgtaatttaagaagcctttcccagtatagcaagatgttaactatagaatcaatctaggagtattcactgtaaaattcaacttttctgtatgtttgaacattttcacaatctcataggagtttttaaaaagaagagaaagaagatatactttgctttggagaaatctactttttgacttacatgggtttgctgtaattaagtgcccaatattgaaaggctgcaagtactttgtaatcactctttggcatgggtaaataagcatggtaacttatattgaaatatagtgctcttgctttggataactgtaaagggacccatgctgatagactggaaatagaagtaaatgtgtttattgataatggtgtgaattttcctggacattcagtttccttaaataatgtattgaagcagcaagaaataatttgtttgaatgcaaattactatcaattactgtttctctcatctgagcaggattggattttgttcctttttagaagaagcaggcaggaggagaccttccaaattgaggcaaagccaagaattgaatattcatgggggaaaattgagtgtatgagaaaaggaggaaactcctctgagtgatgaatgcttaatttgggggaaagagtctgtcaagttttagaaaagagtacataaatttggatcctgtcccaaagcaagtt

SEQ ID NO: 134399 - DNA, 1076 bp, Homo sapiens
ggaagaagcacagcctcaaagaaggcagtccgctggaggacctggccctcctggaggcactgagtgaagtggtgcagaacactgaaaacctgaaaggtatattctcagtcctgatgatgattcctgaccacaaacaatagtgaataggcagtacagacaggcagagttcagtaggtgattaagctaccattttcccaatttgaggaaagatgagaacttttagcaggaagggtcatgtctgcacacattcctgaagcagcccttcttagctggtaactgagaagccttcctccatttggcatccccctaactgaactgggagagatgcttaggccaggataaagaattgtgggacactgctttctgcgtaggccccccagcgtgcttgattttctttttgtagtacatgtgtttaattattccagcatttgggaagaaaaaagataatgtgggagaaaggacctgcagtgggatcatagaaatttttggctttggatagaagctatgtatgattctgtcaatggagctgggaatataacttaccactctttcaaatttcttctctctagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccggtaagttttctcagagacggtgtgcatttttttcatcattttcatgggttattgtattcacacaatctccaagtcaaaaagttttcctgttcttaaaacataagatgccatagttaaattatcttagatttatgtgtaagctgtcagtaagatttgatatttgcctgtagagtgactagtataccttggcataggttaaatggactgtcattttcctttctggatgaagtagctgtcatggagaaaatgggaaagtcacatgattgctcctggccttcaatgaggttggagtggggagagatgggggaagatggggtcagagacggcctctcactttcctttcagaactcag

SEQ ID NO: 134400 - DNA, 1042 bp, Homo sapiens
acatcattcctcatctataataatctaaccagctcttacttagattttcaccactaatgagaacctttcttagataaatgccgataattcatctacataggcccaaaacctattaataaaatgcatccttggatagtagtattttgcttttttaaaatgtattctactagtgttatttttctcttgtgtatttttccattggacaatatttattagatacattttttccacatccatgggcattttgatggatgtttagccagaaacatttaggtaattttcttcttatttttgttaactgagctcccctcccctaccccccctttttttgtttgtttgttttgtttgtttgtttgttttgccaatcctcccttgctttaggtatcaagtcttcgttcaggtgattttacaagttcagtggtagcgcatattctgggataatgttgatgaactctaagatctggaatctcagtctctaatttgttaatgcttattaaggaaaaagagctcgcttggaaaacctagtaacctctttctttttgctgaattttaaccctccttcactgctccccgcctttagttttttctctttgcttaaacctcatgctcaaactattttccattctgcatctccagcccagaaaaattatatggcatttctggactctcagacagccacattcagtcgccacaagaaacgtttattggtagttcgagagctcaaggagcaagcccagcaggcaggtctgggtgagtatctgcgtgaaggccatcgacgtgcgggggcagtggggttgggtaacgccacacattgtctagattgcttggtgatccgcctgcaatctgattactgtgccatgggcaagtgtgaggcttctgtggagccccttcagggccctctgtgtctgtgtttgtgtgttggtgaagggcaggaccaagcatgaatggggagagctctgccagacattcccacctacccccattcacccagagcagctgaccacttccgtgtctaacaaaatgagtttcctcatttccagaa

SEQ ID NO: 134401 - DNA, 1363 bp, Homo sapiens
catgttgtattcctctctgaatctctggctaacatccagcctggagaatcgaggatttggccagtggctacctctttgcccttgttttctgttctcttccacactctctctgctctagtcacactggccgtcctgttactcctcagacctgctatacacattcctgctgcatggccatggtgccttctctgccctctgcctggtgccccctatctcatcacgtggtttattctcctgacagccattagagctcacactccctgagagctgcaaggagactgtcctctgtccctttactcacgtttgccattatgctatagactatattttgtccctaagtccatcctctgttactataagagcagcaacttggtggtggttcttatatggtttttcatttgtttggttttattttttgccttgctgtagtatccatactgcccagaatggtgcatatgtagttaagagtaattatttgttgagtgaataaatggcacatcctcagtaaggttttgaatgaaaaaatgactgtactaactgatcaactgtaagattttcccaggtaattctttcaagggagttccaagtataggaactaaggcagctacactggagctttagagaaatgattgtcatatttcctcctcagtcctaaatctcctcttgtcacaggatatcagcattgcttatggggagcacctgatgcaggagcacatgtatgagccagcggggctcatgtttgcccgttgcggtgcccacgagaaagctctctcagcctttctgacatgtggcaactggaagcaagccctctgtgtggcagcccagcttaactttaccaaagaccagctggtgggcctcggcagaactctggcaggtaagtacaatcatttatatgtttacatctacaaaggttttaaaaaatttatttcttttgtttggtaattttgcaaataaatttagggcagaatactctgagacagtcttgttctcactgataaaaattaatttagaatgctttaaaggataagctactacagcaagagtcccagaatgcagtggcccaatatggaaagaagtttatttctctctcccatagggatttataggcccttccgttgtgtggctctgcaaccttttaggcagatggttgtagctgggttatctccacagctgtggggaaggaaggagagtggggagaagttagaatcatggtaaaacatttacctttaagttggaaatgacctggatggaagttaaactatcaccttctattccatctcggccacgccatgtagctggatgggctgtgccctgtaagaaggtaaagatgaatttttggatgggtccattctgttatagacag

SEQ ID NO: 134402 - DNA, 1669 bp, Homo sapiens
tttactctagcttactttgtacttaaactaatatgatctgaacgaagatgttttgtcctttttttggtaggtgtttcttggaaatgtggaaaccttcattaaacagatagattctgtgaatcatattaacttgttttttacagaattgaagtaagtattttgaataattcatgtgtatcttttccatagttttctctcttcttgttaaggaaatcaagcataaatagctagagaagaaaaattccttactgttcatttttaaaaattgctataactcttagatgccagttggttttttgctcttttccgttctttttaaaacagcctgtttaaaactatgtccttaaaacatgtcattcagaattattatttcacttgatttttaggtatacatataaaactacttgtttttcctaggagactgaaatcaaatggcatctttctctctgatgatctttcccctcaactttttaatgaaacactttcaaaatagagaaaagttgagagaattgtccagtaagcaacctatatataccccacctggattcgccagtttatatttttctgtatacacattctcattctctataatctgtccatccatcattcatcttgtttgtagacaaattgctaagtgagttgtagacatcagtccactctaccacctgtacttctccttgtatatcattaactagagggcattctttgtgtatgggttggttttgttgtgttttttcaggtcatatttatctacagtgaaatgtccaaatcttaagtgtgccacttagtgagttttggcaaatgtacacttcatgtaacctgaacctctgtcaagttagagggcatttactccttttcagaaagctgcttcagattcctttcaatcagtccctgtcccattccccaggcaactactcttctgaattttttaccataaatcagttttgcctgttcaagaacttcacctaaatggaagcatacagtattactcttctgcataaagctgttttcattcagcatattgtcttgagattcatctgtgtttttatatgtatcactagttcattctttttttattggtcagtagtatgccgttgtgtaaatacaccactatttgcttattcattcccctgttgctggacatgtggattgtactaccctgtttggggctaatgtgactaaaacatctacaaacatttgtataagtcttttgtggacatgttttatttctcaatatttttataattcaactcttttccaaaagtcatttttatttatcatcatcagcatgccaggtgtatgttagtaatttgatcgctgggctacatgttctgttgatgaccattccatacacacctgttcttagagaagaagatgtcacgaagaccatgtaccctgcaccagttaccagcagtgtctacctgtccagggatcctgacgggaataaaatagaccttgtctgcgatgctatgagagcagtcatggagagcataaatcctcataagtatgtatgctgtcaccaggtggcatcctttgaaaaaccgaagtgtgtagttgtccttgtccagcctacttacctttctcattctggtgttcttcacttattacctcagatactgcctatccatacttacatctcatgtaaagaagacaaccccagaactggaaa

SEQ ID NO: 134403 - DNA, 2220 bp, Homo sapiens
agctttcacccatgcctctctggccttctcttgcaggttgcgtcaaatatcacgtcatttgcagtatatgatgagtttttattgttgacaacccattcccatacctgccagtgtttttgcctgagggatgcttcatttaaaagtaagttttcaatgtataaaacagaaatggtcccttctccaatgtcttttggagtcttgatgactttttgaattcttcatttattttggctttttatcaaggagtcctaggctggagaaaatctttagagttattttacttagaccctaatctcaacataatatctcagttaaatcattctgcactttagtaaagacatccaaggaagggagttccttccttaagcagcacattctaaagttaaaaacttttcaggaaattttattatgtaactgatctaatattttatttggaattactatgtagatccccaatgttttaccttctgtgtagtcttttcccactgtgcccaccctccactgtacatctgcgctccatctagtggtttgtaggatattggctgcattttgtcttctgttccatgccctatctatctctgtgtgtgtggcgtgtatgtgtgtgtggcgtgtatgtgtgtgtggcgtgtatgtgtgtgtggcgtgtatgtgtgtgtggcgtgtatgtgtgtgtggcgtgtatgtgtgtgtggcgtgtatgtgtgtgtggcgtgtatgtgtgtgtggcgtgtatgtgtgtgtggcgtgtatgtgtgtgtggcgtgtatgtgtgtgtggcgtgtatgtgtgtgtggcgtgtatgtgtgtgtgtgttccttattctaaaaagccaacttattttctttgcttccaacttggaaatagggaatctttctttcattgatatgattatagtacactgataatgctaagaaatagagaagttgccccaattcttaactgtgtttctccacatcatttgagaagctgtgtatgtgaatgtgcatgagggctctgtaagagagagggcaagttccagggatgagcgtgttcatcagcagggctgatagtcttgaggttcagtgggagagctaaggcacatggttgttatttgttctcttctatttcacataatgtgtgcggtttcaattgcagttaatggagagtggcttgttgtgataattaaggcttattagttaatggtgtgtttagcattacaggccggcctgagcagcaatcatgtgtcccatggggaagttctgcggaaagtggagaggggttcacggattgtcactgttgtgccccaggacacaaagcttgtattacaggtaagctggtttttcagacaagatagatagtctgattgtcattcagccaagtaccaagcataattcttgcaggttgtattttaggctttcttattctttgtatcgtttattgtaaacctttccttgatagttttctgttagctttattcaaaggagtgttgatacaggctgtgaccataaggctcaaagcgaaacttttcttgaaagtcaagataaatatagagaacaacaagattctgctaaaagtgtgctgattttagagagttgtggtaattctctgtgaagagttaggtaaaatggtgtatcctggctatttaaatgttttctacttaattaaaaatgttactgctttaatttatttaagatgccaaggggaaacttagaagttgttcatcatcgagccctggttttagctcagattcggaagtggttggacaagtaagtgccattgtactgtttgcgactagttagcttgtgatttatgtgtgaagacaataagtattttattacaatttcgagaacttaaaattatgaaaagccctcattacctatatcatcaatcagattcttagaggctcttttttttttttttaacttttttactttaatgcagtattttgtagtggagattcctagcagaaagaatcgtgacactcatcatataaaggagggcttctcttaacctgagggaacacatgtgggttttaggtggcctgtgaacccagggagattgtacacaccaaaccttgtctttgtgtatttattcaagtagaaagcccacagctttcaatagatttacagcggggcctatgacccagaaaagcctgagctactcttgtgaaggaaatgactgattttctgaacctatttggaggaaactttgtattggaaagatctatactaatgttttgtt

SEQ ID NO: 134404 - DNA, 1050 bp, Homo sapiens
gcaagtgtattctactcctgtttcctcttttaatgaactaacgtactcttaaaaaagtgattgatgactatcgcagggacaaaaaaccaaacaccgcatgttctcactcataggtgggaactgaacagtgagaacacttggacacaggaaggagaacatcacacacctgggcctgtcgtggggtgggggagggtggagggatagcattaggagatatacctaatgtaaatgacaagttaatgggtgcagcacaccaacatggcacatgtatacatatgtaacaaacctgcacattgtgcacatgtaccctagaacttaaagtataataaaaatatatatataaataaataatgccagcattagagaaaaaaagtgattgaaattgcatgttaagtgttttagcaaatgttgatgttgatggttttttgcaaagagcgcatcagctatttgtgaactagatctgtgaatcttgcagagtcaccttctctggctattaaaccatggaagaactctggtggatttcctgttcggtttccttatccatgcacccagaccgaattggccatgattggagaagaggtaggtgaacacggagcaggaaatttacttaaagtagttacccagggactgatggcattaagtagaaagagcgtgggctttggaggtggacttgggtctccactaaatgcctagacaatagtgggaaatgatctcactttcataagccacaccttattcatctataaaatgggaaaatcagtatctgtctatcagggttcagaagactaaatgagataatatatgtgattagcaaccttttatccctagttgtacaaatcattcaaagttaattttatttaggaggggaaacagaaatgtgatcttgagaatagttttagtagatttttattcaacacatactagaatgcctataattgtggtggatggtagaatgcagtggctggaaaacaaaaccgcttgactaattcctgctcttctggaacttgtgatctattaatttcaatgtaatgattccctttgttgggagtg

SEQ ID NO: 134405 - DNA, 1306 bp, Homo sapiens
tgggcgcctgtagtcctagctactcgagaggctgaggcaggagaatggcatgaacccgggagatggagcttgcagtgagccgagattgcgccactgcactccagcctggccggcagagcgagactctgtgtcaataaaaaaaaaaaaaaaacgaaaataaacatatgaataaaagttaaaaatagaaaaaaaacaagaaaataaacatatatttctgaccttattgattcttgatattttatctgcatggaaagctattttttggcagttattattgttcttattttagagacgaggctgagcaggaagggtcctttgaaaaagaaaagattgcccttgaacccctctggcaagtgggatgaagtctgcttcccagcctctaacggccttcttttcattttcccttgcagttcagctctggactgttggaaactatcactggtatctcaagcaaagtttatccttcagcacctgtgggaagagcaagattgtgtctctgatgtgggaccctgtgaccccataccggctgcatgttctctgtcagggctggcattacctcgcctatgattggcactggacgactgaccggagcgtgggagataattcaagtgacttgtccaatgtggctgtcattgatggaagtaagctcctgggaagtgtgtccatgagcctgcaaggggtcctgagcctagggcctgcagatgtggtggtttgactggaacagtggggaatctttatttgttttggctgtttgggttacttgtttttttattgaatgggatataaggtggggtatgttctctcctgagaaccattgtcccccctcccccaccagtttcctgttatactgcatctgtggccttcacacgtttacttgcctggcctttgaagacactgaaaactttgactctaggtagagaggatgacaacagtacagtcttgtgggattgggtgtgttagctttatctgtttgccctgacacagatttataattgacccttataccaccccacttgtgttgctttgtttcctgatacaaatgcttgctgatatatacctctccagtatgttcagttcatgcataaacgtttgcctaatatgaagattaggtttatattttataatgaggtagaaggtttttttagggggtggggtgggaagggcaagactgaagagtgaagtagtcaccttaatgaatagtttcattgctgatatgaaagggagcactggcttctaagattgtaatgtgaggtggtatattaattcatattctgtgtaatattctacataatactgattttatagt

SEQ ID NO: 134406 - DNA, 1038 bp, Homo sapiens
atttggtgaagtcttaaaaaagacctactggagcatagaatatttgctgaagttgtataatggaaggagaaatagattttgatttttaggacattatacctggaatggtttagataacttattatttttaaagtcatccaaatgcaatgtaaatatgtaaggttttgtgggcaaatggagcctctgtgtaaaacaggaaaaggcactctttcctctgggcaagtacagtcccacagtgggatgaaccgctcgccgagagacaagggacacatgggatttaaaacttccttggataaagatattcattaattcgttcattcattcattcatgtttgctggaaaaaaaactcttctggattttatctattctttagttaggtgagctttcgatattgtaacactctgagtttgctttaagaccctcaggcagtttgattgcatctacacaagataaacccaaccagcaggatattgtgttttttgagaaaaatggactccttcatggacactttacacttcccttccttaaagatgaggttaaggtaagtgcctgagtttgtttcaccctcgaatgtagaggactttccatagctatagagggaattttttttttttttttttgagatggagtttcattcttgttgcccaggttggagtgcgatagtgcaatctcggttcactgcaacctccgcctcctaggttcaagtgattctcctgcctcagcctcccgagtagctgggattacaggcttgcgccaccacagccagctaattttgtatttttagtagagacggggtttctccgtgttggtcaggctggtctcaaacccctgacctcaggtgatccacccgcctctgcctcccaaagtgctgggattacaggcgtgagccaccacgcctggcctatagaggggatttatatttgatatggatatataaatagtagctttagagtaaatagtaataaaaatggtggcttcctagaactgatttttatttaataaaatattgtttttccagtgattttgcaaataatagc

SEQ ID NO: 134407 - DNA, 1254 bp, Homo sapiens
tctagatctgtagctcttttcctcttttgctgttctcagaggccactttttttttttttaatgccgaaaggaggattttgtttgttttacatttttttcttctttttgatgatttctgcgttctaagaaccaacccttggatggtttctgattctagaggcaggctttcaaagtagcttaaacctcttaaaaaacatctgtatctagtggtctgaggcttgtttgattctgggatacttaaggtcccccagtaatattggtgtttgttcccctttttagcatgagtctgctttgccctgggatgaccatagaccacaagttacctggcggggggatggacagttttttgctgtgagtgttgtttgcccagaaacaggtatggaaatatattgcagttaaacaacaataaaaaatttttatcttattaaaattaaggaaaattttctttcttttgctttgagtagggtattaattatacatatgaggcaaggatgtgctgctttaaatgtgaaatgaggttagagttaagaattagaagagtcctttgaggccatttggtccatcctcctacctggtggacacaaatttgtaacaaaattaatctaattggctatgtaaaaccatggcagtttttatttgtaaggaaggtgtttgaatagttctgaattgacaacttttatcataatgttttaagtgtgtatgtgtgtttgactccactcccgcacaggggctcggaaggtcagagtgtggaaccgagagtttgctttgcagtcaaccagtgagcctgtggcaggactgggaccagccctggcttggaagtgagtgggagaagaaaccttagagaaattcttggaaccagagtagaggtggtggtacacatggatacagatgatacagatgtttgtgtaacacaaaaggatttttacgtttcttcatttggttataaggctgtatctatctttgtttcttcttttttttttttcttattccctgaagtctgaattcaactcgaatagtagattttacgcttcttcacagatttcattgttccaaggccgcatatattttgcattcctaactcttaaaaggctgtggttttaaggcagggtatatatgaagccattgtacagagcagaaaatggtgtttagaagggaaggcccagtttgcaaggctctgtggggcaaatggtgcttttgtggaaattagggaaagagcctccttccttggcacaaaattcctacagcagaggatct

SEQ ID NO: 134408 - DNA, 1817 bp, Homo sapiens
ttaaccatcccaacttccctcagcccctcactacccttcccagcctctggtaaccatccttgtactctctgtgtccgtgagttcaattgttttgatttttagatcgcacaaataagtgagaacatgtgatgtttgtctttttgtgtctggtttatttcacttaatgtaatcatctccagttccatctatgttgttgcagatgacaggatcttattctttttttatggctgaatagtactccattgtgtatagtaccacaatttctttatccagtcatccattgatggacacttaggttgcttccaaatcttagctattgtgaacagagctgcaacaaacatgagagtgcagatatctcttccatatactgatgtcttttcgttttgtttttttaattgttttgattgaagttgcagtcagtttttactgagatgctagtgtttgaatctctcttttcaattttctctgtctcagctggagtgtgttgggagtgtagccagtggtatctctgttatgagttggagtcctgaccaagagctggtgcttcttgccacaggtaagcttgttactggtgcctcactggcttttttaaaacattattccagatgtcttacaggcttcatcagctttaggctgcttgaatttcaaaaaatttctttgaaccagtataataccaattatgaaccagtataataccaattatgtatgtgtgtgtgtatatatatataaaacgtagagtgatttttttttggtgactgaagttttgcctcttagtctatcattataaaaagttgtttcatgtaactttttaagtctttgggagtaagaaacaaagtcataaaacttggggaggctgctaagtccccagttagagttaaaaatgtcagcaatatgtattttaacttattctaagagttgctgtatggacacattctaaaagcccttcttgggttctgttgctgtttttcccctttaagtctcatcattccagatgagtttagtaaaccagctccactgatgacatttatatttagaggtatcttggggacaaggagtgttgaagttagtggaggagggctttgtggacttttaagttcaactgtacacacattaatagctgagcataagcaccaggtgacttatctagggaaagctttttggggttttttgtcattgttgtttttttaagtcaaagcattttggatgaattctgtctgctctgttcagactaactccagctccttagcttacagtgccataggtacttaggaatggcaaatttgttacatgaaaacaaaatcatttttgtttgtgtttctctaaggtcaacagaccctgattatgatgacaaaagattttgagccaatcctggagcagcagatccatcaggatgattttggtgaaagtaagtatagctttgtgcaatattttgtgacctacgtttcttcccatttttgaccatttccttgtgcactaatagccatgtcattaggccaaagaactgtgaaagttaaacccccagctattaaatgtctattagcccagttccttcagcccatcccaaatcttaaaaggcctactgatgcctctccaggtctgagggtttaaggtcacttagatagttattacccaaaccctaggaaagtcttaggctgggctttcagtgaaagggactgtacaaggtagtatttctgggatacagttttagggagaagaaaagaagaaagatggaatagaaggctggtttttgttactacgattagatccaatctgcatttccatgggaacaatcagattattttcttgctaaaatctag

SEQ ID NO: 134409 - DNA, 1003 bp, Homo sapiens
tagaaaaaatatttttgaaagcttttatgtaataaaagaagcattaaaaagtatttctggaaatgttatcaattattcttgaaagtagactgggttaatttgcttgtgtttactttggtgaaaggtgaaaaatgaagtttctttggtggcagaaggctttctcccagaggatggaagtggccgcattgttggtgttcaggacttgctggatcaggagtctgtgtgtgtggccacagcctctggagacgtcatactctgcagtctcagcacacaacaggtaagtggaagactccagtgaggggggagtctcaagcatcctcaaataggttacttgctatttgtggaagttttcaaatcagtagccataatagttacacttttgctaattaatttttgcattatatatttctttatttaaaaaattgttaacatggctttatctatatgttaagattcttctaaaactgagttttgtctgctgcatctattaatcagagtgatcagaatgttccaaatgagaatatatttttttaaaagttaaaactggctattcttatgtggtgtagatcacctcttatcagaccctcatcttgagttgcaacctttgtttctcaatttaggaagtctttgtttatctgacttagattttctgttatgaatgttgattggctaaatttagagtccctgaagtctaggcactaaagtaaatacattgtcattacctgcacatgtgatgactgccagtagagctagacttcaagcaattgcttctttctctactttagtgtatagttgagtttctgatttctatcctcaccttcttaacagcaagggtttcaaattacacttggctgattctttaaatcttcttccattacttcattagttgtgatctccttaacattgattatgtcacagaagttagagtattactaatagtaggataatgatagcagcttacatttattaactatcatgtgcctggcactttttaaagtgcttt

SEQ ID NO: 134410 - DNA, 1041 bp, Homo sapiens
aaaataaaatgtttccccattcatttgttctttcaactttcccaaaggaataactgatattacatcttttttgaagaaaacattctaaagttgagaatcttgcctctcctaaaaagaacataaaataggtttcagaattcctaatttgtagaccataactgtatagagtgggtcaggttgctgctataatccatacatgggtgtgtactcagagaggtaagttttttcttttcttggttattctgattctgactaccacttcttcaccccctgaatcatttcatttaaataaatatggtcatttatcactattaagctatttatttttctcttagagattaatgattcatcaagggatagttgtacttgtctcgtgggaatcacttcatcatgcgaaatctgaaattatttcggaccctggagttcagggatattcaaggtccagggaatcctcagtgcttctctctccgaactgaacaggggacggtgctcattggttcagaacatggcctgatagaagtagaccctgtctcaagagaagtaagttactgatgtagaatgccagcatgtgggtatgacccttgatttctcttcttccaaatttctttccccacatggtctttctttatatcttattgaatttatatcctcccaaataaacatcttttgcttcatatatatgccatgttagacatagcttaaatcgtaatccttctttaactctgctgctattttaacctaagtcagtagaactctgaccttactttttgagtgtgtgccgtactttttaccctctttgtcatgcaaattctgtttataagagtggttttttttttttttttttttgagacggagtctcgctctgtcacccaggctggagtgcagtggtgtgatcgtggctcactgcaagctccgcctccccgggttcacaccattctcctgcctcagcctcccgagaagctgggactacaggcgcccgccaccgcgcccggctaattttttgtatttttagtagatgtgcggtttcaccgtgttagccag

SEQ ID NO: 134411 - DNA, 1087 bp, Homo sapiens
ttactacttaattttgtaatttttttttcagagtgaaaccagatactaattgtcttaactctttccagcttcagatggaaaataacggatgggtctcagttacaaataaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatgaaactgattgtaaagctttttgacaactaataaatgtcttggtaattgctagattctaattgtagtgtgatttttaaaatagaacattgcactaatgttctttaaaagtcaaaccaaatatcccaactgtctcaaggacaatttaatccacaagaagctattttgaatatgtgcttagctttggcatattttaccttaactgttttctttatcatctagatcactaatgtcagcagcaaacatacagtagtctgggtgaatgcagggttttccttaaacctgtggactcttcaatccctctgtttaccaagtgtgacaaaaatccccttgatgaccctgtcccagattgtccatgccagcagcaagtttgttccctaataagcattttgtacagcaagggtgggtctgctgtgctgtgtatgtccctcacctactcccaaaagtaaggtaatggaactccacagaatcctggaacaactcctggagagtatgagatgggtttttggttctagttctagcatagctggccagtctgccctgaatattagctgggattctaagcctatcttatagacttaaaagatattttgaactttctcagtattgattgatggaatggaagacaaagacagaataaggaagccaagaatctatttaaattctgaatatcacacatttgaaatgttcactataaaacaaaacaaaaaacatctttctttagtctttttaatttaggagtttaaagcttttcttgtttttgtgggtggggtcatgattgaaggatctggtttataggttttctccttataata

SEQ ID NO: 134412 - DNA, 1032 bp, Homo sapiens
ccctgcattcacccagactactgtatgtttgctgctgacattagtgatctagatgataaagaaaacagttaaggtaaaatatgccaaagctaagcacatattcaaaatagcttcttgtggattaaattgtccttgagacagttgggatatttggtttgacttttaaagaacattagtgcaatgttctattttaaaaatcacactacaattagaatctagcaattaccaagacatttattagttgtcaaaaagctttacaatcagtttcatgatcagaaaatagagcaaaatttcaatattgttttctttataaaattgatgaatttctgaaaagataaaggatcatttgatttttaaaaatgtcagcttcatcacatgatgttccagagatctgaccccaaaagcttctcaagttttactatccatagtgtccttatttgtaactgagacccatccgttattttccatctgaagctggaaagagttaagacaattagtatctggtttcactctgaaaaaaaaattacaaaattaagtagtaactattttcttttaaaccattttttaaagtatgagtctaaaatagaaaaactacctcaccttcttcagcagtttataacaaagtgaaagaagttggactaagagagccatcatggatcttgtcttcgtaatacacttgtcaacctacaatgacaaaaagcatgcaaatgatattctaaaagtagtacttaaaagaccttaccatttatttagttttaacatgataaaatttctccatatggaaatctaagggatcttgaaagagatatggatttaggcacatgagctgactcaaagccccaggacacaggtgcaggggtagctgcctagatttcatgtctatctcatggaaccccagcagaaagagtgggtggaaaattaatcattctactgcaggctgtttaggggcttctcaaaacactccaaatagtggaattaaatcccatcctttgcaattccttgcactctattttgtgggcacaaacccatatt

SEQ ID NO: 134413 - DNA, 1872 bp, Homo sapiens
taaaaatatatgtatgagaagatctttttccttaaagtattagtgatgattttccttcctaagctaagtgtacacatgagtgttttgttttattgtaatttatactgtgtgtgcaggtatgtgaatccatacccaatgtgtgtttgtgagtgtgtatgacttaaatatatgtttccattgtaaaaagttggcccccttttctctacaaaccctagctgttctgggactcctgcctctaccatgggagctttcaccagatctcagagttggaggaatcccctctgtgggctatcatctccagagaacttcggaatatatttttcaaagaaatgttgctattggtggtggtgtgatttgtcctggtactctattcttcaagtatacaggcatcagtggactagcctggtctaactaggatggaatattttctccccttctagggaaaatacactctgagttccagatagtttacatgaaaacaaactttctctttcaaaaatagggaaccattgaacattggttcacatattaaattcagaatcctaagtataatctctttataacttgggatatgagattagcagttgtgatatctatgaagctagagagttgaaatttagccttccaagagcaaattagttaaaggaattgaattctggagtcataacataaggaatgtatagaaaactacatatagtggctaattttaatatatcatttcataagaataattcaagcattataagaatcttgttgaacagagaagccagggaggtttgggggacataataattggactccaggaatactgcagaagttgtcttgagtccctggaagcccttgtgaaaagaggagagcagctgtaagcacagaggccacagagcagggaaggcactgacttgctttctctggctccagatttcaaactaacaacctattcaaagctgaactcacttactagtagagtacttgcaattggtaaaatattcagtcattacatactgaatattttaaacttttgttacaagtactttgttatgctttgtattactattgtatttccttacagtttaatgtactgctttttaagataatcttaatctttttattgtcacagaagaataatgcaaacctgaaatcattaaagccagacaagcctgactctgaggtaagaccaattcctacatctaatcttcctttaacatgaatagtgataaagtcgttgtgattaaaacgtctgtttcataggagcaagccaagatagcaaagcttggacttaagctgggtttgctcacctctgacgctgactgcgaaattgagaagtgggaagatcaggagaatgagattgttcaatatggacggaacatgtccagtatggcctattctctgtatttatttactaggtaaatgtagttgtatttttattttttaaatcagtataatgatatctggtgtaaagaaaaaagttccatgttaaatcattgacaggttaaagtcggtatcaaatatatggtaaaaagactaaaagtagttactatgacaatttacgtaagtgaatgcaacaacaagacacatgtatttaattaggatttagatttagaagggatcttctgctaggtttctgcccactctttccatcattgaaataattttacatcctgcttttttgttatcctgcattgttaatgcctctcccagccagcatcagtacgttaagaaaacatgtcttttatgcctttatacagtgattgactagatacagatgaagattgattagacacagatcaaagaatagagctatgaggactatgtcaatagcgtgccaaatctctgtgagtcaccattcattatgtagagaattcccctaacttt

SEQ ID NO: 134414 - DNA, 1561 bp, Homo sapiens
agcttgtgtatagaaattacttcatagttgtttattgagttgaattgaacagcagacttacttacctttggtcttcaaagtgattctgagggctaagattttgaaattcacacaggtgtatattgtgtttctttagataatttctgctgctgaaacattgacattgcatccatctagtaaaattgctaaagaaaacctagatgtattttgtgaagcttgggaatcccaaattagtgacatgtcaacactgctgagagaaatcaatgacgtgtttgaaggaagacgaggtgagaaactgtccacataatgaaatatgttattattttaatgtaactcttgttagttttttaatgccaaacctcaactgcaaatgaattcttgtcgtaacccagctgggttatttttgtagtaaaatattgttcacaaaaaaattacaaaaatattattttatcctcctttattttagtatccaagcagtaaagtttgttgtacaacagtgtagtaggccaggtgtggcggctcacacctgtaatcccagcgctttgggaggccaaggcaggtggatcactttgaagccaggagttcgagcccaacctggccaacatggtgaaaccctgtctctactaaaaatacaaaaattagccgaatgtgttgatgtgcgcctgtaatcccagatactacggctgaggcacgagaatcacttgaacccgggaggcggaggttgcagtgagctgagatggcgccactgcagtccagcctgggcgacagagcaagactctgtctcaaaaaataaataaataaataaataaataaataaataaaacaaacagcatagtagatctctgaattaatattaacatcctagttttcctattgaaatagtcatttttaaatttcttctgaattgttttttaattataatacaacagctcttctataatgcagtaattctatgttttaattctactaacttcataatgaaatgaatgtagttatttgatttttgaattgctttccttccacttggatggaatctctttccttgatgactacataatcttggaatattgcctgtggtgggtaagttcattggtatttctacaacatgtagaatagtgccatacaatgtataggaaggcatcatttttattctttattttaataccgagtggaagttttgtttattttccattgtactgtgtgtcctgttatttatatttacatgtttatattttttctcttcaaatggcttctgtagtgtcaaagcttgcttatttttttaaataaaatgtcatttacaattatatcaaattacatattttttattgagtatgcccatttaaacatttcatattttaaaaatactcatttaggataaatgttaatttgcttaaaaatcagggcataatagaattatagctataacatcatttgtaaagtatgataaatgtttaccatgcttccacatttaaaaatttctgtgatagtctgaatggcaaatcattttgatgctttgtatttatagttacatagattttcatatgagccaaattttggatat

SEQ ID NO: 134415 - DNA, 1495 bp, Homo sapiens
caaatctcaaagactaatggttagaaggaacctttagactaattgaactggcttcctcttctttacttgtttacataggagccaaaaaacttctgggggaacattcttaaaatgactgtagatatagcttcttcatttaataaatttgatgctgctatgtttataaaccaaatattataactatagggaaactgcttattttaggaatcttgcagcaaatctttttaacattgaaaaaaaaaatgttctctgattttctgttttaagcgtcaagattttcagtaatttcctctgatatagggtctgtccttattataccagtctgcctaatccaatgttagctccattggaagacagtgttgatagaacatgtagcttgtagtaactctgacatagtttagctgtgagaccttgggcaagttacttctctgagccaaatttcttttttttttcccaaatttctttatatataaaatatgtgggcactactaggtctttccaaaggttctttctgttttaatattctgtaaccaccttgccatgattggataggaagtagaaacaatgttatacctttattgatatctgctttgttcccagagaatctgttggtgaccaatataatattataataatcttctcagtaatgtttaagtttattttaataggttttaagaaattttatttgtaaaattttctttttaattataaaatgatactatgtattgtggaggatgaggatgtgaaagttaaactgtagacatattgtcttgtagacctgtcgattgttacgacacatatctgggacagaacctctggaaataacctgtatacatgcagaggagacatttcaggtgactggccaacaggtatgataatagcagattgctccttctgtattgtgtcctatctgagtgttataacaagttgtgtggatggaaggtataaatggtttttcataactagagtccaaatatacatagagaaagaaagataatggaatttctgttggtagtgtgccagaacatggctaaccttccattggagctggtcatctgccaaattggagactggttcatttaattaatactctagtttatatctattttaaaggaagctgtttacaatgcacttgttataacatgtttggagattaagttatcatgacataagaagccatatgttatgtaatattcacatttcaacctaagattcaaatacatttcatgctaataattaggacatgagactaaaacacaaacaaaacaatgttatgacattacttacaagattcaattgggaccaggcatggtggctaacacctgtaacccagcactttctgaggctgatgtaggaggatcgtttgagtacaggagtttgagactagcctgggcaacacagcaagaccctctgtctacaaaaaataaaaaataaaaacaaacaaacaaaaattacccatgtacagtggtgcttacctatagtcctagctactcag

SEQ ID NO: 134416 - DNA, 1012 bp, Homo sapiens
tcaccagtgctacacaactcctactgttacacagggaactttacaccctcccctcagtggaacccatggaactgctttgcggcttctctttattaatagtttttaaagtgctgatgtggtgcttggtcacaaaatgttattgtttgttttctttccttcatcacccttctccttctccaccctcccacccccccacccacacacacatctgcagcttcatagtacagcgacacagctggcagcagatctattaaaataccatgctgatcatgtggttctaaaagcattaaaacttactggagtagaaggaaatttagaagctttggctgaatatgcctgtaaactctctgaacagaaagagcagcttgttgaggtgagtaaacaaggtgctaaagaaattgtagtttaataatggctttattaaactatgtgggaatgttaacacaaatacagttttgggttaatttatctgagcattttctctctcctttggcatcttaaaagcataccatgtatctgttctgttcctgcaacagtctggcctctaaaacaaaacaaaaaaaatgctaagacccacaaatgaacttcttaatcttcttttccttatcctctcagagaagttagaccttggagtagagccatggaggtacgtcgtatgaccttgtttctgtttgaatctgtcagggtctcagcagggaggagatgacacactcaaattaggacaatttgaagagagtttaataaagaagctgtttacaattgcatagacagggcatgggggaaaccatacatgagagagcagtaattggggcgagtggtagcaaggctggtaccaccccaggcccacatcagcaggggaatgtggaatggggaagcctttcagagaactgccttgagaggtttgtgattttaggactaggcccagagacagcccaaggtgaccctcccgggaggagcatgggagtcaaggcccattctctcctcagtcctgctcatctgtggatggggcttc

SEQ ID NO: 134417 - DNA, 1040 bp, Homo sapiens
ttgtatttttagtagagatggggtttcaccatgttggccaggctggtctcaaactcctgacctcaaacgatccacctgccctggcctcccaaagtgagccactgcacccaggcttaattcctttatattcttgaagacggtcaagggctcaagacaatgaaattagaattttaaaaaaattttcttatttttgagatggggtctcactttcttgcccagacaatggtgtgaacatggctcactgcagccttgaccttctggtctcaagtgatcctcctgcctcatcctcccatgtagctgggccacaggtgcatgccaccatgtctggctaattttttgtagagatagggtctcactattataagctcaggctggtcttgaactcctgggctcaagcagtgtttctgccttggcctccgaaagggctgggattacaggtgtaagccatcatgcctggctgaaattggtttttggatgtttcttatataaattttatacgtggtgatctgtttcacatcttacttggcactgatatgtctattgaaatctccatttaaacatcctgttaaacatagaaagacatggttttctatgctttataaaaagcctgctgcccttgacacaaggaaaaaaacaaaacaaaacaaaaaagaaagaaaaaagcctacccatttcattccagactattcagttttaaccaaagtattgttaaaatcctgactgtcagtagaagatgatctccttgtgataaactgagtggctttccacaggcttcattttcattacctcttatatgggtatatccatgtcaacctcatagaattcttgtaaggattaagggagataatgtatataaggctgctgtcaggacgttgcatagagcaggaactttgcgtttgtcctgcctccctctcttacacgtgacaagagttacatgaccttggcaagacacagtctctgtggagctgtttcgtagtctgtaaaataaatgactggcattagatattctctaaggtcctgctggtgaaacaaaatctttt

SEQ ID NO: 134418 - DNA, 1038 bp, Homo sapiens
atttagattgagtgatctgagaaagcctttctgagaaaaagacatttatgtaagatcttaaagatgagtaggattttaatttttaactaggttaggagtgaaagcatggacattctaggcagaaaataaaagagattaattttagacttgagtttattaaagaaaattagattttaaaagttcacctttcaatataatccataggttcacagaaaaataaataaataaaaaaacagaagttcatctatttgtagttagcattgaaaaatataactaaactgaaattttattttccactgtaacttaaacaggtaaattttgaaaatctacttttatagttcacagaatagtattaaaatttattacaatttacagtccaaacaaaattgtaattaacagattaaagagatgcggtaacattacatgtatactttttaaaatttttagcaaagcaagaaaacaaaaagcatcgctgaagaactggaactcagtattttgaaaatcagtcacagtcttaatgaacttaagaaagaagtaagtatagtttgaaatttagcctcttctaattctttgtgattttcatgttgtatgggtgtatgaaatacattagtattattagtatgtctctgtgcctagaaaatggttttaaaagttttcctttgaggccaggcatggtggctcatgcccgtaattccagcactgtggggaggccaaggtgggaggatcacttgagcctaggagtttgagattagcctgggcaacatggcaaaaccccatctctacaaaaaacacaaaagattagccaggtgtggtggttagcacctgtagtcccagctactcgggaggctgaagtgggagaatcacctgatccccagggctcaaggctgcagtgagccatgatcgcgctactgcacttcagcctgggtgccagagtgagactgtgtctcaaaaaaagaaaaaaaaaaaagttttcctttgacatagttattttgaagccatgattttattaatgccatcattctcaaagcttgcacatga

SEQ ID NO: 134419 - DNA, 1079 bp, Homo sapiens
atcttggagcgtatggaggactttactgattctgcctacaccagccatgagcacagagaacgcatcttggaactgtcaactcaggcgagaatggaactgcagcagttaatttctgtgtggattcaagctgtaagaactttttttaaaatcaaagtaaatcttatataatggctttcccataaagttttgcaagatatggaagttacataatcaccaggagtatgaatttgttccagaatgggacaggatatctcatcccttctttccctcctagttggccaaaatatccttcccatctagcacttacaatacttgacatttatttccaggcctgttgactctcattctagccagtctcaattatatgcctctgtcactatcactagttcacactgttgtccctactcttccaccaaactcacctctggaaaattcctccccaaaatacttcttcagagtgaagaacagaggagtagaccccctcctagaggttcttgggacctgagcctgactgctggagccattcacatgtacacaattcttacctctgaggacagctgatttacagagacaatgatttagaaaacttattggggtgtagattcaatgaaaacaagggtagatccagctggcaagtaaaagcttttcacccttgcacaaattcctggtctaaaattggtgggtggccactctgtgagccttaaatgggctgttggtgtgcttcaaacagaggagcttatttgggcaagaatggccaagactgacagaagtgggacagacaggaagtgtgtgtacacaatctcttatagcaggtggattgcaaagtggagagacagagagccctgggacatgtctctagcattatttatttcttaggcccaggctctgtcagaaaagtatttaacatggcttacaatatacagcagtgatagtacaaatctggaagtcatgaacaaagctttggcagtaaagatgatgaaggagggtggatatggctgagactgaagaaagaaggagcagttgatttccttgtaagtagattaatttatgaatgaaagtagatatgaatcacagatttc

SEQ ID NO: 134420 - DNA, 1050 bp, Homo sapiens
cctattagatgctggagaagcaagcattaaaagaattgatacatgtaaaacacataggctagtgcctggtactgttgtgcttaacaaatgttagctagtcttattttttatatgataaggaaagtgaagtttaatctcaattttgtaaaactgtgtatttaagtatctatatgtacaaaacaagactggaaagaattatgccagaattctcagaggttagtaggattatgggtaatttttatttcttgaggctctcctatattttccatttctgtttataaacaataaacatgtataacttttgaacctaccttttaaaacatttgaaactaattttagaatataagtagaccttaaataaagaatgttacatattgacttagttcctctaaataaaattttaaaggcatactatatttggattgaacatttcctagactgctttccagtgaaaggaaggcagccacacctaattatgcactggggaaggcgcttctagtgaaagcaaaatgtgtcttttggaacggaacaatagttcatattttggcttaattgcaggatcttttctttgtaattgaaattttaaaactttatgtaaatgaaatatttaataaacagaatcaccttaatctgttcggattgctataaaaaatagactgggtgccttaaacaacagaaatttatgcctcacagttatgtaggctgggtagtctaggatcagggttcaggcagattcagtatccagtgagggtccacattctggttcatggacagctgtcttctcactgttctctcagggtggaaatgagtgagagagctttctgaggcctcttttaaaaggcattaatcccattcatgagagctcctcccccatgaactaatcgtctcccaaaggccccacctcctaataccatcacattgggggttaggattttaacataaggatttgtggagggggagtgggagggggaatgggacacaaacattcaatctatagcaagaacttaaactcctttccactgcagtctcttccaagatggtagcttggaa

SEQ ID NO: 134421 - DNA, 1767 bp, Homo sapiens
cttttttactctgacaggttctcactggcagatatggtagttgacaaaacattttttcatgcttctcagtctgttgcttaagtctggaattccttcacggcgtgcatactgctgacaacctccttttggccttgctcctggagaccttagaataggagtcttcagctccccgcccccatcgtggggctctgtgcgagctcagagttgtgcttacagaactgattcttacccttcccctcaagtgagttgtcagaaatacacacttggtgttttcatgcaatgaacagttatgaagaaactgctctgtgcctggcactaggaaaaaacttcgaaaaatagttttaagaagtagtgttgaacagtagatgaggctttttcatgtttcttttaaatttcttttgaataagtctaaacagtagtgtgaaagatatactgacttcctgccgaatacccagatactccattaatgattgcattatcaaatgtttccccttcaatccagctcaaagtgtttgtgagaaatacatggtgaaagaatgagcagggtggagtggaaattggaccttccggagaagccccaggaagacattaccactggaattcccgtcccaggggaaaggcccctcccaacagacttgattctggttttggtctaccagtttcaaccccagcacagcttccagaagtctttgcgggaattcagagctgatttaggacgagtcacctatcgagaggacgggaagctttgctggggacgcttgtctgtccaagtaagaggaggccatgtggctgtgtgacagatgtgttttgtttctcctcgccaccctggcgagaaggtgcctggaacccatggaaggggtctgagaagagataagggcggggccatgtgggggcgggacccggcttagggggtggggttgcagggagcccacaccaggctggactgcgcgggcggggcagaggccgggggtgggcggggacatacggtgacgggcgtcggggacgcagggttggcggcggagccctgggggggcgggcccctgggggcggggtctcggttggcgcgagtgtcctgtcgccgccgcctcgggcgggtgggctgactggcggcaggctcgccgcggcgcggagtcccggctgcgggatagaccgagggccatggccgcctctcccggacccgccggcgttggcggcgccggagcagtctacggctccggctcttcgggcttcgccctcgactcgggactggagatcaaaactcgctcggtggagcagacgctactcccgctggtttctcaggtaaagtggcgcctggcgcggcccctcttctccttcccgccgcggcccgcgatggcggccgccgctcgcacgaccggacgggaggcagccgctgccccactttccgcgccggcactgcggcgttcttgtcggaccgcctgtgtggggctccgggacgggcctcggcccgggcggcgagagactggataatccaaactccggcggcagggttgagtggactcggcagcaggggaggctgcggggcgggggtgccggcctgggcctttgcccccagtacctgcctcgggtctgcggctcccgggtgcccccggccgggcgatgccccctccgcggggcgagtggttgagcccagctcccgaggcagagaggacccccgcggggcccctcgctggtacttagggccctccacgataaccgactttgtcaccagttcgcagcctggtcccgagcccggctcctccgcctggg

SEQ ID NO: 134422 - DNA, 4142 bp, Homo sapiens
tgagcccagggatttgagatcagcctaggcaacatggcaaaaccccatctctacaaaaaaaaaaaaaaaaaaaaaaaaattagctgggcacggtggtgtggctatagtctgagctactcaggaggctgatgtatgaggatcacctgagtccaggaggtcgaggctgcagtgagccaagatggcgccactgcactccagcctgggtgagagagtgagacactgtcccaaggaaaaaaaaaagtgttggggggtagttcttaagcgttgaagatttcctttttggaaagtatttaaaggtagaaatattaataatttttcctaaaacatctccctaagaagtcactgataattataattagtttaaatttattcttacactacttaagaaaaatttcatttagaaaaggctaccatgagatcttttgactatatggagtagactgcatacagatctctttatttctattatgaatattttagcgattataatcagctattccactgagtattagatttggtcactaagtaactcatgtttttctttagtcaatcattcattcattcactaaaacatttgttgagagttggctaaactctagattctgtgccaggcactgtacagggtgatggagatcactcataagaaggcctcttgctcttagccagatcatatgtaatactaaatttaaattttttgcattaaaaggctaaaaaatcatttgtttttgttaattatatactggttgatttatagatgtaattagcacatattcataagagacaaatatatacaatgagttactatacatatacaaagtgattttagctgtataaagtgatattgcaaaaaactacagctaatgtttcttgctgggtaattattagcataaatatcaggttcttagaggtctttaagagaatactttagagctaccaaaattagcagcagtgatgtaatatcaccctgaaataccaggagcagaggtgccccagagtgcttcacagctatgatcaggaaacttgacctgccccattgctacagcaacggcataaggactaggaaggtccactagctggggaggtcttggaaccctccgagccagaaagaagcattccagcatgattcctcagatgcaatgaggaaggtttacagaattttcacagggcaacagagatcaagtggtatgaaaaggtaggagttttaagctcaagtctcaaagataacctacctttacattctcagtcagaatttgacccagaaagaggaagtttcttcaggaacagaccgtacgttgatgaagtagaagtcatttcagtaaaaacggagtacagaacttggtcataatatcttgcattttatagatttattaaagattagtttcaagttcacattcgctattcagttgtaaaccgaatggatgggaggggagaaaatacaagctctccacacaggtatgctcctctcttttctgagagagaaggcatgggattttcagcataaattccatgttatgtgagtgctgtttgagttctgaagttcctatcaatatctgttcctgcaagtgatctctgtaagaccaccttacatgctggtcttagttattgttaaaattgcaaggtttcttcacaccctctttgataagaagtgtttagctggcagagctttcccttgacttctgagtctagtgtgggttggcccatgacagtgggaagaaatccaacatgttacatggagaccttgtatgtaaacaaactctgtagcctttgaaagtggaactgctttttacagttaaagggctgctaaatggcttgcagatgagatcttctggctcaccttgatcttcacatgaacccattgtgacctatctggatttcctaggacctgtagtttccatttgggttatattagtgcctcaggaatgtgtcactactggtcaagcaatactcagaaattcaggctgtgaggggttagattagaggaaagtaatttaggtgagctatccagagctttcaacctcagggtttataggaaaaaaaaacaaaatacaaaaacccttaggacttctcatactctagccctgaccttgcagtctcctctgaggggcctcctaagacccttaaaataatattacaataggactttgagtgtgcatttcacagtggaaatagcctctggctagcattacttccaaatgctagttccagctaaaaacaagtactttttattagtttcttgtctttcaacattctgccatcaaaatatattcattttattaacttaccgattattgggaacctgcaaaaaaaaaaaaaaaaaaaaacacacatgctgtctgcagccactgtttggttatttttgatagtttaagagaattataaatcaagttgttctgtctactagagtcagaaattctgtgctagaatgggacttctaaaattaggtggtcctgtcactttctagagaaagacccaaattcataggtttaagtggcttgtctgacatacacatacagccagttagtaacagaattcagaatagaatagagttcttttttttctgtcagtccgttgttctacttctctttccttttcttcatggttgagcagcttttggcaaaatgtgttccatatagcagtagttccaagagatgttaatagatgtaagaaaaaaagtgtgtgtgtgttgggggtgggggattgcatggtcaattaaaatgaaggaatgctgagtttgtttccttactgtaggacttctaagagttttgaacatgctattacacattgtgaatttataaaaggggacaaacactgtttgaccttagactgcactccccttctttattcctcagagcatctcaaaggactacagggtcctttgagaaacatggcccttgatcaagtttacaactctttgagaagacatccctaatggaaatactgaatggcagatctattactgtggtaccatgtagtgtgtaataaatcttgaagtccagaaagcaagtatatttgctgtttagagctatacttaaggtatagagattcttttccacctgtggtgtgtaaaatcagtattgtgtttaattttgcaggtttttcaaggatcaactaatgtgcaaatacagtggtgatatattgatattacattttaataatgcttttgtatggcactttatagttttcagacaccttttgtaacagccctgtgagacagacaatattatccttattgtacagatgggggggctctggaggctctgaaaagtttttggtgatattcccctaagtttataccacaaaatgatggagccagaatttagttgcagaacttctgactccaagtccagagttctttactagacatctggtttcttactagctttttgctagctttttattttacagtgaaaagtatggaagcaaatcctgataattttggcttattatcaaatatcatttattttttattgcagagacccagcagatgtaactctcattgtagccatcccaaagaaaacccttctttgccctttgcagtgccacttatttaggtaactgaagtgtatttccagtacaatttgattttgaactaagatttgatatagagttgtaattgcttacataactctttgaaaatgtatcatccctgggttctcaggtgaaggaggcaattcaaaagtaaaaaagaatattcgaatacaataaataccctctgttctcacacaaatgctgtttcttagctaacttgctttgacaacctactgatgtaacttctttattaatgtgaaatatttatattttgaaataaaattactagtgttgaatgaatcatgtggtaaacttaatctcctgtgtgttgaaaaacttgatcttttgtgaagccaaagtttcatgaatccatccgtctcttaggccttctgttatgccatttcctccggcaccattgtgtacactgaattcttaggagatactgtcaacttcgtaagggaaggtgtgtccaggaagtggacactgggcgccttaaagaggtcaagggccctcagtgcacaggggaaggtggccttgtgataggtaaggaagtggtgagatggttggctgagaagaattggaagaaaaagttggattgaggacctgtccttttt

SEQ ID NO: 134423 - DNA, 1299 bp, Homo sapiens
ggctgctttgtattttaaaacacagcttgagagttcagagttggtggtttgctcacttaactgttgttaagatggcttgaaaagtttcattttatacactggtaccctggcttgaaatttttccactttggttatctatgttactatattatatatttataaagttattttaagaactctaaactacctgctgttaaaagaatagatggtgtaattttttcctggtttaagaaatgtattgttaaacttttctaagacagtcacttttcaaggaagagggctttcacttttgagtgtgtagttgagtgagcaggaaaaatgaatcttctacccttctcccacaatgtattatacgctctttaagaaataataaatcataagtataagggtggggtggcttatttgatgttcagttttatattataaccctgggagatacaaagactgaagctcttcctcctcttccttttctcttcacgcttctttacactattgccaaattataaaacttggctgaccacgttgaagtgaaatacttattaagctgctatgaatggtaacagtatgataaaattcatgctgttattaggttttctccttccaggtggttgaagtgaaaaatctcaggtgtagcaatactctgatttgttaaatgtatccgtttcattatttggaactctgccaataagttagttttcagcagaattttgtatttatgtagtattttcccatctcttagcacagtgccttgcacatgactctaaatgaatgcttgttgaattgaattgcaactttaaaaatatctcagatatcacaataaccagcatagtgctttacattttacaaagtccttttgcacatactatttcacaagtacatcacatcagctttcatatagctttatattattttacatcagttttacactgatggagaagctaaggttcagaaaagtgaccaactcaaagtcgtaaagtgtagtaggatttggcctcagatctttgactccgttgtgtgcagattctgctgtattagtgttccttctaaatattgtatgcagttttcccagtgttacgagattggtgttgctatccatttgttgtgaatgaagacttgtcctatagtacatgacagggctgagagtggactgtagttcttagctgaaccctttctactgtttaaaacaatcatcaggcctatcctctgctcccaggggaatgtgggagagaaaagggttcttggccaggctgtaggtggtggctcacatctgtaatcccagcactttggaaggctgaggtg

SEQ ID NO: 134424 - DNA, 1031 bp, Homo sapiens
gggtgatttttttctccccagacaatttctcatgtctggagtcattttgattggcattctagttgaatagaggccggggatgctgcaaaacatcttataatgcagaaaaatttcaagattgagaaacactgatttgagatagatagatagatagatagatagatagatagatagataatgcatataaacatacatgtgcgtatacaaatcttcacctttggacttgttttcagaacataaaagtctttaaggaaagaaaattcatttcaattattagatcagccagcatctttaaaaatggttggtgtattcatgtcacacataaaccctctcaaagcctcaggagccatagccaggagactaacagtttttcaaagtagagctgtgctagtagaggcgtgcttcagagatccagaggcttagggcaccatccttgaaagagccttgagataactgaacatccttaaaggtaatttcttttctgtgacattttacctgttcccctcttgacactgaagtactttcctcattgagtgctgcaaggttagtctttaattgatctctgccttgcctatgggcctcctaaatatttatatgaattgagaggagagaaaaggagtaagggagggggcatgattgtggaattacatttgaagttcagattgtttattttatgagtttttaggtgattgtacctaataaaagctttttgttatctttagtttctactactgtgagctgttccttaggttttggaacacttactttatattgtacttcaatttattcctccttcccttcctccctcccttccttgctttttttgggggggtggtggtggtggtgcagggtctcattttgttgcccaggctggcctggagtggcatgacctaggctcactgcagcctcaacctcttgggctcaggtgatcctcccaccttagcctcccaaaagtataaaaattagccggatgtggtgtcatgttccctgtagtcccagctactcaggaggctgaggtgggaggatggctt

SEQ ID NO: 134425 - DNA, 1068 bp, Homo sapiens
aaactatattttaggaggttgccaaaagtctgacctatgagtaacagggatgctctcattgttgctgtcgtcatataaaagcataattaactgaattacatgctaaattgtgctcacttaattatccttgatggaggttaacttaacaggtgactcctaaccagtcccaagccaacattaacccatcataggcaggcacctgtaatgggtataaaatatctgttaacattgctggctttattctttcattcctggagctataaaaagaggcagatgtcatccataggaaaaacaattgttgcatctcaatattgttgcatctcaatattattgcagtcagtgttcagttgtatgcatcgaggtgatctaaagaaagctgataatatgctaaaaagcatagtgtattaaagaatgcacattgtattagaaatgtatttcagattttttccagtttttgtgtgttaaaggtcgtgctctttattccagaggtggccatccttacctgacaggcttggcagtggccggtggagcatactacctaggcctggaaggagcaatcatcggtcctattcttctctgcatacttgtggttgcttccaatatctatagtgccatgctagtgagtcccacgaattcagttcccacgccaaaccagaccccatggcctgctcagcctcagcggtgagttaaagcagaataatcataagctgtatttatacattgaactgtcctgtctctgtatttgataagtagcttcatccagacttgtcaggataaaggtatttgagtaccaatgctgtgataaaggttgcagaagacactaagtaaatacaaatcgttggcagagttttgggtttcatataccaagaaaatttaaaacctatattggggccgggagcagtggctcacgcctataatcccagcactttgggagaacaaggcaggtggatcacctgaggtcaggagttcgagcccagcctggccaacatggcgaaaccccatctctactaaaaatacaaaaatcagccaggtgtggtggcacccgcctgtgaacccagctgtttggga

SEQ ID NO: 134426 - DNA, 1054 bp, Homo sapiens
cctcttaagatctgttgtggtgcttcttctacttttccttcctttatttctatggctgcttgttttcctaaatatctctgccttccacatttgcctctaccacatccccccctttccctatttgtctgtgcttccttctacattgtcaagttcattcacgttcttctctactgtgatgtccacaaacctaccctctgacctgcaagcaccctgtgaggcgggatggtagacttgtcatatagatgagagaccagttttccaaggtcatgtacctggcttctggtaggaccagaactagaaactacatttgctttactcttaacttggagagaagccagatggaggaagagtgcttgaacatactgctctggaagggaatgaccttgaagcagggtccttcaactcaggattttttctgtttatttttattatgctgaggtttagaaactaatttctgattgggctttggactcagtacaagttttgacacatgttctgtaggtgtatttataggaccgtatattaactattgattgatagtagcaactacagaacccttgaattttattgcttaagaagagatccataaataagacacacacttagaaagatttttagtatcacattttaagatattgagcctttacttagctagaaaattcagttagatagggcatatcatttccctaatatttgagtttgtgagtatttaacttgttttgttggaagttgttgaggaggagctactgcttagattcttttgctttgttagtgttttgctgatgatgttaagttgtttttcttttactcttttttcagcattagcagcaatccttggagcagtgccattcctggggacatactgggcagcagtacctgcagttcttgacctgtggctgacacaagggttaggatgcaaggccattttactgttgatttttcatctcttgccaacatactttgtagatactgcaatctactctgacatatcagggtaagtaagccacagaatttcttattagtgaatcatccaggcatttccgttttttttttt

SEQ ID NO: 134427 - DNA, 1895 bp, Homo sapiens
aagaagaaaaagttgctaggaatttgagggagttaaattctgttttctggtaaattgtaagaggatttttctctgctgttttatttataaaacttgtgtgccagatcacaagtaatgaggtagaggggaatatattgtcttttcatccctcactaggttacatgaatatgtttagtaactgcaaacaatatacagtgcatttaaaagttgccttgagaacattaccagcaaccaatattctcagcagtgaaagaaagaagactgctgtcttctccacgtggtccttactggattgagccttggttacttgccacccagaggggtgattgagttgcagtattctgttgcacctttgatgtcaacttatttttggcttaaattttttaaataacataaggttaaagaaaggatcacatctctatcttttcctcattgacctccctagttctagacaaattctatacttttttcctttctttttctctgtggtcgattatgtcattattccctccccctcaaaacctaccttctcccttggtctccgggaatactgcactctagtgattttcctcctactacggaaatgatttcattacctctctggctggtatttctttgtctttaggtcctttatgaaaacacaacctgttgccctattttctctccacttgcccttttaagatgtcctgtactcttttataattattctggtgcgtctcagatgtcttgttctgaattttctattaagccttgtctcttatttcagctacctctagggtattttcatcatcctttttgagttcctgttgcccatactaaacaaactgcccttttcttgcatgcctcttccattctggccttctccatgactttgagacactgctattctttccccttcaggtttaaaacctgaagctctgttgttttctttttgctctgtcctctctgtttagttgttgagcagatccttggtattttctttggggtctttcgcttccttttggtatttttgataccactttattctgggttcttgttgcagagtcatatggctcctttaagacgttctctagtgaaagccattggtccggatgacaaagcaggttttacaattggggagccactctgcccctggatccatgtcccagaacactactaaatgactaaatcactagattacagggcttcactttgctcctaacagtatacctcttgggatgctttagaaaagcttggtgtttctttttgcatgtacaaggtcacgtttgccgctaacgtcttctttttcaactacagcttttcttctgtagtgaccatatgaaggtgctttccctgcacccctctgcaccaccccatagagtccaggtttttatgattttgtgctgccttgagattacttacgggttgccacctttgtgctctctgaacagttccttatttcccctccttatagtgctgcactgccttactaatcttccaactgaaaaacacagagcacctgacattgcagattttcatgtattgaattcctatattagtcaccaaatatatgtgtctgtttttatctctcttgtattttcctctctgattttactttggagttaggaatattttttttcccacaaattctctcccaatgacctactttctttgatagcatttgtaagagatgttactttgtaggcttagttacatagtttaagaaacataggaagattttgttaaggcaaagaaagatggtgaaatacaagttacactatcccttattggctctttccaaaaggggaggactggccacagcctgggtttcttagagtttaaactgtattcttggaaacatgttattcacgcttaattttctttccatttgttttggtggtgaaatatctgcttca

SEQ ID NO: 134428 - DNA, 1137 bp, Homo sapiens
agctgggcttggtggcatgcacctgtagtcctagctactcgggaggctcaggtgggagaatctcttgaacccaggtggtggaggttgcagtgagctgtggtcatgccactgtactgcagcctgggcgacagtgagactctatctcaaaaaaaaaaaaaaaaaccaaaatgataaatgatcaagatgatggatatgccaattacccctatctgattactatacattatatgtattgaaacattattatgtaccccataaatatgtagagagcagtcaagggagctggcgagtacttttcccactggttattgtatatactgtgtctctaaaagctgactggtctctcccaccagctcactttctacttgagacataccatattgcagtgaggctagaatactgggaaggggaatgacagtcctttagaaaagagggtggaaccagtgtaaggaaatgtggaggaggcagaatttcactttggactcttcactcctccttttcttcattatttatcttcttccttagacaggtaattcttactcagctgtggtctaaggccctgtgtacactgagtttatagagcttctggactggtttgttattctccccatcccactccttgcttcaaatatcattccattaaaagcaggtcatctgattaaatcctgaattgtcttgttatttttttcttactcagtttagaaaagtagcaagcacaatctggtttgtcagaaaagagagggttgagagctaaagttaagtatcaggaaacgtgtgaaaaagtaagtttcatcctaggatttataaaggatgaagatcaagagctggttaggaagagttaacattgtaaacaatcatttgaagtcaattcaagcttctggtgcagaggagttattattaaatatagttgtgtaaaggaggcatggatattcacacctttagtgccatacggtataaatatacagtaggctttattaggggaaaatcctagctgagaaaaagctgatcctaactaactcttggaacttttattccacagagaggtatgcttaggtggggcatagctggattggatgcacgatggcctaccttccaatggacaggaatcctgctctataatagtctatatatagtatg

SEQ ID NO: 134429 - DNA, 1618 bp, Homo sapiens
taattttaaggctataattcaaggtgttttttttgcagtttaagttcctagggctgtttctttactggctcaaattcaagacttaaaatgtacagattttacagagattcctctgaagagctttctcctgtggagaagatggtagtgagttctctttctaagagctcctgttggatttttcatcctgaaggtttgtgttgaagaggcaatatgtttcttcatggaaaaagattttgagggaaaaataagtggttatttataatttatgaatgactatgaaaatattgtaatgtcctcaaagtgcagtttagcctacaaatatcagtgataccaacttttataagcatcagtcattaatcatcatctatgttgcagctaagtggaaatcattacattcatttatatgatctgtgaataagtcaaaaatggaattgaaattgggggttaattgcatgaccagacagtgatagtgtctgttcgtgaagctttgccttctgaagtatgtggtttctttatgatcactatctcattgaagttttgaaccttactcattattttgattctgaataagtattcttctcagttgaatacatttgcaattgggttttcatttcatgaagttttgagtcagtggcatgcatcctttatccccagaccattttcctctcttcagcagcatgttgtctcctgaatgtatacatcacacccttcttccctgatgctcccattctgcttgctctggtggagatattgcacattactaagttgcatgttgtcacggcctcaatgcaatttagtgtgtgtgatattttcacatgagtgcatgcacacgggtatggctcttgcttgctgggattacagcttttcagtgccagtgggtgggtgtcctgatgaattagataagacagtgtgtatgccatgcgattctcatttggaaagtgaacatgcttcccatcggtaccttccaattttggagaattaaaagtatttggattaaaaaaagtcagcaatgatcatttagtaaatcagtgtttccattttttactttgagcaaatgaaatatttattacaaattctcattgatttaagagtataaacaatatttaaatgtataaggaagaatgtaaagctgtaagaaaatgtattttcatttatttgaagaaatctctcccaacactggaatagagaagcagaaatctcttatgcatatttggggaaattaaattaactggagttcttaaataataatcaagacagtaaaggtatgcttaacctacctgatgaaagattcatctcataaacttaagtttccaaggtaaattaccttaaaaatgtgtcttttactttctcattgtgatgcttcgaaaactgctaaattcattttagtgggctaataatggaactagttttgaaatacacgtttactatttgcctatgtaattgaaacaaccccttgttatttttttagttagcattagagtaagcatccacaatcactaggcattgtcaaggacacaaaaccatgtattactgtatgaaaatattgaattaatatttactactaccatagcctccagatgatctattgtgatgctgtcattgtatgtttctgtgtttc

SEQ ID NO: 134430 - DNA, 1424 bp, Homo sapiens
ccaggtagctgggattacaagcatgtaccacaccacacttggctaattttgtatttttagtagagacagggttttactatgttggtcaggctggtctggaactcctgacctcaagtgatccacccgcctcagcctcccaaagtgctgggattacaggcatgagccaccatgccccaccaattatatataaaatgttttaatcctgttttttaaatttagcatttcattgtaaaatattttcccatgttataacagtgatgtttttaattgctgtctatattatttggtgtggatttactattttctttactattgagtatacaactgtttttggttgatttttctttttttttttaattttcatttgaaataatcctcagttcttagcttttcagttcatggtactaaaacactgtattaaaagcacactagatggctctagaaacttttttcatgaggattggttctgatatccagctttccttcctcgtcagatcttggagtctctgtggatcgttatgagccggaatgtgagcctgctgttcaccactgtcactacactcttgaccatcctcttctacagcgggacagcccttctcaattttgtactctctctggtacgtccacatagataagtacacgtcatatttccttccctgttaaagcatatttctggtttcatttgcaattgcagatgtctgtcttcctatagtttccaaatacgatttttttaggagatgttgtcctttgttttgcagataattttcctgaccacactattttatctattaagttccagtgatgagtactacaagccagtgaagtgggtgataagcctgactccactatctcagccaggtccttcttctaatattattggccagtctgtggaagaagctatcaggtagggataaggtttatgctattcttatttctcccagaactttttttccatgataagcctgttttttgtcatgagcatcctgataacattcagtgctaaactcgtgatggactctggtattttcaaggttttcatctcattttgacaggataaatatgaacagtgcagttgttaataagaaaaagattcaggccaggtacagtggctcatgtctgtaattccagcaattgagattgcttgaggcaggaagattgcttgaggccaggagtctgagatcagcctggacaacatagtgagaccctgtctctataaaaaaattttaaaaattatctgggcttggtggcatgcacctgtaaccccagctacttgggaggctgaggccagaggcttgcttgaggaacttgaggttacagtgagctgtgatcacgccactgcgctccagccttggtgacagagcaagatcctgtttctttgttttttggagatggattgcagtggtgtgatcttggcttagtgcagt

SEQ ID NO: 134431 - DNA, 1022 bp, Homo sapiens
cacagcattgttgggaggtctatggaagcattttagaaatggtaatgggaggtgtttttctggtcattttgtttttgtatttttcattaagaggaaggatagtccacttaggaagaatagaacagataatataataaggggatttgagatagtaaatgaaatgtgcaggtatgctataaatattgtacctctcctttattaatatttaacatctatgagaaaccttcctcatgatatctggttctagtgaatgtgtaggtgacaaatcagctgaactcagtagacgtcaatatactggtcattgcctgtctcaggaaagatttttggcctcagagcactgctcttgtccctgtctgttgattgcttttcttgtgatttaatgaagtcattgaggtgatgctttttatatttgtagatagctctaagttggaaatggcaagggtgggggctaggcagccagtaaagcaaatactggaatttcatggcctgcacttaggatcctacaagataaatataaccacaggttgtactctagcatattccccaggaggtaaagtcatggcctgtgtcacataataatgtctctgttaatgatgggccacaaaatgcaatcatggtcccataagattataatactgtatttttactgtaccttttagatgtttagatatacagatacctatattgtggttgcctgtggtattcagtacagtaacacgctacaaaggtttatagtttaggagtagtaggttgtatcttacagcctatatgtgtgctaggctttaccatttaggtttgtatcagtacactctatgacatttgcaggacgaaattgcctaatgacacatttctcagaatatatctccataattaagtgatgcatgactatattttttctctgcttgcgatttttacataatctacaatgatgtgtgtgtgtgtgtgtgtgtgtgtgtgtgtgtgtgtgtgtgtgttttgagacagagttttgctcttgctgcccaggctacagtgcaatggta

SEQ ID NO: 134432 - DNA, 2001 bp, Homo sapiens
tggcttactgcatccttgacctcctgggctcaagccatccttctgcttcatcctcctccttcttcctcctgagtagctgggactacaggcatacaccaccacacccagctgatttttaaattttttgcagagatggggtcttgctatgttgcacgggctggtcttgagctcctgagctcaagctgttctttcacctcggcctcccaaagtgctgggattacaggcatgagccaccatgcccagccaataattattgttgtatttagaaatacagtggctgtgttgaaatggcgttttgaggtcacgtgactcatgtcccttcctttaaagataagaaagattggaactagagaagatagcagagctcatgtggtccattgtctccaggctccctcccaagtctctgaggcagacagaggtggctcagttctgccaggagagacatttttccttatttagacctctgcattcctgcaatgtcctcttcctcctttgtttttctaaactgttgcgtttgaatctccttcaccggctccatagaaggtgggctgatggctcttagtaagtactgggaaacgaagttaataatcaaaaggttgtttggtgagtggtggactcagagtaaagggctgcagagccactggagatggtgaggccttgttggtcagttcttatccacagtagagaccaccgttcatgaccacattgcttagttggttcagtaagtctcttgggctttttgtatgtttcataatgaactctttgtgatgttcttccagtacttacattgctattgttgattaaactgataccaaacctggctcatgttttctacttctgagttaggatccttttttttccccctcagagagagagtctcgctttgtcatccagtctggagtacagtggcacgatcccagctcactgcaacctccacctcctgggttcaagaaatttttgtgcctcagcctcctgagtagttggaattacaggcatgcaccaccacattcagctaatttttttgtatgttagtagacatgggatttcaccatgttggccaggctggtctcaaactcctggcttcaactgatccgctcaccttggcctcccaaagtgctgagattacaggtgtgagccaccgcacccagcctgagttgggatacattttgtctccataaatgtgttttgttttcagagtttcatgggccttgctattgtgcctgcctttacccagtttctcctctttaagcctgacatataaattaaaccactttactttaaggatttagttaatattctagaaatgtttcttcctctattttctccagttgattccctttctttttttctttcaaataggaaaggttacttttttgttgttggagactaccaatctaaaattagtgtatttagttaatttcttaagaattaccacaagatattttctctcagtgcaacccagaaactatttaaatttttttttttaataaaaattccaaaatgactgaagctgcaaaaagaatgcttgtcaaatcacaagtaaaggcattgttggcttgtttcttggaactgatggcattgttcatttattctttatcccacgaggtcaaacagtcaatcttgcacatttttgtaggcattgtgaagcattttcaagattttatgtaaggagtttttgtaaatgaaaccagcctgccggagttctcttatgaaactgagctgaggtttgcaagaaatgccaagggcaacaaaatatgcctttataaatggtacatctgaagtaggaaaggaatggagaagacttttcatagaacagatggacatatgacaaaaaccagaactgctgttttgggaagggcaccaaaacaaaaatcagatgttgtgagttctgccccacaacatttaagctctaagctctagttccacttactagctttgtgcctttgggcaagttttctaaaaatttgtgagcttcaaattatgtatgtataaaatagagat

SEQ ID NO: 134433 - DNA, 1051 bp, Homo sapiens
tagacagagtcttgctctgtcacccaggctggagtgccgtggtacattcttggctcactgcaacctccgcctcctggattcaagcaattctcttgcctcagcctcctgagtagctgggattacaggcacgtgccaccacgcctggctaatttttgtatttttagtagagatggggtttcaccatgttggtcagggtggtctcaaactcctgaccttgtgatccacctgcctcggcctcccaaagtgctgggattacagacatgagccaccgcacccggccttagctgatttcttaaataatgcaaagttcttttccttggagtacttactgaagtgatgaaggggacctgaagcaaaatgtgacatttatactttctgttctttagattaagatgggaatttcatgtctgcactgttttattccatagaatgtaacacactctggaaggcacaaaggacagaagttgcatgtcagtcgtcagaatagctggctgggagacattctggactggcaggatattgtttcctttgttcacgagaacattgagacatttctttcggtaagaaatagcatttatagttaagctgaagttcaaaataaaaacaaactgtaattccaagttttcttcatacactttgaggcctcatctatcctgtttttaacatcatgacatttacatatttgagaactctaaatgcactaggatgatgttcaaaagccataggcttcaggtgtcactcccttggtatttcccctgtggttgtagagtaactgagagatgaccaggatgtctccagctggactactggagaggcacctgcctttgtgttgtgcgaagacccttgaccagatggaaatatggttccagttacattggagggatgggatgtgttgaatgcttagcttgtcaccttcccacctaacctcctaccatgcatcatcacctctgcagtctgcagcattcctaagtgctaactactgctcctcctcattccataccatattttgtatggtgtcttgcatgtagaatttcacagagggcagttttct

SEQ ID NO: 134434 - DNA, 2360 bp, Homo sapiens
ccagtctgatcaattgtaaatgagaccggacatctctcagcatgcaaatagaggaaggattcgtgtttatagccaacatcctaaaattttacttaaaattctgtggtaattcttaataatagagataaatgtaacatgagacatatgtataatggaaggtcactgggattacaggggaaagatttttctctggacaggtaagatcagataagtcagcaatcatggcttcatttgcaccattctctgatagcgtgaggtagctctcttagagacctaagaatagagcaaagaaaatagaagcaaaaacatgagaaaggaaatttactgggaatactcaggagtagatttaaggaaagaacgtaatatggctagagataaatagtctggaacatttttgtttgctttggaacaaatgtaaatacccagcatatattaattttactctgttgttgcctgaaatattgtaccacgtcgtatctgtgtttttttctagctccataaaattctaggagataaggtgaacaatactgctgtaattgaaaagcaagtactagaactttgggacagactgtatcactcttggtttgtaaaggtaagttattttagctaaagtttcctgttgtaaactaataaagtccttttattgactcatcaactagataggattatattcacagtgggatttcattcatggaaatttcaaaacagcaaaaccttaagcctcaggtcactaaaagtcagtgtgagttgatggttagtctccatggcagaacctgcctatctctctggtgcgtcagtattccatcctcagtctgttgtcacggacatctcatcccctagactagctctgtgcgggagaagtgtaatgcaagccacataaggtaatgttaaattttctaatacttatactaaacgaattttacctgttttagttttttagtgatattttatttaacccaatatgccccaaatactattattttaatatataatcattagaaaaaatttaataagatattttatatcattttttttccatatgtctttgaaatctagcatgcattttataccagcagcacatctcagtttttgagctagccatattttaagtgctcagtagccacatgtggctagctcctactggctactgttttagacagtacaactgtaggcattaataacttttctttgagaaagtgaaactgaatctaaacgcttagagatcttttattttttattattatttatttatttattttttgagacagggtctcgctctgtcacccagactggagtgcagtggtgtgatcttggcttactataacatactccgtctcttgggctcgagtgatcctcctgcctcagcctcctgagtagctgggattacaggtgcatgccaccatgcctggtgaatttttttgtattttttgtagagacagggttttgccatgttgtccagaccatcctatacactggatctggcagggcctgtgggctagcaggagccgtgctgtgtatagagtggatagagttggtggtgatgattctcagagttcatgtaaggagagcaagtatatatgtaagtctcttaatgtagggtggagggggaggagggctgattttaaatttgaatttgttgcttagtgacttgtttgggattatgtactcttgctttgggatgagttgaaggaagattgttagtttttatagatttcaaagacttgggaaaaaatattcagggaatatctaggtgagtatcatagatttgatcccatctgctgaaaaaccagataattagaaaggtatatctatttcttttgctaactctggggcttctgcttacaaatagcttttattacccctcacacctcctgagctttattttatagtagaggaaggtcagtgtttcataagcataggtttgttaagtggttaagtacaattgtcccccagtatcatgggtgatcggtcctaagacacccctctggtaccaaaatccagggatgctccagttctttgtacaaaattggcatatttgttgtctgggcctggtggctcatgtctgtaatcctggctatttgggaggctgaagtgggaggatcacatgaggctgggagcttcagaccagcctgggcaacatagtgagaccccatctctacaaaaaattagctgggtgtggtggtgtgcgcctgtagtcctagctactcggggagactgaggcgggaggatcactgaagctcaggaattggaggctgcagtgagctatgactgcaccattgcactccagtgcagcctggtgacagggcaagcaagacgctgtctctaaaaaaagaagacaacattcctaccatcatgcttgt

SEQ ID NO: 134435 - DNA, 1911 bp, Homo sapiens
ttgggaggctgaggcaggtggatcacttgagatcaggagtttgagaccagtctgactaacatggtgaaaccctatctctactaaaatacaaaattagccaggcgtggtgacgtgcctatgatctcagctacttgggaggctgaggcaggagaatcacttgaacccaggaggtggaagtcgcagggttgcaccgagccgagatcgtgccattgcactccagcctgggcaagaagagtgaaactccatctcaaaaataaaataaaataaataaaagctaaggaaagattgaaaggacatcctgaatgttagagacttaggacagttaagcctggaagtcctgctcatgatgctttggtatctgtgtattggtgaatgatcaacagtctgtctgttatggattaagcatatcaagttcaaagcattattggtacactacacagaaagtgtacttttttcatttttttctttgttttacattagttggcttcctgaggctcaggtagtccaaagagccctgaattctgcggctaacaacgtgtatcagtatggacgagaatggataactcacaaggtaagggaagaaactttctttgtggctttctcttttcagggtctttactggtggttgcttgttgctttgataaaacataagtagaaatgctattcacagcagtaaataggcttaaataaacaggtaagcaacatacaatgaaatcttttgaaagatcacattgaataggggtagtaccctgaacaatctgagaggttggtcatgtactttttcaagatagatgtgattcattacttgtgagttaggacagaatgatcacttggtttgggtagtcaaataaggctttgtagagaaaaaggtattaatgcatattaaatcttattgtctgctgataactgtctttggcagtttccagttattttcatttaatatttgtttttttttcttttactgtttctaagaagcctgcagtatgaattattttgcctgctttgcagatgaggaaacaagactcagcaaggctgagtcagttcccagtggtcgtgtagtaaattgcagagcttggtttgaaactgaagcttaacttcaaatcctttgtttctactgtagcatgctcgcagtgtgtgcccagaactggattaagtgcttttgatgtggcacttgagataaaccttgaaggaatggcagatcaaggaagagtggattttaagaagggtatttgtgtgagccaagatgcagagacaggagtgtgcttgaagagatgattgagatgctgagacaggagtgtgcttgaggaaatgatcttgactgaagtggagggagctttgtgaaggggaaatgaatgatagaggaaaggcagcacagttaaggattagattccaccatatggatttgggatattctttccctccctagttttgcctgtaggaataaaggtaatttgcacttttagtatactgaaataattaggattatgtaagaatcgacaggatttgttgcagtaagacttgtgcctagaaaaatatattagtatgtgattccatattgaaaattcaaaaacaaaatctaaaaaaataatataatggaagatacgctgtatacacatatatggaatcaggctggccgtggtggctcacgcctataatccaagcactttgggaggccaaggcaggcggcggatcatggggtcaagagttcgagaccagcctgaccaacatggtgaaacctggtctctactaaaaatacaaaagttagccaggcgtggttgcgcacgcctgtaatccgagctactcaggaggctgaggcaggagaatcacttgaactcgggaggcagaggttgcagtgagccgagatcatgccactgcactctactctcagagacggagaaactccatctcaaa

SEQ ID NO: 134436 - DNA, 1057 bp, Homo sapiens
caccagcaagcctgggtgacagagcgagaacctggctaaaaaaaaaaaaaaaaaaacaaaaaaaaaaagttagttccttatttgcctgtttgtctcacactgcgtgatgaacctgttagctcacaaagtgctgatattgcttacatagatacacaaacacatttatacgatatattcatgcaaatgaaatgtatgtacatatacgtgtcaagtatttgaacatatctatttatgtatttttttcttaagtaatgtgttgaacagggagctagcatgtactttttatttcccgtagtgcgtatcattagatataatgtatagtaactttgcgctgcatgtttctaaattaattaaagcaaagatgtgtatttatttggctctcaaagcattgttccaataatagagtagaaaaataaatgttaaattgggtttattttttactgagattcttttctttctttatctgtaatacaggtacatcaagagagtgtacacatgattgaagtcacaagtaatttgattaatgaaactctagcaaatcaccctgagtgggcaaagtaagaatattgttttgaaaaagaagagagatgaatggcctagtttcagcatctgtttgcacgaaatgaccttcattgatgcagctgcattggaagataaaagatagggtttgccagagctttgataaatattgtcatttttgaagaagaatgtcatgtaatacagagggtgggaggaaagtgctcaggattttaggtacaattcatggtaaatgatactttgttttataattgaggtttacagcatgtttataatttacaaagcacttcatctgtcttatgtcatttgttcctcacagtgactgtgtgagatagattgaagaaattatccccattttacacatgaggaaacaagatcaaaggttaaggaacttgagataataattccgcagtggcagagtcatttataaccactgcttctgatcaactgaaggaaagtttccactataacatggaaactgtaactcctcaactttctatataatttttaaatttatgtt

SEQ ID NO: 134437 - DNA, 3973 bp, Homo sapiens
cactttttttcctcttttcgtccttagttttatgtatcaactccccgtgcccccattttttttttgcttgaccttctctgtttccttttattcttgaataaatcttagtctctgtttctctttcccactctttcctctctcttactgtctcccttcttgtcctgttctcagctaacttaactggccacatgtgacgaaaacaacaacttcttagcttcttttttgagcatcttaaataattttgtttattttaaatttcaatgaaacatccaaccctcactgtcatcccttggatatacgtttttatttaggtgactgaatttttttcaacctttatggcttgtgatagaaaaattttaccctaacttaaaactaaaaaattggatattgtaatgttaatgtacctaatatgtttttgaatattctatgttttatatgttaaaaatactcaaacatgtttctaagtagaatatcatttacatttaaaaatacatttcaggatatgacttttctgaaaaaaaaaaaatagaggctctacattattttcagaaattgtaatttgtggatacaaatacagtcttaattctgaaattattttatttatgcttgcttattcaaacacatagtaattgaatgcttaccacgtgctaagcacttagattttggagatacaaagaggagtgatacaaacctagctctttccccaggaagctgccttgataactagttttcaattggtttctgattgaaagttttcagtttcattgattttagaatttaacttcagaatatgacatctgaccttccatatcttagaaacctgttattccttttttttaagtctctgcattgtctttgatgccttggtagcatgcactgaaaattaactcttctgtttgaagctgtaattgtcaagattaaagattaactttttatctttgagttcactttagcattgatctcttagtgacagtgcccttgatgaaaaacagataaggggggcacaagcttataaacgtcaagtgaaagtaaatgctgcagaactcatgttgtttttttaaccaacattctttgcttttggatgtttaattcactggagagcataaatcagatctaaattaagaataacttatttagcaatgctgttgctcaccttggggttgagcagtgcattgtggtgtttcagcagttattaatctagttaaatgtagttttgaaatgttagatggtagctttgcatgaaaggaattctagcaatctatcaagtatatattctgaaaacacaagttgtttaaaatgtaggattatttgtggttgtgaaagatgaaggaagttatagcaagataatgtcagatagcatttagggaaagcacagttttaataactgattaagaaacagctactacattgattatatcaattatagtcatgtcataaagcttatgttttcagaagaatagaaacttcaagtagaatatcagattttaaaaagcattttattatgtattatgaaatatttcaaacataaaaagatgtaaagactatctaccaatgactccccccttaataaaacaaattaacctgaaggctgttttgtgcccctccttgattgtgcattcacctcccaacccctcgctccttgggcaactgttatctttgttatttgtcattgccttaacattagatttttttattactgcttttgtaattctaatgatatcaaatggaaaaaatattttgaatgcaactcctcttttaatttgctccaattttatctgtattttttagtccatgcctgtattataagtattataaatactatctgtatatacttttgctaaagtcgtgtgtatttgttaaactgatgatacagcttcataagattttaggtcagctaatggattgtcaatattttgtttagaatacttaccaggttataaattacaatttgaaacatagatatcctatagtttgagaatttgaacatagatatggattatgttgaaatcgactgcctttttcttagctatgacagtaataaactatataacaacagcagtaatgagtactgtgaagtttttaaagttgcttaaagcttttattgctttaattattatgccataatttgctttgccatgctggagatcctgttttgtctttatgacaattgagtatatgtatttttaaagttctactttaaagataagtaattctctttttcgtttttgtgcagatgatcatctggttggagaagatgttagataaaataattagcattttcatcatatttttgttagtgataggaactcttcttttagccctactcctgactgcaaaggtagagtacagtgattattattctcattaataaacccttaattgttagaattgtagtctggattaaaagctagcagaaggggcatggaaaatgttaacttgatttaaaagtatgtacaatagctaaaggatttatgatttgtatattactaattttgccatgaatttgcctagtatattttcttttcagacctcttttacatgcatttttattttatcgaaacccttgggagtaaatacaaatgaaaaaaatgagataatgaagaacaagtggcgcttgttttttttagtttaataggagaattaggatctggtcttatgaattctaatctagttagtattcttcactagatcagaatttgctgattaccaccttccatccttgtctcattgatccttctgctgatatataccatagcacctttatttctcgctttccaggtccttccagcttacatttcctttccccattttcatctcatcaaagaaaattattctctaaagaacacctaaaatgttatctttatagtgatatctcttactattttttttaggcttatcaagtctgacaagatttcccccccacttttatggtacattttaatctttattttatctgaaccgtattgaactccacaacccagattttggtatgttcttttcaaggagttggtgaagcttatgtgaaatcatggatacaaaattttttttattcctttagttcccatagagacatgttggtaactataattgataatctaattaaccaatttgctaaagaactgcactatttcttcagtggcatctctgcttggaagtcctattcttagtctcagcttcagtacaccctcaagctatcttatttgcttctaaaaatctcttctagtacttctgtttcagtctttgtatagttcctatctgttctttggatattaattatgtatagtcacgtatatatactgtgcagacttatttagaggctttttgtcatattttgcttaaacctgctactgtgcaatcttacattccagttctttcattagtatggtctttttttttcctttctcctctcttctacacttctattctacttttccttcttggtccctttgcgtagcatcttttgcctggccatctcagttttatcttttaagtcctttttctttgttcatcccctgcttcagtgagcttttgcttctctgaactttgataacaagtattactgaaccatttatttctgggtgtagaattcatccaaactgagcttttgagggaaccttattggttatctaattcattctcctggccagtacagctgtcattctctgaaacatccatgacagtatctacttgaatgtttaatggacatctcaaatgtaacgtcagagactgaattccagaccttcctccagttgtctgttcttctcatagtcttcagtgacaactccattcttctgcttgctcaaatggaaagtctcaggatcatctttgactactgtttttgttttgtatccacatccagtttgccagaaaatcctttttggctccaccttcctaatatgtcctgggataatagcagggtgaggaagtcaggtaattcctttccacagaaatcaagaataaaacaacatgaaat

SEQ ID NO: 134438 - DNA, 2190 bp, Homo sapiens
tggattcccaacaaagatgtggttatcatcatttcaatcattatatatcttaaaggaatactacattccgttgattttaaaactttgatgtgttacagtttttccgtccctagtttttcctttgtctgggatggtttccttctcatgctttccttttcttttcatactatggttgcattctctaatgatactccactgttcttatcttctctttctcaccttaccccctatcctcaagctctggcactggctaaataagaaggtaaatgaacacccagatgttggtttttactattgaattccgtaatgcccctgtatcgcctttttcactctatgtttctgtccatgtgtcaaactaagtttttgttttcaaagttttaattataagctatggaaggttgtgaagcatgaatactatcacagtataatttggtaaaaactcagcaaaggctgtctaggatatggatggtatctccttgctcaggtgtttgtaagaagttctgtctcatagtccttttgtcccctgtaaatccagttctgtaaatgtggctcagcctgatattctagtctcctttgatgtgtgaaaacacattaggcaatagttattgtaagggcaagagagaactctctgtttgatactttttctataaaagacacaggaattttttaaaaagacaaatctgtgaaatatttgtatggtttccttggcagataattttatatattgtctttttttaaataactagtatttcaaaatttatttttaacttaaaacagatagtagtcatgacctgtgacatcgaattttgtgttttctccaaggtatgaggttgtgtctatggtaaatgcttcacatgattggtatggcattataataggcacacttttaataacttcaataaaggctaatccagatacattaggaatgttgtacctcgacatatagtccacatatcgtaatgtttaaattaattttaatgaattaaatagccaggccttgtggcacacacttgtagtcctaactacccaggatgctagggcagaaggattgtttgagcccaggaattcaaggttgtagtgagcaataattgcaccattgcactccagcctgggtgacagcaagactctgtttcttaaaaaaataataatttcaatgaatctctaggacagatagcaagagatgacatcatttatatatgttgtgtttaaacataataaaactatatatatgtcttttgtggaaatattatatcaggccttaagaaagatgtagtacttcttgaaaatagatcaaaatgagacttttggatgggttaggatttcatttttttctgttgaaatagaggagaggggagacttgacaatgcctaaagttttaaagttgagttgaaaggaagcattgtgtaaaataaacactcccacactctcacatggttgtgtatgtctccattccctataaaactagtatgggtaagtgagttcaatccttggcaaatgatgtgcaaatataagtcacgttttaaaattttgaccaaagaatgtggtttctaaaaaatttttatttgttctaattgttttttagagacagggtcttgctccgttgctcaggctggagcagtggcacaatgaaagctcactgcaactgtgaacttgggctcaagcgatgattttgtacttttcttcaatttgtgttatattgaaatgaaattgccctcaagagatgggggaaaggagaattaaattcattggattaaatttgatttaaccttcagtggactaaatgagctagattacctaatttatgagactacttcataactgaatcatcgagttaattttaaaagatctctaagatcaagtcctttttttctttcctttgatgattccatataacatagtaaagcattggtgtaaagatagagtaactgcttgagattttgagcgggtacattccaagaaaggacatacataagttgagaactattttattacattacatctcaaagtcagaaaattgcagcactgggtaatgttggtatgtagaaatttcaagtggagtgaattaggaaaccaattcaagagaagagagggtgagagagcacacatgggttaattgaaatgtaacccatttctcaagagttacttgttttatttcttttcctttttttttttttaaatttgagacaggat

SEQ ID NO: 134439 - DNA, 1615 bp, Homo sapiens
caaatctctagagttagggaaattatgtactgattgagatacagggtccaaacttgaaggcaagcctcacagttgagtaacacttctttctggccctaccaccttcttaattggcttctaacaggaagcttaacctctgcttaaagagccacttcactgcccaactccaggaggagacagtgtggtttgagagtggtccccactgaagttgccgtgcacagccttgggccatttgtagcagccctgctagtattcagcttgcttctctactgaaccctggcatctgttcagatgttgagagcagcatcaaatggggaaataggaacaacattactctgcagtggtacaaaatcatgatgcgtatggaataccttatacttttctggtcactaaataacgagcaactaaggaaaagaagaatatttgacaagaacagctataaaagccaaggagatgaggaaatgtcaggggtttgtattatttacccaggaagggggaatatgcaaggggccagaattgtagtcactgaaatcttcacgatgagattatcttttgtttatgtgggctgtaaaataatccctgactctacaaggattcagacttcaggaagaagataatatataggcaggtggggatggtttgaaaagttacttggtccaattccatctgtgtggggagtactttgagtcccaccctgctttttaacattgatcttctttttaatactagctttgttgttttagaaaggttttgtgaaattaaggtaccttttcatgttacaacttgttaatctatattttgtttatatatgtattttttgtctttttttagtctggatactcaaaaagcttgtcattcactttggagttgtggatttcctagagaaacgctaccatgtgtggtggggcattatagaaagcttcctgaaggagcggcagggagctctcgcgccttggcccattgtcgggcttggaaaattcttgttaaaagttgatagcaaggtattgtattttaaggacttgggctgtcttaatggagttaatatatttcgtggtttgaacttttccattctatggtgtttatattgtaactgttgataacacatgtaatatctaattctatgatgaaagtttaatgtttaaaattatggtttacacaaggataagatgggtttactttaaataaggcttgtgtaagtattttttcctcataaaaatgggagaaatggattttctgatttaattccttcattatattaggaccaaattgaaatccagagaggttaagcgacttgcctaaaattatgtagctaggtagtggctcagtttagtgaatatttttggagtaattaccatatgtcagatactgtattaagtcctacggaaaatcagatgaatcatggaaaaccagatacagaagccttgtttattggggaaagacagcagttgataaaaattcagagatggcggttagatttagagccttagtggttaaagagcatggactatgaatccatgaagtttcctaacctttctgtgccttggtttccataccagtaaaataggtacaatagcacctaccttgtagaatggtggtaagggttaaatgaggtaat

SEQ ID NO: 134440 - DNA, 1031 bp, Homo sapiens
ggaagacttttattttccatcttgcagtcatccatttctctgtcattctttctctgaaagtttgcatgcttcatgtgttaatatattgacccctcaaacagacccctctggttgttttggactcgttgtcctgtgtggcctggctttgggaattgcaggctcctgaggaatccagctggtagatataccagctgtagagtcatgctgtactcttgcagagttccagaatgtaaaaggccaccttagtctgtgctgagagatccattagtgccagaggtatttggagttagggaatatttagagtgaattctccttgaagaactgactttagaaatgtcagctaagataaaggaatttggtgtagtaggaacacttatttttcttgcacatggaattatgtttccaaagtggagaggaaatgatattttggttttggactcattcttccaaatatctgtcacacccaccatcatgaagtttccaaattagaaagataactcagagcaaagtcaaacaaaagcatctgttaactagcttgggctttagccctgcacttttaagggtagaatgttggtcctagtgaggtgagctgacttaccagggtgcaagtgatctcagtagtaaaaattgactcatagctgaacttttaacattaaaaacacttaaggaaattatgatacagcacttggtgggctactgtatgattgcttatgaaaattatgaaacaacagggaagtcattcattcacttatttagtgagcacctcctatatatgagatactattgtatgtgccaggaattcagtggagggagaacaaaacagacaaggtcttagctctggtggagctgactttcaactgaagagaaagaatgagaaaggataagtagaacatgctacaactatgtaaaagaccagggggaaaatgtgaggttgggattatgggagttcttatttcttttctcttttttctagactttttttctgacgtatgatacttttgtaattaacaatccacacattcaacgtgaca

SEQ ID NO: 134441 - DNA, 2358 bp, Homo sapiens
catctggcttacctctccagccttgtttatttgataccagtttcttactagctgtctgtgttccagacacactgaccttctttcactgtctttaatatgccgggttcttctcacagctttccttctgcccaagatattgttaggatgtcacaagatacccagcatttctttttatagcaaccataatttctatacacacgtttatttgtgtggttatttaattcatacctttactatactccctgggggcagggtctgtgtctttatccccagcacacagtacatgtaagaaatgaaagacactgtttttctctgtcagccctttctgtcttattggcatttcaggaggaccttggatacacaggccaggagagtaaggtcctaatccagaaatctaacttaggctttcctctcagaccatgagtttgaatttctctcatattgagagatacgataccctatctaaaaatgaactctttcaggtcacaggggcatttattagaggagggacagagtatgactgagcaaggtgagtactcttatcctgatgtctgaatctaccaaagatccacctcaggctctggcttgctgctatctgggagagggctagctttggatatttgggtatgtggagttaattaacttggagctgaaattcatcggctttctgaaggatcatggctcttttcattggggtgacagaatcctatgttgccatacggagtcttggcctaccaaaagtaatgtctcagttgtatgagtgtgggtgtatgatttggtgactaggaattgctagtgttcttagttgtgaacaatagaatctaccccaggtagtttaaataaatagtaggaggtattggttagcatttacaatttttgcacatggaatttctggaaagaccagacaattaatcttggaatctgacacaggtggaagcagtgcaatcaggagaaatgctcagtgacactgaaggactgtttgggcagagggccacggctgctgctgctcgccgtgaagttagagatcagacatcagaacttctgctaagttgctgcggaaaaaccatatgccttcctgactgactgtgtttgatacaagagctctggctttcaaattacagtgtgccacttcaggctctcaagtcctgcacaggtgtacctgcttggtagaaactgtgtcacatgtgagacctcggctgcaggggaatccaagaaatacaatttttttagctctccagtctagtgtgcaagaaagtgtgctagaacccgatgctatgtgagctattcttccttgtctgctatagaaggttaaaggttgacagacttcctttgccagtgaatgttttacttgaatttagtgcaaatgattgagcttggtactacctattaggaatttaacatggaaatatataatgtgaaacaacgtcatgatgttcctttagattttcaagtggtggattttgcctgtactgagttatgtaatttataaatctatatggttttgcataatagccatatattcgcatactcatttgtggaatgttgttatgaccaccaattgtggattatctcgtactaacatgagacctagtcatacaacatagcctaagacagtcagatcagggagctcacagacttgatgtggtagtgtttttcaatagaagtatgcattaaaatcaacttgttaacaaatgtaagtgtgggactccaagtttacatgtgtagtgtctgccacatccaccagcattaagttcccaaaggaggaaggtatacagagagtcaagggatttgcttttttagcacactttcatgtcaattcttaatggttcttccttggtgaagaaccacttattcagtgggtcagtagtaaccattttattttgttgttgttgaaaatgttggactgtgtttaaatttgcagccattatttcctactttaaagagttttgaaaatggatgcttcttttacaggggcagagttaccagggcaggttatctccatggcagcttctactctggcaaacttggccatctctatcacagggtatgaatcaagcagtgaagaccagccctccactcagcctgcaggtgactgatgttctggtgacattcaaggttattctggaaaatgaaatgtacatagaaagtaaaattcaggacaccagcatcacaaaatgctacttactcctgctgatccttcatttattctctttggttcctatttttatgcccttttccctctcatctttgttctcatatatcactttttaaatacatgtaattatgtaacttcttgagtttcttaccttggttctttgttctttcctttttaaaaaaggcttttcttatttttcttct

SEQ ID NO: 134442 - DNA, 2030 bp, Homo sapiens
cagtttatcatctccctgcctggactgttgttttttgtttttttttttggactctgattccaggccaattccttgtggtttttgaggtgctgaagggtatcattgagacagaagtcattaaaatacagatctgttggataaaagcagtttgccaaatcttatattcataattttcaaatactttgtttattttctctgtgtgctactcctttcatgcttttgtgaagtctgaggtgctcgaaaaatgtgctgagtcatttgtgtattaactagaaaaatagtgcagtttccattgatgtagctaagctttactgcatatttactgcatattttagtgccattagcaagttggagagttattccttaagccacagttttgaagatttaattgattgggtttagctttttctcgaatctttcagtgcctactctacagatacaagatattttgcttagctctgtggagagatctaaaaatgtctactaagggaagatagatggctatactataaagtagaaaggggaggagaggtacaaagaaatactacagaagggttagtggcttctgcttctagtttatactgtcgaagccaacagattgatattgatgatgatgatagctaacatttattgagtacttcctacatacccagcattgttctaaactttatttatttatttttcaagacggaatctctctctgtcgcccaggctagtgcagtggtgccatcttggctcactgaagcctctgcctcccgggttcaagtgattcttctgcctcagcctcccaagtagctgggattacaagcatgcgccaccatacctggctaatttttttgtatttttaatagagacggggtttcaccatgttggccaggcaggtctggaactcctggcctcaggtggtctacctgccttagcctcccaaagtgctgggattacaggtgtgagccactgtgcccagccagcattttatatgtattatttcacttcattctcaaatgagatacgaatttatgtaagcctcatttttacacatgaggagactgggacatctcgacgttaactaacttgcctatagccatctaagtagtaagaatagacctgggatttgaacctggggagtcttctttcctcacctgtgcttccagccactgaattgtgctgcttcctcatagcaaatgtgagaccttctatgccctggtcccaacctccctctgcattcttacgccactctgctcttctcattcacactatcttccggtcttattgaacttcctagagttctttgaagagggcacctctgctttttcttgcctttgtgtcttcatatttgtttttttgtcttcctgaaacacttttctacccctgctctctaagacaccagtctctcaggagcttcctctccaagatagaactgttctgtcttctttatctagcttacttttgttaaaatggatttaaaggatggcatctttcaatattcttgtcagacagctcctttggaaacccttcccagacctccctgcatggatttgatttccacgctgctccctaacagtttacacttactttacattagctcttaagtatcagactgaatttgagaccaggggcttagtctcttatatcagcatatagcctagtcgcctatttggtgaatgaatgcttagtaggcatttagaaatgtaagataaaatgcagctgaactgaaagtccattatttgaagagctatccaatgatcttgttattttgcaaaaaccatcaagggacttacttttcttacagtgtctcaagatgagtaaccatttaattaaattacttttgaagaggccagttcagtaattaaagacccttgactagtctgtaatcttatgtaagagagaattcttaatttttaaaatttttgacctgaaggtctttgtttttgtttttcctttttctactgtactgtcccaggccattaggtgttcccaaactttgctcttgagtggggcctaagagatccctcctgggtgtactgctgcaa

SEQ ID NO: 134443 - DNA, 2051 bp, Homo sapiens
cagttaaaggaactagagatgtttactctggataagaggagggaactggggctctagggtgggaaggagatagaggtaaggaggatataagacatgaaagcctatttctaatatttgaaggactgtcctgtgaaagagtgctttaaacagatctctgtaaccatgagggagagatgtcagagttgtgagttagcttcagagagacaaatctcttttccacataaggatgattcatgtcagagctgctcagagtaatgggttccctgttatgttagctgggtggctgctcagatgttgatttttcagcgtggtacttatggttgagactttcatctcccaagtttgagccaatggaaacactaagttctaatttaacaacacaattcagtaacccagagcagcagatagccttaaagtagtttctagagctactacttattgttaaaaataaaataaaaaacagctatgtctctgtcttcgtttgatgtcaaacaaagcattattctctagctttgttgagttggaatgatagaggaatttatctgcaagaacccgtatgtcagatatgactcattttgaactcagggaaggcagaggagggaggcaggcaggcagggatgttttatgaggttctaggtggactcagggaaatggttatgggtagggacctgtttcttggtgacttgtgaactttttttttttttttttttgagacagagtctcactccatcgcccaggctggagtgcagtggtgtgatcttggctcactgcagcctccacctcctgggttcaagcaattctcctgtctcagccccccaagtagctgggattacaggcatgtaccaccacgcctggctaattttttttttttatttttatttttagtggagatgggatttcaccatgctggccaggctggtctcgaactcctgacctcaaattagccacctgcctcagccccccaaagtgctgggattacaggtgtgagccactgcgcccagccaacttgtaaacatttttgcattatacactgaggaggagacattgatggttttgctgtgctcttttgggccattctctttcttgggagagaaagttcacgcccggtggtattttcaagaaaccaaggcagactttatggctttgagatctatgcctaattctggtcattctggggtgaagtagatggtttgagttcgggatggttttagacctttggtatacgttacaatagactctctttaatagaaccccattaaaggtaggcaggcatgtaccctatccatttgaccaggggcctctgagagcagggatgaacttaattttgagaaatcttgaagtttatctaatggacttaaatttttttttttttgcctgataagtaattctgtaactaatatatataccagattgttctgtcaaactacaaaactgagttttgtaaaaacaagtactaggtttttatttcactaaaaatgttaattcttaataatttgcagcatccctggctggctcatggagaattccagtattcctggttattgttttcctgatgtctgtgggtaccctctatgaaaaacagaatggaaaagagtcttctggtaagaaatagggcattctattaatactactctttgaagtattttggagagtagctttttaaaaaatgctatgatgaaacagctttgaatctatttaaaaacctatgatggtttctgagtggaaaataaattgtttaaaatattttaggttgttagaccatgatttgttttggtattattttattgaggcatgtataacttaaagttaaccataagccattgtattttaattttattaaaatattttatttttataaaataaaatatttttattttattttttagtgacaaggtcttgctctgtttccaggctggagtgcagtggcacaatcatagctcactgtaaccttgaactcctgggctcaggggttttccaaccttatcctcccaagtagcgagggctacaggtgcagtaatcacgtaaaaatggcctacaggccgtgcgcagtg

SEQ ID NO: 134444 - DNA, 1022 bp, Homo sapiens
catcataactctggattaggttctaatcatttgttgcctagattatttcagcagggtcacacttcagctggctgctttcttacttttacagagttatttccccagtaacaagcatattttataagctgaaatagaatcttttaacctgattctttttggaaagctttccttttcttgtttttttcttttctttccgtttcttttctaaacattgatcaacagagaaaactgtaggaattccataagattagattcttaatttaaatccatggtttatgctttgaatattttatctcaagcatttttgtgtataagatgggttttgaactatgtatcttttgttaaacaactatttaatattactacatgagatttcaaatgcctagtatttcaaaacttaggttctccaaacgaggagaacctaggtacgtttctttgacaccatcaaccttcatcttttctgtgctatgtccagagcattcctgctgtatagacacttacagattttgtataattgtatgttcattttcacgtgtatagattttacagctgtgtctttcatttatttaagatctggacgttggtggttggctatgtgttgactgtttcattcaagtggaatgcaagcactgaacgctacttgagagcagtttcaattcctgtctggattatattgctttttcatttaggtgggttccttcttttttttttttttttttttaagtctagcctaaggtcagcagaggctgactgtgtgaatgaaagtgaattttttgtagtgtcatatgttgcatttaacattcttaatctttagaaaatgttatgctttaatctttcattaaattttaatgaaaatgatgtgctttaaaatgtctttaattatgttcattttccaaaaggtccttttaaaagtcaatacatcttaaaaagtagagcacccttggattctcatatcatttctgagtgtcatacttaggggaagatatagataagcagtcaacgataagaggtgctcagagaca

SEQ ID NO: 134445 - DNA, 2508 bp, Homo sapiens
ctcctaaattcatttctttgtccatgtgaacatataaagtagaaggtttttgttttttgttttttaaaacaaagatgagataacatacatatagctctgtaccttgctcttttcatttatcattgtactgtggccatctttccttattagcacttagagatatacgtctttcttttttttttttttgagatggagttttgctcttgctgcccaggctggagtgcaatggtgcaatctcggctcactgtaacctccacctcctgggttcaagcgattctcctgcctcagcctcccaagtagctgggattacaggcacatgctaccatacctggttaatttttgtatttttagtagagaaggggtttcaccacattggccaggctggtctcgaactcctgacttcatgtgatctgcccgcctcagcctcccaaagtgcaaggattacaggtgtgagccactgccctggccacttttttctttttaatactgctacagtataaatcttttttctccccctcccccaccatgccttttagaaaatgttttcaacagattttcttagctctgaatttgtattagaatactttgataaacatttttaaccattggtaattgtataatcataatgggcttaatataaactctaaagtgtttttataaatggccttacctcttgaactaatattacttctgcgaatcttttctgaggaaacacttcaaaatactggaaaaaatccagaagccaaaagaatttcctaaaggttaaaaatacttctttttctgtttataaagatactacataaccttagtagaaaattgagcacctgtaataaaacataaagaagcagattactccttgaaatctgccatctagagataatattttaaaacattttttgttgagtatattttcaccattataaatttacacacgaataaattgacactgtagcactgtatattgatgttcatcatactgttgaaagtctgactaattactcaatttttggagatagcattatttaaacagttcactataaaatgatatttaagttctcaattttttatattgtaaatggcaagtgaatatttttatatgtgtctgcacagtgtgcttctgtaaaacactcctaaaagtagaattggggagtatattttaaaatggttattttaaactggaatgaggtaatctgtgagtttcaggttgatagatgaaaatacatgcttcttgttagacaataaatttctcttaaaaaatctgaagtatgcagtctcttattttttctctccttgcaaatgatactaattccttatgcatacagataagaaacaaaaacttcttggaggtactgtataaattgtgacctccagttcagcttcttactaagggtagtacttactttgtcatctctgttcaacgtttgctcaaacacttttagtaatgattattccatttgtagatagctatagtttattggaaaaacctgtccttttactgagctgtgttatttcctaattcccacgtatttctgctctcagaaccacagaaaatcaagtcttatgcctctcccagatgacattttaaaaattatttgaagatagctacaaaatcttgatatttccttctcttttctgagcaaaactttttttttctttttcccctagctacatttatattatcatgttgtgatttctatttcctttcccaggctgaattttgttgtgtggtttggtagcgcaaaattaattgaaacaatcactttccctgatacgagtattgtacttttagaaataagtgcttctactagtcataggctgactcatactgaactgaaaagtggttcagatgttctctttccattccatacttgtacagttgagttttgaatctcgaagcagaactttgcatttcttttcatatagtttaatcttgtttggattagcccattgttctggcttcaggatatctttttgaatcatgatagattatctcaatatttattgacaactcagttttgtataactgatttgtgtaaaatcagttttttctgttattgtgcctctagtctttcatctaagtgactgacgtaatgtttaatagggtggggctaactgacgtacctctgaagactatccatttactgtggatttttttttaatttcaacaagttgtagttgtctaaattgactgtttttattttcccttgtgaaaatctgagcagcttttgcttatctttagtattctagcaccatgcttctttctccttaagattagaaaagtgcactctggagccagattcctgggttctaatcctgcctctgtcatttattggctgtggccttgggcaagtcacttctctgaaatctgggtttctttcatgtgtaaaatgaggatcataataatattattttgtggggttatgaggatcaaatgagttagtatacataaagcattagaatagggcctggcacataggagtgttatataagtgtactattattgtactc

SEQ ID NO: 134446 - DNA, 1066 bp, Homo sapiens
gtagagacggggttccaccatgttggccagactggtctcaaactcctaacctcaggtgattcccctgccttggcctcccaaagtgctgggattataggtgtgagccactgcacccttcctgtagttttattctctctaaaaaaagcttgggaaactgttctgcaaaaatatgtaacagaagcaaccaagttgtttttccagttaatacccagatgacaataaatgaaacaaagatggttgaaaaggcagagtctctacttaatgttttctacatttaatatgttttttaaccagaaaagtatatgtggataatcgtgtgaaatgaaaggaaaatgtgattgcctattagttccctttacttgaagtgctaagtaaatgttgccaaattttatgcagtcttatgtagtgtctagcacattggtgctataaaaacgactatggaatgtatattttgaaaaggacatgttgttttggagaacataagtttggaaaaatatgccctcttatctgtaactgtggctcattgatttaatgcctggaataaaattcacacttgaataggtttgctcagaggctaaacatatataaagttgacttgttaacctcatgtttccgtgttagtgaagatttaagaattaaaaaactcctaagaggtcctagactagaaattgtgtgtgaaacatgcatgtacaaatccttatttttgttattttaaaggatatttagtgattcaaaatgttgacccaagtaaaatatgcttgttacatttgaaaaaacataagcagaacagaagtttgtatggtaaaagtgaattatccctttccttcccccgccctgcccctggccccgctgagatggagccttgctctgtcactcaggctggagtgcagtggctcgatcttggctcactgcaacctctgcctcccgggttcaagcaattctcctgcctcagcctcccgagtggctgggactacaggcatctgccaccatgcccagctaatttttgtatttttagtagagacggggtttcaccatgttggctaggctagtcttgaactcctgacct

SEQ ID NO: 134447 - DNA, 2494 bp, Homo sapiens
tcccagcactttgggaggtcgaggcgggtggatcacctgaggttaggagttcaagaccagcctggccaacatggtgaaaccccgtctctaccaaaaatacaaaaaaaaaaaaattagctgggtgtggtggtgggcacctgtaatcccaactatttgggaggctgaggcagaagaatcacttgaacccgggaggcagaggttggagtgagccaagattgcaccactgcactccattctgggtgacaagcgtgaaattccgtctcaaaaaaaaaccaaaaaaaccttgaaattcagctgtttggctcaagtgttgggagcaaggaaaaagagagagggttaaaaaaaaacaaactcaacataaaagtatgagttaagtatttgtgagtagggagtggtagaagggctaaatttgaaagaaccttcaggtcaatctgagtttaagaaaaacaaggcatggaattgcattctgctcaagcagcacttaaggatggatggttggatgggggtgaggtgtacttgagaagacaaggagtccttgctcttatccaaaagtgctgattaaggccaggtggggttgcccacgcctgtagtcccagcactttgggaggcccacacaggtgaatcacttgaggccaggagttcgagatcagcctggccaacatggtaaaaccccgtctctactaaaaatacaaaaaattagccaggcatggtggcgcacacctgtggtcccagctactcgggaggctgaggcaatctcttgaacccaagagttggaggttgcagtgagttgagattgtgccagtacactccagcctaggtgacagagcaataccctgtctcaaaaaaaaagaaaaaaaaaagtgctgattaaaggccaggcacagtggcttaatgtaaccccagcactttgggaggccgagggaggaggattgtctgagcccaggagtttgagaccagcctgggcaacatagtgagacctcccccacccccagtcttttaaaataagaaagaaagtgcagattaaggcctggcattaagtgaaagtaggttatgtgactgggcaggaggcccactctggaccttttccatcccacagttcacagcggtttggctttatgagcccaagcagggctgtctggttatagaacatggtctttatgctttctaggctactttaaccatgagcctgctgctgaagagcagtatagatgagagaggcagagagaaaagttacctttaagcgaatccctgttttgatgacttgacagttcatccatttaagatccaacttttgagcatctgccatgtcccaggcactagattaggttcttttacatgggtgttatttcattctctcaatgtcttatgagctaggagggagggatttcatatgtgagaaaactaattcagagaactgttgatgctgtcagtaaatggcattcaatagacctagcagcagttgaagtcctgctgttatcaaaactctgtagtaaccttcaataaggatttttaaaaagttttccctaatacattgtgtttaattatttttagtggattgtaggccaggtgcggttgctcacacctgtaatcccagcactttgggaagccgaggcaggcagatcacctgaggtcaggagttcgagaccagcctggccaacatggtgaaaccccgtctctactaaaaatacaaaaattagccgggtgtgacggccgactccataatcccagctactctggaggctgaggcaggagaattgcttgaaaccgggaggcagaggttgtaatgagcccaggtcgcgccattgcactccagcctgggcaacagagtgagactctgtcttaaaaaaaaaaaaaaaaaaaaaaaaaagattccagttactaggaaaaaatcagaaaaatatcagcattctagtcatctagaaaccttattcgtccctcttctttcttcccttttatttttatatctatgcagttttccaggtcccatcaattttcctttttagtgtctttgggacctatgtttttcttttttcttcttatattttgagacggagttttgctcttgttgcccaggctggagtgcaatggtgtgatctcagctcactgcaagctctgcctccccggttcaagcaattctgcttcagcctcccaagtagctgggattacaggcacccaccacgcccggctaatttttgtgttatttttaatagagacggggtttcaccatgttggccaggctggtcttgaactcctgacctcaggtgatccaccttccttggcctcccaaagtgctgggattacaggcatgagctactgcgcctggcctggacctatgtttttcttcgtcactagtttttctttccagttcagttcctcttcatgtcacttgtagatttcttcagtctcctaaaactccgtgcttcttacaagtgaaacactaatcatttatgggatgagtaattctttttcagcagtttcaaatatgttaggagat

SEQ ID NO: 134448 - DNA, 1058 bp, Homo sapiens
tcggcctcccgaagtgctgggattacaggcttgagccaccgcgcccggccgatacaactttttaaaacatctctaggttaatgaattactctgaaacactgaaatccttaccatgaagagcagttcagcgcaatggttgtccatgatcaccacagttacttaagacaaaactgctgcttagccggctctgtactttactgccaccacttttgcatcaattccagaaaatatattagaatgcaagagcatgagatgccctgtgccatttatttataaaaataaatcaacaataatttattttaaaagcaaattattcactaactttgatattcttacaactaaccagtaataatatgttactggcagtatcctttacaactaatcatgatatattggtgtgtccctatctaagaacaagggtgggaaagccacagtccataagcaaaccccgcctgcttcctgtttttgtgcagcctgcaagctaagaatggtctttggatttttttaatggctttctgaaaaaaatcaaaaggaaaacatttgtgacatttgaaaagtacatgaaattcaaagttcagtgtcaattaagttttattggaacatagccatgctcattcatttatgtattgtttatagcagagccaaacagagactgaaaagccaaaaaactactatctgacccttaacagagaaagtttgctgacccctggagtagagataagaatgacacacaacctcagtggtcacgtctcttatgcacaaaatcctgaatatagacagtaaacttaattccagaaatagtagtaaataccatctaggatggaaatccattcctgagttgtccaaactttctgatttctttaatgacaaaagccaacttaattaaatacagcttctgcattctatctgaaatcatgtttatatattcaccttttgactcagcggagcaataaaaaaagcactgggctccaagttagaagacctaggttttaggcaatttcttttaaattgttacattgttaaaaatgtatttaagtcttgtttgatctgtgtattaa

SEQ ID NO: 134449 - DNA, 1054 bp, Homo sapiens
tcttcttctgctatttatcaagctaatgatgtaataggagtgctacctgacaatgtgaacaaaattacctgtcatcccaatttagcatgattttttgtcatttttacatatttccttctatttattcatatcattcataattttacatagttaaatcatagtaaccatattctctcctgttttcctcttttcacttaatgctgctatgttgtttctagcttgttcttgttaccacattatatgactatttgtatttcatcaagtgaatggtctaccatttatctaacacattctttactacaggatgtgcgctttgttcgcagtttgtcattatttgggagaacacatatagctttttgcatcaggaattttattttcttaggctataccctgctggattaaacatggtgactttggcttttgccccctttctaaagtggttgtgctaacagatagtgccatcagaagagagtgactttgcttttctccacagccttagcaacacagagtgtaattgttgaaatctatttttctaatttacagcaggtataaaataattctttgagattgctaactttcacctttctttcatagcaataataaaccactttctggcagggcacagtggctcacgcctgtaatcccagcactttgggaggctgaggcaggcagatcacctgaggtcaggagtttgagtccagcctggccaacatgtaaaaccccaactctattaaaaatacaaaagttagctgggcatcgtggcacgtgcctgtaatcccagctactcagaaggctgaggcaagagaatcatttgaacctggggggcggaggttgcagtgagctgagattgcgccactgcactccagcctgggtgacagagtgagactccgtctcaaaaaataaataaataaaccactttccctttctgcttcatgatgatctgagagtcttatctgtctgttactttctgctaggatattggtctcagagcaccatgctgactcaataggcaacaagaggagaatgtaccccaagacttcaccccaagggtcct

SEQ ID NO: 134450 - DNA, 1049 bp, Homo sapiens
gtagcagggagacatatttctgcaggatataccctgaggtccatagagagcagcaggagggttttaagtagtctggtaaaagttaactgcaggtgactcagatggattcacttgactaaaaactagatttagaaacagtcaacaaaatgaaccatggactaagactttgcaaatgcaatttctacatctcccaaatttgaatagtaaaacaggccatcgtgaagaccattgtgagataatagttgtaaaaagccctttggaaattgtccaggactgcacaattgtaaagaggacagagatagatcactttggagacggaaaagaggctggcaattttcttgatcatttttctatgaaacttacccaggggctgtgttttattcttcacagcaggatgatatcaactatttaaggaaactctcttgagataaaagacgtgtatatttgttctctggagcaaatggtccctccctgaaacccaaaataaccctgtccgtggttccctctcctaacatcaagcatcctctgtcctccaacctcatcctcaccagtacaagctgttggacctctgctgggcgcatggtgctattcaaggataaggtggagaaccctgcgtatcccaaaggatgtggcacttttttcacaatgtttggtattttccagctaagtagcagggtgtcccagtgtcaaacgagatgccacggctgggcccatgcatctcgtcatgggtcagggtcagtttgttttctgaacacagataacaaagagccaagacatatgaaatcctcaactatatgttacagctgggcacaatggatcatgcctgtaatcccagtactttgggaggccgaggaggtggggaatctcttgaggctgggagttcaagaccagcctgggcaacatagtgggacctcgcctctataaaaaagaaaaattaaaatattagccaggcatggtggcacatatctgtagtcccagctactcaggaggctgaggcaggaggattgcttgagcccaggattttaaggctgccatgagctgtgatcaca

SEQ ID NO: 134451 - DNA, 1067 bp, Homo sapiens
agacttctagtttgcattatgatcttgtcataggattatttacaaatgattttttattattgtttttacctcttcctctcatttagagaatgcctttaaaaaaaagaaataaatattatttcatttaatttcaaatacttctttaagttacaagacttaaagtctctgatatatacaaacttccactttgctctttttcttaagtataatattaccattgtatatactttataataactacagatctagtttttgagtttatttctttcagtgtttaatgcctagaaaacgtctttgaaagtacacagagggcttgcaaggcattctgcttttctaaatcctgactgtgtcaccctccacagctacccgctcccttccccagtgcttagcagctcggaccggttgccttttggcattgaggagaatgggggcacaccgttcctcaccgcagcttcaggaaggcatcaccaccagcaccagcatcagcatcagcaccagcaccactcaaactacagcctctcactgaccctggagaacaaagaggggcctctgaggtccccaaactccagcagcaagtcccttacaagtgagtaggggtggagggggcaaggcaggagaagggggagcaatgctgcagggcacgagagttccctagattcttaagacagacccttgcggtgcagcacacaatggttgtcatgttatgctgggctaccgggtttgggccagagtagacaagagccttatgcatttgagcagaagcactttagggattatggtttaccagtaaactctaatttcattatagggtcacagttctccacctcctttctttttttcttttctttttttttttttttgagatggagtctggagtctggctctgtcacccaggctggagtgcagtggcatgatctcggctcattgcaccctccccctcccaggtccgagcaattctcctgcctcagcctcccgagtagctgagattataggcatgtgccaccacacccaactaatttttgtatttttagtagagacagattttgactatgttggccaggctggtc

SEQ ID NO: 134452 - DNA, 1049 bp, Homo sapiens
gagagccaattgttctaagatcacccaaagaatcattcacccttgccccatgaacttgtgatgccatcttcatatgtgtctgccactttcctgagtgctctcagatcctttctctgctcccctgcaacttacactgtttacaggaaactttacttctcaggctccctgtcctctggcttttacataggtttggtcaatgggaggcactgacatggactggagggtgaatacaggagacaagtcagggtatttctccttcatttcttcatgcctccagtgatgtttccaaaagcagccatgagttctctgtggctccagctccctctagactgtcttcctgctaccttagctcctgggtgctataacactgccacttccccttgtccctccagctctaggagtgataagcaggttctgtttgttgctaatttataggttacctcactgtccaattaagtttcttagttttttcagcccttgtataaccaattccctgaattaaattccctctgtaagaaatgcctagagtagtttcagttttcggattgcccatgacttatatacaatcaaaacctctctttggatttttcatatatatatatatatatatatgaagaatatatatatatatgaagaatatatatatgaagaatatatatatatgaagaatatatatatgaatatatatatgaagaatatatatatgaagtatatatatgaagaatatatatatgaagaatatatatatatgaatatatatatgaagaatatatatgaagaatatatatatgaagaacatatatatatgaagaatatatatatatatatttgttttttacagacagggtttccctctgttgcccaggcaagagtgcagtggcacaatcatagctcacttgcagccttgaattcctgggctcaagcaatcttcttctctcagcctcccgagtacctacaactacaggtgtgcactaccacacctggctaatttttcattttttttatagagacagggtctcatcatgttgcccaggctggtctcagatcct

SEQ ID NO: 134453 - DNA, 1042 bp, Homo sapiens
gaaattcaggtaacagtcagcatgatactgccctgcagaactgaaaaagggaatgtgggcaacataaagatagcaaagggaaaggaattgattttgaatatctgtgtttcctttcctgtttgggagggtattgataactttccactcaggcttcttagatacccacccagacatcatgaatttccctggtgcattgaccaaggaaggatggatgtacttctagttacaattaaagtttcaatatattggaactgaaattacagccacatcccaagagtcacctgtggttttattggatgaaaggctgcagaatttaaaatattaaaactgctgtagtctaggccatccactaaaaaaggattagaataattagaggaacatccctgtaggctcatgttataagaaacccacagaaacctcctaatcgtcccctactgaatggtgaatggtttaaacatccacattctgcactgagacctcaaaagcaagaggtgttgctatgctaatgctcaaccagcttcattccctggctgaataatggacactgtctgtattaaaggcaattaaaccattaagcccttaaaattcatatcagtgttacagcttcggaggccaactaaggatgttcataatagaagcttctgaaaaacctgcaagaattggggaacagagagaggatcatttgcggaaatttttaagcactaatgaataccaaaataaattaatcctcatctgtatcaccctagaaacacgtacccagtgttcagctccaactctgactcacattggtgtcttgtgcaattagaatgtctaaaacctactcttaacagattatgcatcttattcatctaacctgaactacattccgggatgaataatgttttaatttcattcattcagtgagccggatggcgtctggggagtggaaaaataacacttcccagctcatgcctgagtctgccgtagctctgtcagagtgcacaggatgacaaagaatctgctttgtggacattattttacactcacagctgagctttcgtga

SEQ ID NO: 134454 - DNA, 1063 bp, Homo sapiens
cctgactccagttgctcctgacaagctcatgctcctcccagtcactagagtgatctttctaaaacacagtcggcctgtgccattgcagtgcttgccattaccctgaggatgaagtccaagggcctctcagtggaattccccactccgtgtctccatcctcttgctctagcatatatccaccatttctcaccctactgttgaaaatccttcaatgccaaattgcttgtggttcctggcatgtgccacaccctgctgttactcacatctgtgcctttgcaaatactgttctttctgcctagaattctgtcactcccatcccttcccctaactcctgctcaatgtctgcctctgcccagacatcttctcccagggactcttgacggccccacctctgcaaattgggttaatttctgtgttccagtaataaccccctccctttctacccccatctatagcaacgttgcacttacagctttgtattaaaatgggctcttttgtttatctcatcctgaaacctgtacactgcatcaatctgagctttgtgtcttacttgcctttgttccccagcacctgacagatagcaggtgctcagtgaatgtctgctcagcaaatggattattccacattcatttgaaaggagatgtctaaccagataacaggcaataatacatcatctctgggctggtctgaaggtatctgaacaaccttatccagtatgggggcatcatactgtgagtaggacactgaccaccatgtgacttctagattcagtttcatcatctgaatattactcagtgtgtcagctgtgttctcgtttgaggcattggtatcatgctgtacagggcagaagaaagtccagccacgtgacattggaaaccccggtaggtagacattgatctgcgctaatatataggggctagtcatctaatgctaggctttgcatgtgtcacttcatttcctgaccactctgtgagatgggtagtatcctgtttttcatagatagggaagctcaggcttagagtttaaccaagcagcctgtattccagagcctatggtctcaacc

SEQ ID NO: 134455 - DNA, 1599 bp, Homo sapiens
aaagtatgatgtatcgagataaactcatgactgcactttgagagactgaagcatctctcttccattcaccttcatagtttcattgcattccatgaaaagtgtcttggcctcagatggatggatgtgtttggacgagtgtctttaaggagtagtcctgaaaggtgtttttggtgtccatgtaaatatttgaagataaaaccactatagcttgtcataatttactgttgactgcattctcattaaaatgaaggtaaaggctcaggaatcatattgatgttctgattttaaaattggagtcaaagtctatgtttatcattttactatgttcctgatgttctttgttatttaattaatgggagcaaataaaaccagaagagcttgggaagattgctcagcatatattcctgtcgtagaagttgagattgctagggtccagtttccctagtgtggcctggacgagtcatttccccttcattgacctcattttccccatctgaaaagagagggttggactaagtgatctccaaggtcctttccaactctaaaattctgcaatttgttaacatttcattttgtttaggttgaggacatacattcaaactaattttatcacaaggaaaactgcaatacccacttccttgacagagttactcctttcagaagctaaataaagtatataacttattagatgttatatagatacagggggactttgaatttcacatcttaaagcagttgagctactttgaatttaagcagtcgtactaatcttaaattgcatagcatttgttttgatcgaatttgctgctcaagtatgggaataatttttaatgtcttaatgattggtgctgctaacttgcgtgatttcagaagacataattgtgaatacacactgtcagaattgggggattggtttttaccctagacttcactcttaaaaagcaacgtgcaatcaagatcatttatggctcaaatgaaagcatataaggttttcttgaagttgtgccaaagcattctgtagagtaggatgagatggttgttgccctagtctgttggtagaaccagaaatcaatatgttgtcttttaggttaaagcttgtaccaaaatatttatttcccccatttcaagccctgagtcaaacatttttttctcttaataatagacctgaaatgttttattagtatttctgtgaaatcagttgattcttgtgccatttttgtatatgtaattgtaattttgcccatgttaggccctctaaaaaatgtttgacatcctttgagatattttattactaaaatctgatcttttttggctactgcaaaaatctattcagcaagaaggtatcagctgcataccttgcacagtggagctgactacctataaactctccctaaggcatttgtttacaggtgtattccattttagcagacgttctgatgctcagtgtatgtgctgcatacaaataaatgtgttctgaatcttttcatcttattgatagcatttttacaaatgtgtttccaaggaataaagattattcttgctttttttttgactccatcttcattttttttaaattgattcttgttgctatgcagaagt

SEQ ID NO: 134456 - DNA, 1049 bp, Homo sapiens
ggcaactgttcctttatctgtaaaacgaggtggtcacatttgttgacctcatagccttgtcgtgtggattaaataataacagatgtgaagttcccagtacagagtcttgtctggagagaacattccaaagtggtggccagattattgacagtggttttaatagcaaggggacccacatgtggctcccaccacagtacccagtgggagatgctcaggagggatcggtgcctccccctgccgtgggaagaggctctgcgcatcactggagcttctggtgccggtgctgtgaggtctcccagcaatgccagggcaggcctgaaatgggagtaaaattacttggtttgcccaactgaaacaggacctcatttttgtcaccaaaatatgacattgagactgcattctggaatatttcctactgtttctgtttgtgagctctaaaaggacaagtgaaagttgctgtctggggttttccttgttatatgttcattttaaacagccaataaccaaaaaaaagtcattatgtggaagttcctattagagtatgtagcacataggaatagttcatgattgttaaataaatcattaataatgccactctacaacctatttttctttttttttctgttttttgtttgtttgtttgtttagctctaaaacaaatccagaagtccataattaccaggtaagatactgcttttaaaggttttctttaaagaaggaaaattttaaaaataaaatttaaaaaaaggtttttgtaaagtttctaaattttccataatgagcagtcatcatatttgtaatcagattttgagaaaataataacaatatttgtttttttgagaaaatggtaagagaagagccctttccttctgacccctgccacttcttggccatctgaactgcctgtttttcttaaccttgtcaactggcaagcatcagggacatatgtttaagtttctgggtggccacacacagccccttagtggcattcaagtgaggcagcttttggtcaaagtgtgttttaggcctagggaacatgagtcccttga

SEQ ID NO: 134457 - DNA, 1211 bp, Homo sapiens
agattttatttccaaatggaaggttaaactttgtgtttctttacccaagtgagttcaggctaagttgaaacgtacgttggagctcttggaaataaaagtgcactttcaaaaacaggtaatgtactgagattctgatattgataacacacgagaaaatatttacttcccagtgggcggacagaatatcaagctacacatggctccaggttacgaagaaccagcacctttgagaggaagcctagtaaacgttatccatcccggagacattcaacgttcaaaggttgtgtgtttttcattctttcttggaattttacattatgcttgagtcatttaagccctcgaggagcttggtcaagcagcttatgaagaaagtacccgcagttctccagtctggagcttttggaaaaataatcccagtggtgttcttttaacgggacctggccacttccgccatccctctgtcattagtgtttgccgtggatgtgttcatttatttctcccctttctccatatttctttccatgtgcctctttgcttcttttagacctgggctcaagccccggtacctcaggaatatcacagggaaacacctttcttgcctatagaagatactgtatctccatcatcttgcaattttaagtgtggacatcaggcccatgctaactggaattctgaccacgtacaagtacatgaagaacttttagatattcggctcaagtcccacagtcagtccaaactttcctcacccttaaatttagccaggccctagaatgcctgcccccttcccctttccaaaccccttcaaccttgtccatcagttacagctggggcctcatacctgtatgaggcccggaacacagtacaactcagtcagtgaatgagcaagccaggctcatttctgttggatcccagcctccagatcccatcttgtagctcttctttctctacactaggttgctccccgacttaggacgcccagtttgtactcagtgtttgctcttttatggcagagcctctgcactcccagcctcctggccccttctgtacatgatttccttgtggccactccatgcatttttcttggctcaggacttagtgggcctccatgggacttggtacctctacttgttcccttctggaatctgtaactttgtgttccccaccattctttcctttatgaaccgatggtgcaacagcatgactacctgaaa

SEQ ID NO: 134458 - DNA, 1846 bp, Homo sapiens
cctcttaaaaatggctttgaaatactaggcctctggcagcacacagtgatcattgagtataagaagcattggcactgaagtggttgatttcgcatgcagtcttaatttaccgtaaagataagaggtttcaacaggcatagctcttataactgtgtcatttttcagcatctgtattgaatattttctattacatgaaaaactaaggctatattgagtctaaaaagtaacccctgctattgaaaagaatacgttctgattttgaatataatctgaaggaaattaaatatgtaatttccgaatttgcaaactctccatagaatatgtgctataaaaacctcagtgaaatgtactccatagaccaatagaacaagtagattgtacagtgtatacatttgccttattcagccgtgcaatacagacctttggttggtgtgtgtattatgagtgtgtgtacttttttttaatcctctctccctctctctctctctctctacctctctctctccatactgtgctcctcatactaaaggctgtgtaactctagaaattgtcttcggtttggaaaaatattaatggcaacaccttgcatttgtacagtactttgtagtttacatgcagtttagcctgctttgtatttaaaagcagaatggtgttcaagtcccaacattgctcctttccagctggatgacctggggcaagagcccttaacactgagttcctcatctatataatgggagatgggtcgggggggctcactggcaacacctatcctaaaggtttacaaacttgatgcattgaccaaattggataatataaatgaaaaggctttgaaaactatgaagtgctataccaatgtatgtcattattgtttttctaaccaaatttgaaatattacgtatgaatgagatcactgaatttgcagtagtactcttctatggctgtgccttagatagacttagaatgctgagtgtatccagccatgctggcagtgttcgatatggtgtctgtgtgtttatttttaacgctatgaccttgtttcaagaaagatttgaaggcagctttaaaaaagatgcatgtactatatcaagataaaataaatttaaaatatgtttaaaaataataaggcaaagggaatacttttcattctgttttccaaacttttccattcttgccaaattcagtaaaattgtacacgattgatagaaactatacctacattgggttattttgccctatgatgagaattgactttgggaaatttgtagtgcaagtcgcttgttgcattctttaatgtagacagcaaaaatatgactaagaatacaagtcattatctaaatagcgctaccttttgaaaaatgattttaatgacattttgtatggttgtacttaagttcctatttcgaattaatttcattttatttttttcaagattgaaatgcccttatgaaacagctgtggaattagctgctctctgtctacaaggtacattaatctttagtagtaattagcattttaatgttattgctttttatttcaacaaatgagtgtccacagtataccaggcccagtgcttagctttggggatataaatgaatatgacacggtctctgtccccaagtggcgtgcagtccagtgaggaaggcaaggagtagcaaggactgcagtgcagttccttcaggaacagagacgtgcaggaggtttggacaaggaaggcccattgtggggatgagaagaccatgagtcaaggaaccaaggcacaaaagtgcagagaggttagcagcagttgagtgatgctacagagtgaagttcaagcatttggacaggtggatgacctcgggccccattt

SEQ ID NO: 134459 - DNA, 1011 bp, Homo sapiens
ttgttgcttttaaaaatgcgtatatgggccaggcgccgtggctcacgcctgtaatcccagcactttgggaggctgaggtgggtggatcacaaggtcaggagtttgagaccagcctggccaacatggtgaaaccctgtctctactaaaaatacaaaaattagctgggtgtggtggcaggcgcctgtaatcccagctactcaggaggctgaggcaggagaattgcttgaacccaggaggcagaggttgcagtgagccgagattgcgccactgcactccagcctgggtgacagagcaagaccttgtcttggggaaaaaaaaaaaaaagcatatatgattgggaaattttcttcttagtgaatgggtaaggaaaggctaactttttgtgtggtgaacttatagtcaagattctattcacagtagctcaccctaaccacaaaccacagacctcagggaaataatcttgataatctgtataaatccaagcctaaggagaggctgtcagcatcacacctttcttttctccagctgaacgtgtcattctctgccttcttcctgcaagaggcagtgacttttttttttcttaagactactgactcacccagaagaaaaaaggctatctataaaaagacaactttatttgtatactcctccatcagatgaatggatagtgatgccttagttatagttttatgaccctaacagccaagctcaccatagacagggttaaaggaaaaaagttcatgtgcttttccactcattgacctttttgaaaatcttacacgcagagccaagtacatagctctaaagttctgcttcttatgtacagaataccaggcatgagtgggacccaaggagcttggggttcaagactgtgccttggcccaagaagcatccaggctattagggacagctctcaccatcagtttcagtccaggggagtaccgtgcaaagcatccaggggctgccacgcagcgaggcctctgattgccgcagggatgctgtgggaggtcc

SEQ ID NO: 134460 - DNA, 1017 bp, Homo sapiens
gtgtacacagaaccaagccaggctccaggtagataaagactaagtcagggatgccactctttccctgagtaactaccacttgggtaagaatatgtgtcttttgcatctgcagagaactctatggtttttacatgcttttacccagtttcggtctaccttgcttctctggggatgttgaaagttgactcttggtggccagagctctggcatagttgttttgctgcactttaggtgcaggaactggcatctgtaacatgggactaagggaagaagcaggacttgaatagtttattgacaaaaatggttctgaatccagttggagttgtttgtttatttatttttgagacagggtcttgctcagtctcccacgctggggtacaatggtgcgaccatggctcattgtagcctggaattccagggctcaagagatcctcccaccttagccacctgagtatcagttggggttatttttatcggaaatatttatctcaacgcgttgtagcttacccatataagatggcacaggaagtatgtagatgtgtctacatgagattagccaaaactgcatattgaaggcttttttaattcatatgcattatactgagtgaaattaaccttaaaagagtagcctctgtatgattccatgtacacgcagctgtagaactggcagaactaatctgtggagaaaacaaatgagaataactgttgcctcgggggtagggaagctcagggattgacgaggaaggggactcccaggaactttctggggagatgagaaggggctgagtggtagaggagtgtggggtacaccagtccatttgtcaaagtaggataacttagatttgtacatttcaaggcaaatgcaatttactaccatccccaaaaaagtataaaaaaattaatggtgggccagggaggaatgaatagaggaaaagatgatacacagtgttgatcattgtcaaagctgagtgacaggtgtttactgtactcttctgttgactttgtgtttatttgaaa

SEQ ID NO: 134461 - DNA, 1030 bp, Homo sapiens
tggcactttctgaaagatctaattaaacatgttgatgtgccaatttaatcaagatgagagatccctgctggtgtcaccctctagaacctgcacttggtgttttgactttccagaagaaaaaaatgcaactttggttagggggcagtggttggatcacacagttgtctttcgtttcctaccacagtaattcatatttaaatatgcttttagattagtgtggatactattgctgctgtgttgctacctgacctttttctggggggggtacctcagaaatgagcatttgagggcaagcgaaaaagccctcttcatcctccagaggcaacaaagaggcagcagaaatggggaaagattgtgagaggcagggcttgggtctagacctggacttaggcaagatatgttgccctcaaccctgagttttcttatatgtaaaaagggaaggttgggctggactagatgaggtcaagatttgccattctgggaggctgatattccagagaatcaaaattaatcctaaaccaaagctttatggctgctacagagacatgtcacatttctgagacttgtcaccaagagtttgtccctcagactttggcgctgttgaatgcaaagacaaggatggccaccttctggttcttgcctgttgtcctcagctgagagcagtctcggtaaaggtggcaaagattctgtgacctcagaccggggaccaaatgcttgggagtctgatggccgggctgggccaccattctcatagctctcattctgtttggagcaaccaaaggatttgtgtgaagttatttggaaaaggaccttaactgagcagtaatcttttttctgtatatttggaatgtttttcattctgacctgttctgtcagtgattctactgaaaaacaatttaatcaatataaaaatgttcaagctatgcaacactgttattgtctgttgacatttttattctaattgatttctgcaaatcttttcttatttgtgtttgctttttcctttcatttagaaatcaactcttttgga

SEQ ID NO: 134462 - DNA, 1410 bp, Homo sapiens
ggtgtagataagcatgcaattatggcatcatttaggcctgtatttctatggaaagatacaaaaaggatctcagtttggggcctgtcctaatgccttcttccctaacatcaccacacacacccctgtcggcatcctggagcaattgagaccggacacccacagagctgttgtcctcccagcaacaagatggtgtggttatcttgggtcatttggatgttttgtttgtttctgtgtgtcagactgtaagggctgagctttctgtgcttctaggtggagctggaacaattcagattcacccgccctgatgctaaggaaaccctgacgtatgtactagatggcagggcactgggggtcaggctgaaggctgagcaacacctctctgccctccctccctttgtcccatctcccagcgacttccaatattcatgtttctgagaattgtgtccctcttcaggttccctcttggtgcctaacctggattagtaatgtgcattcaggtgaattttcagctgaggctctgagaactggtactctcagtgtgttctggtcatcttgtggcttagttgtagaagcaggtgtgtctcttgcctctgcttgcctcctactgcacactcagcacccaggactggaatcaccgactactgaatctcctacatgtattgctgctacttcaagctcctccacttgaaaccttatgattttcccaaggggagatgggacagtgtcatctaaatattccgaatgtttggccttctgagaaaagagcttctagtaattgaaccatgggaaacccagcttctggagggttggccgtggggctgtgtacatgtgtgtgcccaggggtgagtgtttctcaggattcctaacgattcaaattaccgttgagtatatataaagaatgagtctctgtatggaagaacaaatgtgtgcattcacccccagtcacaatggtctccattgcatttcaaaggagaggatcagactatctgaatataaacacaatctgatgttaatttattctaagaacaccatcattttgattgtcctaaagaattctgcctttgtgaataccgtgttaaatttttttaaatttgtgacaggattgtagcaaattattatttaaggaaaataaattgtgtaaacatttaatgtggtatttttgaacagcggtttttatgtactcagaagaggaagtaaagccaggttcttaatggtatttatagaaaagatgttttcatattataatgcacataaatgaagccattttgatattcagcaaattcggtgccaattgaatagtttgctggtagcaagacggatgaagacctatatgggagattctttatctctagagctagcatatttacttgcatactttgtttcttttccacatggatattttactgctaa

SEQ ID NO: 134463 - DNA, 1050 bp, Homo sapiens
gtgtgcccttacaaacctctgttgactgtggttcttcaccatttcaaaagttttttggaattttatgaaatcctaactttgtgaatgtagcacagaactgaagaagaaaatcccctcacacaccctttctcctgtccttctgtcagctgaccttcgtcataggtgtgagtgagaaagggaataggtttggcacttcacagtggccctctttccactgcctgctagcccccagtctcagatgtgtgaggacaggctgtctcagcctgtttgagagcacgccgtgagtgtgcgttttgtcttctcgaaggccaagggaggaaagcccctttggagtcagcggggaactgctcgctgggccatgcagaaaggctactcagacaaatcccaagtctgtcttctctcccctctccagtgctggaataggtcgaaccggtgtgttggtcactatggaaacagccatgtgcctaactgagaggaacctgcccatttacccactggatattgtccgaaaaatgcgagaccagcgcgccatgatggtgcagacatcagtgagtagaaatccagtaattacggtggctggcactttctgagcacttacaccaggcaggcctgagagaagggctttgtgagtcaacagactgcagctcagggggactgaatcacttgcccaaggtcacagagcttgtcagtggctacagcccacacccatctcacctctgagctctgctgcctctgtggtttatttcctgccagcccgtctgtcagggagcagccctggttgcattctgtatcgttgaacaatcatttgtccattatcctcccccgcaccgacccacctagacctgggtactccttttggctcagtggatgttgcatatgaccctactttgagctctgttccacccgtgtggtgcctgagtacctgctgtgtcctccacgggcaggccagagctcaaagtagggtcatgtgcaacatcctcttgtcctcaagaggaactctaggggataactcttggggatttcccctggaactgcaagcggggcagtgaa

SEQ ID NO: 134464 - DNA, 1165 bp, Homo sapiens
cccagtgccagcccaaagctcagcaggttctgagtgttctttcgtcaaaaggactcagtccagagggcaaaaaggaaacatggagcaggaatatttctacctgaaacattcatttcaaaacatttcaacatttaatgtcaagattgaccaacttcatgatacaagcattggaagccatgcagaaggcaaagtgcaacaagaattggtggtgtaaacctgtaaggtttatgctttaaataaacgtaaatagattttgatagaaaaccctgcatagggaaagacttaggggtaggattggtacatacggctgaaaatgcagatagccaatattgattatatttaggatagagcaatgaaagtcatttaaactcttctgccatctcacagatagatttctgatttttgcctactgagtaccacacacttttatcttaaagatctaatactggtggttgtcagatatttttcaagaagttttagaaataacttgtttgattttccttattggctgtgaattgataaagagataatttttctggtgcaatatcaattagcaagtagaatagtttaaaatccagttccctgtgcaccctggggcagcaacagattctaatactttaccaatttcttaccagatggaaattcctgctgctaaccttgtgaacaagtacatcgccactcaggggcccctgccgcatacctgtgcacagttttggcaggttgtctgggatcagaagttgtcactcattgtcatgttgacgactctcacagaacgagggcgggtaagtagcttgatttctaattcagatgtgtgcagtgtcacaccctactctgtgtaacatgaatctcagcgctgagaagggtcttcagcgtctcctggtccagcccgtatgtgaccctaagtctcctctacagagcaaccaatagacacccctagtgacgggaggctcagccctcctcctccccagtcccagcttggatccattacaacaagccagaaggcacttcccctagccttacttcatgtgccccaacacccctgcagtgacgtggccttgcccattcaggacaagtgctggtcctgaaagagcagtgtgtgtgccaggttaacagtggcctttgtaaaaaggagaaattacatcactgtgccattttccatagaatc

SEQ ID NO: 134465 - DNA, 1749 bp, Homo sapiens
ggttacagtgagccgagatcgcaccacttcactccagcctgggtgaaagagtgaagctccatctcaaaaaaaaaaaaaaaaaaagacaaaaaaaaccattaaaaatattatttggtatagtaattctcttcttagaagtttgagtaaaaaaaatttcaaaacagcctaatgaaaaagtaagataaaagttaatacaaattatagtaaactagattattgaaccattaaagatcatatgtgtaaataatagttaatgacatggggaaatagatactatataataagtaggagaaagcagcttgaaaattagggtagttatttcccagaatactccattagatgctgagattttccacggccaaattagcttgagatatgtttagctgatcagaatttaacaaatgtatgcattatgcattgcaggacttgtcctgttagagattcatagaacataaaataaatgttttccaaatgtcttgactttgaaactttttctaaggaatacttactatcttcttttaggacacttaggttgagtagaacatagcataagaagtgccaatatagccgggtgcagtgactcacgcctgtaatcccagcactttgggaggtccaggcgggcagatcagttgaggtcaggagtttgagaccagcctggccagcatgagaaaaccctgtctctactaaaaatacaaaaattagccaggcatggtgatgcacacctgtagtcccagctactcggaaggctgaggcacgagaatcgcttgaacctgggaggtggacgttacagtgagccgagatcacgtcactgcactccagcctgggcaacaaagagagaccctgtctcaggaagagaaaaaaaaagtgccagtatgttgttcaatctcattttttgcttttaaaaacatagtatataaatgtattatgcgtttacatatatgtgcttctgttcatttgtgttcatgtaggcacagaaaaaataagctggagaaaatatacaaaaagcacatctcagagttgtgaaattgctgataatttttttctttatattagtctgaatttcccaaattttccgcaaaaaaaaaaaatcacttccaacactgaaaaaactgtgtttttaaattcccatagagttaataaaaaccactggtgagaaaggattaaagggaaaaagcagtcatatagaaaagaaaacataagccttggagtcagatctgagttcttgtttgtgatctcgaacaaagcattgaacttgcaaaataagaatacaattaatatctcttacagggctgttgtgaaaatcacatcagataccatacaaatatgtctaatacatgactttagatatgcaaagattgtgttgtttgagatttttcgtagtgattacatgtgtagggaagtacctctgtaaatgaaatgtactatatattgggataaatgtttttcctgtggaaatagactcctgaaatgatgaatgaaatgctctcgttcttaaaggaagggtgtggttcactacattgaactgaagggaaatgattctagactaatttagatgatttccatttaattttgagccagaattcttcccccccccccccacatctagttgcttttagctcttgtcaaatagttgtcataaagacaaggtttcacttaccatgctccattacctgagacccagacccttcctatggcattttttcaaattaaaaaaaaaaattattaaagagtttagtcagtttctcatgg

SEQ ID NO: 134466 - DNA, 1049 bp, Homo sapiens
actataattacttgaatagaactaatagatatattactgagtattctacaaagggaaatagccctttttttcagtggcctacaggaggctgttcacacttttggttaaaaagaagaaaatgtaggctgggtgcagtggctcacacctataatcccagcacttaaggaggctgaggcgagtggatcacctgaggtcaggagttcaagaccagcctggccaacatggtgaaaccctgtctctattaaaaatacaaaaatcagccaggcggggtggcaggcacctgtaatcctagctacttgggaggctgaggcaggggaatcacttgaacccaggaggcggaggttgcggtgagacaagatcagcctaggtgacagagcaagactccatctcacaaaaaataaaaataaaaaaaaaaggaaatgtagaggttatcttctctggccttgcctttcaaaaaagttcacattttgagcagtaaaactcattcatattttcacacactccaaaatcgaaacaaggaagaacttaagagccagtcacagtgcataccggttttttggtattagagaggacaggaaaggcagtgagaagtcgtttgtttgttgatttagcgagtgtgtcttgggtatttcccctggatcaggaacctgatgagggaaggagaggggagtttctggccccaaggagtttacagtctaattttagtgtattttaggaggtacatcatgtgtcccagaaacagctgaagaccaagacagggtaagatgttattatacagaatatatgttctgcagcaactggaggtgaggggactccaggagatccctggagtgagatgtgtgggattaataaaggggtgattaggattaagtgtgtggggggagcatattccaggaaaatctcagcccaaatgcagacaaagctcatggggtatcacgtagcataaagagacaggcctacctgggtggacagcgcagtgcagatcctgggcaatgcctctaggtgaccaccgtccttcagccctgcgagaactggttccagtttatcag

SEQ ID NO: 134467 - DNA, 1123 bp, Homo sapiens
cccgaagccattttccccatgtgtccggagggtggggacactttggagggatccatggcacagctaaagaagggcctcgaaagcgggacggtgctgatccagtttgaggtaagaccctctggaggctgaatcccactgccatgtcgcctattgggctgcccctgcctctgagcagtggaggaaatgaggcagagacacaagcccttgtttccttggtcgagatgattgtgtgtttcacaaaccaaaagcagtcaactgagtctctgaggactgacagggcgaggcctgtgcttgtcgtggataacagggcacagcaggcagcccccttctcaggctcggagcagcaagcagggatcagggtggccaccctcgctgaactctgtctcaccctcttattctagtaacatttggtagtcatggagaaacatgccagaaactgaggaggagggactctgagtgtatttaactgccaacacaaaagctcaaaactcccagcagtggaaggcagtggagaggtggctgtgggtgaaggaaccagctctctgaccacccccagccatgtgctggaatttggagcaattagtgttatcccatgagggcatagtgtctcgccctcccaagttgcccagaaccctataaacacaagtaagaaaccaaactcaaacccccatcttccccaggggaacctgtgattcataggattcaggctgttgacaaaggtacacacagacattttttataaaacaaaagggaaccaaaggaaactcagcttttaagccagttttactgatcactaacagaattaaaatagaatgtgttcatcttccaaatttattttcttatttttattttttaaatatgttgttgtcgttgtttaaaatagagacagggtctcactgtgttgcccaggccagtcatgaactcctggtcccacgccgtcctcccgcctcggtcttccaaaacgctgaaattacaggtgtgagccaccacacccagcccatctcccaaatttatttaaaagtagaagaaaacagagtaattcctgtaataaaagaaataacaccaaaaagcataaaataggtcaacaaaagaaaatagatcatcattagaaataacaacagtc

SEQ ID NO: 134468 - DNA, 1071 bp, Homo sapiens
acaaaagctttcacctttgcaagacagataaatactcacctctagctggcaaatcatttcctaacagtacatctaggaaacaaaaggctggaaatggtatagttatattataataagtgaaggttgactaccacggagaaatggcttcagcaatttttatatccttattctgaaatgtttcataacttatattctgagcagtacttctttatatcttacaaccatctaccatgtccacatagcagtggatgcattatacaaataatgacagtactacccgagggagagaaggcaaacttgatcatggtcccaggtgtctgggagcagagcgagtcagcgttcttcccccaaggactgtgttatggtaacaggagaaactcgcttttccccaccacccaggcggacacctgcattcctaagctgaacgaaggggatcaaatcgtgttaatcaatggccgggacatctcagaacacacgcatgaccaagtggtgatgttcatcaaagccagccgggagtcccactcacgggagctggccctggtgatcaggaggagaggtaatggccacctggggggaggagccatagggaagctgtcctagccaagctgcgcctgctccagccctttatctgctcttgaaaatgttgagtttgtagccaacatttgaaaatcaagaatcttcaggtaataaccgaatgtttggcttctcacttgaaaaatgtgaagatctgcccccaggaggcctgtccccatgtggccagtcttctggggggagacagcgcccctgcagcccctttatacaggacatgagcccccagctcccagttcctcccaggcccagcgcagcccacatcacgcactctctaagtggcatgactctgcagacatttgcattttcagccccttcttaaaggatctggtgatattttattcgtgcgtgtttgattttgtcggggaggcagtgaggagagcagggtctgactgtctcgggtgattcctcactctgcctctgcgggctgggggaccttgcaggggttacataaccagtctgtggttcagctggctcaggtgt

SEQ ID NO: 134469 - DNA, 1038 bp, Homo sapiens
ttactggtgggttaatgactgcagagttgagcagttgaatcagagccctcactcccacaaagcctctctggccctttacagaaaacgtttactcatccctactctaggacaaagtgagggcaggtggtcgcctaccccccagctgccatcatgcacagcctcatctgccccagcagctgtgttgaggaccagcgctcacaggccagatgcgctcacagggtgtgcccccttcccaggcctcgctcgcctctgctgaaagcccctatatatatatatataaagcccatatatatatatattaaagcccatatatatatataaagcccatatatatatatatatatatattttttttttttttttaattattataagttctagggtacatgtgcacaacgtgcaggtttgttctagcagcactcgaagacatgctgtggagtccctctctgggggcatctgcgtttttaaggaggagcttctctctgagtgtatctgttagttcatggactgtggggatggcagagggaggcttctgaacagagtcctggtcagcccgctggatccagaggggtcaggaatttgttccatatttctgaaatgacgtgtgattcgaatcagtcatagtgaagtttgaagcctccctgtaccaaagactcacatttattggtacctccatgttgttgatgctgtgagctactcgtttttttgtttgtttgtttgtttaacttaaaaaactttgttttgtttttattttaaaatgtttacagggaggagtggatcaaaagatgcctcttgtggtatcaaggataaacccagagtcacctgtaagtaaatacattccatgttattcctcgtgtttgtttgtttccccctaattctaacaggtttctgtttctgagtcctgtttctttttttgccagagcaaagaatgtgcttagatatacatcaccatgttttctataaccttgcggctcagtgtggtctttgaagccatagcacccatgttacctgggacctcattagaaatgcagcatctct

SEQ ID NO: 134470 - DNA, 1058 bp, Homo sapiens
taggaagatctcttgagtcaggaaatcgaggctgcagtgagctgtggtcatgtaatggcactccagcctgggcaacagagctttaccctacctcaaaagaaaaaaaaatggattgggggggtgcagggagggagagagagggagacagaggtagagacagagacagagacagacagaacgagaactggaaataccattttaacttgttttgtaactgccaagcagttgccctttctgccactgggtgatgctcttgtaaacagtgaaacccagcaaagatgccgtatttggggggaattttgtaaagcttccttttacgtaagtgaaagtcatgctttttcaatctgaaaacttgtatacaacttcaattccaaaatactctgtctctgaaatgccttcccatccataacaccctacccccaaccagccacttggacaccataaggccagactcttgtcctactgtatcgctgtgtttctccattggtctgtcactgaatattttattcaaatagattgtgattatgaatcattctgtgtgactatgatacagattttatatttaaattaggctcatttaaactcactaggagaaagagaagcaccaatttcataaaaaatccatggataagggcttgaaatgaaggtcaagaaagaggcagtagcagctgtcttttgtctgggtttcactgaatgacttggtctctgcgcttctcccctcacttcactttggatgaggttagggtggggcagagtcttagaatgtaggagagccccatagtcatcagctctgtaaggtgtctgtgctgggcctgtggctccggaaggggctggtgtgggtgatgcagagactcaagggtcctgtcctgtacagtgacagcagggatggttaatccctgtgactctgaggggttagaaataggggtcttggaagtgggctctgcatggtctggagagggaagaaaggcttaggacgcacatcggtcaggtttctgtctgctaagccgggggaaagccatgtgaccctgggcaagttactcagcctctcctgacctcag

SEQ ID NO: 134471 - DNA, 1033 bp, Homo sapiens
acagttgtcttgatgggtcaccagcatgacaccctccgagtggatggggcttcatgcctgcataacttcttcgctgtttgcctctttccttagagcctgccttcttccatgggatttggggcagccattgttttttatttcaaaaattctgtgctggccagccatagtggctcatacctataatcccagtactttgggaggccatgctggtcagattgcttgatcccaggagttcaaaaccagcctgggcaacatggcaaaaccccatttctacaaaaaaatgcaaaaattaggcgggcacgatgttgtctgcgtgttgtcctggctgctcgggaggttgagatgagagaatcacttgagcccaggaggtcgaggctgcagtgagctgtggtcgcacccctgcactccaggctgggcattggagtgagaccctgtcaaaaaaaaaaaaaagaaacaaaaaaacaaaaaacaaaaaacttctgttcattggaaggaacctgggggatccccttcttcagctttggcggcagtgtaggaattcccccagccctgagagccctgcgagcaatggagagtcccctacagtgcagctgtgtgctctgtcgttagacagcccaggtgcccactgttcttcccaagctgtgctggaagcctccttgacgctgacccagcatcaaggttcctgccttgaactctcaggacaacacagatggtgtctgttcccagttccacctgccagccttggttactgttccttaagatagacaattccaatgtagtcactttccacccatcaccctcgtaaccaccattctccaagtgcaaatgagccttctagagggtggcactagatctgaatgtggaggaaggatctgcataccattctacatgtccccctcggaggacaccaggcagggacagggttttgttcagagtgtttgtgtcccttttccttgaaccttgccttcttgtttgagtccacttgcgtgtagatgtctctcagatacctgaaacccaatatgatccaatctca

SEQ ID NO: 134472 - DNA, 1128 bp, Homo sapiens
ctgcagtcccatcacagagcatctagaccttcatagtccaatacagcagccaccagctccataggactatttacattccagttcattaaaattaaataagatttaaaattcactccttcaagcactgtttgatgtaagtgatttctggccctgcttgttcctatacattgcacaatgagtcttcttgaaacccctccttgagaccttgtaaagtgtgtcatcttggggctctttttatcttgcagctaaatgttaagaatagcaaataacagtggttcaaaggcaggcttccttgtggggttttaccaggtgcactgacaatagacatgtcagggggtcaagttagtgactgtgctctgcaagtgggatgaacagccagaaaagcagcccccaccacctctgttaggtgggagacctcttcctgccggtgggaagccactttgtgctgggtcttcagaggaggctggccctcctgagggtctgggaacccccattgctccaggtaagaagtacagactggtctgtacctggtgagagaaaaaaagaaaaaaaaaaaaacctgttggttagtttctgtgagtatttgcaaaatgtttacaaaatatttgacatgttttatacagcagatttgtgttaagaggcaaaaagaagcattctgtcagagaaatcggatgaataatatcacagacagtgaggagggttccttttaagaagaagaattaagtgcgatgttctgtactcgtttaaaaaagaagaaagagagaaagaaaaagagcggttagatttggctgtaaacccagagtggcgcagctcaggctgcctgagtgccatcttagcggatgagtcacttgctggtttgttccgtatttatagcagcacagcaaagtttatgattatagttatgaatccttggcagtttgctttgtgcccaagtaggctgcactcttttgttgctcccaaggttctatcagccattgtgtgttcctttccctgcttccgaatgaagaccaaattctgcagagaagtaagtttctttcatggcagaaatgaaaaagctaccactctccacccagataaaagggagagaatgttccctaaagaaagagacatgcagaacagaaactgggg

SEQ ID NO: 134473 - DNA, 1205 bp, Homo sapiens
taatgagttaaccggctctgaatgtcagcctccgccaaggaaggcatccttagaaaggtcaggacacgaggttcactggtgtctaataaaatttttaagtggaatttgctttgaacactttgcactcaacgtttttcccacccaggcgaagtcctcggctccggcacgaaatccgaaagccacgccactcttctgcagataaccttgcaaatgaaatgacctacatcacggaaacggaagatgtattttacacgtacaagggctctctggcccctcaagacagcgattctgaagtttctcagaaccgaagcccgcaccaagagtaagaaactcgtgttgttttatttctgggtatttgctttttggctgttgcggaatttgctcaggtccaggttgccatttgagaggaaccaagagctggtgcctgcagccagctcccacaggtgccttctgccaggataagaacataaatcagactctaccttttcacccggaagacggtctatgtgcctggggtctagagcttgtacttctttttgtccacgacaaagacttcctagtcactaagtacttgttagtctcttgaattagtctcctctccagctcacaagcaaagcccagtttaatcattccctgttctggaggtacagactctagggccatgctaactctgatttctctagattattaaagttttaccatcacatgatttcaaatcattggaaatatgcttgcttctaaaagccttctccgaacaacagggttctgaggggttttgttttcaattaatagttagtataaagaaacaaacgttagaacatctctaattttctttgagaaattttttgttaaatttttatgtcctacctcccccaccccgcttttttaacgtgacagagttccctcatagctcaaggacagaaaaaatgtctgtcctgaaagatggttgagtgcttttgttattcaataggatatatttaacccatttgtttccctttttgccttggttaccagggagttcagaactgcacattaggctcaattgtattcacttccctcagcccagatttcttgtataggaccttctcttcctcatttgcctttgttatatgggtcttttttttcttattttaatggattcatagttacatatctgtacgttttggggtaaactcgcaaatcatttttttaagtaggtaagacat

SEQ ID NO: 134474 - DNA, 1123 bp, Homo sapiens
gctccaaatgtatccagcctagaaatgtaaatagatttgaaataaaagcattcatgaagaagcgcagatgatgataaagaatagattctggtcatctctattaccatgttcataaagacggttaacaaatcgtgctcttgaatattccggtacactggtttgtggccacggcattttgaaaccagttttctgctgtctgttgcatcttacctcatttcaccaatgtgggttaaatgcttacaagtccctgctcctatgtctgtgtgggtgaaatcttgactgtttttcctcccaggctgaatccagggaacatattgtggccttcaacatgctgaattaccgatcttgcaaaaacttgtggaaatcctgtgttgagcaccatacgttctttcaggcaaagaagctactacctcaggaaaagaatgttctgtctcagtactggactatgggctctcggaacaccaaaaagtgagtgtgctgtaaagactgtgtccacactaggctgagatgtaaatgcatcctggtcatcagtgaatagaggacattgttaggcagaggaggaaacccatagcccaggggctccaggcattggatctctgaaccataactaaaagtctcccggggtcagcagtgtctaagggatatctcatgttcccagcatttctctcccctcaactctgctgaactcagcacttccaagcagtcagaatggcagctgtaccctgcaccatgacataataaaggaaatggagccatggttctgtgtgtctcctggtgccagcatactgggctatcccagtctgatgccactatgccagcctctcccacagaactttaattccataagatgctctataaaaatgaatgaaggaatagaaaaacatttccagagtcaagtgactttgggatatattgcctataataattacaaaataacagtagtaatcacagttgataattactgagcatttactttgtgctgggcacataattatatttgactcttacaactctcctatgagataggtactattagccacaggaatgatattcaaaatatttaatgactagtacaggaaaagaaatggatgtaaatttatatatatttatgtataaatatata

SEQ ID NO: 134475 - DNA, 1289 bp, Homo sapiens
gtggttcctgtctccctcactggattataagcctctggatggcagtggctccatgtcctcttccctctgtccccagggcctggcatagaactttgtacatcctaggctctcagtgcattttttttttcttataaatgagtgaagggcagtagggagccccgctgaggccccaagcctggaaacgacaagagttcatgtctgtgcataatcagatttgacagctcagggagagagctgtcaggtggggaaattggggtcagcctgggaaggcgatgctgagctggagccctaggaaccacaggaggcctgccaggccctcctacccctgtatatgaagccaggggtggggggagtaagaggtccacagatacccatgggccaaacaaggcaaggtaagaactcaaaaggggagttgattctcctgactcgttctgcagaacaggaatttttgcatctgccagttggcacaggagaatcgtgaggagactcccccgacttcagggagatggcagagcagtaacacacactaggaagagtatctccagaaggggtgagcccagacactcttctcatccttagactattaacctgtagtcaccccaaaaaatttacttcacagttacatctaccaacagatcgttgaaaatagatgtgtattaggtaatatctaatatgtaatagaggtatattgctgatccatctgggggatgtcccatgaatagttcaagtttcgttttacctacacagcctctccattctagaatgttctaccaaggtctttgtatgatcctagagaatagtaaaattccttcatttccccaaagtatttcagaagtaaagattccagcagagaaatatgcaccctttgtatggattacagaagttttgcataaatgaatgatagtcagcccttggtgtacttgggggattggttccaagaccacttgtagttaccgaaatctacacagacttgtcacacagttggctccgcaaaactcgtgtatttgaaaagccagccctttgtatatgtgggtttcgcatcctgcaaatactgttttccatccatgtttggttaaaaagaatcccccagatagtggaccccacatagttcaaacctttgttaatcaagggtcaactgtaaatttattttaaaagttatgtttttaattaaaggaacaagcattgcaggcctactgtgtgacaaggtagggacttgacattcctactctgcttgaatcctcacaaggccgctctctgagaagggcagtgttttcaccactgttgggaag

SEQ ID NO: 134476 - DNA, 1137 bp, Homo sapiens
ttaaaaaattttagtgtattacatttgcctttactgtttatgtgcagcataaagttgcttttgttacaattcatgttgttttgtaatggttgatcaaagcaaagaaagacatgtgttactacgcatgatctgtcaatgtttaaggctgttgttggttcttgtgactttgctaatatgtttttctcctgacaggttaacctgccctcttaactcagcagtggttctagcgtcctatgccgtacaatgtaagtcacaaagggagcatttcacggatggacaggttgttctgatcagtgtgtggagaaagtcactggttcctcctgcttgaccaagtccctcttccccaggaatcctgctgggcagcatatctctggctgtccagatatgtgtttctactcagactggcactctcctgtagcatggggatgttagattaaggaaggtggttaaggggaaaggaatgaatgaactgtggtgtgaaattttctccaagggagcccatcagacagcagacagctgttgcacattgcattttccagaaactttgctcaggcatttgatctgatcttcatacaaatcccagtgggacaaatatttgtatcagtcatcccttatacacatggaaacctagacccagctaggttaagaaatttgctaggagtcacccctgctgcttggttggtgctactctaaaacactactgggatcttaggaatttcttttcagagttgcagtatagctaatggattgtatattgatctataccagtgctattcaatagaaatataatgtgaatcatatatgtaacttaagttttctagtacactcattaaaaaaggtaaaacgaaacaggaggttttttatgttttatttaatgcaatatattgaaaatattagcattttaacttaatgtacaaagttattagcaagatattttacattttttttatactaagtctttgaaaatcagtctggattttacactgacggtacatctcaatttggactaaccgcacgtcgctagtggctaccatattggatagaaagtccagatggaattttcttgaaggctggtttaaactggagtaggaatccgctcattcaatcagcaaaactttatcgagggtatattccctt

SEQ ID NO: 134477 - DNA, 3088 bp, Homo sapiens
gaaagaaaaagaggctatgcctgcagcgcagagatgaaaagttttagaagagggggaggggaggtgaacaagcatcccaaggcagcaggaggacattgttctcccctgatgtgcagattgtcatagcgccatccgctggtacctagacatgtggacaggtgtactcaggggcacacccccgttagggattctttgaacacacgctgcagatgaagaaagaaagcactaaagagcagggagggtagagctcaggatgatctcaggtagaggaggagatctagcaggctagtgagaaggacttgagttgcagagagcaagaaagtgctcagtgcctagatagggctggcgaatatttactgagggatgatggtgaaattgacatgaagatcttgggatcttagcagcacaatctgatcttctcctgttgccgtctctgtgagaagaaatggactaattttatccacacaagcaaattgactctagatgttgatgcataaagccgtatttgaatatgttcattgtgtgatttactagtatactaacttaatatactttacattaaaagcatgagatattttctagtttaaaaatgattttgaaatgtggtatagcagaatcaaagatctcattactctaattctggttttgtcaccagctgtgtgacctaaggcaagtcacctctaattggcttatctgtaaaatggggctaccagtagcagcgtagcccactcatagtcatggtggtgttgaaatgcaggaatgtacatgaaaatgcttgaaacttataaatggctacacaaacgcaggctattatttctttgtatattttgcataataatgccgatttaaggattttttaaattcctaatacagatgacggagtgcaatgtttaaacacagccctaagataaacgtgtgctaggaagtagatgataactcagtctgtgctgatgttgcataaatgttttactttttgaagacttggagatttctgaaacaactaacttatgtactccatgtttgaaattagcccttttataatggaaaaagctatggttgagtgaaaaaatgcatcacttatggaagagaagcaacttacatacattgactttgtcaaagggaaaatttaatttgtttttgaaaaatgttgtaggaggtttcccctgtaccctgcattttcgagtaagattttttatacctgatcccaacacactgcagcaagaacaaaccaggtaacaacatttttttaaagttttctgtttagtgtataaaaatgagtaaccactaaaaatgtactcttcattttattactatggccaaataacttcatttgggtgtaactacaccaacaatgatgatccaagtaaaaatctggggtgcacatactgacattttaatcacctaatgagttttcagtcttgggcctgcttctcttatctcctgatttgctgccattcccagcatactcccatctgccacctcctacctctcccacctccttccacctccctggcctctcctgcctgctgaacacactgtgctcaaaggacaaaaagtcattttctaccaatgtaggcaggatgtagaagacaaatttgtaaaatagtcatccacaggtcaaatagcatgatgtctctgaagagctaaaatcaaggctcttgaagataacaagacatctcttgttataagaattttctttctttttttttgttttgagacggagtctctctcttcaccctggctggagcgcagaggtgcgagcttggctcactgcaacctccgcctcccaggttcaagcgatcctcccacctcagcctcccgagtagctaggattacaggcaggtaccaccatgcctggctaattttttttttttttttttttaacggagatggggtttccatgtcgtccaggctggtctcaaactcctgacctcaagtgatctgcctgcctcagcctcccaaggtgctgggattataggcatgagtcaccaggccagctttgttataagaattttctatcagatccccagtttgcaagagttagaaaggagagcaggctggattcagcttgtcttctcagtgaatcagcaagtacaggaaatatgtgaaccagataagggaaagagggctgtgataggagttgtttacccctcagggcttggagtctctcccaaccctgggctggtactggggtttttctaggtgtgagggacagagtaattggaatggagtaggagagtgtagcacaagaaagttgttgctgttttaacacagactgcacaaacaaactttccctcccctgtggcaacgttaagcccttttattattgatccatttatttttcttagggagggaagctatagaaaaaaagcaatagatgcttagtattgaatcctgttttacattcatcgtggccaaaagacataatcaaggaggcagcattaactcagacacagagtgttgccttgttaattttttttagcagtaattacatcacattttaacttgtaatatgttgaaaggccaaatattaatctgttactgtattttgccttctttgtgcacctcctccctctactatagcagacactgggaatttgactgtattttttattactttttaagccaatgtccaaggtgtctggtatgacacatccggtgaccacacagaagcatgccctgtcctctgagttttccccataccagctctttatgctggtaaactggggataggatagaaacactcagcccagcaggttacttcataagctgacggacacagagctggtgatgaaatctataagaatgtgtttgaaatgaccctaccaaggtttcctcaggccagtactaaataacacactctgggccaggcatggtggctcatacttgtgagcttcccagcacttcaggaacccaaggcgggagggtcacttgaggccaggagtttgaaaccagcctgggccacatagcaagaccctgcctctacaaaaataaaaataaaaaagtagtcaggtgtggtggtgcatgtgtcagcatctcaggaggctaactaggaggatcacttgagcccagaagttcaaggctgcag

SEQ ID NO: 134478 - DNA, 1021 bp, Homo sapiens
ttttcaagtagtgattagggtatatgttgcccatgaaactgagctccttgaaaacaggaaagaatagaaagggtgttgtttcccccgtgcctggcacaaagctgggcacacagcatgtgctcgttaaatgtgtgagtgagtgggttgtgaaacaatcagcctcacagatggcagggcttggggaggttctggctcatcccacttaaagcccgtggcagagccagcactagaaacgaggtctccagtctcccaggccagctgcaggaagatactgggaccatggctgcctatggtgcccacccaccccagtcaccaccgagcccgtgacctttgcccatgacctcttccatcctctggccagtcctaacaggatcagtcccaaccctgaactggctgctaggatctgccccaacctgtaaagttcagtgtgcaaggaaagacatcagaagagaagatgggatgagagaacaattgagggaacaataaaaggccacaagaatgcaaagggtgacaaaaactgatccctgggtcttccgcacaccccatacaagtttgcccactgccaatcccaggtgatcatggaccttgatgtaggcaggaggagaaggcagtttgcgtggagttttagcacggtgggtgctgtatctccttttcagcaggcatggggcggtggcccagtgccttggctgcagacgtctccctgtcagtgcagaagactcaggtggacaaccaaagtcatggaagtttgggcccttcgcctggcagagagtgggaatgggcagtagagatggatgtttcccagccttctgccccactcttccacgagcacccaggcctccagctattccccagtgtcagggcatcatttttttgtaggtgggaaacattgttgtaacaagtgaaaactccagcaaggaaattcagttgtctagttaggtgtctccaaagtctaattagaggggctacaacgtatacctgtgacctgtttcttcagaagccactttggaggaaaacatcctct

SEQ ID NO: 134479 - DNA, 1094 bp, Homo sapiens
tttattagatacatattttggtccaaatctttgaattgtcgtgactttaaaaaaaattttttttagcttacaagttctgagtacatgtgcaggtttgttatataggtaaattgagtgtcttggagatttggtgtacagattattttgtcaaatgcgtcataagcatagtacccgaaaggtagttttgcaatcctcaccctcctcccacacttcaccctcacgtaggccctggtagctattgctcccttctttgtgtccatatgttctcaaagtttagctcccacaagatgctggtacatgtcttttagtgagtgaatatacatttttctgctgggaatgtgcccatgactgaaattgttctatcacaataaatgcatatgttgagctttagtagatactattcagcagttttccatcgtacagtggttgcactgagttatgctttcaccagcagcatgtgagagttctggttgctccacaccctccgtggttttgccagtcttgaatcataggggttctctggtgggtgtgtggtactattgctttgtgggtttaatttgcatttctttgacagctaatatggttgagtacctgtttttgttttcttcctgttttctaaggagttttctgttacttcctctcactaggttagcaggagcactccatatattcttggcagatgtatatattgcgactatctcctcccactctatcggttgcctttttgctgccctaaatggtgtctctcaatgaatagaggtccttaattttaatatcagtttatcaatgagtcttttcacatttgaaatcatatttataccatgtttagttctgtaaaaccttagaggtagaacacaaatacataaaattgtgaaacataaataaaaatttaaaagcctgggaaatataaattagaagactcagaccagggagttaataagacatgcaaataagccacgtaattctgtgaacgtacaatttagcaatacatattgcttagagcatcttagaagtcaaaactcaattggaaacatgatctgctatgtagttctcattatctgtgagtccgtcagacagtatcgagaggatgggat

SEQ ID NO: 134480 - DNA, 1014 bp, Homo sapiens
ggcaacagaggaagactgtgtctcaaaaaaattttaaaaagctatagatagaactaccatgtgacccagcaatcctactcctacgtatatacctgaaagaattgaaagtggactcggacagatacttgtatgctgaaatgataaaatttaagcattgcaacaccattcacaatagccagaaggcagaaacaacccaaatgtccaatgacagatgaattgataaacaaaatggaatatcattcagtcataaaaagaaataaagttctgatacatgctaaaatatggaggaaccttaaaaacatgctaagtgaaataagccagactcaaatagacaaatactatgtggttccactgatgtatctagactaggcaaattcgtagaggcagaaagtagattagaggtggccaggagttggaggaggggtgaatggggagttattgcctaatgggtacagagtttctgtttgggatgatgaaaaatttctggaaatagtggtaatgtttgcacaacattgtgaatataattaaagccactgaattgtacacttaaaaatggctaaaatggcaagcgttaggtcctatatattttacaattaaaaaaaaaaaaaacgcttgtttaccggagatttaaaagaacagaaaaaaagaaaagaaaaagaaaagaccagaagaggtagtgggaggagcacgtctttggcaggagccaccggtttggattctgccctgccgctgggtcacctcagaaacacatgtggtaacctcatgggcgaagcctggtcccctcttttgatgtgagagtccagtaagatggtgagtgtgggctctctcctgggtcatgggagttgctcagggaatggcttcccatcccctttaatttcatcttttccattgtaaaagattgttctacctggtagaaaagacagaacacagttaacttggcgattttgcgcaaatcatcatcagttaccttgctcatgtttagccatcctcctctaggtggtggcccagcccctg

SEQ ID NO: 134481 - DNA, 1032 bp, Homo sapiens
ggcaagctctgattgttgcatgatggtagcagataaaactagtcttagggtcacagcaatttgtttcagtagttattaaataaaactggttttaggttataacaggcagttttagcagccacgcttgcagagaattacatttttggagcaatgttatgtgccctgagtatttttcccctggcctctcaactctgatttagttgggcattacaataatgacccaaattgtataatcaacttccaccctgtaaaatgaggatcataattgcacctattccctttaagttgactgttgtcaatgagctaatgtggaaaactaaggcaaaacttggcatagaaaaggggtccctcactttgtggtcagacccctgaccctccagacaagtgctttgatctgtgttcagtgctgagagtcgctgtgggtgagtgaaggtccctcctcagccaggaccacaggtcccggttctcaggactgaagggatattccaagagggagcatccaggactgtgcaggggccatggctgcctgaatgctgtgctgatgagggtcccctggcgtaggagtggggttggagacctggcccatgcatgtcacctccctcagccacatcagctcaagggctagcccagaggttctcggtgagggaggcagcaaccagctccatcagctgttttttgaccgccagccaccattgggcctggggaggggaggttggcctctgagctcagtcttccccactggctcccccgagtcccctcccctgctctggttatcaaatgcattcatggttcttgtagaaaataaagtgtcagggaacacaagaaaaattatgcatgatgcttctctgaaagcagctggtccactgtcagcactgccatgatctgcacatgccctctcctgcttccagtggattctctactccacagacgggggagtcttccatacactcctatttttctcaaaatgaagacaaagctgatctctcagcatctcctgcaggccctatgttcatgctctttgagccctcacct

SEQ ID NO: 134482 - DNA, 1047 bp, Homo sapiens
tgttttcacctggatgggagcaatgccactgtgttgtctttgaggcaggagtaacttctgcagggatgcctctggttttagttatcagcactaatctgtacttattggttgccacacactgttgtgagtgctctccaaatagtaacttaattcatttaatcttcacagcaaccctgtcgccaggctgcctcccaggtacaagtaggtgggggctgaactcctctgcccagtgtatgtccctctgtgggtgatgctctgattgtggcccggcctccccctggctgcctttacatagatgtgccgggaaacagcccagtctgaattgcagtggagcactgaccccatttcctttaggggaccggcaggactgtgctgactgcgttttctgaaccaaagaacgggatctgtagtgtgaaaaaagaatgtgtgtgccactgctttgtgcaagaggaggcctgagaagtgtttggatactgagagagtggaatttttgaaacattttgatggtttatatggaaagttaggacagaggatttgaaattggaatagtcctggaaaattgaggtcccatgatttactgttaggatacacaagcttttagtaaatgtttaagcagtgtagagtgaagtgaattttttttactgagcccccatagggaacaaacagtgcattttagcctcaaaatctgactgattccttccagccccattttacagagggggtgagaaaactgaggctcagagagatgaagtaaccaccaaagagcacagtgtttgtaagcagtgcagccgagatttgtctttttggtttttgtttgtttgtttgttttttaaatatagagaaagggtctcgccatgttgccaggctggtcttgaattcctcggctcaactgatcttcctgcctcagcctctcaaagtgctggaatcacaggcgtgaaccactgtgcctggctgcagccaacatttgaacccaagtctgtgcctagacaaatcatctgttgtcaaagtcaaataaaatataaaaacagatgtttctctaaatttaaa

SEQ ID NO: 134483 - DNA, 1006 bp, Homo sapiens
agcaggagaaaaagcccaagttaccatggaagcagattcaggatcccttaccatatcatcagtcatgtctctgacccctcgattcatcttttatcatacagaagatactctggtagttttaagcattctcattcaagtctcagagacctggttagggaggcaaggtcagagacaaatcttatccctggaaaaagctggggttccgaggtggtaattggcttcagagaattgagagcaacgctttgttggctgtgaactggaaggtttcacacacagtggggtttgttgctgccaaaccccaccccattccccaccttgcagataaggaaactgagctggcaaaggtagagtggggccaggagcaagagggaccaattttgaccttctgaactacaggtccaggcacacaagagacattttctaggacaggcataacctaccagaagggctcagctttggggatgggagggagtgagaagacatggcaccctgcctttccccaaccctccgggtttgtggtggttgagaaaagaccagcaatttgtggtccctacatcttttcccaggagagctcaccttccagcattgcggtcctggaaagcagggacaatgcctctttatcttttcccaagatctgttgtagaagctggaatgctgaaggcacccagcacataccctggtctggaagggctggtgggggtgcagtagcctacccagcatcagctcttcattccaactctaatagagacaggaggagaccaggtcagtgtccacactgctcttggctgggtccaggtgacctcagagcctgatcttatagatgtcttctttcctctggccgagaaggacctgagaagtgcttggtaagcccctggctgaaaactgatttggtaatgggttctaagacccagaaatgttgcatctccagagcttctgcttgtgtgtgcacctgaagcttcccactgcccccaggttaacttgttattccaagaccaggtgtgagcac

SEQ ID NO: 134484 - DNA, 1511 bp, Homo sapiens
taaaaattcatgggaagttgagacaacttgacacctgggttttccaagctggtggaaagagcttgtgacttggaaactggagacctccgttcaagttgggctcccccttggccagctggtgaccttggcaagttgtttaacctctctggtcctcagtttcctcccttgcaatcagctggtaataatgcccacctcgctgggttgttgagtggattaagtgggataaattatgtggaggtgtttggcaccgtgcccggcacaaagctagcaagcagttggcgtgatgtgaatttaattcgtttagagaccctcgtggctctcatttcaggaggaaattagaattaggaaaccatcttcagggcctagtggtggagtgacagaccctgtctctgtgcccaggagaacttctgccgaagtcaaggccttcggaaaaacaatttagccgaattgtaatcagagagcatctcctttaaaagcagttttatacattcagaaactccagaagttggcagttggcttcacttacaaaagagctgttttgcaagatgatccatcttgcaaatgtttaagcagatgatgggagaaagtaaagcctgcttaggaagatttctgttttaaaaagctcccaaatccaactttaagcgattatttagatcagggtttctcagccttgcactattgacatttagggtttgataattctttgtgtcctgggcattgtagggtttagaagcatccctggtctgtagattccagtagcaattcctgttccccagttgttccaatcaaaaatgcctccagtattgtcagatgtcccctagggagcaaaatgccaccccagcacccctttagaaccaccaatttaattcttgctttctgtcattagcccgagttgtttgagaatttcatcttgtgcttttgtaataactaacctttgcatagccttatagaacttacagagtacattcacctgtatcgtcttatttaatctttacaactcccttgtgagactggtgtcactcccattttacagatgaggacatggaggctctgagcagccaattacacagtatgtggtagagctggggtgtaacccaagtctcctggttccaagggcaggtctttttcttctgcatcaagctgcctgtccctttgttgtatggaggctttgatatggatgactttccggatgattaaatcaagatgtgaagtatattggaagttggaaacttttctgagattgactagttgaaaattaacaacagtaagctattatctgacagagtaggccattctagttaaatattctagtttatagcgagctcccataaatcccacatgcagttaatggaataccaatttgcagagaattagagtagaatagaacgtgcctaatactctgtattgatcctgcgttttctctggtgatttgccatctcctaaaaaggactcatatatgcaaattagacattagctggggaatataaaaggtcaagttactgaaggcattt

SEQ ID NO: 134485 - DNA, 1005 bp, Homo sapiens
aaacagagtacacggagtggtcaggagcagagggctaatcgaggaaggtggtcaggaaaggcctctctgaggaggggacctatgtacaatgagaaggcgccggccacgtgaaaagctgggcaagaacgtcccacagagggaaaggcgggcgccaatgtcctgaggttagtgaagttcgagtgtttgatggacagaaaggcgctctaggatccgcaggaaggcaggtgtgagatgagacggaggtgggaagcaggagcacagatcaggtaggggtcccacgagccttggggaggtttaaccagggaagcttactagtgccaagggacgagcactggactggaagtcagcgggacctcagctcaaccgcgcacccgtcgtgcaagactcctcatttcaaagtttctttgggcgccgacttcttgccttccctaggcatgaaatcactgagggcctggcacacagtaggtgcccagtcatggctgtggaacgaatggctgcatgcatgcgcgagggaactcaggacctgcccggagctcggcggagagccccggtgcccctaggagatgcgtcggggcgcgccagcccggggcgggggcgggagaacaccgcaggccagcccggacgcccgccccccgcccggcgcgcgggcccgtcgcggccagcccggccggcgggaaccgcccgcgggcggcactgggcatgctcagacggcggccaggtcgcgccgcgagcgagcttccgcgccgcccgcacgcgcgacctacctgggcgctccgcgcccccggatgctgcaggtacgggcccgtgcgaccccagcgggccgggggcagggtgcggggctgccgggggccggggtcgcgctcggcgccaccccgcccccacccgtccctggggcgcgcggcggacgcgcgggcgggctggcgggtgcggctgcaccgggatccccgcaccacgtcggggcggggagggggcgccccgctgcgctcacctggcggggccggggcg

SEQ ID NO: 134486 - DNA, 1034 bp, Homo sapiens
ccaggctagtctcaaactcctggcctcaagcaatcctcccacctcgacctcccaaagcactgggattacaggcatgagccactgcccacctgcagaccttctaacacaactagatgactcttgggtgtggaggttggtgggtgggggggggacatcctgacttacttgttacacataggcaagaaatttagagtgcacagtgatatccaatcacagattagttataccttatttgggacactgctggacacatctttctacatctatctatatctcttttctatctactgattgattattaagctagcaagaaaaattctggaaggactttgacaaagaacctttagatacaacatcacccttcttgctcactgcagaaaagcaagcaatttttttgtaaggggcacatagcccttcacatatcttgcttagacataatagtcacagcctaaatggcttcaggaagatctttctgaaaggggcacacacattgataactcaatgcaagtcaaaatgtgatgagaagcataaaagaaaacagaacaggccaggcgcggtggctcaagcctgtaatcccagcactttgggaggccgaggcaggcagatcacaaggtcaggagattgagaccatcctggctaacacggtgaaaccccatctctactaaaaatacaaaaaattagccaggcatagtggcaggcgcctgtagtcccagctacttgggacgctgaggcaggagaatggcatgaacccgggaggcagagcttgcagtgagccaagatcgcgccgctgcactccagcctgggtgacagagcgaaacgccatctcaaaaaaaaaaaaaagagagagagaaacagatcaaatactctctggtgcagggattagagagctcatagccagtggagataatcggggaagaggcagtttctgagatggaccttaaccaggatttcaacaggcagagacagtcgaatgtgttgtttcgggaggttgatataggtgaccttcatttttcaaggggaagcaagaaagaggt

SEQ ID NO: 134487 - DNA, 1070 bp, Homo sapiens
tatgtctaagcaagatatgtgaagggctatgtgccccttacaaaaaaattgcttgcttttctgcagtgagcaagaagggtgatgttgtatctaaaggttctttgtcaaagtccttccagaatttttcttgctagcttaataatcaatcagtagatagaaaagagatatagatagatgtagaaagatgtgtccagcagtgtcccaaataaggtataactaatctgtgattggatatcactgtgcactctaaatttcttgcctatgtgtaacaagtaagtcaggatgtcccccccccacccaccaacctccacacccaagagtcatctagttgtgttagaaggtctgcaggtgggcagtggctcatgcctgtaatcccagtgctttgggaggtcgaggtgggaggattgcttgaggccaggagtttgagactagcctgggtaacatagtgagaccccatctctatttatttttaaaggaagatctacaggtgaagggcacattcttttgttgtccacctgtattgctgagtgagctaattccaaaccagctctggggcctatgacctccatatttgagcagaagaattaaaaagtctgtaaaatccctcattgaaattatcaggaaataaagggaagctaaaaccctcttagtgtctcatggttttgatttcattgcaatctagaattgtatatagtgcagtatcaatcatgggaagctgccccagtgttgtcagcctctgtgacagtattttattctcacactgtagggtaaatgcattgaggcaaccttcatatttctctcaatcctgcgcaatctgcagtaaccagctttctttgattacctagataggctcaggggcctctccctctgcattatctactagattctcactttaacacattatatacagttgtttaagtctgctactccaactgttaactgtctaacatcttttcttatgctgggctcctggatagaatctagcacttactgagagtgtgatgagtgagtgaattagttgacattgggttgccttattgatatgcccgtcaggccaagttccttgactt

SEQ ID NO: 134488 - DNA, 1025 bp, Homo sapiens
tttaaacaccatgtgcaggaataagaaatgtgtccacggtttcccttctctgaaacattttgtgtaggaggtcccaaaggcctgtctctccctgattaaggaggaacaaggtacctcctaaagaaccctgaataattacctaaaaatagataaacaattttaatctcctttatgtcatacttatgattaaagtcttaaaaatcctgtgcttggtgtttccggtttcaatgtgtggtcacacaccttacctcatgtagtcttcatggcattcaggaagcaggtgttaccaaattttgtttgacagatgagacactgagatttaggagtccctaacaaacatttcttgacgtaaaaatgaaagctgtcttttaaaaagctttaaagattagtgtgataatgtttaactgagtaggtgtgtgttcttctcaggagtgagaaaagtgtgtttggctgccagatggcttttggagacttgtgttggttaggccagcaaaaatgccctccaatctgtggaccagctgcaccagctgcacccaggagcttcttaataatgtagagtgtgagtctccccctccagaggttttcagatttggtaggtcaggggtgagaatctggaaggaatatcgttaaaaagctcctcaggtaattctgatgcacggccaggtggaagattggtcaattgcctcttttggttgcaaggataatttgaggccctgatgataaaaatgtggtctgcaagccacctgtctcagcatcactcagatgcagtttcctggacctcgccctaccaaattagacctaccaaattagaaatctccagaggtgggcatattttaaacaaactcccaagatccatttgttcatttatttacaaatatttcttcaggtctaggtatgtgataaacaccattccaggaactgggatataaaggcaaatgaggccaacaatgtctctcccctaaagacacttgaattttgacccagctctttgaatgctggagtttgagaaccactatcttaaaata

SEQ ID NO: 134489 - DNA, 1048 bp, Homo sapiens
gagagggagtaagcaagagaagaggggtaccatgccctttttagcaaccagctcttaggtgaaccaatagagtgaaaacccactcgttaccttggagaaggcaccaagccattcatgaggtatccactcccatgacccagacatctcccactgggcccaacctccaacaatcaggatcaaatttcaacatgagatttcaggggacacgtatccaaactgtatcactaatgaagacaatgtctgccctgtctatcacaaagtcctagagggatgggtttgctcttgattactataccggcacagaacctgctggggtgtccagtgcactccactagctgtgaaaccagatgtcactcctgtcaaaattagtaaatttaatgaagccatctgtcctaggtccactcttggaagatccctttccatgcaagaggctattactaattcaactgataaaccaacccactcattcactcgtgatgataggaagatggtctgccagacaccgggatacaaaggccaattagacatggctgatccattccttataaagatcataggctaatagaagggacagataaactattataaggtggtgagataaaaattaaagaagtacgagtacgatactgagggagtggagactaatcctgtctggtgggttagagaagctttcaaggacaagatgatacttgaaatgggtttgacaggcagggaggagttgaccagctacagaaaggggagaacattcttggaagaaggtgaacaagcatatacatttaagatccatggtgagggtgtaagggtgtgtgtagggggatggtgggaagtggtagaaaatgaggtggaaactcaggcatagccaggtgtacacagcttgtatactacaaccaggagtctggacttggttccaagggcactggggagcattgaagattgtaagaaggggagtaacacatttgtattttgcttatttaaaagaccatcgggcaacaatgattgtggagaaggcaaagactcttgctaggtcattgcactaataaaagggaac

SEQ ID NO: 134490 - DNA, 1042 bp, Homo sapiens
aagcagcagctctgtgactgggtagagttatccatgcgagaggtctgtgccagaggctggcacttggcaccagcagcattaggagggaggagggaagttcttaggatgtagggattgggacatgtaagaccatctgggtcctgaaggaaggacaagtctctgtgcctgtctacctgtttctccagccatgaatcttgggttctcactcctacttcctccctaggagagactcagtcctgtctagctagctctgtgctaccataccagaccctcagttgttaaagctatgtcctccttacccaggtatttctctttccatccctctttatcacagcatcagcaccagcaccaggaggttcctggaaaagtggctggagacatggtccccttgtccatgtagccaggcaggtctggcttctctgagaattgttggaaatgacccaagtacaaaagtgtaaatcaaagctcctcacatgctttgagaccttcacattttcactgaactggcaatatcagcagcactgctccatgcccactacactggtatgactgttaggatttcaaacaaccatcaaagccccagcaggaagtcttctctgacttcactggtgatgccagaatattctgtagtccagctcacactctatccagctactataagaccctccaaggacaatttttcttcttcttcttcttcttcttcttcttcttcttctttttcttcttcctcttcctcttcttcttctttttcttcttcttcttcttcttccttcttttttaataaaaacccccatggtgcacttttggaaaaaaaatttttattgaggtataatttgcatattaaaatgcacccattttatgtgcacatttgatgacttttgacatatttatataccttaaattttcatgcaatataattgtgaaataatcagtatatggaacatttctatcatcctaaaaagtttcttgtgcccttatttaattttccatgcacttttggtcctaagcatccactgatgtgctttcttgtcataatagattt

SEQ ID NO: 134491 - DNA, 1062 bp, Homo sapiens
atccaatgacaggtgtccttataagaagaaaagaaacagtgagaagaaggccatttgatgatggaagcagagattggagtggcgtaactacaagccaaggaatgccaagtattgctggcagctggcagaagctaggagaaaggcagggaacaaatgcttcctcagagcctatagaaggacccaatcgtgccaacaccttaggacttctggcctccagaactgtgagaggataaatttctgttgtttttggtcagtttgtggtaatttgttaaagcagactttggaaagtaatgcacagccccagaaggagacatggctttttgggtagagcacaggctaactttcagcccttcctgcccagcagtctggtttctttgtgcaaggcacaaactacaccacaatttatcaaggctctgatggagactgagaaaccagagcccaaatccacagaaagaattaaaggagtcagcatttggtaacaggaaaagaatgaactctataggcagatggaagcctgggattctgacactgtcgcaagttagtatgatgttgagcatcagtttttttcacctgcaagacggggtgggaagggaagtagcacttgttgatcaccttttgggaatgatgattcccttgaattcactggatggctctcaggattggatgacagagtacagtgcttggtttcccgtctgtcctcaacagatatttatttcctgtcccctcctctcctcaccttgggtaactggtattagtgttgcaggagcaataaggatacttgaactctgctacaactttgcttaagctcagaaatgtttggagcctcttgaaattgcagccaatggtgtctgccattggctccatgggccttgcagggagaatgaagttgatataccttctggaaaagaaagagcagggaaaaagcaggagctacagtttataaattctgtttctccaacgtggccacaatttgaaatctacactgcatgtttattctgtttgtagcactacatgcatgcaaaactggttgaagacagtttccatgatgaacacaagcattat

SEQ ID NO: 134492 - DNA, 1070 bp, Homo sapiens
catagcagtaagtccactttcattttattttcttgctctattgtctggggtggaagggggcccccgagggtttcggggcaagcggcatgccagcacagtagccgcaggtcatatgttccaggggctaaaactctgtcagggctcagctaggctgccttttcttttctatgtctatagatggagacccccaagggcgcgctttggactgaggatttgaatgtggaagattggcttaaaaaaagatgcttgctgctgggctttggggaaggactaaacagaggcttggggtggggggacgactccaggaatattatgaccgaatgctcaggcatacgttggcttcatagcctggagaaccaagagaagggtgacctgaacggtggctgccatcctctctgcggaagctgtcctcctgttaagtggaaaaccaggagtcagcgactcagccagccacgcggtagaacctcctcccagaaaccgggaatgttagttttcccttctctgtttgatattgacaagggcactggcacaagccaccaccctggaggtctggggacttcatacaactgggtcctggttataatattccatgagagcctccttcttatggtgtggagtatctgaaaacctattttcagcctacaaaggagtagtcagttttggcaaagttcgtaggcactttcagaaaagtgtacccatgtgcatcttgggtttaaaaaagaactctctgagactgcctagatttgagcaatcttaacacagtgttgccaatgatccacagatgtggtatttttactggagccaccacagctggattatatatttccttcgaggatgagggaatgattactgctgccgtatgaaatagtaacaattaaaaaagaaggtccgttaacatattggcataaaagaatctccagacattcttccacctaaatacatttgtgtttttcagttcggaagttctctggaaacacatataaatttgttggagaaatagtgtgtaatgttttggaaccaaagtatattaaagcgttttccaaaacctttttggacagattcttcattgg

SEQ ID NO: 134493 - DNA, 1779 bp, Homo sapiens
caaaagaaaaagcgctgtcaatgctgtgttgtcatgtgaccacttctttcttctcctttcttctgggcagcctgtactctccaccactcacgtagacctcactgtaccactaactgcaatactgtgaactggaagcaaacacctgccttgccttgcagttgaattgctttgatctctctcattttttttccttttcctcacctgagagacaacgtgcatgtgtgtgcttcattctctccaagaacttgcttttcctctaaacctttccttgtgtcttcaagagtgaatcacttccttcctgctcgattggaatggactcttcgtatcagccagtgatatggtagccttaactcacttgactggaattgaacccattggcactgggggtttcattttgtagtgtgttcctgtaacgtagtcacacactgccatgtctctggtttctcacttgcctcctttgctgtggatctttgtttttatatcttgtgtggcaaaatgctgttggctctagccggttgctagtgtagccaaaagtggaccttacttagtctgtccgatctagggtgatgctttttgctgccttacataagcttccagattacagtattgtgcattcatggctttctttctgttaaaactgaaatgaagtcaatgtagaagaacccagagcttgtcacagctgaaatgtagggactgattccataacctgcccatcagcggttgtctctctttctatggtttaaccgatgaaccctttatataagaagcaccattttaaaatttctaaggacatgaaacaaacattgtttgaagcatcagtagcaattgatctccaaacttaggcaaattcacaagccttgtttctattctcttaaaaaaatgtaaatttttatattgtttcttttttctggatattttctggtcatgttaatctattttcaatgaggagatcatcttgagaagtatctttgcagtgaccatatttctaaaacagtctgtccaacctacaatggttgccatgatgctcccacttcatcatggatggtgctgtaatgcattaactgttcatctcctccccagttgattacaaagccttgcatccatactcttttctttctggccccatgagaaagagaatgttttaggtaacttcaacttgtaggtttatctgcccttcaaaaaaaaaaactttaaaaaacttttaaaaattaagaaagacctatcttctcaatgttaagcacttaatttcataacaaatattaagtggcacatagctgagcttcttagggcattgttttgtttttagcttctggagattccagaagagcaaagaatattttttatctagaacacaatgaacagtttttgaaataccttctcagcactcccccaaagcaaaaagccacatatgtagtaaaaccaaagggaaacaatttaataaaataacaatagtatagtaatgaaataaagatataacatgattactggttttaataagagttatcttaactttaagttatttgcccatttatagcattgttatgaattattcataaaattatgtcccacagtatatagttttgaaaaaacatatgatatactacatccagtctaacttctgtggaaagtagatcagaaaaaataagatagtcttgagagaattttattatagaagctgtctaatttgacctattttgcttgctcagtgctaaatctattgcttttttttaatctcctggcttgaaattatatttacttcaataggaaaggtaaaaacat

SEQ ID NO: 134494 - DNA, 1012 bp, Homo sapiens
gaagggaaggaagggaagggaagggaaaggaagggcgggaggaggaagggaggaaggaaggaagaaaggaaaagaaaaagcaagcaaacaaagaagtgaagggatagtaatgtggtttggttgtatccctacccaaatcgtatctttgaattgtagctcccataattcccacttgtttcgggagggacctggtgggagataattgaaccatgggggtggtttcccccactgttctcgtgttagtgaataagtctcacaagatctggtggttttataaggggaaaccccttttgcttggctctcattctctcttgtctgcctccatgtaagatgtgcctttgccttctgccatgattgtggggcctccccagccaagtggaactatgagtccattaaacctcttttcctttataaattacccagtctcagttatatctttatcagcagcatgaaaacagactaatacagatgtgttgagaggtcaaaaattctagatactttgggattgaaagacatattgaatctggagcgaaaaggacaccccatttaacaaactgccaaatgcccctctcccaagggcccctcccttcccacctttatctgaacatcgaagtgtgccatcctgttgtcttgcccaacaatgaatggcaaggcaagcagctgggactatctactcgtagcttgtcacaaatgtgctccaactccagaggatggtgcagtaatttcctccctttttctttcgggttgtgctttctgctactcaaaagttctgctctcctgtgatcaagatggtaagtcctgtttcatgctgttgcccctttggaattgtgccttcaaattccatttgcctggaacagtcacattcttcagagtgatgggcctcaaccacaaaacagcaacagcaaaaaacatttttctctaatatttgttactccaaataggttatcttcaatacgttattgtggtaagagattcttctcaggagtgtttgctgctgtcaggggtaacatgg

SEQ ID NO: 134495 - DNA, 1049 bp, Homo sapiens
accatgtttgccaggctggtctcaaactcctgacctcaagtgatccgtctgcctcggcctcccaaagtgctgggattacaggtgtgagccaccgcgcccagccgatggaaaatgttttgaagtgaaattatatccaataaagagctcctgtcattcatccagttgtgagagtccctttgagagttgccagaaatgtctgctgtcttgtttttactcttaaattaacttgctctttctcgaagtacagaattctaaaacagagttggtgtttttgttgttgttctattatgtcctcctgctttctttagttgttggtactagaatagtcattttctactactttttcatggacattatccttgaaataggttattctagacaagttttggaacccaaactggatttaagaccaaggcattccaagaaaaataaaatctttttgcaatttctatgcatcatctttttataactttcattctcctttgcaaaggaaatgtggggctgtggatgtgaaaggaggtgggggcagtgaccggccagctgcagaacattcaagcctggcctttggactcagagactagggcagaagaagccagagtgctaggcttctggccagagtggaatgtgtcttcccaggagtgggaagcctgtgtttttccaccttaccatctgatctgctccagagggctctgcattagaaaaatagggagctatggggaatgactagggggtggagatcatgagagcagtgtctatggaggattatcagttatgctcagaaagggaagatttggcacctggtcatcgatttttagtacagtaattgtcttgagaaaagtatttgagaatcaatattagaaacaatttttaaaatatatcagtcttaaaggtacataaatgagaggaagaaaatcagagatcagggtgtctgcaagatggtctactaggctttttattattgtaatttgtgattgaatgccctctgtggggccaggtattttgtttttgtttttgtttttgtttttgtttttgttttagatgagtcttgc

SEQ ID NO: 134496 - DNA, 1043 bp, Homo sapiens
ttatcgaactgaggagggagttagctttctccaactctgggcagattaccgagagtaggatgccaggttacattctcttgggagaacagtgctatcatggctgatctctcaattaaggacttcatatttagattatttaaatctcaaatattgaaatactctcatttttctaacaatgataattaagaaaactttgtaaagttacaaataaagtgaaattgaaaaggtttgctgaatgaagtattttactattgaaaggtcttctagaatgtaagtttcaaacacatcgtctggttggtgcattacttaatctattcctgtttggctgctgcttggtatttcccacgcaggagttcattgacttcaaggcaattgaatgcattattagccagaagaagaaaacatgtgagtctccttcacccaacaatagattttttaaaatacattgtgcacagtcctcttaaaaaaggcatcaatggcaggtgggtgtgaacagaggaatttcctcctccaccctggctgttgctgagctgtaagctgtaaacattgtgagagacaaaaagtatcaaggtctcaactttctttcggatattgctttgtatttctgtttactagtatgaatgaaaattttcctgaaaatgctggctaaaactgaattttggtgttgtctttctaatggaatttctgatcaacaatttcctttatgttggcaattgcttaatctgctgaagtaggtaaggtagttgtgctgccttaaaatttatttttatatttgtcattaaaaacaaacatgaaacttggaggttaattttgtctgtttaaattttgatgctttcattttgacaaaatcttttaagaataatgacgaggctgcagtgattgaaatacaatttgtgtggcttttaggcaagtgagcatttagcaagtaagaatttcccagattgggtttagagttgtatttgcttatgttccaaactctttttttttttttttttggtaagataattttgaatatcagtagaacttggggcagatagaatgac

SEQ ID NO: 134497 - DNA, 1051 bp, Homo sapiens
tactgcatttcaggacttaacttttaaggacattttgtgaaattactccctctgttgcagcacaactgtatcttcctagtcgtgttcagcttcaactaaaattcacatgtaaggatctggggttggggaaagattagggagattagagctgccatagattctgactttgagtctttcccgggccttttttctttcatcttttcttcttgatttcttttcttctaaaaatctcctgctcttttcccaaaagaaaatcagtctgctgccagaaagaatataatacctgtcatttaaacctcagtgtaaaatggcttaataatagtgaacatttgcattaaccgttttacagtttacatagtacttttaagtacattttctaacttaattctcaaaacagatttgggagatattattagtcctgcttatgaaggagttctgttctcagcagaattccataattacaaaaagtctggtaggacttttataggtagagccaagaaatgaccccagactctggtctttggacgctaaactctgaattaccacatttcctgcattctttaggtggagacataggcacctgtgttgtaaattaagccacgctaatttgctttgcaaaactattaaacactttttggtaaataaaggcgactttagttgcagcctggctaccaggttatgttaaacacaggtctctgggaccaaattctggcactcatacagacttgagttgaataaacatttataaaaaatgctatgaggaaatctcagctccctaaatttctagatgctccaaccccaccttgcctgaagacagatgtggcaactttatgaagacaggattctgttaccattttagtgggtggtaagcaaccgaagtcccctgagccaaaggctagaaacaagatcgtttagttttcaaacctcaaacaccatccctaagggtgtataaaccaaagggttcgctctattggcatatcccctttatgaaagggtgaggaagatctctaatccacaaatttgaacaccaccaatttcacggatttctaac

SEQ ID NO: 134498 - DNA, 1045 bp, Homo sapiens
acagcaggaacagttgctgctgcagaagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgttggttgatgaccccttggagtatcaggctggcctcctggtgcagaatgccattcaacaagccatagccgagcaggtggataaagctgtgtccaaaaccagcagggatggagcagagcaacagggacctgaagcgactgtagaggaagctgaagctgcggctttcggctcagaaaagcctcag

SEQ ID NO: 134499 - DNA, 1230 bp, Homo sapiens
tctccaaaatccatcttctttcccctaccttctccttcccatttgttgagcctgctctatgaggtatacagtaatagcttctctctccaacctgtagctcaggttccctctaccctttcccaatcttatgcccaacccctgcattttcctgggtccttcttgatcctccttttaggagccactgtggctctgcaatccttcttttgcggtggcctgggtgtataaatttgactctcaggggccatgaaacagtgcttccctagtgacccaggatgattcctttctgctttcagaactcaattccaatgccccaaattacagtaggcaaaagcactcgggctgtccaaagatctgagcggatagccaagggactaacttagtccacatcagccatctagcctagctgctcttgtgagttctttttgaaagttatttcccaggaagaagctctgccatttactccagaaacaggttcattccttgaaaacttcgaaagaactgggtactcaagcaaggaagaaatttttaaatttgaggatgagcagggataagtgttcattattctgttaactaaacatgaacatttttggtgtactagggtcaaagtcaactaagttagttgactggtgatcattgagcaccatgactacgtactgttctccttgccttttaaaaattgatctttctgccttggcccagacttccctgtgttctctttatctaaatccagcaagtatgttttcttgaaaaatgcatgccatttggaaaggaattggtaagaaaagactatgttgaagctatgtttggcaaggggtgaaggtgtgcaatgaaatcaggacttttcaaagtatagaattccacattctctttagatattacccttaaaggcttggaaaagacaactgccatggttaaacctgcctgtcagcctcactcttctttttttttttttttttttttttttgagatggagtctcgttctgtcgcccagtctggagtgcagtggcgctatctcggctcactgcaagctctgcctcccaggttcacgccattctcctgcctcagcctcccgagtagctgggactacaggtgcccaccaccgcgtccagctaattttttgtatttttagtagagatggggtttcaccgtgttagccaggatggtctcaatctcctgaccttgttatccacctgcctcggcctcccaaagtgctgggatttgggattacag

SEQ ID NO: 134500 - DNA, 1230 bp, Homo sapiens; identical to SEQ ID NO: 134499

SEQ ID NO: 134501 - DNA, 1230 bp, Homo sapiens; identical to SEQ ID NO: 134499

SEQ ID NO: 134502 - DNA, 1230 bp, Homo sapiens; identical to SEQ ID NO: 134499

SEQ ID NO: 134503 - DNA, 1230 bp, Homo sapiens; identical to SEQ ID NO: 134499

SEQ ID NO: 134504 - DNA, 1046 bp, Homo sapiens
ttccaaaagtcctgaaaattttggtcagatattatgatttgggtgattattactctctctatgcatgaagtctgaggtcttaaatcaaagagcctttgtttccacatttctcaaaataaaagaaaaagccttcacccactcgtatttaaaaaccaaactgaaccgaacaaaatcactcaccagaggacatgcctaagccagggcctccttcaatgacctcctttcttcacacagcattgggataaggttgcaaacatctgaagcgacccacaagtcaccagaaagaaatgagctcagacttgcattttcaatttcgtttcctctcagtacaagggaacatcctgcttgtcagccccagagtgcacggacttgtgcggttccagctgtgacccgcacaccaagagctggtcccttcttctttcatctcctcctttgaaggccccaggggtgggagaatgtgatgatatgaatcttcagattataaacttagctcagaaatgagaaataccactgcttggcaaacaagtctgagaaactgtcaaatattattgcttaaaggtaagtcaagttgttggatgagttgctgatattgggtttatacctatgaacacaactggaagatgatgaaaactctagaaggaaagaaagaactctgctcttacagggcaagcagagtttaaggccaaaaaggaaaaaagttaattaaaacagtaagaatgaaaattatggtgaatagtaattctccaccaagatcctctcttcaaatacatttctactagcatggtgggcttggctgtgtgaagattacctccccccagaaggaaaacatttttatggtaatacatgtaattttattcactcagtacatttaatgatggactttttactctttagtttttcgaatcatagtggactactgaaaactcattattcctgacctcaagtttctaagagaaatgttaattctaaggaagtaactgaaaaaaatcccagctaggaatagaaagcaattttatcatgtgtgttcggttatttatttcaggctc

SEQ ID NO: 134505 - DNA, 1041 bp, Homo sapiens
gtttctctccagccttttggcagcctgtgtgattcctaagatggcacccagaattctggtgcctggtttgaaccatacttggggaggatcatcagagatcacagggcccagcagaggagcctggctgagctagcttcccttgatactgaccagaatgatggccggaagtctggggatgaggcatagtgtcttctctctctggggacctgtgatagcctctcctaagggggtagatagaaccagaacatgggctcagttatccaaagcgaccattctcagcccccttgttcctggaagcccctgctccagaactgctaagccagcctttctttcctgctacttctctgacctctagtggctagaactggaaaaacttgctcaagggatgaaatcatcaataagcaggaaatgtctttgatgttaaatggctgtccacttctctatagtaatccttcaccctctttacaacattctttctgcatacatcccatcatttaattcagccatcatcaacactgggtttgggctccagactgtgactgtcactgtcttatgtaacttgggctggagttggcatctgagcctctgtggtcatgacatccaggtgtcacgacatccaccctaactacattccagggttgttgcaaggctcaaatgacatgaagcctacaaaagaagtggtatataaatccgcttgttactccaaagccattgagtctgtgattctgtaagcctaaaatgttttaattcatatattttggtgaaggcatttaagccctttcctctgattctctatgggagattctgtcccaatccataagcatttacttgtggttgttatatatatttcataatggacttactgattactcaacaaacatgaattgcctacctcgtgccatgtaccacagctactgctgggatctggcaatgatcagacaggcaaggctctaccctaatggagtttgcattcaaatgaattaaggggattcatagacaggtgaaacatacccccctgtcctcaggatgacattatagctt

SEQ ID NO: 134506 - DNA, 1041 bp, Homo sapiens; identical to SEQ ID NO: 134505

SEQ ID NO: 134507 - DNA, 1041 bp, Homo sapiens; identical to SEQ ID NO: 134505

SEQ ID NO: 134508 - DNA, 1041 bp, Homo sapiens; identical to SEQ ID NO: 134505

SEQ ID NO: 134509 - DNA, 1004 bp, Homo sapiens
tggcccccaacgaccttgctggtgggcagctgattgtgtacagaggggaaggaatcttgttaattcaaagtacagaaactgaaagcaacgttttgaattaacaaagtacggcttatctgatatttttattagtgaacaatagggtatctagttgctgcaaagaatagacttataaataaactaatatcagatggagaaagttttggcatgggtgtagaatggcctcctggtattacttcccctcccatcctcttctggtgtggtgcctgttcccggctagggggtgttctgtaagtgtgtcactgccatgtactaaccctggtcttttccctctctgccagtacacttctaagttactgtcttgcaaggtgacttccgaggtacttttcaatttgtttgtcttggtcttactgaatgcatgatccaggtgcatgctgttgtggtttgccatttcctgatgagttaaacgaaaatggcaagaaaaatgacttgtctccatatgtatttttttgtgcctgttctgaaatatgggactgcctcgaaatgttggagtccatgcaacagtgatatacaatggtgtggtttgctgtgctgtgctgtgggggcgagtgggagggtactggggaagaccttgcctgctcacgaatcttgaagacgtttggaccagaggacacaagtgatgggctattttggtttttaaagtttctttaggcattaatagcaagtatacttggcctggttggaaaacagtgcagctcatgcagattgagctatggattttcacccattctttgtttaccttaacataaagctagaaagctccattctatagatttaagatgaaccatcctaatctacagatttatcaaatgtaaaccatcctagacctccctccctccaatctttaaacgtgtatttttattttagaaactctaagccttgatttctccaaaagcctccttgtttaagagacaaggtcttactctgttgcccagggtggagta

SEQ ID NO: 134510 - DNA, 1013 bp, Homo sapiens
tagagattcacacacacacacacacacacacacacacacacacacacacacacgtctgaattaattacagaacagatactcattcaaataccttgatttttgaatcttctgaagaccagttgtggtgcagctttactcccagacacccctgggtcataagccttatgaacccaaagacagctttatatcaagattgccaggtatttcagtaaggatgtttattttcttgtctgtgccattactagaggctttagatttcactagaaatttattgtatggccatggtaagtgattgtatgaccatggtaaatgggcatacatactaggggaatgaattaagaaaagagagctcattgttggtataagtgaattactggggctcttgacaagtagatgtccaaacccaagctatactaaacgtttccataattatgagtattatttttctgcccattatacttttcgtcactaaactccatgagggaagggactattctatcctcaacacgaagcactgtgccttatacttggtaggaaactaataaatatgtgtaaattggattgatagatggcttgtaacaagagttcctaaagagcagagcaaactcaatttgctcaagttgtttgagaattaaaatagggtttaaataacaagacaaagaacattccaagaggatggggaccatagtttttagaactttagatttatttttagctttgatgtaaacctttctgtttgtatctgcaatctgaaaggcaaagagatgatccttttatacaatgtagagttctttataaaacgccctatttgtatgccacttcataatttatatatccctttcacatgatgatagaaataattattccatcatagtttgagagcttactatgtgctgggaactatactttacatacattgcctcattgatttatccgtccaactttatgctgtagtttttatgatccccattttacatggggatactgaagcacaggggtaagtgacttttcca

SEQ ID NO: 134511 - DNA, 1013 bp, Homo sapiens; identical to SEQ ID NO: 134510

SEQ ID NO: 134512 - DNA, 1013 bp, Homo sapiens; identical to SEQ ID NO: 134510

SEQ ID NO: 134513 - DNA, 1013 bp, Homo sapiens; identical to SEQ ID NO: 134510

SEQ ID NO: 134514 - DNA, 1400 bp, Homo sapiens
tctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggagagtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgctt

SEQ ID NO: 134515 - DNA, 2032 bp, Homo sapiens
gcagacacagggataagaacagaggaggcagcagcattgcacagccccaggcacagtggcagttaggatggctggagagtaggatagttctatgggttgcccaaaaaatgtgatgcgcttcatgttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataaataatggctgcttgtttgaccgtgagggaggttggaagactgggccaaacagtggcacgccagcgtcctacttggccgctactgtgtgacagcttctggttcctcatgtttgcaacaaaggaatcaatccgagctgagggggcactgctgcaccaggctgttcccacagcccccttttcaatgctgtccccagccaccctggctagatgccagaagctgcaagtgcctcttaaggacatagactcgaagccacagcaagagctggacaaacagcaggacgaacggtaaactccagccttgcctgtagcttttggctctaacctttagaatacattatgagcaccggccgggcgcggtcgctcacgcctgtaatcccagcactttgggaggccgaga

SEQ ID NO: 134516 - DNA, 1088 bp, Homo sapiens
gtctcaaaaaaaaaaaaaaaaaaaaaaaaaaccacattctaagcacctgtatttggctctcctctgcaaggaatagctgatggctacatgttgacatgaaggactccttttgttgtattcaacataaagcccctttccccaaactcttactctggtttctttattttcctactcttcgactacccccaactctttttctttttctttttcttttctttctttttttcttttttctttttttttcttttttttttttttttgctagagctttattgtggtataatttacttaacaaaatttattcatttcaagagcatgcgaagaccacaagtttctcaggaagcgtcctcccttctacttcctccctcccgcttcagtctccggctgctccatcccatcaccgagccctgggcccctgacccctgaccatcagttttcctagtctttccctcggcccctcctcttcctggtacttcctttccagctgcctttttctctctctccgcatttgtaactcttccagcctttttctccccaggatttccaaccatatcttcctgttctgagcatctgggggtgttctgtggcacctgtcaggggtgatatctttcaacctctaagtggtgagagttctgaatttggaagtgggggcacccctttaaaaatttgatcaaagtctagtaacagtggataacacttgtgaatgtcactgagaatgtgacaggcactccaggctctccatgactatgatacatttatatttatatttatattgatttccattttacatagtaggaaactgcagccccgggaggttagtttttcaatgcatagcttgtaaatggtagtgcttgcatttgaaccccggctcttaactgctcttcccacagaagcacacattggcagcttcacatgcgtgtgaagtcgaaatgggcttgcaccatctccccgcactgtactgtccaggaaagaggctctcagggatcaaagccaaggctgtgataggagcccaagtctaggggaagagtgaggttttggtgggagcaacaaagaactttcttcctttggatgaactttctctgggctct

SEQ ID NO: 134517 - DNA, 1088 bp, Homo sapiens; identical to SEQ ID NO: 134516

SEQ ID NO: 134518 - DNA, 1527 bp, Homo sapiens
aacttagatgatctctcaaaatactaatggaatgcctgttatgtgccaggcatcatgctaggcttgggataaagctgtgactaagacaccctcatcctcatacagcttacattctagaagcagagacaaacaggtgaataatagactggtatattctacaaggcaaaaccaaaaactgggcgcagtaatgagaagaataggggaaccagctgtgcatcaggtggttggacctgggttctttgaggtgactgtaaacagagctgttggataaaaagtactccaacctgctgagagccagggaatcagctttcaagcagagagaatgacagacacaaaggcttgagtcaagaaagagcttggtaccttgtagaatcatcagaggagcatgaaataaagctcgatagagtggcagggccaggtcagccagggcgttatttgttctagaacggatgagaaaccatcgaagggtaagtcagggtacatgctttgttaacaagttattttggcacctgtatagaaaacggaaactaaaaagtggaaaaccagttaggcttttttgtttgttttttgagatggagtttcgctcttgtcagccaggctggagtgcaatggcgcaatctcagctcactgcaacctccgcctcccagggtcaagccattctcctgcctcagcctcctgagtagctgggattacaggcacccgccaccatgcccagctaatttttgtatttttagtagagatgaggtttcaccatgttgaccaagatggtctcgaactcctgacctcaggtgatccacccacctcagcctcccaaagtgctgggattacaggcgtgagccactgtgcccggccccagttaggcttttgcaattacctagatcagagataatgatagctgtgactaggaggacagtggggaagtgacagagatggaacaaagcctaagggcctgtgagaggaagacccaggagtgaatctcaggtttctggcagaagccctgggtgtcggggtatgatgtgatgtcatgagtgaggtgaggatgggagggagaaaggggtggtggtgagggagtcagtctctggcccttctgagttgggtgcttctgaggtgcacatcccactgaaggtgctgtgcaggctgttgggtacctagttgagagctccaaggacaggtctggactgggatagaaatttgcaagacattgtcatgtagatggcacttataaacaaacatgacatcacccaggaagagtccagagtgaagagggctcaagatagcctgaaggactcaatatttggagatcaagtagaataggaaccaacaaaggagactgaagggtggccagaggggaaagacaaaaaccagaagagggttttatcctggaagaacagaggagaacatttcaaaaaggaaggagtatcatttaccaaattcccttggagctaagaaaggtaaggttgagaaaacaaaatggaggttggtgattgcaacacaaaattcctatggagtgatggggaaggaagccag

SEQ ID NO: 134519 - DNA, 1493 bp, Homo sapiens
tagcactttgggagcccgaggaaggtggatcacttgagctcatgagtttgagaccagcctgggcaacatggagagaccttgtccctataaaaaaaaaaaaaaaaaaatatatatatatatatatatatatatatatatatatagtgtgtgtgtgtgtgtatatatatacacacacacacacaaaattagccaggtgtggtggcgtgtgcctgtagtcccagctactggggaggctgaggagggaggatggcttgagtctgggaagtggagattgcagtgagctgagactatgcccctgcattccatccagcctgggtgacacagccagaccctgtctcaaaaataataataatcagtaaacccagtgtggggttattcctttagattactattattttgttcttgaacaattgatttttatttttttagactttttagcctttatataatcattctgtgtactctgccttcataataaaactggaaaaattatgagcaagaaataagaggtactagttctgaggaatagttaagattatcatactgagtccaattgtagcagaattttttgttgcttctttgtatgatacttaaaatagttgaaaatttgattggattaaagagcatattggatcgctggagtatctgatgctagtaacattctgaacattctgcctgttaatgtgcccgtcaaaggaagtaaatattaataaaacttcttcattgagaatataaccggtttggcttttgtaatgccattatattcattatattaattttcatatgctgaaaaatgtcctcatgcggaaatgtggggtacatgacagggaaaagtttctggttttggattacttctgtcaaagctcagtactcgcagtcttgtatttaatcctctccctttgctactttccctaccaggatgttgcttcagagtgtgaagtcaaatgcatgccaacattccagttttttaagaagggacaaaaggtacgtacatctgacctttaaaactctaactgggcaataggaaacccagtataagtgaataaatcactggagtgatgttccctttaaagattgaggcatatcaccaagttctgcttttaagaatttttaaatatgccaaaattcattggcttaagtacataatgtgacagctaactgaaaatcaatctttcctagaactagtcctatttatatcataaagcacatagaatttcttagacttgggcagttcatttgttgttaagtattgtgtaaaagaaaatttgtacttgagccttttgacttttctcttgatattttttctttgtttataacttaaatgaactgtatgttattcagggaagtttactttaaataagattatacttctttttccctccacccctattcttccttcattctatgctgaatacatatttatacatatgtatatatatacatatgtatatgtatatatataaatacatatttatacatattttatgtataaa

SEQ ID NO: 134520 - DNA, 2813 bp, Homo sapiens
ttaagtaacttgtgatgtttcaattgcaaaatcctatgcctttgtgacttcaagtgacccctttcataatccataagtgtttaatgaatgtctaccatatacctagccttgacatggaaacatttttaatacaaatgtctatttttattttccttttgtttggtgtagagaaaaaatagccagttcacaatattttataaaatagttatgaagagaatgtcagtatactctacacatatcttgtttcatcttatcaagtaacactaccaacaatgtatagaatttcttcaaactgagttttatttggcttgtttggggatttttttttttttttttttttttttttggctaaaaagtaggtcctgaaaggaggacctccagaatgtgctttgtgtcattgtgtcgagtctttcttttgaaggtttaatatttaactatttatttaatataagcttttcttttgctgttagactgcttttcaggaagccttggacgctgcaggtgataaacttgtagtagttgacttctcagccacgtggtgtgggccttgcaaaatgatcaagcctttctttcatgtgagtattaaacaatgtctgctttgtaagagatttgtgttttttgagttggtggtcacagtggtaggaaagaaagacagttaaaggattttggtttcggtggggggatttctttggctggatctttggtctaaaagtagtagtataacaaataatttaggtttgatacatgtagcccattgaaaacaaattttagaagttaattttgtcttaaatagttctttttttccccacattgaaacatgggccttatttgaaatcccagcctcagaatttgatatgccaagctgttttatactaagaaaaatttgatttagagaaaatttatgtctcttagatctatgtctccaaagatctaaatttttggatctttaattagtctctacttttattaagtttccatttaagaagcttgggtatgttgattgccattacctagttctaaatctttttggatttttcattttaaattttccagtccctctctgaaaagtattccaacgtgatattccttgaagtagatgtggatgactgtcaggtatgtagctggaaatatgagatactgctgagcttttcacattggcctttttctctgaattgcacagtgcttttttccataaatatgtcaaataattctagaactgtaatcctatctaaaaagttctatctcagaagagcaggcaagttaggagcttaatcctagctatcgggagctgtatatcacatcctaaagtaaacaaaaataaatgagtgagacttctgaatcttatcggccacccacctttctaaaaccctacattctactttacactctgagatgtgcaataaatggagattgaatttagctatgatcattacatccataggcttgatggagtcaccaaattatgagaccgcttgtagggctctttgtgaacttgcagtagcatgagaacctgcatttgcaagcctattctagtcttggttgattttagtcaattagaaaccacaaatgttttaacaaataaacaccaaggtacctgagagaataatttggaagaaattccagggttggttgtatttaacaaatacttgttttgcactaggtatataccaggcactgttctgggtggtttttaagtatcagttcatttaatcctgagtgctgttatcatccccattttatagatgagaaaactgaaacacagaggttgttcatgaagtttcagtgagtatgtggctgaactaggatttaaaatgaagtggtctggcttcccagcccttgaccttaagcactacccatcggaggatgctctgtcttgtgggtgtagatcgggtgcttagcacatgaccacagacctaggagagcgggttgaggaggtatcacttcggggccctttacagatatgtgagcattttcacttagccctagtggagaaggaaaggcgatgggggaagggtgcagtgtggcaacagaggcgctggacctggcttccagtcctggctcactagcatctgcttaggccagtcactcctcttccttgagccttaagacctgccccatcaacctcccaaggttgcttattcattgagcaaacatggaatatccaataaagggtgaagggtcacttaaaacaggcatatggcagtgctctctaaacatgggagggcgcaacaaccccagattgtgtattcttagccagtttttgactctgtgccttgggcaacccctgccttggcttgtgctgtcttctccatctggcctgtcctttcctttcctacctgactaactccttgtcatgagcttcaccccttctccacttaccgccttgtgtgccctaagtacccagtgaatcttggcaattattataatgatctttatgtctgtcctttaccattagtctcagtagattcctaggatcagagaccctgtcttaattcacgttggttgccccttcacctagcacacctgccttgcatgtagtataggtgtggaatgaatgaatgatgaatgtgatatggttgttaagttactattctagatgtgtcccagagttgtttttttttttttaaaaagagtgtaattgcatttttgtgaaaaatccttatcccttgttttaatcaaacttagtcttattaaggtcaatttagctaggggaaaattgcacctggaatagagaaattctaactgccactgatcctatcagatagcaacttgattttttttttttttttttttttttttttttttttgagatg

SEQ ID NO: 134521 - DNA, 1293 bp, Homo sapiens
ggaacaataagtgatgatttggaaaaacaattgctatacttctatgtaccctgctgcagctctccccatgtctccacctctagaggtggggttcagggatttgcataactaaaaaatttatgaaagtgttgtcctacctttctcaggaacaccatttgtgaattattttcccaaaaacgaggtagaaattagaaatctagagaagtaactattagtacatgaggtcatattagtgttttcttgttgggtttttttttgtttatttggttttttatcttatggttttttatttatttgatttctttctttacgagacctcttgtggcggtggggggcggggaatgttcatttttttttaaacctatttgaccagcattgtttccttgaagaaaacctagatttcagatacagatgtttatgttttgatttatcttaattgctctggtttggtttttgggtttggtcagcactaacgtactaatgtggttaaaatgagtcctttgttttgggaggccaaggcgggtggatcacttcaggtcaggagttcaagaccagcctggtcaacatggcgaaactctgtctctactaaaaatacaaaaattagctgggactggtggcagaggcttgtaatcccagctactcaggaggctgaggcaagagaatcacttgaaccccggaggcaaaggttactgtgagccgagatcaggcctttgcactccagcctgggcaacaagtgaaactccgtctcaaaaacaaaacaaaacaaaaatgagtccttggtaactagaatattcggttcccagggttacagtatctagatagtaaataattcagggaagttagtggtaagagatttcttgatcatttctactgagaattttatttaacaagcattccttatgaaaaataatatctatgaaaaatttccttcatgaggaacgaaaactttcatttaatgaatgacaagggtatagttttaaaataaagggcaaaaatcaaaggttggtaaacgtgtgatctcagctctggaaaccccattatgcttatgtcaacggtgatgtctgagtgttgaggtttgggaaaggtgagtttccttgacttttcaaaaaattttagattttcgtatggtccaccatagacaaatgagtttaatcaaaagtcatagcttttttttttttttttttttttgcgacagagtctccgtctattgcccaggatggagtgcagtggcacaattttggctcactgcaacctccgcctcctgagttcaagctattctcctgcctcagcctc

SEQ ID NO: 134522 - DNA, 2247 bp, Homo sapiens
ggaggcaaggacgtacacaccgagatacttcccggtcaccgttactcagcactttgtggggttcacgtggctgggggggccggggcgtggcggcccttttcgaggaatccagccctgcctgggcggtccccatctcgagcgtgggcgtgttcgattcaggcccggcggacgcatccccaggtgacccgggagggaccttgtgtctctgggggtgactgtccgtctccccgcctcccaccgtcacgcgcagtgctgatccccacttccagctggagtgcgagctgggcttggggttacaggagccgaagccctggagctccgccccacgcttgcgccagccccgccccgatcccggctcgcaggctccaggggcggggcgtggccggggcgcagcgacgggcgcggaggtccggccgggcgcgcgcgcccccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaaggtacgcgctaccggggaaggccagggtgccggcgccgcgcgcggcctctgtaactggggaaggcggtggcgggaggtggggaaggcggtggcgggaggtgcggaggccgcccctccgcatcgccaggggaaagggacgcggcgtctcggcctgggactgcgggaagcagcggcctgggcgcgcccgaggcggtggagcctgccctggaggaagggaggagaaggacgagggtcccctggagggcggagtggcggtgcccagcgtttctcgcaccctgttcctcgggggattgcacgcacgcggggagcgtccgggggatgtgagagcgcagacagcgtgaggagtccccacgctgcgcctcctgcaccctcccgtccgggcagccccgactggaggaagatgagggaatggaaggggtccgcccttggccccccatctgtatccagattcaggccccaggcaaggatagggagggcccttgcagaaggcacgggtcggtggccgccgctgcctttccgtatgtgaagtgatccacccgcagcgggggtagtgatctccctttgggagcgggtctaggccggagacccccgcctgcctccacccatgcccgaccccaaaggtgacgcgtgctgtatccgcactaagggggcggattgcggctggagaccccctggcacgtgcaggtctgtccaggaggcccgagggccccaggtgaccgcgaggaagtgaggtccgggccgcgcccacgggactcctgtggcgcagggcgcgtttccggcagcagtggctttggaatgactgagtccccaaggttgggcccgggggcctcggctgccctgcccgtccatgattcaccctcagtcggtgggttttgctggagccagggttcctcctgggagcagccgcgccctgctgcctgctcgccgacctatcggtatcccgatcgttgttttgtcctcttaaaaatgcccaaggcgaaacagccttcccatgtttgaaagttattgcaagcctaaaaccttgtagactgggaaacccagagcctaacgcgcagtgtctagtccaatgtagccactccagaaatatttgttaaatgcagcgtcagaaaagtgagtggaggaaattgatactgctcgaacggtagaagacccctcgccagcgcctaccctgcgattacccctccctacctgcgggaagcagaggagggcgggtcctcgcccgcctcgggtgccctgacctgtttggtgccgggtgggcttcggaaacagaagtgtgtctgcaatgtgtccccgatccttttgttcctttgattattattgactctcagtgttttttcctcatatgttgattgccactgtcatcttttatcttcctctcaatcagttttttcttagtgggattctcattttagcagccctcatgtgttgaaaagatccttagtagtgaattgtctttcatatactttttttccaagcacctattgtgtgacaaattattaatccattcctggggaagggagtggggctgggattctgttctccagggtctggcaacctcagtataacccaactgctaagaaccccctccactgagccagaagacctttgagtggtctatgttagttgtcccaaaatccagacactacaaacaaagttgattagga

SEQ ID NO: 134523 - DNA, 1096 bp, Homo sapiens
agctactgtgagaggaattcagagagagtctgacctgccttgattagttcaaggcttagcctgcctttaccagagggagttagattcatctttcacccccaaccctcacccccaatacacacacagggacttcatggacttgcatatcagctttggaggcatttgggactggccagttgccccaacagcttgagatatgactggatataatgtaacagggatagaggggtgtggttagaacgtgtcacaaaaatgtataaggaaggtcacgttcagaggcagagaaatgctgctatttgtgtgagtgctgggcctcccaaatggaatgatcacagacaaagtctttcaatgactgacttttctgagcagaaacatctcattacctttgaccaacaggaaaagtgattaggactcatatctatgctaattcttaatacttttgggaagatccaccttgtttacactgtcagagctctcctctgaggggctaatgaatgaaacttggaggctagaaagcagccagataaaattcatgtggtgccagtttatagtcagaaattatcaaacccatccagaactttactgctactctgaggaccctctaagtctgtctactggtgaagaagaatagaattaaggaggaaaagcagtcaacatgaaaagctctctggacataggatttcgttccagaatgaagttcagaacttaatgctgggacacagcgtgcaggctcccctccactccttcaagacagagcccctgaaagaaccgtgtatggcagccaggctctgactcagaactgcacttctgattactcacgaggaggttctgcccacccaggtactcattccccctacttgtcacataccttgcggtgaggtgaagactcattcctctgtttaggttgaggggatgagggacatctagtggcagtctgcaaccaggaggactcttaccaggaaacatcacttccgtgccaaatatccggaatggagctatgaagtcagggccgattaaatacggaattgactgcgtttgcttcctaggattttgcctgtcccttagtctcagtcaagtttgataagaaggggctgtg

SEQ ID NO: 134524 - DNA, 1029 bp, Homo sapiens
cttggtagccacacctgcaatgtaaaatggaagaaaatgcaaagaaaccaaatgtgccgagtgaataaaggattgtcatatcaattagtgtgggtccatctgtagcaaatgggttgagtgtgtcagtatgtggttggttactgtgtattcgccaggaatcaccccgataggctgccaccctattaggtgatacctgtttaatatgttgtccaggtagactagtagttgcatcagtttgctgtaacaagtaaccagtgaggtaacacagtggtgaagcaggtcaggggaggtcaggaggatgtctgagagaaagaagtccgggagatgaatggctgtctaggaaggaggatgtcagtgcacggttagtgtttgagcagagggcagacttgtaaagtacctgtagtgaaaagaatgtggggacccgattagcagaaaggtgtttgcacgtactttatacaaaatacagaatactttatattggaagtgaaagaaatgaacgtggacttttacacatgtgcatatttttctggaggctatatggattatttgaaatgaaaagcatactaattggactttaataaatcattttcaatcagcgtttggtaatgtgtggttctggtcagtgctatttctcttgttcgagagtcttccagcttgcattgcgtgggtgtttttcccactatgacctcctttatttctctgtaacaagggctgcttaaccctgaggcggagcaaccgtgtgctcccccagcccacaactgctttttttcaatctgagtaataaatcttgccaatgtctgggaggtggtagtttatgttccttgagaggagacaatttattaagatggtactttagctcaacaggataaccgttagagtgggtttctttttgaaagactgattttacaaaaaattttgacaactttatgaaacactctcactagtttataaagtcacggtggtatttctacttataggtttaataaccaacaagataaaagttatatatatatcttccaatgatataac

SEQ ID NO: 134525 - DNA, 1672 bp, Homo sapiens
ggaaagaaagtagtttgcctaagttcacccagtttattacatgtcaaacaaagatttgggcccagacaacctgaatccagaaactatgccttaattaaacattaaaggacacttatcattcgtgcttatcttttgcctgaaaataacactgctattaaaaaccatgttgttatgtgaggtgaagtgtttcctgaatgcagtttttcatatctcaattgcttatcaaactctttgtgttttgctcaaaataataatcatcaatgtctcataattgcttgattttagtaacgtccaaaataaaattttaagttgactatcgttaaattttttctgattttctcaggaaatgagtatttcatttgcgacaatggtggcttccaacttcagtatttttatattgaactgaaatcatttcactttatggtcgcatgttttataatattttttcattctctttttaaaaatccttctgatccctatccttgtccttgtaggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaa

SEQ ID NO: 134526 - DNA, 1717 bp, Homo sapiens
agaagataaaggagaggaatccaggttcctcaatgaagcatccatacatagaagctcctgtgtcaggctgtggtgtttcccacttcctgccttcagtctagcagggttccttgcatttcttggtctaaaagtaaggcttatgggctctttctggaaagatcttacaccttttaaattttaacatgggaagaaattataaacaacaaatgacagtgtttgaattctctcacttttgagcaaagtcaagcagcttaagtatgagagaataaagatattcccttctgttgcccagaaggagaaaaagatcattttatttaaaatctagctattgagatgcatgttccttgtgtctaatcaagttctgaatttgaactcaattagagctttgataaaaggaaggggaaaggaaacttgaaagaatgctgttccattcatgaagggactgtgtgtttttagtttccaagtaaatggcataatgggaccatgcattttccatccaagcattttccatcctgagaataattcccttcctggcttctcaatgaataatgcattatttctgaaacccaagaggcattcctttgattttcctttatgtttagctttctgagtgattttcaagcaaggaaattcaaggacttggaatgaatgctttattaacatttttattgaagttcaaattgctccttggctattatctcctgatatttgaaatatttttttctctccaaggaaagtctaaggtgttgtatttattagaaaatgaagtaccttggccaatcttcaaagtgaacagcagtttaaaaccaatacacatttgtgttgtagaacaaagagctttatgggggtacttttctcctttattttcatttccctgctgaaaagtttcacaaaagaaagctcagattcaaaagtgggctgtttggagactaaatctcatttgtttacattttgtgaaactaattccttgaggctggaccaaatccatgaccccagtccaagcctgcatccaccaaagccagcgccatttaaatctgaagatgcaaatgcccttctggggttgctcctacttccgctctgcctgattacacatatgtagcctgcctgattacacatatggggcccattaggtgaggtgtaatgggacacagtggtgcccaccgctgttggctcatgttctttcagtagaagatccccagcagagtctggagtaacacagtggtaggatttaatgctattttacaacctccattttcctgggatccaaatgatgagtgatttcagaaactaaatgaaatagaattaagcatctcatctatattttcattcctcttacagttatagtaaaattgtaatgattcagaataattgggggaagaaagagaacaaagttgatctaaattagtagaacatctgaaatagtaaatttggtttaaaatatttaatgttatcattttcaagatatagaaatgtaatattttctagagcttgaactctggaggcagcctctaagaacagaaactctgggatttttctgctttccagtactgtggccttgagccagttatataaactttctgggtctcagttccttcatctgtacaatggggatattagtttctatgtcatatggctactgtgaaaattcaataaattattactggtaaagcatataggacagcactatgtgggtagttgttgaataaaaataaaacat

SEQ ID NO: 134527 - DNA, 1131 bp, Homo sapiens
gtgatatctgtgatctcccaaagttaatgaaagacattgtgacagtttcaggtaggagaggatgagaaaaatatttggttaatggcctaggttggtagctagctagccagatccttgttctttctttcacttattttttttattcattcaacaaatgtttatagagcacttactatgtgccaaaaattttgttaggtaataatagacacagtggagtaaaaatagtctgatgacagaagtaaacaataatcacattataaataaaaataaattacacctgtgataacttctaccatggagtgttttatagtgctgagagcatattacaaagggatttttgacttaatcagggaaggcatcccagaagtagcggtaagtaaagtgtgagtaggaattagattgcgaggagagcaggtaacatcccaggaagagagagcaaacacgtacaaaggcccatggttagggggattgtgatagactgaaaggaatggaaaaactaatatgtccagaaagcagacatgcagtgcaagacaaagcttggcgagtaagtaaggactcgtactatgcaggtgttttacacaaaaagaatgggaatcatacatcagacttctcacctgcaagactaaatactagaagacagtgttctgagagaaaatgattttaagcttatgcaaactttctagaaagaatgctcatggatacactctagaaaatgggggtgggggagggagaagaaaagagattccaaaaaaaagatgtacgttagaagaaacaatgtgccacctaggtatgtaaaataagcagccctcagtggaagctgagaagcaggcctagaaatcaatgggttcgattgggttagtaagtcagcgggctgcaggaaatgtctttggggataaattgtataattaaaaagttggaaatacatctgtggcatgcttctgctgtaataaactgtgtgtttcttatctgtaacaaaagagagaataaaaagaaaaagcagttagaagttcaagggaaaacaaaaatctgttcaaaagtcatggtgttgaatctgttttttagtaagagaattaagggcatcacatttatgatatctagtcacatgtttgggcttattcttgacattctatt

SEQ ID NO: 134528 - DNA, 1040 bp, Homo sapiens
tacttttatttatattgagtcatttgatatgcagaatcccaaatagatattgaggacttttgggattatacctctatttatttactatgtctttgagtatacctctttgaatagttttccttttggttgctatctcattacaatacacatgtgacttatcacagtctactgatatcaacattttaccactttgagtgacacatgggggccttatttccatttaaatgcttttacctttcccacttttaaatattattgtcttgagtatcagatggtgttataatgtttaagtcatctaatatatcttatgaaactcatgaggaggatcatctatcgtatgtagccatatttcagcttgttttgttgttttatttcctaatgctccatgattccatcttccatcattttctttctgttcaaaaaacttattttagccatttttaaaaggtctgccagcaacacagtccttttgtttctttcatctgtttctatattcccttcattcttgaagtatagttttcctggatatagaatttgaagatgacaattctttgttttcagcacttggaaaatgcaccttttccttctggcctatatggtttcaggtaagaaatttgctgttattggagttgatgttccctaataggtaatgtgttgttgctctctcagtgctttcaagacttttttttttttttttttttttgcaattcacttatcaaaattttaattatgaaatgtcctggtatggatttctttgggtttatcctgtttgagatttatacagcttatgaatctgtagatttatatttttttgccaaatttagaaaattttaagccattattttaaaaacaatttttcaagcccactctctttttctccctctattctggacctttgatgatgtgaatcttgaacattttgttattgtgctacaagtccttgagggtctgttttttgtcggtttttagtctattttcttcttgttcatagtgagtaaatttggtaattctgttgatctgttctcaggttcactgattct

SEQ ID NO: 134529 - DNA, 1062 bp, Homo sapiens
gctcctataattcccatgtgttgtgggagggacctggtgggagttaattgaatcatgggggtgggtctttcccgtgctgttctggtggtagtgaataagtctcatgagacctgatggttttacagggggaaacccctttcacttggctctcattctccctcttgcttgccgccatgtaagatgtaccttttgccttccaccatgattgtgaggcctccccagccatgtggaactgtgagttcattaaacctctttttctttataaattatccagtctcaggtatgtctttattagcagtatgaaaacagattaacacaaagacatttgtgtacacagtgataaaatggtttaaaagttagggagacagctacataagacaaagggaaacaggattagaatcaggcaaaggagtttgtaagttcttgggtgtggagcttgctttctcctgggaagagttgccttttgagatgctgtcatcctttgaggacaggaaccaaaggaaaaaagcaatgagggaacttctttttgtcccaaatcgcctgccaaaaataagtcagtgatgcttgtcaagcttggacgtgtcttgttcatacagtctggtaatagccagctttcttgtggaaaaatatagcaggcacccattgaacttcttagatgttctctcctctttgagcatgtaacctttcatctacattctacaaaatagccactttgatcttcctactcaacaatttaaatggatccccactgcctaagaaggaaagcagaaatctcttaccctaatgttctcgtccttccaaaatcacattgcagcctgtcctttagtcttattttccataactccacttcacttggtttgttccattcagaatgtgctttttgtttgtgggcatacttaattaggcttatctgctggtctactctgattattacatagttttgtaatatctaaagctaaaaatggatatatatatatatacttattaaaatgaacttgatacacatgtgtgtgtacatatacatatatatataaatacctttcatcaatacttttgcaaaac

SEQ ID NO: 134530 - DNA, 1059 bp, Homo sapiens
tgacccagggtaatctcccttttgagcaatttattgtcaatttaattacatatgcaaaaccccttcacttttgctatttgacagaacctaatcaagggagtggcatcctataactgtattctatggctagaagcaagttacaggttctgctcacacaccaggggaagggggactacacaagagtgtgactcattttggaacatcttagggtgtgtccaccatagatgtaccattttgagtacagatggaaaaaaaaaaaccagcttttcaaaaatgctgttttaaaggaattgatgttgttaggttgaaggctaaaggatggaatgttatgtatttaaatgtatacttagtttttaaaaagtttttgccaggaatattagtcatctgttaaagaatgtatcatctagtactttctttttgaagttttctttaattttggctacagagacattactcttctctgagtctcatatctctttacctgttccttcacttccccttccttcatcccttctgtttgtttttgaaatgctgcatctctaacctgacagttccttctgtccactcacctcaaggatggctagaaatcttatatccagaccgcttacttcctgaacacagtggcatggaaacacataatcatgatgtaatcatgagcctgtacataagccagctactctgttgggttcaggttgtaacctgagtgtctgcagaatggcctgtgggtgagagaccttagattgtttcaatctcactgttaaaatataaatgaaaatttattttctttttggtataggaaacatgctggtttcattcatgttgggtggttcttatgtccaatagcagtcttacataaacagtcttacagaagtgtacagagtatgtgcctgtttatttatacttaatcttttatttaaaaaaggatttggctggtgcagtggctcacacctataattctagcactttgggaggccaaagtggatggattgcttgagcttaggagttcgagaccagcctgatgacatggaaaaaccccatctctacaaaaaaacaaacaaa

SEQ ID NO: 134531 - DNA, 1367 bp, Homo sapiens
gaggatcagaagggaaaaggaaaggaaaggagagttaggggaaaaaaaacacaaaaccactcggacaaaattcttggctcttgaagagctatgaaagaaaatagattgtttcacactaaatagactttcctctcaaaatatttgaaacatccacactaattagttttatcaccctaggaaaatttgtcacctgtaaattaatgtctgaaaatcacctgatctactaaaaggtatcttgagaaattatggggtatctaagaatgtttcaagtaggcatatgattttatattatcctgaggagaaaccatttgtttcccccaagaatgaggatggagcaacaatgtatatttatttttgcattaacctaatacaattgtatgtgtctgcatggaaacttttgtagaaaaagggtaaatcaatcatttgcttgttcataggctttaatttcttcctgagtcagcatggtataatctgaagagcttgggagtcggactcacatgtccttgtgtgcaaaaacccagttctgggctgggcgtggtggctcacgcctgtaatcccagcactttgggaggcctaggcgggcggatcacgaggtcaggagatcgagaccatcctggctaacatggtgaaaccccatctctactaaaaatacaaaaaattagccgggcgcagtggcaggcgcctgtagtccaagctactcaggagactgaggcaggagaatggcgcgaacccgggaggcagagcttgcagtgagccgagatcgcaccactgcactccagcctgggtgacagagcgagagtccaactcaaaaaaacaaaaaacaaaaaaaaaccagttctgatgacatgttaattgtgtgacctagagcagtatatttgacccttctgagcttctattcccatctataactgggtagagtactgtctcccaaatgaggagattgttgagaaaattagatttgttcaagtgcttagcatgctgcctggcacatgctgcggtgaatgtaatgttctcatactttacctgtggctcacatacatgaaagggccacctgtggcctgctgtgattagtggttggagctgccttcccaggatgggcattccttgaagttatctagcttcttttataggcctgtataatgatgagtggcattttcccattctctgcctgtacaaggtgatctgaaggttctatatggggattccactcgttagtttgtatatttatccagaaattcatcctctagtcattcattcaatcaatgatgtagaatcccagcaggattctataaactgtcatctatcaggattatgagactatcaggaatatgatgttcatacaatcttccaaagccaggcttgaattg

SEQ ID NO: 134532 - DNA, 1014 bp, Homo sapiens
caatttttttcttctgttggtacctttgatattgtttttctttgaggcctaactagagcctgtgcctctgagaagctactttctgttcatgtattttagtgaagatgatagtgtctagactgaatgtggtcatggctttacttaaaccctggcagggctcctgcacccatagaggagttattataatgatccaaagcaaatatgaggttctaatagggtgacacagcaataacagggtctttttgaagaaatgggatttaatctggcattgggagactggaaattcatggcttcacttatttattctgcccaagtagacttttgttgacacaaagaacactgcattttaagttgggttttccatgagttcattctaaacaggtatttctgtgcttcaaaaagcttctcatatttatattgcaggcatgaactcattcactcaagttattttcctttctcttgggagagagaaggtagccacttaggagcctagccttaaagaacatgcagaaaagatggatgaagtgaacagtccagaaggttttgctgtagccagcaagtgattcaccattttatgctgaagggattgggtttgctaaccttgccaagcacgtggtactcctttgtatattggtccagtctgagaggaaaggccaagctataaattgaggagctggaatcagtgagtttctgaactaaagcaaaagaggctctatttagacattctttaaaaggtgtgtgtgtgtatatgtatgtgtgcgtgtgtataaaacgatcagacggtagagattagagcactggctttgtttaatttggcaaattctaatgttctagaagaaaagtgaagatgttttaattaaaaacactatttctaaggcaccatacatatattctagagtaccagtagatgagaactacttatttagagtggcagagcatgctatagaaacaaaatatgagtaattctaactgtagttatgttatattagcgtagtgagatagtaacattaatag

SEQ ID NO: 134533 - DNA, 1957 bp, Homo sapiens
atcatcaggcattagttagattctcataagaagcacgcaatctagatccctcacatctgcagatcacaatagggttcacactcctatgagaatctaatgccgccactgatctggcaggaggcagagctcaagcagtaatgcttgcgcatctgctgctcacctcctgctgtgcagcccgattcttaacaggctatggactgttactggtccatggcctggggatttcgaacccctgatctaaggcaccattctgttattctgtttccttttgatcagcagtgaagggccatgtctggcatgtatggaagaaatgacgaatggctgggttcatgagacctgattgctgttctctagccggtcctagcttcacagtttgaccacctgtgaatcctttagtctgggattcatcgtcatttacttacaaagaaaatgctatttattaataactcctaatctctcactgctacctcatgaatctctgtgaagaatcatcatggctgttctatgatgccagggctttatcttacttcccagcacctagaataggtcctggcactctagatatttgctgaatgactacatgaaatatacctcttgttctggattgggagttttacaggttgcctagttacaatagtaatatacccaggtagccaaaaattcaatgcgatttgatagtggatctcattcaaagggatatttgccataaggtcgttataattaagcagctacaactcctgcctctcaggactttttttaaggctaagttccagtgaaaacttcccgcattgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagaaataatgccacatatctacaaccatctgatctttgacaaacctgacaaaaacaagaaatggggaaacaattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaagagcttctgcacagcaaaagaaactaccatcagaattttttttgcaaacttgttaataatagtttattttgtcagcaaacatgcattgaagtcttctagactctctgttaatgagtatgactgcaaagatcaacaaaaatatgtatcctgctttcaagaagctctcactgtagcagataatgacagataatttaaataagtgcaatataacatggtaaataaacacaatataatatgacaaaacaggcaaagtgctatgtgaatgctgtatttcaccgggcaatgtctggaaaagacttcaagatgaaattgatgttggaatttcatcttagatgatgtatagaagtttgctaagtaagcctaggcaaaggaattatttctattagatattctttataccctgaattgaatgaaatattcaattacttttcttgtattgtaattagtatttcacttagctatgacaatagccgttgttaggcatgtacatcttgtataaatccttagagtggaaagggaagcttccagaattgtcagacaatatttacttagaactttctggctgcattttgcactggcataatattcacctttttttttgtttttgtgacggaatttcgctcttgttgcccaggctggagtgcagtggcgtgatctcggttcaccgcaacatctgcctcccgggttcaag

SEQ ID NO: 134534 - DNA, 1255 bp, Homo sapiens
ctagccaggattaggtgtaaacattgtggctgtgaaggtaactggttctcaaaggaagagtttccttgaataggtcttcttataaccaattggtaatctccctccctaattaaaccttgaaaaaagttatctgaaactgaatcgcttgtacattattagcatcacatatagtagcttttcacatatattagcatcctgttagctttcttgacaacagcattatgttactatttttcattccacttggtttttatattaagtttgtgctctctctctcctctcctctctctctcactctctgtgtgtgtgtgtgtgtgtgtgtttgtgtgtgtgttcagttatattcactgagtcagggcacctctggaatctactctttgacaagaactatctggatgattctgggcaagttactttccctgtgttaattttttccgtatgataaggtgaccaatttgatttccaagattacttaggattctatttattctgtaaataaaattataaggacagtaactactgtggatcaaccatgtagagctttctagaggaaaacttgaaaggggactgggacaaaaataagggactatgattcttctttgtatgaacggtgcattccaccttcttttttattttttaaggctagtcaagtagaacagtgggagtggagaaagaacaaagaaatctgtaattggttataatcaattagttgtacacgtccctgcactcagaccagccattaccttctctcataataagcttttagatgcactatcccccattaaagggagtggcgagtgtataaaggatcctctcaaagagatgaatctgggggctttactttcctgtgggagagccatgtggcaggaagggaagacttcccaattggtcctgttgctaggggcagggaatggacacagagtctcttattccctggccacaggtgaccggctacacattctgttactctgaaggggaactaaagctaccccatgtctcctcaggtcccagtggcatccctgtaaaggcctctttgaggaagaacctgagcgaatatccatgagagcctcgattgtttggccagccattaggctgcttggcaccatgggtggtggccaggagacagtccttgcaaaagtcccacagtgcttcccagaccccacatcctgggcttgggtcaaaacagaaaacaactttcaaacaccagctctttatacccttttgttgcccatctccattcaaatattttttctca

SEQ ID NO: 134535 - DNA, 1008 bp, Homo sapiens
ggggtggggagttcctgaaaccatgtaaggttaacttccaagtcattgccattgcatttgtaaaccgtcatggtgctggtaggaatgtctaatgcaaatgtattatgattcctggtccttgctggtttggattggtttctttgctacatcctgttttgatcagcagcgttgtgaaaacaagtcctgctggtctcccacttcagtaggaacaagaattctggtctactcgaagttcttctctttgtaaattagtccattgataatctggttattttactttagtttgtgtacatttggtttttagtatttgtcttcactgccagattgccaggtttgtgagggcaggcaggattgtaatgattgtttgttttctccacgttgccacattgcctgtcacggctatctggtacaaagtaggtagtcaataaatgctgagggaatgcatgtgatgacaaaaccaagtttctctgccttcaaaactgaagaccagagccgtagtgaattcactacagtaaatgccactttattcagctatgtgggagccaaacctagcgacacctttatgttctatgccttctaaaatacaacagcctggaaaactcctggctacaatgggtgctcagtaaataatatgtttgttttacttccatttattctgggaatgattactcagtttccattttcacttcatcaaaatgatccctgggttttagacctattcagtcttcatgatcaaaagaagaatttgttggtcagcaactgacttgttatgagtcaagttatattaaaataaagtcatctttgagattaataatgggcaataccaatggctggtttttaagcatgatcttgtattaagctgcttttgagtgagtactggatcttaataattatttttagttgtgaaatacttatttggcataaatcatgtgctaccttagaaattagtatttgtaaattacaaccctatggcgtataggtactgttattgatttgttatccttattt

SEQ ID NO: 134536 - DNA, 1049 bp, Homo sapiens
cacctactatgttctacgctctgtgctggctccatgaaaaggacagatacagacatttcctttggagctgagagtagagtgagagttttttaaaataattacccaatggaattatacattctccatagactatattcaggttaacgtttgatcacattaaaaaatcttttttgaaaaccttttatcatttcatctttccctatggaaattgaaaaaaaacattttatcacctcctctttccccacagaaattcaatggaaagttcctataattctctgtgctccaatttatatagcatttttgggtgaatgtaacatgggattatgtggctcctctgaaactctgggaattaccttaattttagccactggaaggagacagggtcctgctgatcattatataaagtagtattcagattgatgcataggtctcgtctgttttggttaggatgactgcatcatggacatcattttcagctatactcattgttgaccctcttgtagacctgtgagaatagcaactaagccttgggatcactgacacacctaaaaccctgcctaactaactgaaacactgaggaccccatcacctcagatatgagattgtcttattgcatccaatgaagattagtagaactacaaaaatggtttctctgtatgtttattaacaggaccttaagcacacctgtgccacaaggccacattttccatgatgtggataaaacacatctttgtttaccatggatgctatttttgtatgaaataaaacatgagacattaaataacatgagacttttttcctgtattgactcaaatatttatttgctgatgacctaaatgttggttgacattttttatatgcatgaactttttctattacgacaagtgctactcatagtttgcagaattgccagcagcaaatgactactgaacttggactattaacctgccaagttcttgttttaattttgacctttgtataatatcttgtgtattccagtgtgcaatgtactgaatgattcacatacttttgtgcctctttgggttgtt

SEQ ID NO: 134537 - DNA, 2102 bp, Homo sapiens
tttaggggtcccaggtaaacttagagcttcaagaagaatgacttactctatgtgatgtatacttttctaatttctagtttgttacttattttctaattttgtttaaatatattattatatataattacatattataattatatataattatatattatatattatgatagataaataaacatatattattctgttttaaactgtctcaatcctttttaaagtgattattataaatattgtaaataataagcaaatatattcttatcaatgatgttgaagaataagtaaacatgttataaagcattttcactccacactttaaaaaatatgctgcatctaatctaagtatattttacttgtagaacattgtcaaagggtcacctactctttggaggttacgttgggtcctccaaaaagaaaaaaaattctcaaatgtcatagattggttgacaagtcctattctgaacttaaggagttgtgggggtaggcagtgctgaccacaggaatgttgagcagcaaatgctggctttgggcaaaaaacctttgatgcacagtgacttgtttgaaatgtttggaatgatggtccttgtgggaacctgcattacaaaatgtctgtcccacatggaacatactgtgtgagaatagaaatgcagaataatagggcaatgataccctatctagaaaccaactgtgtttacagattccctaaataacaggtcaaatagattttactatggtaaatattccaattgcaatgttctgcaaaatttttgtctgtctcatgtattttaagcaagatttcttggccatgtggcttttgtagtagacttcaatgacataaaaccactaagcagagaccttgtcatttatttaactccaactgcctttaatcttaaggacagtaatattgtgagaaaccttggagtttcaacataatcacaagatggtatgcaggatcaaatgttcaaattatttgcttttgtttttctgttgcatgtactataaaagtcttgtgttatctatataagctttaaatttggacctgtgccttctttttcatcatcttttctcctttttcttttagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggtaagttctgtcttgactgtaacttactttatagattctcagtgactaacataaaccacattattttatgtcagaggtaaccaacagtatgaatattcaccaggtaattcaccaggaattacaaggggatgaggcacctttatattaaatgtcagcttatgagtcttcctaaaattatagaattagcgttagggaaacatgggtcccagtggtgcagtataaatgatgatgatgtaaaagatgtcattgaagagtttggctatctaatat

SEQ ID NO: 134538 - DNA, 1054 bp, Homo sapiens
aggagcatggggatatcaccaactcaggaccttggtttgtgttaatttcttctcctgagggttctcagacttgacaggtagtctaagttcaaatcccagccttgtgtgatttatgggactagagtcatgatttcttaagggactctttatttattttccaatctggagcctgagcttgacaaaacttccttgttcttcccagtgcaagtagggatatctttttttttttttttcttgatctacacacttaccaatacgaagatcttagagactgctagcttggtgggtgggtctcaattccaactcactgcctcagtcaagcccaagggctcatcttctgtttcccaatagtattaaagccctgtcctcatgatctctgacaatctgctgcctggacagcctttcaccttggtttaagttccctcttagcttagcagtgcatctaaggactatttattatactttatccagcacatcttagtgtttttagtgaatttttccattccttcctcttaggactgacacagaattctctttggaaatttgacaagtatgatgatgtgtaccttttctcagcatggtagacaatgggctataatagataaaaagtacttttattaacttacaatttatgtgttgcacagtttctttttgcatatgtgtatatcacattgatatacattattattttataagaagtagcattttatgtactttttcagataaacctcctaaaatttactagttgcatattcttcagcgattttaagtattctagtttaaaatcatttttagtggatatcagtattgttttgtggcccattttctagttattgtgacaaaacatctcactttttaaaatgtccaatttgaagctctaagaagggtgaggacttttttcttgttaatagagacttaatggaatttaattaaattctatgctgtctcttttctaatcttttttggagaaagaaaataggcctgattattttgaatttaagaataagaatttaaaaagtcttagaggtcatccttaccttaatttacaaatgag

SEQ ID NO: 134539 - DNA, 1023 bp, Homo sapiens
tttgtatagtatcagccttttgatagatacctgacgtatgttagttctttcccttttccccatgattagtctggaagttcttttttttttaaattttattattattacactttaagttttagggtacatgtgcacaatgtgcaggtttgttacatatgtatacatgtgccatgttggtgttctgcacccattaactcgtcatttaacattaggtaaattctggaagttctttacagggagaaagaggtaaccactacatatggtctgtgtatgtggtatgccagaagacccatcaaaggaaggccacgttggataaacactctatggaaaactccaacgtattgccaggaataaatgcatgtggagataaacattgagacttctgacttcatcttgaaccatgtttctattagaagttaaatttgttcccatattgcaatttaaattcatcttgtgcctccttttgtgtttataaactcagataaggtttgagaagagatattattttggaatctgaaagcccattttgaattttctattcataagatgaaattgtacaggggtacctagggtaaaccacataagacacctttcatgtttgtttatttttctttctaatacatcctttttaattggtttagtcttcaatggttaatggagctactcctttatctttcaaagtgggtctggctttttcccacttcttgcccattagggaactgtttgcccaatctcgttttcatacccctagattctccagctgtctttctttgaacttttgttgcagctttgctgtgaatacacactaaggtgggacagtggcctgctgtttttttccacctgagaaaatcatagagtccaggggatttctgtcttttaagatctgtaccttgccttaataagactgtcatttaaaaaaaatcaacctttccctgctgtgtgaaaatattaatactgccatttggtaattgcataacatcacttaagagctgcccttaagttaaacttatcccatttcataca

SEQ ID NO: 134540 - DNA, 1070 bp, Homo sapiens
agcttgaaatcagccacatggaatagttatactgcagaaatcggcaagtgctagaattagcataaatgggttaggttataaagttggagattttacagggtctttcaaaccgtattaatgaatttaacattgatcttaaaagaagtctttgttagcttaatggtcccagcctttgaaatagacctgggttcaagttctgactttcgataatagttttattgagcaagtttattaattaaccttaaccagggtagttgcattattctcaccgtattttgggaatagtggcagcctctgatggttggggaactaagcccacggggaaggagtcagctatacactgggacattaggtcatagagatagatagcttcttctggagagatgcagaccattgggtcacttggttcccaggatcctttggccaatgatgggcctcctaattatatgtcaattcctcacatgtaatttgtacagtgaaatttagtccaaggctgacttgcccttgccccgaagcttctactgatgtcttctctcttattatcagttttgcccaagttcaaagaaggtaaaaataatttagatatagcatcttcttaggcaagcataataagcagctcactcagtcaccttagcctggtattgtctggcacatcaacttgctttcttttccagtgaattcagggaccttgtaaagataaatccacattcaagtgtgaaaggcctgaaaatccttttctaaggccaaaacaacaattttttagaaaaacttttggttttgtttgttactctattcattgggtaacaaagagcatttttctaatcaaggctgcctaatactacatataaacgaattaatatgaacaaatagcttgtgattgtttcaaacaataatagggaagaaagcttgcattgtcacgcctgctgggattgctgtttagttagttgaaagatatgccttgttttttgaagtggggcaagtttgtattctctgctttacccctgccttgactctgagacagatttttgttttctcatgctgagagagcacctagctcttacaaagctagg

SEQ ID NO: 134541 - DNA, 1258 bp, Homo sapiens
tccctgtaatttcacagccccaggtaagggcttcaaactagcagaggtctgaggtaatcgtaagtttgtcaaatatttaaactgggtttcaggaagtgtatttgactctagggatcatgtatatctctctcgctatcatttggtgtgtattcgaataatggtgcttttgtgagtgaggtgccatttcgttcaggaagcagctggaacaatgaacaagtgattttagtgaactggcctctgttcataggaggccttggttttcagtgcttaggatgtctgacattataggcatcaaactctaaatcaaagtaagtcagtagtaaaccctgctgcttttcctctcttggcttttttgtgggccggggggtggggtggggtttaatgaaatatatcagaatggatctaattttataacaagttttctgagggctgtcttgttgtcctcctcctatacttactcttttgccttgatctgttctaggaactttgaaacaaaatgcaattccagaaacttctgagcagcaatcgtatgagttatttttttctgtccagtgaagagcagtaatacggcagggacatggtctttgttcagatgattttacagcctgatttaatcaggcattggctggactctttcagattcaccaggcagcagggtacaatgtggaaacagactttggagtcataaggccacagttcacatccctgctcctctgattgcaggataaagagccctagtcatgctagcttctctcagcttcagtttcctctcatgtaatcattcctcacatgatggttatatggataaaatgatggttcatatacatgaggcatacagaggtgctcagcaagtgtagtttcccatttactcttcatttatcttctttctatagtgtgacctcctttcttatttgtgacaatcattttttggccaactttatttttatttatttatttttttgagagagagccttgctctgttgcccaggctggagtgtagtggcatgatcttggttcactgcaatctccacctcctgggttcaagcgattctcctgtctcagcttcctgagtagctgagattacaggcgcccgccaccacgcccagctaatttttgtattttagtagagatggggtttcaccatgttggtcaggctggtcttgaactcttgacctcaaatgatccacctgccttggcctcccaaagtgctgggattacaagcctgagccactgtgcccggcctcgggcaactttgaag

SEQ ID NO: 134542 - DNA, 1053 bp, Homo sapiens
gaggtagatcgcgccactccagcctgggtgacagcaagaccctgtcctaacatgctcttaggagtttcataaatgtgaccccagaagagctctctagccctgtttccacttatgaggctaaattgagaagatcgcagaccacaaccccgaagaggcctcatcagagcccaactttgttgtcaccctggtcttcgacttccagccttcagatctgtaagaaagaaatgtttgttgtttaagccacccagtctgtggtagctttcatagcagcctgaactgactaagacaagtggatagctgtctggttgttttagaaagcagggctgcatggtgtggggatgctgctgctactcattcctgctcattccagtgttctggaaaatgaggtagggtgggggaggtctgaaccttctaatttatttctagctgttcttttttagcaattaaagcattcgttggacaccagttgcttttaattcagttccatctgcactgtacttaatagatattactcccaggttcttataaatggctggttgttattcttggtttcagagctattttgagtttttgtcttcatttgtattttgactggaaattgggtgtggacatattggggagttggggctgacatcatctttattcagaagtcactttatgaccatgtgcgggatatattaatttcactacagcttttgatcttaataaaatgtctctgggttgagctgactgatcacgaagattttaaactttaatgtttcctaagaggattgatacagccatccagagaataacatagtatataggagttatcttttgacagatcaagttccatttccaaatgatataaaacccacctgtgtccacatccttatgccttcttttgaatctatgatttgataacttaagaaatctatctatgcattagatattgcctttccggtagagctatggtgtgatcttatgctcatgaacagaaaatgaatttaagaatcctcagacctattgtccagttcttttctttaagaagaacttgctattgactttgtcaaa

SEQ ID NO: 134543 - DNA, 1044 bp, Homo sapiens
acaaaatgtcattgttttgtgtcacggctccctgatcaccctttttttctttttctttttggaatcagaatagagcaatctgaaaaatgccatctaacaatcccatttttattgatcccattgtaattgtaaatgtttgacaggttatagcctctttaaatgcccttggaatccattaacgcatgtttcatagagttcacacagggtaaagtggtactttggtcagaacatggtttgctgaatgtcactgatttgtctctaccacacagctggcttctgaggcttataatgggcaattaggacaggaaggagttacttaagttctttttaaggtaacattaattagattcatctcttaccacatggtgagggtcatggttattacatttaccattttgggtttggtgtttaacctctttattgtggattggttggtcctggacattttcagatttagttttgtggtaggatgttttgtctgtagtttgcgtgtgtatttagaactggaatgaagtgtactttttaaaactacgaccccaacagcaaaaaggattttacaagcacttttggccttcattgttagagtgtcttcttgttctatgaggaaataaatttgatccttatcctggaattaaaaaaaatccttgaatgtattttttgttgttcttgttgcagcaaatgcagatatcagcgattttcatgacgagtttgcttatttaggggagaacattttctaaatcacgtaaagcttaacattaacagaagaaaatttgaaaattaaaattttaagagtgaaattctagacctttcacaaagttacaggctgaatccagctggtctgtcctgtccagtcacaggaattcccgcttactattaaacgaaattttccttccttcttcctctcctttctctttccttgccttttcctctcctctcttctggcatatttctctcaattgaacagtttcttagttttttaccaccaacctcaaaggatcaagtgtgaatgaagtaattgctttattttaggctctttattttgcc

SEQ ID NO: 134544 - DNA, 2019 bp, Homo sapiens
ccccacctagagatagccattgtcaagtttatgggatattcccttttaatattttctctgtaaattttatctagttggaatcctactgggcataatcagtactttgtcctttctcttaatagtatgcagtaaatggaagtgatgttaattccattcagctactgttatagtgaactcacttcagtaaatatctttgcaagcctatttttgcatttcaggtaatttctttagagtagattcctggtaatataatttgttgccttaaaaggcagggatgatttttatggctagagatagaaatgattaaattgatttccaaaacaatgataatgcttcatactcctaccagcagagtttgagaaaaacttaaagatggaaattagtataagtgaaatgtgaaatgattagagcaatgggaaactttaataataatctgtcctggatgacattgactagacctcattggtggatgttctctccactgtggtcatgtctttcactcatccacagttttgtcttctaacagagaactttatgtttcaagcttcccttagttttatgtcctttaatatgctgtgaaaaagtttttttttgtttgtttgttttgtttttttttagacagagtcttgctctgtcgccaggttggagtgcagtggcgccatctcggctcactgcaacctccacctcctgggttcaagcaattctcctgcctcagcctccctagtagctgggactacaggcaggcaccaccatgcccagttgatttttgtatttttagtagagataggtttcaccatgttggccaggatggtctcaatctcttgatctcgtgatccgcctgcctcggcctcccaaagtgctgagattataggcgtgagccactgcgcccagccaagctttgtttttaactgtatacactgcatcaactgatggtagggtattcctgatgagtatacttctgtgaaataactggttaactactagaaaatggagcaagtgctctaaaaatgaatagcaaagaattaaaaactaaatggtaattatacctgtgctggtttagtgtgtattttgcatatttacccgcataagctcaattttcttctagatgccattgatattacagtcagggaccacttttgtgccttggggaaataaagtgagcttccttaggaggtaatagatttgcaatttcacccattactggaagtagtcacatgtaatccaattaaatttgatatctcattagtgatggaggcccaccttcaaaaaactcagactcgagggatgggaactgaatgaaggtaccatgtgataaatgcaatgttataagttagttgcatgtctgttttcctactaaatatagtgaaatttaataagcataggaaggaaatggggtaagaggaagtgagtgtgaatttaagcagagaccgagaccaagggcccaccttagggtgctattcatgtattagaaaagggccacgcattttgctgttcttcctcatagttgacatgaagaggggactcaatgagctgtgttacccagaaagcccatgaagataaggactaaccaggggggacaactcttcatgtgctgggaggagaactcttcatgtgctgggaggagagaggattttatccatggttctccaaacgttaggtactttaatgtattgagtcgtgtctccaaatacaatcttacaatgaatgtgacaatggggttaaaaaaaactgtattgctcaatataggttaatggcataatgccaattgcttatctcagaaaagccattctgtaagagccaaagcaagacagttcagacaagcagctcactgctggctctgtccaagcatagacattccacattctttgtggagtgctgaattagatacttttcaggatgtttcctatgaatattacttcatgcaaaaggatatttttgataagaactgagtagcagtaagttcaaggttattaagctcaatactgcatcctctctttgtggtcagttaagtgtgggttc

SEQ ID NO: 134545 - DNA, 1093 bp, Homo sapiens
actggaaattgtgatgagttttattgggacatttagttcagtggctttcaaactttttagtcatgacccatagttagaaatgtttgtccatacatttgaatgagacattagttgtatatagtttactacacatagtaaactctgacattttcttttctattttttcctatgataatttgttcattttcattttaaaaagtactggttataactcatacattttgaaaacacttatctagtcatgaactgcagtttgaaagacactgatctagtctgttgctgtgctgtctaaaatcaggttcattcatttttcaacatccatttgttaaatacagtatcggttattttgctagtagctgggaatagagtgatgagtaaagcagtcgttatcactggtggcatgaagcatagagtctagtgggatggagcatatgaaccaaaaaaaaaaacatccaaatgtataaatactctgcatgataaattctgtgggggaaaagagcaaaagcgattaaatggggaacctcatctgactttgggggtgattcaggatttccctggggaactgacatttggttaggtctgcagatgagaatgtgttaactctgtgaaggactgagcaggggtgtgtgcgtgggattgcagagtcatggaagaaatagtaacagaagcaaaatagaaaaccggaagggaaagacaggtggaaggcaatcttctttgatgagttggcattttttgtgatacttagtaggccttcctgtttgtggcttttttttcttacttgacaaaagtcaaataggaatgtcaaggattttttgggggagatgggtgttggtgtttgttgaagtagttttgtattagagcaatatagtatattgctaaatagcagggttttttttttttttttttttttttgttgagacggagtcttgctgtgtcacccaggctggagtgcagtggcgcgatcttggctcactgcaagctctgcttgccgggcacgccattctcctgcctcagcctcctgagtagctgggactacaggcacccgccaccatgcccggctaatttttttttgcatttttagtagagacagggt

SEQ ID NO: 134546 - DNA, 1044 bp, Homo sapiens
gaggtcaggagttcaagaccagcctggccaacatgataaaaccctgtctctactaaaaatacaaaaattagctggatgtgctctcttgaacccaggaggctaaggttgcagtgagcagagtttgtgccactgcactccagcctgggtgacagagtgagattctgcctcaaaaaaaaaaaaaaaattcttattccattttgggataatttcttgcagttttaaaaatatttgcttttacggaatatttaacagcattctcctttgtatcataagtatgtacacaggccattaaaatctttcatttttaatttctaatgactacatattagtcacactatttaatgtgtgtgtgactgattaaacatacctaattatgtttagtcattccctttctccgcttgcttcttttttttttttttttttttttttttgaggacttgtgcttctctgcccatatttcagtgttgatgttcccagagttctatccttactctaaatgatctccatttttgagcttatccacacagtggactgtggtttcctggtctttgtccttctgcctaggatgttctttcctaggtatccacatgcctgctctcattattttcatgtcttaactcaaaggtcaactttgagttaaggctttctatcactacatttaaaattgtgtgacctttcctgtctacccagcttgcctgatattttcttctccattgcacttttcttctgacttcttagatgaggacaggacttaaaaaaaattgtatttttattttctgctgtttccccaaaatatttttcttgttttgtttcttaaagaccatgtcttgttctgtcacccaggctggagttcagttgctcagtcatagctcactgtggcctcaaactcctgggctcaaaccatcctcttgcttcagcttcctgagtagctgggactgtgagcacatgccaccatgtttggttatttatttatttatttatttattttttgggtagagacagggtcttgctttattacccaggctagtcttgaactctcacctt

SEQ ID NO: 134547 - DNA, 1347 bp, Homo sapiens
aggggcattttggagcacgtgtttggcatctgtgaaccttttgttaggtagaaaacaaggcctgaatgaaaggcctttcaaccacttctggagcagagaagataggtagagttactcattataggcaggtttcattgtaggagtattcagtgaggacccccgccttggaagtctgtaatcagcagatgataaggatggtgtgttcttactaagagaataacacaactgaaacagaattgccttttgttaaggggatgctttgccttcttggactacgattgtggggagaaggattattgtcaactaagtgaggcattcattctgtacccactatttattgtagttccacagagaactgcttgctttactttctgactaggcacagaaaagtaaaggttcaaaggctagggcaagatgactgacttttccagatttagcacaatctgttctctggtcactttgagacgctgtcagtttagtttcatgcagctgatatcttggagaacttctgtgtccttacgtttggctgaggacactaaatttttttttttttttttttttttttgaggcagagcctcactttattgcccaggctggagtgcaatggcacgatcttggctcactgcctcctgggttcaagcaattctcttgcctcagccttccaagtagctgggaccacaggcgtgcaccaccatgcctggctaattttttttgtattttttggtagagatggggtttcactgtgttggccaggctggtcttgaactcctggcctcaagtgaaccacccgcctcggcctctcaaagtgctgggtttacaggcccaagccaccgtgcctggcctgaggacactaaaattaaaaaaaaattaagaaagtacggtccccgctcttgagtagctcatgaacatggagcgatatggactcaaatgattaagatcaggtaggtagtgatgaatacggtaaaccaagtttcaaacaaagagctgtctgcatatctgaggatggagagggtaagtcagccttagaggagggaaatgacttgcagcaggatgccagcctcaatggtctgtggagctcattccatgcagaagagtaatgaggaagacccagtgagtgacaggcttggggaggagtgcctgaaattgacggtttgtggcaggaagtggtgggaccaatctcgaagcttgtggaggtagaagggtactggagactactgtggacaaaaaagggcatgttgatgccattaccagacaggacacgagagcatgatgattgttgcagtgaggcttgttagttttagacatgtctaaaaccatgcaggcagagattttcagctggtggctggc

SEQ ID NO: 134548 - DNA, 1030 bp, Homo sapiens
ggggtggcatggtggtggtgatgattttatttaaactctttggcattttttagcaggttagtatgatttcaaagtagtgttgttgttgtattatcaacttgtggggctgggccaaagaatattgtcttaatacttgcatgtccctgtcatctaatcagtgctatagaaactttaaccctgaagtccatgtaaaattgtaattatttttttccagaaatgaaagagaactattttactacattcatggatttaggttataatttattttatttttgtgatactgttttaaaaaagtgatataatgacagggcagacccttaactttagtccagtgctaaaacaaacgtgcaataagcctgcatgaggcagggcaagctgtgtttgttgtattatgaaaataaaggaaaatgttttcaaaaccagcatttttctctaaaagaaaaaattttgactaataatacctggccatgggtgggatttccagctgttggttgaaggaaattttgttcattatggccattatgtgtgctatgtctcttagagtttaggatttgctatgctgagattgctactgtgaaccattcctgttatagcaagtttccctatattcattaacttatgtgtctaaacaatgctctagattagactttatatcgatctgttctactaaattttcttcccctatgcctaggtggttctctttgaccaacccttaactgccctgattctgaaattctgctctaattgaaggatattcctgggtctttggagggagaaatggttcaggggcagaggaaactttttttccccccatctcaggagcacttaactgactgcctgctatataccaggctttgtgctagttttactaggggtgagtgtgaataaggcaggattcccaccctccaggaggagcttacacacgattaacagataattacaattcagtgtaacaagtgttatgagagagaagactttgcgggagcaccaagcgggggcacttgaccctcagcggtgaggtggtggaggt

SEQ ID NO: 134549 - DNA, 1084 bp, Homo sapiens
attctgcaggcacagagctgtccaagaaaacattttttttcccctctcttttttgtttagggaagggcttgctggttaatgctaatttaaacatgactcttctggcagctggcattcttgaccctgtttatgttatacatggtatttaaccacagtgattgggtatttgcagcacagaagaaaaagaattattattagtttgaaaccggcattaatgcctctgtaaatgatagggcaaggcagtagatggaaggagagagggaagccaagtagcacactcggtactgcagtgagagatgacataaccatgagaattctttaagtttaacttccagtagaagtaacttgctttctatatattttaaatccctagagctaaagcatttaactcattatcttcactctgtgggatccatttgggagaggtattcaggagctttataggttcacacttgctccccagtacctctgtgtcacaggaggatatacactggttttcagttgcatgtcagaggtggaactgacttggatgtctttgaattgctgttgaatctggagatgctagggtacccaggagacagacaggaaaaagaagaggctgggcacggcggctcatgcctgtaatcccagcactttgggaggctgaggcgggtggatcacctgaggtcaagagtttgagaccagcctggctaacatggtgaaaccctgtctctactaaaaatacaaaaaattagccaggtgtgatgctgggcgcctgtaatcccagctactcaggaggctgaggcagaagaatcacttgaacccaggagggagaggttgcagtgagccaagattgtgccattgcactccagcctgggcagacagagtgagactccatctcaaaaaacttaagaaaaagaaaaagaaaaagaaggtggctgaatttctttcaattaccttgtgaattcaatttaatgaatgatcttcccagcagtttgttttatcttctgcaagggaacttatgtttggcatgtttaataaattaagttaattaagttggagaagcccaaggttagtatactttattttaggatacatttttggt

SEQ ID NO: 134550 - DNA, 1037 bp, Homo sapiens
gggagggcttgcgaggggccctcgaaattctcccaaaacctcgtcccgctggacttgcacctccgaggggtccctgcgcccctggggctccgcacctctcgcttcccactgacgactcggttgtcccccaccaccgggctgaggacttttaactaagtttctgtccagccgcctaacaaacgtgcttaacaagtaacaggaggttgtaaggcaagggagggacctggctttgaaagttgatggttttgaaatcgacggctcctttgacttgcgtaggactcctttgtggtgaatggatttaaagtttattcttgtttttctttgctgccatttggtctttgcaatgttaagagtgaaggcattcaggacttgctgctgcctgctgtctggggcctgaggttgtggctctccgcttctgctctcctctcttcatttttgttgaaatccgtggattttttcataaatgtgggtgctggcttgtttcactatggacgcgtcgtttcctatggggttagatagatattggtaaacataaatattgaaaatgtgatgatcacatattgatgatcacagcgaaatcctctattccttcaggctctaacagtttgtttttcacgtatttgcataagtgtgtttgctcagctaagcataattggtaagccagaggtctgtgattcagagtctgcagttctggttaaggggagactgtacacttggaaaatgcgaagttttttaagaagttattcccttgccggatagaagagtgggtcccaaggaaaaagggtgtattttagaggtatggttatttgaaccaaactaaacatcattaaaatacacagggaggtagaatgtcacctagttctttctgcccttgatttccatatcccagtaggagcgagtataattgccccaaatgcaaaattatgaataataatcagcattgtaagtatattaaggttgcatttttttcttgatacttgtctgatttgaggataaaaacaccaagtggcaagagaaggaggtagcttgaggcagga

SEQ ID NO: 134551 - DNA, 1005 bp, Homo sapiens
aatgtcaaaactgtaatgacaaatttctgttcacttttatgctaccagtatgactttataggggagaaggaaagccttttaattagccacctgggaattactcttttaaaaaatgccttttctcaaaagaacatgataccactccaagtaaatcattgccactaggggttttcctccttccttctgttgcccatgcccctgcctgaaagtgtagggtaagaggaaaaacaagtaaaaccttagtgttgatggtaaactgagaactctgtagcttaccttggattccagagcagaagactggtttacattcagtactcatccttattgacgttaacaccaggaatctccatgtttattatttttcgtggaaactccatgtttattatttttggtggtctctattgaccaatgtatttcaaacttttttgactgcaagtcataataaaaataactttttacatcacgacccagaacatgtgtgtttgtgtgtgtatatatgtgcatgcctaaatacaaaatctttaaaacatttcatgaaataatacataactgtgtgataccctttagtgtctgctcccggccccctgatttaatgctcttcagactctctaaattcatttcctgactcacaacggggttgctacttacagtttaaacaacactgccgtagatagcacctagacttggctgaatatgctggggatttgtttctgattgaaaagggagtttacaaataaaaatttaagtgtttattacaaaaacatcctctttgctgatactgaacgtcagttttagtagcatcatgaattttaaggaatctatctcggattttcatttgagaatggctattgcttggggaaaaatcaacttcggatgttttttagaaagcttatggcgtcttttaggacttggtgtttttcatatcagtatttccccctccaccaagtactccctgactttcatttatggtacctgggatattcttccttggcaagaatacaatgc

SEQ ID NO: 134552 - DNA, 1003 bp, Homo sapiens
gttgaaatgacttttttgctgcagtgtgccttgccctgataattccttcttcctactatgcttcagtgtaattatttctcttactcccactgatactgggggaaggagaggaaactccctgatgtgcctctacgctactgtcaagaattaggttttgagacacatattgacagtatgtaatgataattatatactgatctgttatcaagaggttgctttgcatttatttgggggataggatatttttaaatttttttcttgcttgttctataaggattctttggggttttttctttttgctttgttttttgttttttttgtttttgttttttttttttcatgcagaatctaaacagtgggaatgtttgacatctgaatgcagagtgctcctaattgagtctttagctactatggagccagacagcagacctgaactgcaggagaaagcagcgttactgaagaaaacacttgaaaatctggaataaattagaaggggaagaaacaaacaagtgccatgttcattgggggttgaagtggtggtgttctttgaaaaaccaagtgggaaaaagtaaagattaatctgtagcatgcatcattccttggctgaaataaaaagaaaaagccttaaattttgttccttattagctttattttactttatgtttttaaagtatctgggctgagtgagcttaatggaaccttggatgtttgaggggtggttgtaaaggaaactggcagaaatagttactaaaagagttcaagctgttattaaaggaattaatagacagagttgcagagcaagctggataaaaatcttagaactgcattcaaattagttatttcaggaaggggccctataaataacttattttaacctccctcttacacctgaagaaataggaagctgtgtcatctcagaggctttctgaggcctgtgccaaagtcagaacccaggtgtttaatgtctggccctggatactttcttttatggccatctgccaaa

SEQ ID NO: 134553 - DNA, 1052 bp, Homo sapiens
caggtttagaaaaatcagttaatttttcttgtcacttaaaagttgttttaattttgctttcctaggatcctttggtggcattcgattatacctgcaggagttaattactattacccagaaggctttgcagtctcagtcctggaaaatgaaagcccagggtgcaattgccatggcatcaattgcaaaacagactagctctctagtacctccatatctcggaatgatactgaccgcattgctgcaaggcctggctggaagaacgtgggcaggaaaggtaaaggaaccattcatacccagttaaagggattctgacttcatctttcattttgcataatagtaacgatctggttttgtgtaacttttccaatggattatttttgtgaactagatttcctagacagtggaagctttgggtaaaccttgcctgattaactgtggtatttcctctcaaactgcaacccgtgtggccttgcataatggacagtaatgctggagatagatacattttccatattcagccttccaagttacgtcttaaaccaacttgtcagcattttgtacctgttgacctcatgaacagatcaggattgggcatagaaagatcaggattgggcatatgtgaaatagagtagcaaggtagcctgcctctaaacctggggctgaagatgcccatctctgggacctatgaattagtaacagttatttttttacacaagagctttagtaggattcttaacagtgaacactcagtggggaacatgagattgtggtaacctaatgatctttatgttgtaaaggtcaatagtggcccatgcaggaatgaagtagtaccggactgggagtcagacatcattccaattctgtggttgacactgttttctgtgagacctgggtcgaatcagttctttaggcttctatgaaatggaggtgaagataattatcctacatccatggtttggagtaaaacttggtggatgtgcttaaaattatgcattaaagataaggtgactgttgttaatttttgttgtcatagttatcaaaaattcctaagg

SEQ ID NO: 134554 - DNA, 1047 bp, Homo sapiens
gcaacctcagcctcctgggctcaagcgattcttgtgtctcagcctcctgagtagctggaactacaggcacgtgccaccacgcctggttaatttttgtattttttgtataggtggggtttcgccatgttgcccaggctggtcttaaactcccgagctcaagctatctgctcaccttggcctctcaaagtgctgggattacaggtgtaagccaccacaacccagcctgctagaaacatttctaattgattttacctgtttgttttgctattatatgagttgaacaatagcctgtttagatcagttacccttaaaaacaataaatatcgtaaagattttggtttctccttttcagaacctatctacaagacctcttgtgctttgactattcatgctattggacgatacagccctgatgtattaaagaatcatgcaaaagaagtcctgcctctggcatttttaggcatgcatgaaattgctgatgaggagaaatccgaaaaagaagaatgtaatttatggaccgaagtgtggcaggaaaacgtacctggttagtagtgtggcctgagttaaacctgcttcttaggaatcacagctagaattttttacttgcattcgttattcataaactcctctgaagttactttcccaggaccttaatatgcatcccatttagttttaaacccatccaaattgctcatcccatttagttttgaacccatccaaattgctgagttctcaaggttggcactcaggatttttgtctttactcattcatcactgcccacatgagagaatataaaccctgtgagcaaggagagctttacatttttaattaagagtgtgattttatgtggccttagagtattttagagtagttttctaaatgtgtttttcaccttgtcgcatattaattgatgatgcccatttgtgtgatacgttcctgtgggcacccaagttcgtaaagttctactattgtgagaataagtcacaacaccaacacactttctctccctttgagagagtggtgtgttttaacagttgagagtcact

SEQ ID NO: 134555 - DNA, 1059 bp, Homo sapiens
cacccgcctcagcctcccaaagtgctgggattacaggcgtgagccaccgcacccagcctgatcagagtcattttttaaaacttcagatgaaacatatttattgtgaaaagttaatacagaaggatagaaagtaatcccatagaaggtctcccaatcaccacagtatcattccctgaggagcacctgctgtcaaaagtttcctgtgccttctctcaaattcctttttagtcataggctaccaaaccaaacaaacatactaatttaaaaatagtatcagaccgtgaatgttgttctgtgatttgttttttaaattaacagtatatcgtgtctatatatacacttattctttttaatgtatgtatagtgttctacagtgaggtgattttgaatttttgatggagaggttttgcaacatcaaaggttttaagtgttctttttttctccgtacctttggcactgttgaataacgtatgtgtgataacaagaatctcatttttctgatttgcactcttttcctagcattgtccattgccttttcaatattgtattagtcgtttatatttcttctgtgattgtgtttatgttccatgtctatttttctatttgactgtttttttaatttatatatttttattagaactgttaaaccctgttatatacaacatgtttcctctgttcactatttgatctttaacttgcctaaacttctctaataacttactctctttaccctttgcctctaatattgctgtttcttcttcattcattatttttccctctttcagcagtagacttgcaccttcctgggtgcccataggatgtttactaagcattgagaatttggaaacataaattctagtctaaactttgtagccctaggcaagtcacttgtgtatgccttacttttctcccttatcatatctggatagtgttaacctctccttcagcacagttgttagattaaaataccttcatagatacgaagggtaattacaaagttaaagaactgcacgtataaaattttctactgcttagacacaattttaaaaaccttagaaa

SEQ ID NO: 134556 - DNA, 1071 bp, Homo sapiens
tcatctgttttgttctgtatttcacaaattggaggaccagtgcttagagagtgaaatgcattaccaaattttctgtttagttcttggcagacctaggactcaatctccgatctcattcctctgtgtctctgtagtgtcagagaaagtagattcacttattcttccctgtagatatgtgaagtagaaagtcttttgtcagatgaattctttattggatgcgcggtcactttcactaacgtccatgctctttgtatgtgaggtctgtgtgaaaatgtgtgaccctgccaaaggagcagctggccagagaaccatcgctgcccttctgccttgccttctggacaaaggaatgatgagcaccgtgacggaagttcgagccctcaggtgtgcatccgttgatgaaatgaatgtattggatttgctcagttcctagaaattgtgtttctttcaaggttagattctggaaaatatggagaaagaggtttaggagaatgacccttgggtcatttgtgaaaacttgtgagtcacaatattttcacagaaacattctcatgagaccttatttttgcctagcattctgagtcaagcgtgttgttctgttgtcatcagcctctgctcccaacaagcacgtcttcctgttacactgtaggtcctcaggagcatgtttgttcattataatatttagtaatatttcacagattattagatttaagagaagctgtttaccacctgcaacgatgaaatattcaaaaaatgtacttacacgttttgatataatatatgactactttaagttaaaaccaatagtgtaggattctagtttgtatgttttgtttgtttttaaagtacagtgctgtctaggaactttatctgttccattgttatttcactcttaagagtagaacaaattattaataatactgccagtggtatttcatggcaagtagatagttgatgaaagagttttttttttagaaggactcacctaacaaatgcaaaggcatgacgcaattaagagtgtcactttggctgggcctggtggctggtgcctgtaatcccagcactttgggaggc

SEQ ID NO: 134557 - DNA, 1840 bp, Homo sapiens
tgtaagtatgaaatcaaagaagttgaagattacctgttaaattggtagacaccaagatgtattttgtattgtcatgactttatagtatagcatttctgtatacaagttagattcattcggtgcccagtgtgtatgtggcagtgtgctaggccttggaggcacactggtgaataaaaaacgatgtgtcatctcaaagggattgtattatagttgtgggaaacaagcattttataattgtaaattacatatatatatggtatatttgagggacctggagagaagtcattgctgttttggggtgaggggatgagaactcgaattagaggcagaatctgtattcttttttagtataaatgtttcatagtaaaatactgacctttttcatcatatattgaaatgaaattttgattttcagctgtttagctttgaatgatttattgagaggaagacccttagatgacatcattgataaacttccagaaatttgggaaacgctttttagagtacaagatgatatcaaggtattatagaaataaatcagcatttatatatacaaaaagttaaattggaattattaaaatatttatgttgtgtatgtcaaaattccatttccagataattttaagagaccaacgttttcccccaaagtttcagtcttaatgtgtctgtgaagttgcaaggttgggtatccttagatctaaattaaatagacttagggaaaaaaaaggtggctgtataccttctttcaatagagatctcatgattctattggattagggacaaataacagttttggacatagtaacagtattttgatcagttctgtaaatgggattaattattctcaagtaatgtggccaattcctctgaatttttcttgggcaatcttaattttaggtattttggtattttaccattaaaattaggcacttcagttttacctttctttttgctttatttattggaggcttttaagtgtttcagaattctcacatagatctttatgtatttacttttataatacatttagtttctcaactgttaatagctaaattttttaaggtcaaaataggttacagttaatgtttaaaaattaatagtatggcatggtaatgtgttccttgatgggcagagagtctgatgagataccaatttttttaacatgatatgaaatgtaagattttccaccaaatctctgtagggcctgaggcaattaaattgcaaattgtagagtagatgatagtgaaactctctaacttgtatgatgtcacacttttgtcatttttaggaatctgtacgaaaagcggcagaactagctctgaaaactctgagcaaggtgaaaaccccgtcttacattgggaatggagtggagcagggttctgggtgaccatgacaatgatttacttactgtcataggaaaagacatttagttgcagtataattggcttcatgttgtagttcactgctcttagaatgaatgagaaagtgagtgctgtaaacactgcagtactagtgtgttgaacagagtatactgtggtctctttaaatggtgaaattaagataaaacttcgacttaaccctgaagagcacatcactcagatcaagcaacacctgtcttttctcttgcttttgctgtgtttatatataaagctacctttcatatttgtgaggttggaaagctttttgaaactaaattatctcccacttgaacttgattttgtgatatatcaggaactttacattctagttgcacaaaccttgccataggtcacataaatagtaaaaccaggttttaaatacaggtgttttcctgtttcacatgtgatcttgaccactatat

SEQ ID NO: 134558 - DNA, 1048 bp, Homo sapiens
tggagtgggcatggaattacagaatgtaaatcttaaagtgaatcaagattcagcttctcaaaattccgttagaaactcaaggtttctcttgttccctaagctcgatgcattagcatccagtgaaacctcgagtgttcactttattctttagccttatgttttgttggagagatgatcctaatcgacacacagttactgccatgtattcttgcgtatatgagagagagccagagatatgctattgtttttgctaaattcagagcccggagatacagcatggatccttgcttgcattgggattcacggtgggaaggtatttggctaaaaagaaaatgagaatgtcagagcaacaagacctggagagaaatgctgacaccctccctgatcaagaggaactcattcagagtgctacagaaacaataggtaattaatgtctttatgtcgatttgggtgttgcagtttttgaattatgttaaattttaatatggcgtttcagtttctttttatggcattgtatttgaaaagacacaagctttttcacaaaaaacttacttgataaataatgtatttttagtaacaacgaaggctgggtgtggtggctcatgcctataatctcagtactttgggaggccaaggtgggaggatgacttgagtccaagagtttgagaccagtctagtcagcatagtgagacctagcctctacaaaaaaataaacaaaattagcttggtatggtggcgtgtacctgtagcctcaactactgaggaagctaaggtgggagaatcactggagcctgggaggtccaggctgcggtgagctgtgatcatgccactgcactcccgcctgggtgacagagctcgaccttgtctcaaaaaaccaaaacaaacaaagcaaaaaacaaagcaatgaaagcactctattttttttctctacatttttttcctacatgtttttataaacagagatgatcctattatgggaacaaatttatacattaaaaaaatactactctatcccctgttaccatgttgtctttccactgaataaatg

SEQ ID NO: 134559 - DNA, 1048 bp, Homo sapiens
aaaaaaaaatcaagaaacgaataatgtttcatgacacaaacattgtcgtgtccatgttttactggaacccagccacgctcattcattgtgtattgtctgttgctgcctttgtactgcagtggcagagtggagtagttgcagcagagaccaaatggcccataaagcctttttgtttttttacagaagtttgctgacccttgttttagatcatctgtgaataaatttcacctgttttgtacttgtgtatctttgacgaaaatggacctaagattttgttatctaattcattcagctttcattttgttttcaaataatggcttgtttttttctcaatatccatcaacagattgaacgttcttttaattttaaaagatgttgtcatcaggcacgtggttctgtgtcatgtatatatttgttttttttttatactgctcagagtctgatgaataacagtaaagaagaaatgcgcgaactggcagcgttgttttattctgtagtggtatcaacagtgtcggggaatgagttgaaatcaatgatagaacagcttataaagactacaaaagacaatcacgtatgttattttgttttcattcttttttgtgggagatagggttttataaaaggatctaacttatttttgacttttatgttctcatttgtaaaatgaacttacaaattccttgcttttatgaccataaagagtaaatgagataggtgatacattggttcagtcagctcacttaacagatacgggtgctgtgtctgataagcactgttttaggtgctaggagtacagtgattcataaatacatgagaatccctggtacaacaggatgctcagagcctgcagccgtaccaccgtgaacacacctaatctcatctgatcttggaaactaagcagggtcgggcctgatgagtactgaaagcgagaaatgttagctccttttttcttcctcatctactgctgccagtgaaaaaacaagttttacttcacatagtttgttggttaccttgtgtttggaggttttggcaattagaaataggatct

SEQ ID NO: 134560 - DNA, 1122 bp, Homo sapiens
ttttctgctcctctccctcctcccaccctctctcctcaagtataccccagtgtctgttgtttgcttctttgcgttcagaagttcttatcatctaactcccacttataagtgagaacatgtggtatttgattttctgttcctgcgttagtttgctaaggataacagcctccagctccaatttctgactttaaaagttcagtttgtattttaacaatcttaaaaaattctttggatttgcaaaccttattatacaaattttgctccattatggcatattttctgccttccatgaggattggaatagctttataaagaagtgtgggtgaatcaaaactagaaattgttactttgaagagtaccttcccacactgacttttcgagaagcttatgcagtcttcctctccgttctgtttgtagatcgttctgtacttgcgcatgtgccttgcgcacagtgcgggggtggtgcccacctctcagagtttggctgatatgcaggatcatgccccagccattgggcgctacatacggactttaatgtcaagcgggcagatggcaccctcatcatctaacaagagtggggagactaaccctgtccagatctacattggcctgcttcagcagctgttagcaggtgttggaggtaggaatatgtgacgcgaaggaaagatactgaagcacttaagcaaaaatctaattttaaactttgctaagaatttatagcaaaattattctttttcttctgtaactgaacattagcctttgtttctttttaaacttacctgattcattctggatacactacttcttttttcggaaagaaatgctaacaatagataaatacatttttacttcggaagtggatgtgaagaacaggatatcctttttatagatagctcatctgtaaatttgctgtagtgaatcacatactatatttaggttgtgtaggttttcttttttttttttttaatagaaccgaaagaatgtgtgctaaagcagtggccttatactttaaaggaatttagtgatccctgtatgttcattacttttcttgaaatttaaggtgattctgaattcttatttaggtttgccggttatgtactgtctattggaagctgtgtcagt

SEQ ID NO: 134561 - DNA, 1113 bp, Homo sapiens
gcctcccaaagtgctaggtttacaggcatgaaccaccatgcccagctgactcataaagtttctagcattaatacttacaataagaagaagatacaaagtgaggaaaaaaaattgtaatcctcacctgtaattgatctgttttgcctaaacttgaattacttataattcctttcatgcttggcaacattttggctgtgttaaatattttttcccttaatatgacatgcttaaaaatacatctcctttttttaaaatttttttatttttttttgagacagggtcttgctctggtcacccaggctagagtgcagtggtgtggtctcagttcactaaaacctccacgtcccagactcaagtgatccaccctcctcagcctcccgatagctgggactacaggcgtgcaccaccgtgcctggctaatttttttattttttgtagagacagagttttgctatattgcccacgctggttctcctttttatttttaagggcacgctttagggtagtgtaagtttaaggatgcttcagggaacagttcatgttcttcccaccgtgttcataagagagcatcccatctgcttttgtaagtttttgcttttgcacagtgttttctgctagtagatccaggatattggcagtaatgaccatccaccccctccaggccttgactctgtcccactttgccggaggacaccttcctaccttttacctccactggtgatcctagctctttgctaggtaggcaccttaagggagttgaaggtcagtatgcagcggccatgattctgttttccacatagcagcacagtctatttgtggtcagaagattctctgcttgtagtttcctcctactttgattattaatgaaaataactggcatgcagtgacctgagatgaccatattagtagatgtctggaataggtttattatttttaaacaaaccagaacaaacatggaaaaagggcaatacacttgtcttttagtgtgtgagggacatgcacgatcagcatggttaataggaaagtggaaaatgtttgatcagaaaaagaagcaaacttaggacatgtagctagaaacacagttgtttttgagttgaggaagggcaggtatgc

SEQ ID NO: 134562 - DNA, 2028 bp, Homo sapiens
ttccagatatttgctgctactggctgcaggagatccgtaagtttcaaaaggtgttaatttgaattttggtttattttgaatttatttgaaaattactaaaagttgtattgtttacaatgttggtctatgaaatttagaagctatttattaaagaaagtatggctcttgatgtgatatagacctgtactcatatacctatatatttatatagtaatataaatattacatgtatatatctatataatatacattatgtagatatatatgtgtaatatatgatatatagctaatacagaaaatggttatgaaatggtcaagtgtaaataaagcaaattatatgattgcgtgtgtaatataattatatatctaaaaacaagccctatgtaaggagaaaaaaggctgatgttgatggtttgacatatgtattaatattttattaaatatggagtatcattttatatctaatatatttttaaatgaggtataagttgcattttatattaatgaattatactactgcattttctagagtgtgtaatgctttttaaaagaatgtttaaatggttttgaaattgggacatgcctttaaaagtcatgtacatataatgaaatatatgtggacatattaaaacaactcttttcaaatctgttatatgtcttacagtcaatgccatcttaaaatccatgcagcattctaatctatttcataataaaccattactacatttaacgtttagaatttttgcatcccttaagtgagattcttgtatatgtttttcttttttgttatcagggatagccttatttggggagatgaaaagcttcatttattctgaggaatagtttaaataaaattatgcattctgtgatgatttgaacacccttgcccataaacttttatggtccattttttaaaaatgggtaattccttgataactgtttcagtgttctagttggccagctgtgtgcccctcatgccatttattttctttactataagttgtatatattttgctgttatttatttggttggtattttaattggacatcacaagttattaccaggtgctggtttttgacttctgatcttggctgctgcttctcatagagcacatttcaatctggttaaagtggctttggattgttaatgttgattctggtgctctgttgcttcttaatttttttacgttagtttcccaaccaaggccagatgtactggggcctggcagccaaggtgtcagttcatgttagagcaaggatttaagtctagggagttggacttccaaatagagctcttaactgctgtatcttactctgtaagtgctgaaaattgtttttgtttaagaaaccaaaaacaaagcataactaattcaacagttttccttcttaggttagaaccattcaggtcaaatgaaaatcctctgacaacttaaggaattatttattaattctttcttttcggccctttatgtgttgtttggaaaatgagacacaatcagaggcaattgaagaattaaaaggcctttatgtggtatctggataagactattgctgagatcagtctctaggtggtctgaaattggttgggtttatatttttacactttaatgtcacttatgagttattagttgtacagaattgtagctgaatacatagagatgtaagactttgggtggagtgtgtagaccactggatagtcactgacttctaaaatatgtattatagttgtttatggtttaactctacgaggtaaagcatacacatagatatttacataataatttacttaaagtaccctatcttgttttttaatgtgagtcaaattcaaagatgtaagccagatgagtccccggacctcatgcaatttctgaaaagaagtgatttcttataatgtgttatgttgactctgcttagatagccaagaatgtatttaagacattttctgagaactctagctgccaaataaaattgctgttcttattcttcaaatgatcatttcccattggtgacatttattttttattctta

SEQ ID NO: 134563 - DNA, 1555 bp, Homo sapiens
gcctcggcctccctaagtgctgggattacaggcatgagccaccatgcccagcctgctgtatctttaaatagcattttttcagccagcaccttttgtgctacttctagctattgtgcaaaaatggaattaaaggaattgaaatttatgttgatttccctatgtgactatttggatttggcttgtgttgggaaactgttaattctcaggggctaagatactttttttcttttatatttttctctggtaaataatggggctgagattttaatgattcaaaattctgtcaaaacatgcattcagtaaatttttgattccttaagctaaatgggatgaggattccttggactgtggatttttgaatccctttccctgctgtatttctcttactataatatctccaatatttaaaaggaatttgcttaaaaaggtaatatttcaagaattcattagcattattttccccagtctaagctaaacatgaatgcatgtttgcagtagtatagtgagatcaagatcttacatctgaaattagaactgagtttgaatcctagttttgttctttggtgagttacttaaattctttgcaccttcttattagaaaaatgaaaataatactgcttgattagattactgtgaagattgaatgagttaatctacctaaattgttcaccatagtcaaggcacgttagtaggtattattagtgaaaggcactttatttactgtgcagctgtgctttggggtggtaagtaggcctggttctcatagcttctttctcctattgagtgatgcttgcatggttaagatctaggggaccactcagattattttatggcatagatggtgaaatgctttagagtcattggtagaaatgaaaatgttctggggctcttggggagaagctgtatatttaaatgtaagttagagaggccagacaaaccacagggtgtgagtccccttacctgcaggtgacatctgcatgtcttcccaacagatgaatccataagagtagccatttagatgtggaagggcaaatcctaggataaacacataaactttaactggtagaagtttattgtgttctgagtaatcagattattagtttttgtaaaaccatgtaaaactctatctgtatcttgaggagagaacctcactaattcacctggtgattatgaccctcttaattttttatggtagaaaatatgatagaaagctgttcattacagtgtagatttttagaagatcacactacagtttattgcaattttggtgagagacggaggatcctagtctgttggaccggtgatgtattttctaatgagttaatgttttttagtgtgttgaagatgaactttggtgtttggaggttacatagtgttgaaatatcttgaactcagcaccagctaagagaaacctttcatatctatgaccactgcattttctttttggagcgattggggatgcaaggttttgtcttgtttttccttttagttagtgtgatggattctgggtttggacatttttgttgttgttcaggtgctaacaccatgtagttag

SEQ ID NO: 134564 - DNA, 1081 bp, Homo sapiens
aatattagccctggttagattagattgagtgtggtaaagcagaaataacaatgaattgggaatcaggacctatgaattctagccccaaatggctgtacacatgaatgtgctggggaggaaaggtttggctgatcacataacttttcctggcctcatgttcttcatgtagaaaatgaaggggttggattagattagtggttctcacagtgtggtccatggacctttttagggtcacaaaacaccttttaggcagtctgtgaaggccttttctttttgtactgtgtcaatatttgcactcatggtacaaaagcaatggtgagtgtacttgctaggttcctaccacatatcaaagccatgtcaccagatgactaacagttattctattcttcagtgttatgtactcatttaaaaaaaaaaagagaataaaactcagctttacttaagaacatccttgatgaagcagtaaaaatgactttacttgaagagtagacaggcaaattatagctaccgagatgggtatttggtgcatactttctctaaaagggaaaaaaatgagcttgttacttcaagaaaaacaacatgatttattggcaatgataaaagttagctttcaagcaaaaattagagttttgagaaacttgtattcaccacagtgatttgatagcttatcagtacttagtagatttttctgatgccgttagaacacaggtgatatgagcacaggctttgtgaaaaaaaatgtatgtatgaagaaacatttgcttaactcagtgagccagtattgtgcacatgaagaatgatgttacaaaagcatataaggacaagggagccattcagagtaagataaccagtggaatatagtataagagtatacaaaagttcattgatatggtttcaactccaaattgcaactaaccttttttttttcattttttaaaaataagcaattaactgttaagaaattattatttgtcaagttttggtgtagtatgaaaaaagaatgtccacaattacctaagaaagctaaaatcatctccacttttccaaccacacatatctgtgcaagcgaggtttttgttac

SEQ ID NO: 134565 - DNA, 1206 bp, Homo sapiens
tcttcagcacagggttcttcttcaaacagtggcggaggttctggaatcccacagcctcctccgggaatgagcttttatgcagccaaacgagttattggtgataacccatggacacctgaacaattggaacaggtatcacacaaggcttgctcataatagtagttgattgtggacactttcccctatgaagttcatgaaccgtataaaacataattctagtatattcaggctctccagtgaaatatgtttgaaagaagcagttgatgtaatgtgttcttttcatgctagttatttattaagccctaggggcagggaggagtgggacatactgtttagtttttctaatactgcttacatatgtcaagtataaagcacaactcacttataaattgaatatgtttaacttttgtcattttatttttttttattttttaacttttgtaattttaattttttaattataggtttaattttcatctagcttttatggtgcagttaaaatacaatttttcttacattattcaacttttaagggctgtacgttttatgtaaagtgaggagccccagcacttcacaggtgacaatgtggggaaaagcatgactccctgttatattacttcttgggaatttaaaaattggcattaaggattttattctggatttaaacaggacacagatgttctctgagcagcttttaaaaatgactggtgctctacagagaaggtgccttactgtgtctgtgtcatcaggcacttcagggaagaacagatgagatcagtatgtaattattttggaattcaagcaacatgggttagtcttctaatccttcctttatttctccatggcagtctaaatgatttgatccctttttttttgggaaatgtaagtgaccattgattaaaacagtattcccaggagaggggaaaagaggcaagtggggcattcttgccattcacaaatttatagaatgttttattgagtgagggatataattgatttgatttccttcttcatgttttatggatcttttttttttttcctccttaaactattatgtaagtaagaaaggtaaagaattaacagaggccgggcgcagtggctaatgcctgtaatcccagcactttgggaggccaaagtgggcggatcatgaggtcaggagatcgagaccatcctggctaacatggtgaaaccctgtttcttcttaaa

SEQ ID NO: 134566 - DNA, 1060 bp, Homo sapiens
gaattgcttgggatcaaaaatgttttggattttggaatatttacgttatacttacctgatttagcatcccaaatccaaaatctgcaatgccccaaggagcatttcctttgtgtgtcttgttggcactcataaagtttcagattttgtagtatttcgaatttcagattttcaaatttgggatgcttgaccttgcagaaacacacagtactcagtttcctttggttcatcatgcattggtgagttactggagtgaggaaccacagagtgctgcagtatactaagtttgttttagtcatttgaccagtgggaaatggcagcctaggatttgtcaacacctgatctcctcctagcttgtaaggattaatgcaacagactgggagatctggtgctaatatgtagtgtgtaggtgtaaataggttgattatttctttcttcttcatgataagaaattgcatatatgaatgctttagattagtccatgctacctcacattaggcctactttaaagcaagcattttgattaagttggactggaatttttcctctgagatacagtagttggtaaaggtgcaataaacgtggagggaggatgagtcacgtttacaatgtctttgttgtaaccataactctctaagttatcaatcatatattttcattgaaatcatagagtatttccttcacactcacttgcttttctcttattgcattagaattttactataatttatgttaaaatgggctatcctcgcctaccagtggaaaaacaatgtgaactggcccctacgcttcttactgccatggaagggaagcctcagccacagcaggataggtatgatttcctcaattaactaatttccctcctacaggagtcaacaactgcctttcaaatattaattcacatatttggttttacttgagcaaatgggaggtcttgagctgttttagctgacaaataatagaattttccgtggtacctcaaagttaccgttttgttaatactatcataaaatttcttgatgtgaacattgaaaaatgtgcagaactaacatttatctaagtc

SEQ ID NO: 134567 - DNA, 1078 bp, Homo sapiens
gaagtatggatgacaatgcaagtttctagcttcttggaaggtatcatgtctcactgacaaacactttcgctgatgtgagttcaaatatcagtgtttgaaaaggttaaaaaaaatgggctctggagtcatattttgactttgctatttgctggcccagtatccttggacaagttacttgaggcttctgcttcctcatctgtaaaatgggaatgacaccacctcactggttgttgtgagaatcgtattagataaggaatgcctgggggaagagtgcatagaaactgtgataaatattagctattttaatattactatttatcattcattcaacaaacattgattacagagttgttattattcttaaacataattcacctatttcattattgctgtagatctcttggaattttttgctgtcggtgtcaaacatctctacagctttctttatgcatgctttgaggctagagcacgaatttcagaaatgagggagaatagtgtaaacctggccctgcagaatatttatcttaaattcttgagtctttcttaggcaaggccttctaaaaatcttatttctcaatgctcgatttcttttctgttggcagaaatctttttattgtagtataattgaggccatttgatatgagcctctgtacatccctttctatccatgcaaactgttgacttgtcaattcctattttgctctcttttcccacttaaaggagaggaagcttgttatttcttacaaattatttgatagtatcagatgatattcagaatacaataaaaatgcctcagactattcacaatagcaaagacttggaaccaacccaaatgtccatcagtgatagactggattaagaaaatgtggcacatatacaccatggactactatgcagccataaaaaaggatgagttcatgtcctttgcagggacatggatgaagctggaaaccatcattctaagcaaactatcacaaagacagaaaaccaaacaccacatcttctcactcataggtgggagttgaacagtgagaacacgtggacacagggcagggaacatctcacactggggcctgtt

SEQ ID NO: 134568 - DNA, 1404 bp, Homo sapiens
gggtctttttacgacttggccatgctgaaacagatgaacaattacagaatattatatctaaattccttcctcctgttttgctcaaactctctagcacccaagaaggagtacgtaaaaaggtaagcatgttgggacagctgggggaattaaatgatgaataaatgaatatacattatcaagtgagttttctgttcccattattgagttctaggtttgtgatcttaattatggcctttcaaaatggagagtaagtctagaaccagcttttatgatttaaaagtagctcttgtatccttagcacagctgcatttagcaccaactgtctacttggcatcagtgtcagataatataattgagataattatcctggaatgtatggaggcatgatctgaaatccatgccattgattccaatatgaaaggcatgtggtaatggggcaaaaatattctttagttaattgttgacaatgattataaccttaactaaaagtaagcaaaataaaaaaaaatttaagcaaaataattttatagctcctgtttcaggattctgcaaagtactcttacaaaaagttggataactgtcacatcagattttcattttctttctttttttgttttttgagatagggtctcactctatcacccaggctggagtgcagtggcacaatcacagctcacagcagcctcgatcttctgggcttaggccctcctacctcaccctcccaagtagctgggactacaggtgcagaccaccatgcctggctaatgtttaaattttttgtggagacagggtttcgctttgttgctcaggctggtctcaaactcctgagctcaagcaatccacctgcctcggcctcccaaagtgctgggattacaggcatgagccactgtgcctggccagtattttcattttttaacgaaactgttctacatggaacatttcccccttgatttgtagaatatttcattagtcttccagtatatttataataggtcatccagtctttgagctatggtcaggttttattccttgggccacagtaattggcagtgacttcctggaggtctgccctgagagggattccaaggtctgatttgggttcagtgcagaaagagaatctttaggaatgtcttttatgtttatatctctttacaggagggaatgggcattcttgtcatatatttggcatgtctgcagttaatccttctttgctgagatagacgtgcatttgattatgtcactcttctatttaaaacccttctgtggccttctcttactattaggatagcaaggtctaagaggcccttcgtgagttgatttctgtatacttcttagccttatcagttttgttatttagcaaatatttactgagtgccttctatatgccaggtcttggggatatgg

SEQ ID NO: 134569 - DNA, 1027 bp, Homo sapiens
tgtctgactcatctttgtcaaatttttacattttctgctatcagcttcaggtcttgtattttattttaattaattaatttatttattttgagacagagttttgctcttgttgcccaggttggtgtgcagtgggatgatttcgactcaccacaacctccacctcccgggcttaagctattctcctgcctcagcctccttgtatttttagtagagacggggtttctccattttggtcaggctggtctcaaactcccgacctcaggtgatccactggccttggcctcccaaagtgctgggattacaagcgtgagccaccacgcccggccttattttatttttttaaagaaataaacattgcagatgcaattcaaaccccctgtgttactccttatcatatcatttttcttttcttcccttttttcctctctttcctcctcccctccttccctctcccttttcattcagagattgtcattactgtgatgtatcgtacccaatatgttttgtgtttaaaaactttccataaatgggactaaactgtacatatccttctgcagcttattttgtttgatcttagatttttcagatatggtcttgttggctcatgtaacatgtaatccttgtttatttatttccatcgttgtgtgactctgcataatttattccttctcatgttgactgatatttagattgtttttatatttttgcttttactaatcctgggctgtgaacactttcacacatgtgtccttgtgcttgtctcttcctgggagagttctttttttttttttttcttttgagataggatcttgctcagttgcccatgctggagtgcagggacacgatcacaactcattgcaggcttaagggattctcccacctcagcctctcgagtactgagtagctgggactacaggtgcataccaccatgcctggctaatttttttttttttttttggtagagatggagttttgtcatgttgcccaggctggtcttgaactcctgagctcaagcgatctgactacc

SEQ ID NO: 134570 - DNA, 1004 bp, Homo sapiens
tagtttcttattcttttcttagtttctgggctcccacttctgaaaatgtttcagcttggacgtgaaacacacacacacacacgtttgagcttggacatgaaacacacacacacgctcgctctctctctctctctctctctctcactcactctctttgcccagaattggtatgtcctaggaaaaggccttgttttaagagtgcttgattttctgcccttttactggttcaccccttcctcttcatctttttctgttctcttcctttccttctctcggcagtaactgctgcatctctgctggtttggagtcacgtcgtatacagttgtctagtaagatttagtatcttctccacctactttctcgcttaaaccatgttataatttagtgtgctagaaggagcattggactgtctagggtttgaatcagccctgccacttagtagttttggaatcttggtcaacagaatgttttcaaggctctgtttcctcaactgtaaattggagctaatactacttgctttactagaagttctttacaggcaggtactgtgttccagtgtgcgcttggagggtaaagccctctctgggttcagcttgtttgtttttgttttgttttgttttttgaggctgagtcttgttctgatgcccaggctgaagtgcagtggcgtgatctcggctcactgcaacctctgcctcctgggttcaagcagttctgtctcatccttcctagtagctgggactacagtcacatgccaccacgcctgagtaatttttatatttttaatagagatggggtttcatcatattggtcaggctggtcttgaactcctgacctcaggtcctgggttcagcttctgaatctgtgtatcattcacatggtgacctctggcaggtcagttaggtggtgagtctataaatgcatctataagtgcacctcacaacatttttctgaggctcagaaggccatgtgaaactgctttgtgactgtgatgtattttatatact

SEQ ID NO: 134571 - DNA, 1071 bp, Homo sapiens
agattctttaactcctagagcttttgggcttgtgattgatgtgttaatgtcattatgatatactgaaggcaaagtgaagctacaactgctaggatttaaatagtgatttaaataaagaacattctagggcttacacacccatatgagcattgttctaagtaattagctgctttgggtggatcttaacgatcgtacattagacttttatgcagtctgaactcttgcatagtatatattatttcctctaagctagctttcacaagctgaagtaatctttcctgcttgtcacctcctaaaaccgatttctaactgagtatctctgccagctgctgtctctgggggaaagggccttgtggacctcagtgttgggagtctagcacttactcattaaatctagggcttctgtcttgtcacctggcccagtcttgccaagctactcctatgatttcctccccttcctctgtgtgtgtgtgtgtgtgtgtgtgtgtgtgtgtgtgtgtgtggcgggaggagaggacatgatggggttgtggggaagtgggtgcggggtggtaagcaatatgatcagggaggggtagccttgttttgggctatgctggattggcagggagtttgaagtagcctggaatcatatgcaaaaggctgggcacagtggctcacgcctgtaatcccagcactttgggaggccgaggcgggcggatcacgaggtcaggagtttgagaccatcacgggtaacacagtgaaaccccatctctactaaaaatacaaaaagttagctgggtgtcgtggcacatgcctatagtccccgctactcgggaggctgaggcaggagagtcacttgaacccgggacggggaggttgtggtgagcagagattgcgccactgcactgcagcctgggtgacagagcaagacttcactaaaaaaaaaaaaaaggccagggaaagaaagactcttttcctcttccctgtttaaagagcctagcctgtagtagatccagatgcaagggtttccagattagggtatctgcctgggcccttgggggacagactggtggactagggaacagaaag

SEQ ID NO: 134572 - DNA, 2168 bp, Homo sapiens
gcaagtctcagtttcttcctcataaaattggaatgacaagattcactcatagtattgttaggattaatgtatgtgaaaatgtactgtgtaaacacttaagctcttataaattattattatttttggtgtgggatgtaatagcagatgatgctgtggagataggttgggaccagcatgttgtaggaatgccaacagaactagtttggactttgttctgtagacagtagagaaccatcagagcttttaagcaggagcgtaacatgagtaggtctgttttgtacgggtaacaggtggcattggtgtaacactgattgcaaggatccggagatcaagagcagcaagactaattaggagggtatcacaatggccaagtaaaaagaaacttagggtctgagttgggacagtggaagtggatttggcaaggagttaatataatgtaaaatccctaaaatagggagaaattgttggctgacgagatgagggttgttgaagaagggaggagttagagatgaatctaaatctgacctgagactagaaggtggaggagtaacagagagtgtagcctctagacagatttaggaaagtgaaggaaagagagaacagattcaacagataggtagtctgtgttcagcagaaagattatttgttgaatgaatgggttgaattattgagcccccatgttgttcagggagactgctttgagtagtggctaaaacctctggaactggaatcagagacagttttgaatcctgattctgatacttcttaatgtgttcttgaacaagggacctaacttgtaggcctcggttttctcatctgtaaaatgagataataaaacttacaagatttttttcttttcttttcttttttattgagacagggtctctctctgtcacccaggctgaagtacagtggtgtgatttcggctcactgcagccacaatttcctggtctcaatccatcttctgacctcagcctcctgagtagctgggactgcaggcgggtaccaccatccctggctaatttttgtattttctgtagagacggggtttggctatgttgcccaggctggtctcaaattcctgtactcaagcaatctgccctcctcggcctctcagagtgctgggattacaggcgtgagccaccgtgcctggccaggattgttttaagaatgggaagagatagcacatcttggcacatggattgcgggtgtgtgggaaccttggttctgaagctagggagacagtgtgggaatgattcccatggtagagctgtgggaatgggcatattgttcacagtcagctgactgggagccacgtgtatacgtatttaagagcgagaggaagataatcagagaaaggagatgaagagtgctaagagaggtcagcggtggccggggttatgtctgtcagccatttgcgttctcatatgtaatgtgctaaaaacatgtatacatgtttagtaacacttcttataaaactattatgtaattgaaacacttctaattaatgtaacagtttatatatttatgatatatatacacacatatacatatatgataaaatatgttgcattggtattagagattttaagtcttcagcaaatgattatcagtgtattttttgaagtattagcatgttctcagtaaatttggtttgtggacataggccttattctttctcaaatttgatagtcattataattttttttcctcatactgaatttgcaaagcagggcatcaaagatctaacaagaaatgaaaagtgcttatttttttcttaaaattgtagctatgcatatacatctgttaattgtatttttttggtgttctaaataatagattctttatacaattgcatatgtacgagtggatgaacgtaccattggtgatcccgaggatttttgtcaagattggataaaccatgtatcacattgattgtagaggttagtagatttagttccttaggatgtgtgcattttttttgtagcagcatttaaaaatgcataggttatcaggtagcaatttccccccaagatcttcatgttttttttttttccttttctagctagcctgagaaaattggtgaagttcatgttaatttacaaatgcctgaagcctctattctctgtaatgctaaacataaaaataatttgcaaaaagaagaaaaa

SEQ ID NO: 134573 - DNA, 1590 bp, Homo sapiens
atccacccgcctcggcctcccaaagtgctgggattacaggcgtgagccaccgcgcccggcccccactgtactgtttttgacagtggttgtaccattttacattaccaccaacaatacacagagttctaatttctctatatcctggccgacacttatctatattgtcagtagtaaccatcctgttgggtgtgaggtggtctgattttttttcaattgctatgctgtatgacatctgagttcctgttgtagaaccaaacacattaaagtctgaattgatagcaggaatgggaacaaaactagaggaagaattggatattctgaagtggctgaagtatttgtgtctatgcagtgtgcttccatacattcaggtactggttaagatgctgatagttaagggatttcctggctctagtacctaatggaaagttaggaacaaataattccaatccttgccttcttcttgttttgttcagttaaattgtcagtcatcagccacagatatcggtggacttggtttctgtatttcttcaggagagactgaatacgttgcagttgataccttagaataatttaacttgaaagcatatacatgtacactggttaagaagtttcatataaaccacttttagttttagaatgggtataataaaatagcagatgctgataaaatgtgcttttggccaggtgtggtggctcacacctgtaatcctagcactttaggaggccgagatgggtggatcacctgaggtcaggagttcaagaccaggctggccaacatggtgaaaccctgtctctactaaaaatacaaaatttagcctggtgtggcggcacgtgcctgtagtcccaggtactcaggaggctgaggcaggagaatcacttgaacctgtgaggtggaagttccagtgagccaagattgtgccgctgcactccagcctgggcaacagagctagactctgtctcaaaaaaaaaaaaaaaaaaaaaaagaaaaggtgcttttaagaattccactaaaaaaaaaggagagaattatccaaatattttctatcatttatgactagtagatgatagtaaaagcaaactactagatgccagcattgttctcttccactaacattttattgtaaaaaatcttcaaacacacagaaaagttgaaagtgaacattcgtgtacccaccacttagattctatcattgatagtcaaataactttatcatatttactattatagcaaactttgtcatttgtccatctcagtagatttttaaaaattgttaaagttttttttttttttttttgagacggagtttcagtctgtcacccaggctggtgtgcagtggcgcgcgatctcggctcactgcaacctttgccgcctgggtttaagcaattctcctgccttagcctcctgagtaactgggattacaggcacctgtcactgcgcccagctaatttttgcatttttagtagagacgaggtttcaccatcttggccaggttggtcttgaactcctgacctcgtgatccccccacctcagcctcccacagtgctgggattacaggcgtgagccaccatgcttggccaattgttaaactt

SEQ ID NO: 134574 - DNA, 1060 bp, Homo sapiens
gcccgcgatccgccctggcccggggtcgggggagcccagccccctgcccactgagcctcggctggcgggagggccggagccccggggtgacgggcagtgtccgcccgtcccgtctgaccccgcctggccccgggtccccgacggctggttgagttatagaaatggagctttcgggaagggggagaaggtgcctttttgtgacactctagtaatcagccgaaaggtcacgaataggcggtgaccctcagatggagcagggagggcggagagggtcgccggtcgaaccgcaggagaaaccacggggtgacagcgctttcagaaaggagagttagtgccccctcgatcgtacgcggtgcagccttcccggggacggcggtccctgtctggggagagcggtggtcaccctgaatcccaggccgccccgcccgccgccggggttcgcctcaatgctttgtgggaagtgtagttccggggcgccgcggacccacgctggggtcataaataccgaagtttcataggacataggacatgtgagataatttctgattgcgttttgagtgttctcccccccaagggttttctttctttccctttttttttttctcccaatgctgcccttcagtttatggcaaaaacaagaaaggtgttatttgaagatgatgtgggttttaaatggaataaagcatgggtgaggtgttgcaagctttatgaagcttacgttgttaaagccgcttctgaatttccatatgaaagtagttatacacgtaatgtatgtttttctggtgcttgtcagtttaaagccacttttatatacatgatctcacttttgccctcatagcaaccttgtgaggcagataggtaggaattatccttgttttaaagaggaggcaggtttggagagattaagttccttgctgctttgacacagaactggtggagcaggagtactgtttgctttttttgaagctgaagtaaacacttggtgtgatcctgagcagattggagagtcggaggagacaaggtctcatggtgcgattagagagagaagcgggctacagat

SEQ ID NO: 134575 - DNA, 1076 bp, Homo sapiens
accttttcccatttttgtctcaagttccagtatttatgtctgtgtattttggtagcatgtttttatcttccttggagaaccagaggctatatgtgaatgctgggatatctttactctatgcaaaacagcaattttctgttcttttctctatgagcagactttccagtttcaaaattagagttgatttcccagctaaagtgggttgaattgccatggctgctggaagaagtctcaaaaagctcccgactaggtgagttggtgaaaaatacacaacgaaattaaagcagttgtttagcaagtctgttgagaagactctttgaaatgttgggctgcctagatactaaaatacaaagatgattagaatagagcccttgccttcctgaaatgttcattttagtgggggagacttggtttgggtcctctgaatagatgccaggacatgattagccatgtaagatctttactggagaaagattcagtgaaggaaaatgaggaaggaactagaagaagccggaatagccatcagagcataatgctggtctaacccctgtgaatgagaacaggaaggagggcagattgggtaggaaaagtcttagactaaagtgtcgttctatctttttttttttttttttttttttgagtcggagtctcacaccgtctcccgagctagagtgcagtggcgtgatctcggctcactgcaacctccgcctcccgggttcaagtgattctcctgcctcagcctcctgagtagctgggattacaggcgcctgccaccaagcctggctaattttttgtatttttagtagagacggggtttcaccatgttgtccaggctagtcttgaactcctgacctcgtgatcggcctgcctcggcctcccaaagtgctgggattacaggtatgagccaccacgcccggctgcagtgcagttccaaaaaagtttaggcagggccaaacaggagtccttgccatagttacctatcagaggagtcctgtgtctcaaagaaatgggcctgtgtaagtatcctgtactccatcattgactgggagcaactcgtgggaatttgtgtgaatgca

SEQ ID NO: 134576 - DNA, 1090 bp, Homo sapiens
aagcctgtttatttatttttctttttttcttgagatggagtcttgctctcttgcccaggctggagtgcagtagtgtgatctcagctcaatgcaacctccgcctcctgggttcaagcagttctcctgcctcagcctcccaagtagctgggattatgggtgcccaccaccatgcccttctaattttttgtatctttagtagagacaggattttaccatgttggccaggctggtctggaacgcctgacctcaggtgatccacccacctcaaccttccaaagtgttgggattacaggtgtaagccaccgtgcccggccgaaaatgcctgtttctaatgtctttttctaactgcagtcttctgcactgttgggctaattcagtcagttttgttgctgctaaaacaggtattgtaaaataatgcttgtgacttaatgattctcctgaatctctagtatttagattatttaacattttgtctttgctatctgtttaggtaggtggagagttttcaaacactgttatcggccagatgaagaaatttggaaggattgccatatgtggagccatctctacatataacagaaccggcccacttcccccaggtaatgagcacatgcacacgatcccatatgtcacaaggctggacaaggagaaaattcacagatatgccataggccagtgactctgaaattattagaaagattttcatatattcttttttttttttttttaagacagagtctcactttgtgagtgctcaggagtttgagaccatcctgggcaacatggcaaaatgccgtctctacaaaaaatacaaaaataagctgggtgtggtggtgtacacctgtagtcccagctactcaagaggctgaagtgggaggattgcttgagcctgggaggcgaggctgcagtgagctgtgttcctgccactgcactccagcctgggtgacaaagtgacagcctgtctcaaaataataataacaaaaacaataacaaaagaaataaaaatatatataatttcacatattttgtgctaaatcagcttatattagatttttatgtagagaaacagcaagatctacaaatataaaag

SEQ ID NO: 134577 - DNA, 1044 bp, Homo sapiens
tctgtgatgtgggagtcacagagctgagacaaaataatagtctgaagaatgactgtaccaagagatggcatacactgcattgcaaggaagagaagcccagaaacaaagaaccaaggaagtcaaatggatcggttgtgaaaccagctggtggaactatgaaccaaataaatgcagaagggacctgctgggtggtcagaagcaagctgaagctgagttgtaggatggtccggggactgatttcacctatgggatctgttggcccattatggtattccttttatatgtggctcagcacctaagagagtgttcctagggaacctaggcatacgagaccaggaaagtagtgttggtccatgcttgtgacttattcatggtttcctttttttttttttttctacttagggctgcaaagttgttggagcagtagggtctgatgaaaaggttgcctaccttcaaaagcttggatttgatgtcgtctttaactacaagacggtagagtctttggaagaaaccttgaagaaagcgtctcctgatggttatgattgttattttgataatgtaagtacaaactggacttaatatctaatttattatggaagtactatataaagcaggagtctcctacccctgggccatggatggttagtggtccatagcctatcaggaactgggatgcacagcaggaggtgaggggcaggtgagcaagcaaagcttcatctgtatttacagcccttccccattgctcccattactgcctgagctccgcctcttctcagaacagtggcagcattagattcccatagaagtgtaaaccctgttgtgaactatgcatgtgagggatctaggttgtgcgttccttatggagatcgcactactcaggtgcctgatgatgcctgatgcctaatgatctgtcactgtctcccatcacccccagatgggaccgtctagttgcaggaaaactcacccactgattctatggttatggtgagttgtataattatttcattgtatattacattgcaataataatagaaataaagtgca

SEQ ID NO: 134578 - DNA, 1100 bp, Homo sapiens
aaggagctaggggagggatgggattataagatggcagacttgagcatgcttatattttgagtgaaagggacagtagagaggaaaatctcaacgattctggaaagtggaaggctaagggaaagagagcgacacctgaagaagagaaggctagtgtccaggtcaccttgagccacaggacagaggcctcttgcttaaaaggaagagatgtgggtgagaacaggcgctcctcaccccatgagccactccttcctcaagtggctgggccagttgagagttctctggtgacccctatgccgatggctaagaattaagatggagaggggtggtggactatcagttgtggaatatcaacctcagtgcacttttgtcaacactaaccacacagcatcctgactcccttgaaagggaagacatgtcacatgccttaatgccttaatgtgctttatctttcagagttgtggaaagtaaaaatgtagccctaccaaaaggaactattgtactggcttctccaggctggacaacgcactccatttctgatgggaaagatctggaaaagctgctgacagagtggccagacacaataccactgtctttggctctggggacagttggcatgccagggtgagtttcatggatatattccatttgtttgaatgtctgacactctgattttccaaaatggtttgttcagaacttggtcaacaggaagatatttgatgcatgataggctcaggggctgatcagagaagagggcaggaccaagatggcagatcaacctaagtgtccatcaatgggtgaatggataaagaaaacgtggtctatatacatagcagaatactatccagccttaaaaaagaagaaaatcttgtcatttgtgacaacattggaggactttatgttaagtgaaataagccaggcacagaaaggcaaataccacattatttcacttcagtgtggaatctaacaaagttgaactcatagaattagagagtagaatgatagttatcaggggccgggaggctgaagggttggggagatgttggtcaaaggatacaaaatttcagttagacccaccatgcccggcatgaataaacatttta

SEQ ID NO: 134579 - DNA, 1086 bp, Homo sapiens
aaagaaatgtatatttttaactgaaaaggtgatgacaaattgttcttcagaaaaattacatgaaggctggacgcagtggctcatgcctgtaatcccagcattttgggaggctgaagcaggaggatcacttgaggtcaggaatttgagaccagcctggccaacatgtcaaaacccaatctctactaaaaataaagaaattagccaggtgtggtgatgggcatctgtaatcctagctattcaggaggctgaggcatgagaattgcttgaacccaggaggcagaggttgcagtgagctgagatcacacctctgcagtccagcctgggcaacagagtgagacttggtctcaaaaaaaaaaatgtatgaatgttcactcccacaaatagtattaacctgtttcccttatactgttcatcatcagtctcggcaacctgagataaatataatgatactttatgcttagtttagtttgcatttcttttattattagtgatgttgaccttctttttgtaagttaattctcaattttcttctgtggattatctgtttatatcctttgcccttttcctttaggtcttatcattcgttatattgatttgtaaaagcttctcgtatgttcaggatattagtgttgcaaatgtttgggcctttgttgatatttcttctgtgtccaattacagtttaaaattttatgtgataaaattgtaagtatttataattatggtcctttggtttcatctcatgcttagaaaggggttccccactccataattactaaaatatttattcatgccgggggcagtggctcacgcttgcaatcccagcactttgggaggccaaggtgggcggatcacttgaggtcgggagttcaaaaccagcctggacaacatggcgaaacctcatctctactaaaaatacaaaaattagctgggcacagtggtgggcgcttgtaatcccagctacttgggaagctgaggcaggagaatcatttgaaccaaggaggaggttgcagtgagcagagatcgcgccattgcactccagctttggatgatagagtgagactccatctcaaaaaaaaaaaagtattc

SEQ ID NO: 134580 - DNA, 1072 bp, Homo sapiens
ggggctctactgcggcacgcgggactgctacgaggtgctgggcgtgagccgctcggcgggcaaggcggagatcgcgcgggcctaccgccagctggcccggcgctaccaccctgaccgctaccggccccagcccggagacgagggccccgggcggacgccgcagagcgccgaggaggctttcctgctggtggcaaccgcctacgagacactcaaggtgaggcctgcgggcgtggaggggcttcgaagactggccgcgggaagcccacggcgccttccgaccccggtccgcggagcgtgggcctctgtgaccccgaaactgagcacagccaccaccgcgacctttaagatactcacgtttcccacgtggccctgtgaaagagccgagtcggccccacggggccttggggggcacagctagcctccttgccctcttcctttttgtgacattgttatgcaaaactttggccatcttacgatttcgtgaaaatattttaataacgtgcatttcacattcgaaaagcagggtgatcattattagtaggatctggggtagcccacaacagggaaagtctcgaatatcaagtgacaactgtgatcgcatcagtttgatatgacagaaaattggtttctggaaatagtgttaatggtgacgcttagtttgggtttaaggaactaagaaaacactgagaagaacaatgaacaccagtcaaaaggctggatgtgagtctttgctgtgacacccctgtatgaccttggatagtgacttattatgttgaaatagctgtttcttcatatgcaaaattaaggccatgatacctcctctcagagttattatggggattaaatgataagtgtgcgaaccgcccccctttccataggatccataaataggtgcttaatgacttgggtacaaaactctgagaatttctagtaggaaatattttgtgaatatgtatttgtatttcatttgacaggttttattgagtcttgtggggatgagagatttagcccgatgctgttttcttctactactgcaaaaaatcaaaccatctaggacatcacgaagtataaa

SEQ ID NO: 134581 - DNA, 1437 bp, Homo sapiens
gcttggcccctaaggtggatgttagagtagtgattttggtcagcgtgtgtgctatttcggtgtttcaggtatgtatcaatggatatttttatctacatttatgtgcattgagtgcacattgcctagtgctagtcattaaaacctaactgcgagtatcttcttgtaaaattttacttctagttgagatctgttttagtcattggcaatgttggaatctttgtcagtggcaaatctaagaaattgttgaagaatgtcattactactacaaaacaacccctcaaaaatccagaccctttttcattgttccctctggagtattttctacataatagccagagtgaacgtcagctaattcatatcatttacctctgtaggacttttccatgacttaccattaaacttgggagaaatctgaattccttaacctggcctaacaagtcctggcaccagtcaccaaatgccagtagtgcttgccatcattattgtaacaaccagaaatgtcccatgcatttctgtgtgcccctttaagggtgcttctgctcaggttgaaaaccactgaaatagattaaaagaggcataggaactttctgtttttgtttttgttttgagacagagtctcgttctgttgccaggctggagtgcagtggcacaatttcggctcactgcaacctccgcctcctgggttcaagcgattcccctgcctcagcctcctgagtagctgggactacaggcgcgcaccaccacacccggctagtgttttgtattttagtagagacggggtttcaccatgttggccaggatggtctcaaactcctgacctcgtgatcctcctgcctcggccttccaaagtgctggaattacaggcgtgagccactgtgcccggccaggaactttttatgttgtaaagtatcacaaaaatttaacttctgcctgaaataagttttccctgttattaaactagccattcctatcacatgctcctttaaaggaaatgaacaagtcaaatgactagaatgaagcaatctgcttgtttgaaaattacttctccagtttcattcccagaaacgattcagttttttttttttttagagatggagtctcactctgtcacccagactggagtgcagtggagtgatcatgactcactgtagccttgacttcttgggctcaggcgatcctcccacctcagcctcctgcatagctgggactacaggcatgtgccaccacacctggctaatttttgtatttttttttttttggtagagacacggttttgccgtgttgcccaggctggtctcgagctcctgggctcaagcaatccactcaccgcagcctctcaaagtgctgggattacaggcatgagcccctgcacttggccgacattcaatttttatgaataaaaactacattggaaactaaggtggtatgtttaaaatg

SEQ ID NO: 134582 - DNA, 1053 bp, Homo sapiens
catgtccagcgtttagtcagttggctaaaaggcgtctgttgtagagctgtgtttagctacgagtgcagcattatttgcagaagatctgtaagaaggaacacaaccaggatagtccctgtgcctcagtttctcctttgctgtgtgcctggcactgctacagggaatagggtggttctggaggggaaggtaaacagcaacttaacggatacatagcatcgcttcatgtactaagtggagtgaagataataaacagggtaaagggagagagggctgtggaatgcagaggtctggtggcttatgtgttagtaaaagcagaatctggactgtcatagggtaggcagacgttttttctttttaaagaaacctagttttaaagaggaaataacgtgtttttttaacttaggaaatgaaaagccatgttttagggttgagaggaagtaacaaattatatttttaggttccagggaagaaacaaatggaagccaattgctggtagaggagacagggctacgggggggtgggggattggtggcacagcttctgagacaggaagaaagaaggtaagggtgtgtgtaaagataagtttctagatatgggctaaacttgtatggtgacacttttctttgtgaaataggaggccaggttttcttctaaggcagaggaaaggggactaagggagtggcccctgagcaggcacgcagatgcgctgtgactgaagacccagctgctgtgacaagggagactgctggtcatatttgtgattttttttttttcctgcagcaatctttaccatcctggaatgtgagtgctgaaggtgaacggtagttgaaagaggagtaagttagcaggggaggtatgccagaaaggtggaggtggggccggagggcaaggcgtgtgaaggtctggccagaaagaggctgagcctagatggatagagaaggaatgcagccagcctcctggtgataggtgagacagaaggggaggaggtgatgcctggtgatctcggtgaggtcagagcagaataaaggaagaataaaggaggcagcaccctgg

SEQ ID NO: 134583 - DNA, 1053 bp, Homo sapiens
tttagatgtcttttgtattcacctgttactttcattttttttttgtttgagacggagttttgctcttgtttccaggctgcagtgcaatggtgcgatctcagctcaccacaacctctgcctcccgggttcaagcgattctcctgcctcagcctcactagtagctgggattacaggtgcccgccaccatgcccggctaatttttttgtatttttagtagaggcagggtttctccatgttggtcaggctggtcttgaactcccaatatcaggtgatccacccacctcggcctcccaaagtgttgggattacaggcgtgagccaccgcgcctagctcacctgttgctttctatttcgtgaatactaaagtaccctattaaatgatgactagttaattttataaagaaatcttactaaagtgaaaaccaaacaaactctttttccagtaggagagaagtttgctgaggaatgccttcaagcacaaagtgatgaatgactgccttcaagtctcaagaaaacacttttccctaacttttagagatatttcagccctttcctgtggcctggtcctatagccaaaatcacagatattcatgagtttctacttgagtgagaaaactgggtgaaggaatagaattttaaatagtaataactgcttgttttttttgtgcaagtacttttatacataagataaacaaaaaccttaccaccaaacataccaaaatgcacctctttcataagtgagttactaagatttctatacctggaatatcatgtatgtttcatttactggatgtttacattttaggaaggaaaatagttttgtttatttaaacaactgaatacttataaactgttgttcctggaagttatttattccataaaaaatttgttcttttgtcatgaatttataattcctaaatgaagaccagaaagtacaaattgctgggaggaagaataggctttattaatcaactgatgtcttgatttttctaaatgggaagattgctttatttttaacactaattatgggagcagattcttagcaaacttcttt

SEQ ID NO: 134584 - DNA, 1039 bp, Homo sapiens
cgcggttccgggggcgggacgcgccgaggagtggggcgcgagccgccggttttgattagtgcgcggagctgcggcggtggagctgctcggccgggagcccggcggcgagacggagaggcggcggaggtgcccgcgcgcagggtctggtgggcggccgcgaggctcgggagaggcgaaccggagcgcgggaccgcggtcgccccgaccagagccgggagaccgcagcacccgcagccgcccgcgagcgcgccgaagacagcgcgcaggcgagagcgcgcgggcgggggcgcgcaggccctgcccgccccttccgtccccacccccctccgccctttcctctccccaccttcctctcgcctcccgcgcccccgcaccgggcgcccaccctgtcctcctcctgcgggagcgttgtccgtgttggcggccgcagcgggccgggccggtccggcgggccgggggatggcgctgctggacctggccttggagggaatggccgtcttcgggttcgtcctcttcttggtgctgtggctgatgcatttcatggctatcatctacacgtgagtgagggaccgcaggaggggctcggggcaggggtccgggcctcggagacaggcgagaatgggaaacgtttgcgctttgaaggggactgggctcgggcgggggtggagaaagctgatcgtcaggctgttccccccgttccctcgcccctcggaccggcggtggcggtggtctttgcgagggaaaagtgttgggcgtgggaagggtttgctgggttgcaggcgactgcccagccaggctaaaggagactgctcttacgtgtcaggctgaaggtggtggcttggtttgattgtgctggggattcgtgtaatttttcatctgggccgagatgtatggtgtattgtttttttctcccgacctgggccacgtttctgttagggtggtgattgtgtccacttttctgggagctgctcacagctatctggacacctctctgtggattttcttcttcctggaagggctctatgcgcttagataggtg

SEQ ID NO: 134585 - DNA, 1685 bp, Homo sapiens
cacatcaagggcttaaaaaaaagaaacaactgctgcctgggtctcacccctacagacatggttaaattggttcaggcatcagtattttcaaaactccataggtgacatggatgtgcagcctaggctgagaatgattgccccaggctgtctgcccacagttgtgtccagcacctgccacctcttggcttcatttaattctccatttagcctagagcccacagttcatcacttcattatcttgcctcttgcctcacctcgtatcagtctgccctgttatcttgaatccatccaataattatagctgctcaactttgaaaatcctacagagggtaatcacacagccatgtggactaatactactacacattggtagtctcagggctcagctaaacctgcattgcggtgctgcctggcagtgcttttttttctgtgtttagctctgacatccatcacttaaaaaaacctcttctaaatcttcattctaccgcattcttggtagatgaccttagctcctacttcatactgtggatcccatcatgccttaaattagttttttctttttctctctttgcccttcggctagctcttcttgaatttttaaagaatttcaagtagtctttaaaaaattgaactagaggctgggcttggtggctcacacctgtaatcccagcactttgggaggccgaggcaggtggatcacctgaggtcaggagtttgagaccagcctggccaacatggggaaacaccatctctactaaaaatacaaaaaattagccgggtgtggtggtgctcgcctgtaatcccagctactccggaggctgaggcaggagaatcacttgaactcgggaggtggaggttacagtgagccaaggttgtgccattgctctccagcctgggcaacaagagcaaaactttgtcttggaggaaaaaaaattcaactagagagccaaggcggggaggatcgcctgaggccaggagttcaaaaccagcctgagcaatatagcaagaccccatcgccacagaaaaattttaaaaaattagccagaggcagtggtatgcagtgagctatgattgccactgcactccaacctgggtgacagagcaagattgtatctcaaaaaaaactagaaaaattaaactagaagccgtctgttccaccctttggccctttcactcactgtcaggtttcagtagaaactagtgtttgtttactgttatcacatttcaactcccattcatttactttttaaccgatttttagctgtctacccttatcctccatgaactgccccaattcttgccaaaagtgctcagagatagcagcaagtacatatgtaatctactggacattaccattcttaccttggtctctccagcagcattcagtgttattctttcttgaaccctttgagaaagaaaacagcctggccagataaacccttctgtcactttacttgcatcctggctgtctttctgcttctttgatccccacttttagtctccttcatgcattactctttttttttttttgagagggagtttcgatcttgtcatccaggctggagtgcagtggcacaatcttggctcactgcaacctctgcttcccaggttcaagcagttcttctgcctcagcctcccaagttgctgggattacaggcgcaccaccgtgcccggctaatttttgt

SEQ ID NO: 134586 - DNA, 1032 bp, Homo sapiens
tattcatggtgggaaatctctcttagcagttttcaagtaaacaacatgttgttatatactttctcatgtacttatactttatttgtggtgagaaatctactcttagtcattttcaagtataccatacattgttgttacctatagttgccatgttgtacaattgccattaaatattgactcatacttaactactaaggcaaggacttaagaattagaaaaagtgaaacagtgaattttcaaagataaatgatacagttttccttttgagaatggacagttttttcctaaatatattattatgaataatagagaatgttaaataatatgaaagtatgtttaattattaaatatgcaagtattctcatttctatcatgtatctttatactataaaatatttttaatgttgcataaatcttttactactgtacctttacatttttaggtggcaaaaaagttggcattaatcctaaaattaataatttaatgccaggatatgaagttgcaaagtatgatcttatatggatttgtgatagtggaataagaggtgaggtttttttcttatttattttataaaactattaatttgaagataaaatgctaaaagcaatctcagatacattcatgagttctttttatttgcctaaaagagtaatttatttcatcatcatttcatggtaatatgtccagttatgcttactaagattttgatttttttaatcctaaactagaatgttacatgtattaaaatgttttcattttgaagagaaaatttcaaccattaaattaaaaatggttgtggttcattatataatctgcaagctttcccatgggtgtaacttttcccttgtttgcctgacacttatctttaatgtgtttcggcttgcgtaatacaccgtctcacaaagggacagaaattaataggtgcatattttactaaaacacatacacttatcggactatacacatgactttttacttaaatgattttagcaagaagcctttcatatactgaaattataacttgcattttc

SEQ ID NO: 134587 - DNA, 1023 bp, Homo sapiens
gcacccgccgccacactcagctacttttttttgtatgttagtagaggcggggtttcaccatgttggccaggctagtcttgaactcctgacctcgtgatccgcccgcctcagcctcccaaagtgctgggattacaggcatgagccactgcatccagcctaaaatacttgtttttaaaggagatcactgccttgtgtgagaattcttttaaattttttaaaaactgaagtgtgttttaaatacaaattctgtcatgattgtgttcatgtggttcatggtttcctagtgtctcccatgagatccataatgccactttctgtttacatgtcttgttgtttggttagtagtcatcagagactaatctattaaatatggagccctctccattttttttcaaaatgactgcattttaagtttcttaaattgtaaagtaaggtgggtacagtttcttctagttcttagatggtgctgtcacgggccagcataattgctaaaacatccatacgtatggtagaccttaagtcatgtgctaatcatgaaagctgggctcaccctgaataccggcagttgcctggtctttataatgattactgaatgcataaccagttacgcttgcatgtgttcatcatcataacttattttctaattatcttaattttcagaggttggaggtttgcaatgtccactcaagttgcaatgcaaaactctggctcatattcaatttctcagtttcaatccagaatgatcaggtaaatcaactgttttctttttatacttcgttaaaaggaaagtggggaggggggtggtaatttttacaggtttaatgtagttaaatgaatgtacctaaaggttgaagatttttgtttagttgcagaaaatagagtttaacgtctgtgtttaagataaatttaatgtctaaatgtattttatttgctgtataacactgaaagcactcattagagaaatgttgagactgaattttttaatatgctgatctttattttctaactttctgtgctgattaa

SEQ ID NO: 134588 - DNA, 3566 bp, Homo sapiens
gtggataggcatgaaaaggttggcagtcccttggtggaactagaactatttcaatttagaaaaagttgaaggaaatgtatctgagccattcttcagcttcccattgtaggttagtctcgggtttgaacatgactttctctagtggaatgttgatgcaaaacttaagtcgatttgcaactttctattggttatataatcgcttttattaagtttccaaaaacatgaagttaattaaatcagtgagtattgaaactaataagacattaagatagcagttattttaatgcttcattaacaattagcattttcttgaacggtataacatggcagttaaattacataaggaagcagacttgattttacatagtatacttagaaaagtgaaatccaagaatttaattttttaaccttgtctttagtttgacagtgagtgaaattaaaaaatttttttttccattcctagggtggcacactgtgtttttcaaaacttgattatgcagtcgcctggttcatccgcgaatccatgacaatatacatttttttgtctgcattatgggacccaactataagctggagaactggtcgctacagattacgctgtgggggtacagcagaggaaatcctagatgtataactacagctttgtgactgtatataaaggaaaaaagagaagtattataaattatgtttatataaatgcttttaaaaatctaccttctgtagttttatcacatgtatgttttggtatctgttctttaatttatttttgcatggcacttgcatctgtgaaaaaaaaaaaaaacacatctgtagtcttggccaaatgatacactttattttgtggaagtagagaatcaagagaattggttctaggaacctgggttcgttcatcattgttgtttatttttttaaaataaataaataaatatatatatagatgctctgcaacaaactctgtgacagtatccttcagtagagaaagtttcttacttgtgagtacactcttttagaacatttacgggtggcagcagctttgctttagagtttagaagataatagaaggaatgactattcatgtccaaagtgaatggttttgtgcagtgaacaacacatggcgaggtactaactgagaaactttttcatgctttatgcctacctcttgtagttgttgcagagcaaatataaattgtaataagatagctaggccttgcagaaacaaacagaaaaacttaaaaaaaaatgatataagagctggagtctagtatttatatgaatctgtgagagataatttttttggtctcactgcaatgaaccaaaagcggctgagtttggtttttaattgtagccatgtattgaaggcatctttttgaccaactcttgttggttctgtcttgaaccattgttaatcactgtgctgtaattagtatagctaaatcttttccttccttgctcctcccccagcccaccccgtcttcccttaacattttttcagggggggttgggagtggtttcattttagtgtgagtggatgttttgatagttgtaaggaaaaaatgcatttcagacacatttcacacatgagctattttcttacacagtatgtcttattgttaataagaatgtaatttcatgatacaagtatttaataccttttttaagtcagtaaatattctagccatcaataaattgcagtagagtattaagaggggacaggatgagtttactcttaaaattaatcagtatcaaactaagtctactgtgtgtgttttttttttttgttttttgtttttgtttgtttactattatagtaagtctagtcttatttaaattggatttttgtattcaagtttatatgacaaaatagactagatcagcgctggttgtaaatgcatgctgtacctcactgttttctccccatcatgccgctaaacttgctcgccaggttgtgcttaacttgtggtgaactggacttgattctgttttgttttgtttttttaaaaaaaaaaaacaaaaatgtaagggacagtgcataagccttttctttgttaagtagtggtgttttgctttttcttcaggattggatggcatgttgtccacaggaatgcctactgcagggctaacactggcaatatggcagctttaaattctgagttactacagtctccatgtcaaagcataatgtgtagcatatcagcaataactacatatttatagaaaacactttttcactttactgagccaattcatttaattgtcaaatgtctatatccatggtttaaatggcaacatatctataagtatgtatacacattatatttaagcttttctctgggccaaactgcttcatccttttttctttctttttttttttttttagccttatgatgaatttgtttgaagggcattttctttatgaacaaaggcttggatgcatattcctttctttctgtgaatgggtattattccctgaggaaagttgcacagtgaaaaccagtctggttgtgacccactacatgttttgtttttaatcactattacctgagttgaactttgctcaccatgtttgtacttgttggtctgtttaatgaagtttggttgatgccatcctttgcactgccgaagcgtaatcttgtgtattacttagctctctgctgatctcagtatggacagtgtaacaacaaaaccaaaatggctggacagacttcttgtgttttgtaaatataaactaggacagttctgtaggtttgttcagtgtgctagtggagtatttccttaatgtaaaacttcacttaacagagagattctttgtttagcaagcttggagtgatgataaaatggtaagaaataatataaatgttgaagaaagcatcacaacagaactataggagtctaaatttaataaatctttaaaaaaaaccagtgtctagaatatataccatgttttattatttaaaatcattgtcttaaatttttgttcaaaaaataaaaatttgaatacaatcaaaacgttagcaatagtgtattttttgttcttctgtatttttataagtagcatgttccaccattcacatcagaattattagaagagttctgtcaagtattccttttgaaatcttccttttacctgagccataggtaaaataaataaggacataggcagtcctgtgacttaagtatggcttttctacattggttgcctgttaaaatcacctggagaacttgtaaaaaaaaaaaaaaatacacaacacacaccctgggccctgtacacaacacacacacacaccctgggccctgtacacaacacacacacacaccctgggccctgcccacatagattttggtgtaattattttgggtgaggcctgagctcttctacccgtgattctactgtgagaatgactggctcgtaatgacctttagaaaagagccagtggtcctttgggcccctctccccccgggctcacagcttgaactcagccttttagatcttaccactctaatggctagaaaatgtaaatccaaaggaaggaatggagtggcattattacttgagacccagatgggag

SEQ ID NO: 134589 - DNA, 1022 bp, Homo sapiens
tgatgcctgagggtcagctcctctagacattgactgcaagagaatctctgcaacctcctatataaaagcatttctgttaattcattcagaatccattctttacaatatgcagtgagatgggcttaagtttgggctagagtttgactttatgaaggaggtcattgaaaaagagaacagtgacgtaggcaaatgtttcaagcactttagaaacagtacttttcctataattagttgatatactaatgagaaaatatactagcctggccatgccaataagtttcctgctgtgtctgttaggcagcattgctttgatgcaatttctattgtcctatatattcaaaagtaatgtctacattccagtaaaaatatcccgtaattaagattgttcttcccttggttaatttttctgttactaagcgtcttctaaaaatgctctttgccccctgttagaaactgagatttggtggtagtgtagtagcaatgcttaaaacagtattgagcccatggctagactagagtccatgtgtgtttcaggggaggggttgccatagagggtgacacttcttttatctaaacttcagtaactatgaatgttactccattatgaactatgaaacattagatataagcggtgctggacctactgtgaatatgctaagttgacagctggagtctatttgattttacttttaaatcatgaattggcattctttcctcttttttttttttttttttttgagatggactcccactctgttgcccaggctggagggaagtggcgtgatctcagctcactgcaacctctgcctcccgggttcaagtgattctcctgcctcagcctcccatgtagctgggaccacagggcccccccaccacgcccaggtaatttttgtatgtttagtagagatggagtttcaccatgttggccagggtggtttcaaactcctgatctcagttgattcgcccacctttgcctcccaaagtgctgagattacaggtgtgagccacacgcccggcactaa

SEQ ID NO: 134590 - DNA, 1050 bp, Homo sapiens
tatggagaaaatgacaggtgactcaacaaaggatattcctttgctctatctgaccatcagggctatcagttttggaaaccaaattcaaataatatcataatgacttgtccctccatgcaaaagaaaacggcccataaaaatctatcaaatgtaattgattgtgagaggaccaacaaaaaatgtaacacgttgcatagtatttgtgtgctcaacaagattagctgttttctcccttgtaactttaacatggtctggctttacacttccttttcagaaataccttgtaactgtaatttcctgaggctgcatatccacagggccaactcaggggacacacaggcatgttgggcattcttgggattctttgttaaatggggccaagctctgggttaaaatggattgagcacagtggggtgtgtgcctcctgggaggtggtgatgccgtgcactctgggctaagcctgtggttttgtcccacagattcgtcactcatgctgctgcagatggcgggtgttggactgggttccctggctgttgtgatcattctcacattcctctccttctcagcggtgtggtatgtgagggtgtcatttttgagaaatgactggaatggaggggaggatgggtcagagtcacgaagaacagctggggatgaggggagtcaaagggagtgtgggtggaggttgtccttggctcagcagagcacactcagcggtgaaaggcatgactaaccctgtacctccaggtagcatgggggatgccttcccaggaaaagagcaggaccagtgatggctgccctggccacacacagaggggtggctgagcttccatgctgctccccctcgcctcctcccatgggtgtgcgtgtgagctgtgcatagagatgcacagtgggaaaaccaaagtgtgttcatatttgtctcttttcttttcctcctccatgtctagatggcagatggacactgagtggggaggatgcactgctgctgggcaggtgttctggcagcttctcaggtgcccgcacagaggctccgtgtgacttccgtccagg

SEQ ID NO: 134591 - DNA, 1045 bp, Homo sapiens
agtggctcacgcctgtaatcccagcactctgggaggccgaggcgggtggatcatgaggtcaagagatcgagacaagcctggccaacatggtgaaaccccatctctactaaaaatacaaaagttagttgggcgtggtggcatgcacctgtagtcccagctacttgggaggctgaggcaggagaattgcttgaacctgggagatggaggttgcagtgagccgagattgcaccactgtactccagcctagtgacagagcaagactccatctcaaaaaaaacaaaaaacaaaaaaacaaagaaagaggtttgtctcatagcaggtgctcaataaatatgaatgaatgaatgaactccccatgcaagggtctgatggacacttctccttttttcttccagttcatatcaggtgttagtgcttcccctggccctccaaagcacattttcttgtgattctgaaggcgcttcctccttctttagcaacgcctctgatgctgatggatacgtggctgcagaactactggccaaagatgttccagatgatgccatggagatacctataggagacaggctgtactatggggaatattataatgcacccttgaaaagagggagtgattactgcattatattacgaatcacaagtgaatggaataaggtatctttctttccaagctcttgtgaactctgtattttcttcttcgtatgacatttaaatgtttgaacatttattttccaagtatatgagagggtcactgcatgtaacaatcacaaaatgtttgtgaatactttgcctttatgaagaagggacaggtgaaacccttacagatgatatggattctgaaccacctggggaccttgctgaatcaacatttggactgacctggttttgtttttactcttaagctttacagatgccctcattctattgcactgctgaagtctaagttggaaagaaacatctagattctctgttaacttccttgtgcccctgccaggctgctgcttctctcattctcctgggaagccgaagattaagcacagcactc

SEQ ID NO: 134592 - DNA, 1038 bp, Homo sapiens
gcacacagtttattggcatgttgtgcaaccctcaccactgtgtatttccaaaattttttcatcaccccaaggagaacctctgtgaccattaagcaatatgttcccattccctacatgccccctccacccccagcaacttcttctgtctctatgaatttgcctatgttagatttttcatctaagtggaatgatagagaatctgtccttttgtgcctggtgtatttcacttagcatgttcttccacattgtggcatgtacagaataggctcctcgcttctgaaattaaaactttctttttgatagccctcacgaggacctcttttgtcctgctgtttacttgttccaatcataccccttttcttcttttcaacatgttttcagagcctcccctcccggaagtagaattttttacggtgcacagaggacctctaccacgcctcagactgaggaaagccaaggagaaaaatggaccaatcaggtcagtagctgtcctttctccacggttgcccagtgatccccatggagtgttttggaaactttgattttggtgaggagaagacttctgtgttggtggctgcacttgggtggttagaacaatgcagttggggcctcttttgtttccttgggtacagactggcctttaatcccaaccagcatcctttctaatggtgagagagacttcttttttttaaaatttaaattttattttttatttttttgagatggagtgtcactcccatcatacaggccggagtacagtgttgcgatctcagctcactgcaacctccacctgctgggtgcaagtgattctccttccactgcctcctgagtagctgggattataggtgtgcaccaccacacctggctaatttttgtatttttagttgagacgaggttttgccatgttggtcaggctggtcttgaactcctgacctcaggtgatccaccagcctcaacctcccaaagtgctaggattacaggcttgaaccaccacacccggccacatagagagacttctaaaggaccctatatacaagc

SEQ ID NO: 134593 - DNA, 1017 bp, Homo sapiens
ttcaagagattcttgtgtctcagcctcctgagtggctgggattacaggcttgtgtcaccatgcccagctaatttttgtatttttagtagagatggggttttaccatgttggccaggctgatctcaaactcctgacctcaagtgatccacctgtcttggcctcccaaagtgctgggattacaggcgtgagccactatgcccggtcccctgtgagttttttggtctttagaatttggtttaactatatattaggaacattttcttttattacatctctgattattgctttttttttttaaagtttgttttttgctcttcaaatacccctgtgtggaattgcttgttcgtccacactggtttcccattttctcctttttatcgtccatgtctttttcctctgccttctttgaatatataacaagtttgttctctatgtgcacttacacaaatatgcatttttgcattgacatttcctatctttaccatttccaatgcactttaaattctgctgttgcactttcatttccttttctttgggtctcatctagttccctttttatttctgcttctctctaccagtttcctctctgctgtcacgttcttttattatctaatcctttatctcttgtttgaatctatttttaaaatttttattgaaccgtatgaaacagatgctgcctaattttaccattcttttgctcaatattttcttttttataaatatgctcattctttgcctgccgagcacaattttcctttccttccctctccttctttgtagaatcattttgcagtttttcccccccattctggattacttatccttggaagataaaagttctgtctaggtctgatatttccttcataataaaatggatggccttccctttgatcctccttttcattggataatgttagtatgtttatgtcagatctcagtatgaaggatttactgctggttgggtgacccagtgtcctttgggcagcagctgtgagaaagcccaccaccccgtgcttt

SEQ ID NO: 134594 - DNA, 1002 bp, Homo sapiens
ttccagtgagtcagatagtatagattttgttttcttttctacaagtgatcacatttaaaaaagacaaattctatttgagtgtgtatttcttttttcaccagtgttaagactgaaatattgttcacttttccctgaatgagataagttagcattccttttatttttaaaacttccttttatttcttcccctctctcttctcttaggttattggtttagtatagcattatattaccagtttcttatttttaacatgtattatctctccaaagagctcactcttatattgatttatagaaaccttggtagcgatgatttaaccttgggtacatgttttaatagtttcagtgcttactgacagtcttttcaaaccacgttctctattatttctctatctctatttctctctctgtgtggtgatttgcctgctcctcagggagggaatgggatactttctgagtccatgatgatctgagaatgtcttttgttgccttcacatgtgaatgagagctcaattgaagataaaattcttgggtcataaacttttgttcttggaattctagaagtatttcttattgacgttgggaactggaagctttgaaagaagagttagaaggtgtgactttcttttaaaaaaaaaatcctggccaggtgtggtggctcatgcctgtaatccctgcactttgggaggcttaggtgggcggatcacctgaggccagggtcaacatggctaaaccctgtctctactaaaagtacaaaaattagctgggggtggtggtgtgtgcctgtagttccagctacttgagagtcttaggcacgagaattgcttgaacatgggaggcagagcttgcagtgagccaagatcgcaccactgcactccagcctgcgcaacagagcgagactgtctcaaataaataaataaaatataaaaaattcgatgtaagcaatttgattttcagcttgtgtatcatgaaggcttctttagccatgaaatttaagacatt

SEQ ID NO: 134595 - DNA, 1031 bp, Homo sapiens
ccaaagtgctgagattacaggtgtgagccactgcactcggctgggaatttgatttcaaagaaataaaaagctagatcccctttcgttcttcctgtctgcacaaccacttgcgggttgactgggaatgctgaaaactatgttacctcagggaaccaaggccttcatatggtttcccacattgctgaattcattagctggaatatatgcagaatatttaaaagaagcagaacaacccagaggaatcagtggcatcctgatagaccaggattaaatagcttcagttacaggagtcccagaagtacctaggaaccttgtggagaatttctttagtttgccccaacctgtttctgaggcatggtcctgtgtggtgagacatgtcattttccccctggggatagcagtgacttgaaggagtttcccatcattctgctgggaagagaaaggtggaagtaggtcttacctgtgcagttgcagggaaggtctcactgaggacccagctctgggcctcattccattctaccagagtggaatgccagtggcatccagtggcctgtcaggtgaatcacaggttagaattctgacctatatccaagctggaatctttcctttccctctaagtcaggtaatgggccacgctcattcatgatgaagagaagttgggtgattggcttgggagagcttgcattgcctgactcagtgtctgcctctgaggatgaatggtgaccagcagagataccagctatgcagagagactgatctcctttagaattttgctaaagcccattgatgcattttgtgagttgactgcctttttctcttttagaaattctgacaaagattaatgatgtatcactgtttaatgatacctgtgtgagatggcaaataaactcaagaagaataaaccccaagatctcatatgtggtaagtaaagtgatctactttttcctgctaggacagacacgtcacccatgggaatatgagtcagagggacttgcttccgtgagagcttctcaatctaattgctgtttttt

SEQ ID NO: 134596 - DNA, 1062 bp, Homo sapiens
gaaacattaaccatctctttggttggttgcttgtgtacacacaaatatattcattcttggaatgccttgggccattaaatacgtctaaaggtttgatgctgggaaaacatgatgagggccaaggggtcttgtgtctggtgaatatgcatgaaaagggaaccaaagctctgtgggcaaacatgggacatgagagatagacagggttggaaattagatgagatcctgctctgggaaacctccctcctggaaataactctggagtcctgcaacagcccaagcatccataatgggatgtaaaagagtgcagttgcattaaatccacacattctgtatcagaggctcatttaaaagaagccatctatttctaaggccaaggatggctgatggggatatggaaacaggttatatgattttctctagtttgaatgctgttatctcaataaaaggacttctgtttaaaaagcctggatgttaggagggcttaattttcttggctttctacggattggggagaaaatcacaaatcagaatgaatgcctcaagtttttttctttctttttttttctctgaccatggaagaacagattttttttttctttctgcgtttaggtataactgggactattggtgacacttgaaattattagagccatcttattttatagttattatactttcttgaataacattgtatccatgagtgctattgtgtgacatgaaacattagtatgctttacttcttcccttcaactcactgctctggttttattgaaataatttgaaaatttatttttattattattttacattgttcaacttttagttctagaatcctttactaatagttatgtcaagctctacagtcacatttaaacgattatggagacatccatacatcttgctgatttcattgttccttggtgttttctgtaaaacctgtctgccctgcacacttattcttacgatatttgttctgattcattttttcgatttttttttcccagaaaagataaacggatcgattttttaaaattctgaaatatctaaaaatgactttcttgg

SEQ ID NO: 134597 - DNA, 1049 bp, Homo sapiens
agcaaagcctgattctctagaggtggccagctctttaaggtgtgtaagttttatagattggtattatttcccatttcacagaggagtttaaggaccaggataaggaagtgacttactgtatgtcatgagcttatgcaccaagatgagagcccgatgcacttttctagaaggcagccccagtcagtgtgccctggagatgggaggtgatgatgaaaaagctggagggccctaggagaggggtgccaagacaaacatgcacgttcatgcacagtgtggtctaggacccggccagaagggtattcattgttgccgagtcaactcttcatcttttgagatttttcttagtagagcctgatttatctctacaaaagtggaaagagtttgaaaaagcttcgacataaattgtaccacaatttagtgcattcaaatgaagagtggcagataagcttcattacacggctgcctgtggaattttagtgctggtatggaaaggatcctgagaccacatccagacttagcacaggtgaatgctgtgattgactaatgatgccaccatgggtgagggaggagcgagtgagagcacatttaccttgtgtctgccatctgtgttccaggtgataggatgtttgctcatttgaaatacattttctggactgggcatgatggcttacacctataatcctagcactttgggagaccaagaagggaagattgcttgaggccaggagttcaagaccagcccggaaaacatagtgagaccttgtctctacgaaaacatataacattgtctgggcatgatggcacgcgcctgtagtcctagctgctcaggatgctgaggtgggaggatcacttgaacccaggagttcaaggttacagtgagctgtgatcatgccactgcactccagcctgggcaacaggggaagaccctgtctctacaaaaattttcaaaataaataaataaaaattaaaaaacaattaaatacattttctggcacctcacgatatactgatcttttaacacatttttaaaaactgcattgacttacccg

SEQ ID NO: 134598 - DNA, 1042 bp, Homo sapiens
gaggtaatgaatttgacattaatttattttcagaaatagactgtggtacccctcctgaggttccagatggctatatcataggaaattatacgtctagtctgggcagccaggttcgttatgcttgcagagaaggattcttcagtgttccagaagatacagtttcaagctgcacaggcctgggcacatgggagtccccaaaattacattgccaaggtgagttttcaaaaaatacaggttcccaattcataccaccttgaaactgttttcatatttttctctaaatttcagtttcagggaataaatgagttaagtaaacctttaaaattcctatttgtttctcatagattttcaggtgattttcttgatttttcaggaatagtatcatatcatctgcaaatcataattccattcataaatttttctttctttataatagttatgtttttctcttgattgatcactttgtatttttagaacaaagacttaaatggtagtgttgcctttgaatattatttttttattcctgactattagggaaatggtttgggtgtttcttcattcctgatgttagttttttgatgttaggtgtatatatatatatatattcccagaagtcatgtgggaatgaacatatatatatacatatatatacacacacatatatgtatatatatacatatatatataaaaacgtcatgtgggaataacatatattatatataatatacaatatatacaatatatgtaatatattacatgtaatgtattatatattatatattacatgtaatatatattatatataatacattacatgtaatatattatatattttttatatatatatatagtttttgagacagaatctcgctttgtcacccagtctgcagtgtagtggcacaaccttggctcactgcaacctctgcctcctgggttcaagcgattctcatgactcatccactcgagtagctgggattacaggcacccaccactacacccggctaatttttgtgtttttagtaaagatggggtttcaccgtgt

SEQ ID NO: 134599 - DNA, 1163 bp, Homo sapiens
taatactgagcttggaatacaaagctagaaccaaatataatgacacattaacatgattgatagggaatgtgccagtgttaggggagcacagaggaagatgcatttaattttccttaagaatggaggaatgggccgggcgcattggctcacacctataatcccagctccttgggaggctgaggccagtggatccctcaagctcaggggttcgagaccagccttgacaacatagggagaccccatctgtacagaaaatacaaaaattagatgggtgtggtggtgtgcgcctgtagtcccagctacttaggaggttgaggtggggagaattgcatgagcccgggaggtcaaggctgcagtgagctgagatcatgccactgcgcttcaacctgggcaacagagtcagactctacctcaaaaaaagaaaaaaatggagtagtggggaagacctcagagggaatgtgacattaagctgggtcttaaaatatgaataggtgctagctaggtagagaagaaggcataggcattttaggtatatagagagtattgtgattgtggcatgcgagtaggatagtagatattctgttagggaaagagtagttagcctctgacatctggcaagtaccatgtgtggttggggctcggaaacaatgaggctggaggagtatgtctggagtgagatcactaagagcattgactgtggcctagctcggtggctcacgcctgtaatcccagtactttagaaggccaaggtgggtggattgctagagctcaggatttcgagaccagcctgggcaacatggcaaaaccctgtgtctacaagaaaaaaaaaaattagccaggtgtggtgatgtgtgcctatagtcccagctacttgggaggctgaggtgggaggttcaccttctcccaggaggttgaggctgcagcgagctgtgattgtaccactgcactccagcctgggcaacagagcaagaccatgtcttgaaaaaaaaaaaaaaaagaaagaaagaaagacattgccacacagaggaagagatttgcactttattctgtgagaaataaacagccactgaaggtttttaaggatgagactaggtgtgtcctgtgttattttggtcttcaaattttggttcttcgttgtaaatgtccactaactacatgtgtct

SEQ ID NO: 134600 - DNA, 1066 bp, Homo sapiens
ctgctggttgatcttggtcacaccagaaagtgaacaggattgggtcgtgtgagccattttttatgaggaaaggttgagagttctttttttgttgtttgttttttgattttttttttttttgactagtcaagtacagtagtgagaagggggaaagagtagaatgagaagtttgatctgtaactgactgtccacaatcaattgagataactcactacctttggaccagcccaactgagagttcttgatggagaatgtcagtcctaaatttgggtgggtgtgggaaatatatgacaatttgaatagccctgcaaatattacattgctggagagagtagagtgctctctgtcttggagggatttaaaagcagagtctatgttttcatttctggattttttttttgtcagggatgttggaaaggagagaacatgagatttctcagattccttccacctctggaatttggtgcaatctcttaagagcaatgcaattttatatagtgttagagaccacttgggaatgctttttcttcctgagttttgggccccgttggcttatttcctcccgttgtttgatctgtctttccaaatttgacagacagaatctcaggaaggttgtgctggatttgtttggtctgactgtgaatggttgagggttaggttaaaagcagatttaaaatttaagcactgcatttgtgcttttttgttattgttgctgttgggtttttagagatggggtctagatttttggccaggctagtcatgaactcctgggtgcaagtgatcctcccatctcaatctcccaaaatgctgggattacaggtgtgagccattgtgcttggcctgcatttgtgcttttaaactaccttcttctcttgactgtgaacatctctttactgtactattaaagtccatcagctaatgtctcagaagtacactgaagttgttgctcgtgtattgaagtaaagagtgagagtgtttctcagaagctggcagcctccctcccatcctgagttgcagctttacttggttgcagtggagaggaaggacaggtgagcagggctgaaaa

SEQ ID NO: 134601 - DNA, 4902 bp, Homo sapiens
cacttatttgtcaagtaatatgatcttggaaaattttaaagaaaaataatcctacttataaactacttttttataattgttttcagaaaaaaagtttacagtcttaaggaaaatattcaggtctatcatatggtttgacagattttttaaaagttatttttggtaaggtcttcttttagaaaaaaattaatctcaagggttttttgtaccactataatctctaatacttactcagaattactgtgtatttacttaatttcttattatgtgccttattatgtgcttaagatacaataggttagagtttaatctaaatatcttgaaagctatattgtgggcttggtaagcattttgttttttctttctctgttttggtaaggatttaaaatttttttcattgcaattttaagtggttttcaataagtaatagtttttatcaaatttttggtgcttggtgcagagacggtgtggggaagggtgaatggttttgggaataattcagtgcacacctgtaggcctctttacattgtgactgataggggttattgcatatcaatttggggctgtagagtgcaatctcagtttcatctttttcacccatcagaatttgtctcaggattacttggtttttctcagtcctcaagcgagaacttgcttttctttgttaatgtgactttcattactgagtacccacgtatttggagtatgagaaggtgggttatttctcatactctgtccctctctttttcattgaatgtaagagtacattttaatgttgcttcagtgattgtataatgtaaaattgtttctttttaataagaaactttgctattatttcttcaattgttgatcagaattttttaaagcagaatttgtcaaaagggtcatttttttgtctaccccttttacacttttcagattctcaaagtgtctcatctcaacttttaaaagaataaagaatatcttgctgggcatggtggtgtgcgcctgtgcgcctgtagtcccagctacaggctgagcctgtaggcaggaggctacaggcaggaggatcacttgagcccaggagttcaaggctgcagtgcgctatgatcacatttgtgaatagccacttcactccagccctggaacatagtgtgaccccttctcttaaaagtaaaaattaagaaaatctcaatctctttgctgtattccagtgattaatttgaacatagggaggtttttacagaagaaattttaccaaaaaatagagactgcaagagatgatacagattgtttaaaaagcagaattcactcaccactgagcaacacttagttggtagaatagaaaggagggatactaagttaagacttttcaaatggatcagtttggctgaatagatagatatactcatgtatgtagttgtgggagtttttagttttttgtttttttacttatgaaataagttttgacctagacacaaggggtatatgaaggaggaaaaaaatttctttgcaaaatctcccaaaacttgcttttttttcccttccacacaggcactattataattttcagtgccatgttaaattggattatttcatttactttaagttaggaattactgtgtaatttattaattcatgattctcataacattcagcataagtgtagcaaagttgctaataacggaaggggatcatagtggtgttgaatgtaactttgaagtagggaatggccttttaagtctgagagagaacatttgaatccttttcagggatttgtgtaggggtgtgtttgtgtgtgtgtgtgaatgtgtgtgtgtgtagataagtgtatatacataaatacactcttctaaagttgtatatacatatgcacattacatacattttaatttattgacaaaattaaccaaattaagatttggagatgtgggatgttcttgttttaaaatagcatgtttgaaaccatcagtttgtgtctaaaattagctgtagcacatggatgttgtccatattaagctatttgctgtttgaattatagaggtctacagtatttgtgttggcatagtttttgtaaaaaaaagattaaaaaatatcaggatggtggaaaaactagatctgtgtatctctgttttggcatgcatttattcagtatcttctagcaatggtttttctctgttgatctaccgtagtatcctatttttaagtttattttatttttaaggagtattgtcatcacttttcaaggtgtcttgacttctacacaaagtatatatattcaggactttaaaaaatagcagtacacatttaacagtagcgaattacaccaaaatgatttactttgagatttgaataatttgcatagcagtaaaatgtgttttgtgtaacatacaaatagaaaaatgacccagtatcttaattgatacttactggagagtatcagaattacccagcagctcttacagaatgccataaattctttaagactaaatattgaaatcaattatttgaagtaatgtttctgatttactgttaaaagttgctgagctcagtttttggagatatcatttatgcctgcctgttcccttatgacagtgaggccttctttggctccacctagtatgataatcatgggttctgttttagttgatgagaagtggctcctatgaatgcctctgctcaatttctttttattttactttattttatttttaggggtctcgccaactcctgggctcaagtgattctcctgcttccacctccccacagtgctgggattacaggcatgagccaccacgcctggctctctgttcttttcagtgtctccgtgccatcagtcagcagtgcttacatgtttagcatattgtcatgcagtttctcttctgttcccacgagatatttttggacaaaaaattgacaaaagtacatgtgtttttccccacctatcccttagaaaacctaatgtgtactgctatttttaaaaccaaaaagagacagcgtgacgatgcgtaaagcatttttcttagcctttcctttgtcttgatctgttaatgagaacaaaactgccagactcaaaatactctactattgtgctgaaagaaatacaatttagattgcacaaaatttgaaaatataactcagctgtcttttaaaagagttgtgttgttatctacaagactattagcagtcttttttcagagcaaattttaacagctagttgtgagtggtttaaaatatagaaaattattaaaatcttagtttgaggggttttatagtgggagaaaaaacaggaccaaagtttatgtgccttcttcagtagtcttaattgaccttttcttcctatttgagactaaagtagtatcagtattctggttttcaggaaatatgtactatatagttttaaaagaatgttgtcccaccaactattcatccaagcaaagaattgtaactataaataaagtctcagttacacttttgcctttatcacataatattcattgtagagcattgtgcaggtccaagaatagagctgctcaaaatctttgtggtagtttccttagtttttgtaacctgaggcatatgttccagagaacagggatatttgtctggtccagtgaccttggtgatcatagtcataattgaaagatgcctatggcatgcttaaatcagcattgtcaactgatttgttgttgtattattttcacttcttggatctatgtagtagttgtaataacaaatatttaaatagctatttttttgatgccattaaaaaaatcatactctggccttttttcccccttactgttgtttcccagatcttttaaaaattcatcccatatccagaaagtaccagttataaagattgctgaccaagcaaagttttgcatcaaagtgtcacctcattgctctgaccaaagactgactgttgtggttttaactcctctctgtaaagcattttgcattttccccaagctcctttctgaaagaagaaccagtgcagagcggcctttactttcaatttctactgctgaatagactacttagagaaaatgtgagtttcagtgtgaacagaatggattaggatgacgagtttgatgggcattttcagtactgtatctaagaaaaaaaaaatagcacagctaggagcctctgacattgtctggtgttttacgtggtctgttcatcaaaattccccttttcagtttttaagaatgttcgtctaacagaagaaaatgctgtaaatatttgtaacaacattttttttaacaaggccaaaaaagaaaaaaaggtttttgggaacaaatgaacttataaagtggttttatataaaacatcaattgtcttgtatattttggataagcagcagtaccagctttcatttgtaacagtctgtggcattggaaaaaaaggagtctgtgattgttgaagtgaattatgttataaatgcaaagagaagataaaatattaaaaaacatattttctaaatgcgtagtgcatggttaattcaagcttctgtacactacagtatattccattttcgttcagtttgtatatttgctgactattacttgatatctctaatctcttttcctaacaaatatagcattgtagcatgccttttaataaatgtcatgacatctgtactctcttaaaatttttctgtgttcttgtctgtactttgggtttccctttgtcttacctgtaattctaatgatgtcctattttcttttcttttccatagccatccatctaaacgtgtcatggttagtgaatagtgagcacatattcaaacaatgttcaaaatgggaaaaacacaaaatctattaactgtctctgtcttcatttaggaataattctcgttttgaggagcaaagtgctttcctaatcttcctatgatgcaccttctctggcactgccccgtaa

SEQ ID NO: 134602 - DNA, 1017 bp, Homo sapiens
atttttcttgccctttatatacctgcacatgtcttctgcaaggattgagacaaaattccattgcttgacgatacatgtcagtttttgaacatctttcagggaacttccaaatcaagtctttgtcatatggcttaataattctgtttgaaatgtactctagagatttgatgattgcaagagttaatctgcttcacttgagaatgcggcccaggtagttgactccctctgatgttttcacagcccttctgttacagtggatgatctgaagaaccttttcatagaagctggatgttcagtgaaggcttttaaattctttcagtaagtctttgctttcaagaaatacattaaaattatttaatatggtatgcaaattttaaaggtagttcagtgaagtcttctggtggaggaaggagtttggaagcaaaattcattctaaatactttctgtatttcttataccattttcaggaaagatcgcaaaatggcgctcattcaattgggatctgtggaagaagcaattcaggccctcattgagcttcataaccatgaccttggagaaaatcaccacctcagagtttccttctcaaaatctacaatctgacttttctgtgaatttttctcctaaaactggaccataatttcagtaaaaccttcagacatagactgaagcagctcaagaccaattttgcctctttcacaaaaataactctgagtttgatattcaagtatattttaaaaatcaagggattttttttttttgtattccccctgcccccgccagtcaaaggtttcttttccctttttaccatggtttctacaaaaataaccttcaggaaaaagaaaatcaggaaaaaaattttttttcaataatcttattccctatattaaattagatttgaagaggattaacgttgttttagtttgggtccagatcagccttatacaacatttctaaactcatttgtacttttaaaaaatttaaacacagacttctaaaattacttgatgtaagtaattt

SEQ ID NO: 134603 - DNA, 1036 bp, Homo sapiens
aataaaatcaactgccattacagtataaataaacttattttcaatttttacttaaattgtcagacacttaactttgtgttaccctttacagcttatcacaccacatgggctttttatcctatttggtaagttcatttttgctattttattattgtctacaggtgtgaattgagcacatttcacttttttagtaatatgtattgattacttctgtgtgccaagtattgtgctgacactgaggataaaacagtgaataagacttagtaagtaattacagtgatgatttatagtatgggaaatataggttttgtaaagggagtgtaacgcagggagacctaacctagcagagggactcaatagaaatgatagttaagctgacttgttcaacatgagtaagaatcagccaggcagaaagggagggcaatgtcttcacaggggaggggagaggggagagatgggtcctggtgcatggaagtgaaggaagcccagtggtgagcataggcaagcataatggagacctggtgaaggtggacagctgcgtagggtcaaaatcgtgaagagctgttaaaagctttgttaaggaatttggtttttacctaagaacaatcggaagccattgaataattttaaggcaagagagtggtataatgcgattcaggttttaaaaatagtctccaaactttcgaacagcatagaaatatgagaacaatgaaataagcaatatttactattttaaagatttttattaaggacagtttatttttccataaaacatgattaacatctaatgagcagtatgattaatatgctttgatattactaaaaatccttgttttcattttgattcagtaatccaagggtagattatttcactacttgattttaatggttgtcatagctgaagaagataaatcataaatatatataatctaaatgcaggggtttcattgttgctgtacttcaataattatttcattatttttttcatgtaatccaccaatttttgtcatgttttatctagaaaagttagattttt

SEQ ID NO: 134604 - DNA, 1084 bp, Homo sapiens
aatctgaaatctaaaacacttctgttcctaagcattttggataagggatactcagactgtgcctcagaattaaatatgacatatatgtgcatgtctatgttttaatgaatgcctcagtacttaaaaaggaacctaaagctgagcatggtggctcttgcctgtaatcccagcacttttggaggctgaggtgggcagatcacttgaggtcaggagttcaagaccagcctggccaacatggtgaagccccttctctactaaaaatacaaaaataagccgggtgtggtggcgtgcacctgtaatcccagctactcgggaggctgaggttgcagtgagccgcggattgcttgaacccaggaggcagaggttgcagtgagccaagatcacgctactgctctccagcctgggctacagagcaagactcctactcaaaaaacaaacaaatacaaaaaaaggaacctaagccctgggaacactaaagccatgtgagtctgagttgggggcagttggtggtagtggtgggtaatatggtaaggagatcactgaaaaattttcttcacaatgttttttgagggttgaaggatagagagagggtgtggaatggggagaattcttagtaacttaagataatgctgtctgtcaatgctacacgcatggtttcccattattttagactggaatttcagatgcctttttaaggaatgcttaattatgattcttatcttgggaaacctttaaaaaattaaaaatgcttcgtatgtttattaaaaaaattcaaaagcgtagattattttaagtaaaacttgatattccccaaatagcactcttttctggccagtttagtgtgattccatacatacaagtaaatgtgacatgaagatgtagataccatgttgatatgtgtgtgcacgtgtgtgtatgtatataaacatgtaaaatacaggaaatacctttacatatttatgtgtaaccttttttcaaaatgtaacatgggtgttaattggaagcatttgaaacattgagtacggagaaggatttggtgacgcctgtaatcccagcattctgggaggccgactggggtggatcg

SEQ ID NO: 134605 - DNA, 1036 bp, Homo sapiens
atctcatctcaccaaaaaaaaaaataaaaagtatagtattgtcaaaagacaaaatcacaacacatttaaacatgatttgattggcttctatttgtgattctagaaccgagcaacacttcattctttaaaatagaatgaatattccaccgggcaagacagaacagttggtttttataaggtgggaacaaggaagtgacaattgttcaaaaagtgaatttgttaacattgggttattgcattttacttttctagtaagtgtcaaagcagtagggacttattgtgctgattcagataggccacgctctttctgattggttgctgtgaatctcctgttttcaggagaaactggtttgtttggggatttacctgctttactttgcatgagtgactccattttaatttgaactggtctgctggggtgtagtgcaggaggctagtccaaaataatgtcctctcaaaaagtctaacagtttattttaggtatagaattaatatgtggcttctttcataattcagaagagactgtaaagagtcttcatttgagaaggtaacaggttattcttaagatgaataaggaaacttgtttctgtggtgaccatgacaaaaaatataatacttgtcatgttgattttaataattgtatgtcctcttgttccaactcagaccccactggaatgaattctttagttctttgcaagtttttggctgtcctaaaaatcttttatactgtttattactgtaaagaagaggacaacaaatctaggccctaggtattttgtagtacattgtgatgtattactgtgtttcatctgcttttgataaataataggtttaagaaacacatggtaaatacatttataaataaatagattagtaagcattgggcatgaaagaggttggatgatgatgtctgagttccctatatttagtaaatcacttatttaatatcctcttaaattcacatgaggttactaagatctggagaagttaagtaacatgccttaatatttggcccttgttgtatttccacatttgt

SEQ ID NO: 134606 - DNA, 1603 bp, Homo sapiens
agataattgggtagatgaatggtaatgaatggttgtgccattcatttctattcgaatgtaggaagaacagagttggacgacacaggttcagatttgtatatattgagtttgagtttcctttggaacatccaaatggaaatgacagataggcagtgggtccctggtctcaacatcatgaaagaaatttgatagtatcatacacagttgacaactgaagccatggacatggagagtttcagagaagggagggtttctttatccagatgtttttggagttgtagggaggtggggatgaatggacctccttttccagaccaggagcttatatggtgtttgggaccatgggaacatagatgttcgggaaagtgaacaagtatagagacagaatgaaaagaactggatctaccaagctcattctagcttattttaatgtaactattaataataattctttttaaaaatgaaagcgttaaagcatacaggatactagaacaatggtacgaaattgtgacagcctcaggcaaactaggacttaacagtcattctatttaggtgttgttattaaaaagttaacatctgattctgtcacctaacactaaaattctgtttaggtgttgttttaaaaaattctcttagcttaatgtgggcatgtctttttccatgtcagctttaaattatttcatcgaattcaggggcgtccaatcttttagcttccctgacccacattggaagaattctcttgggccacacataaaatacgctaacattaatgatagctgatgagctaaaaaaccattgcaaaacagtctcacaacgttttaagaaagtttacgaatttgttttgggccgcattcaaagctgtcctgggctgcatgctgtgcacaggctgcatgttggacaagcttgatctagttctaaaacaaagaatccttcttccccgaacctttacctacaatatcttagggattctgataagaattatgttagagttatatgttaatgtgaaatgttgatcattttttggtattatctttccatttgggattatgacctatgattccatgtttttaggttctattttatgtcctttgacaattttgaaaaagttccacacttttccatataaatcacatagttttcttttaaaatgtatcttaggaattaatggcagagattgtttattgtgtaccccaatgctattcttttttttttttttttttttttaccaacagaacctcaatttttatctgacacattgctacccagatgaaactgctactcttctgttcttcattatagctagatgtggtcatgtaattaagtcttgacaaggtataagtggaagtgtaatatgaaacttttagggcatctctacatgggtacactgtttttccttttttttttttcctccaatcttattgcctgtgggtgttccagcttcttagataatgatgggaatgacaggcatctgtaacagagacagctagagcctgataacattgtcaccattccagatctggaattcctacatttagacttttcatgtgagcaagagattaacttcttttttttttttttttcttttgagactgagtattgctct

SEQ ID NO: 134607 - DNA, 1053 bp, Homo sapiens
gattaatggataaaaagttattgattataaagaatttggccagtatggaaatgaagtatattttctacttaaaaaaatacgttggtattgaaaagtcaggattcttagggaggactgtacaaactatttgcatacaaatatatgctacaaaaacaatgtcataatgcaaccccctaaatatggtttggcactttcagatgttatgttttggaaacctgcgtttggttagaaagaatttaaagattatgtccccatttctgtggtggcagttgtgtttatatagttgtggatttgcagtaattttttcttgctatgcagttcatttgattttgtgattcttgaggagttccccctttaatgtcttcatacaaagatgaagtaatattattagcttttaatacttttagtaaatatggaccattatctaaaacttggtttattaaccaaacattggttttgcttttcagcggggatctgatgagcttctttcttctggcatcattaacggaccttttaccatgaatagttctactccttctacaggtgtgtatggtgagttttttttttttttttaatatttgatttctgtgggtttcaaattgtttttttacaatgctcttattttgcttatatcatgttgaagtgccactgttcataacaaaagctaaaatttgtttcggtaaagtactatatactgtttacataggtgaaatcactagttatacctctcaaattttaaggattcatttggatctaatttgatgattcagttttttgattgatgttctttgtgttacataattttgataaaaatactgtcaataaattggtgacccagaactattgagtaaaagagctagatctaaaacttgggttgaagtcaggtgtggtggctcatgcctgtaatccccagcactttgggaggccgaggctggctgatcacctgaggtcaggagttcaagaccagcctggccaacatggcgaaaccccgtctctactaaaaatacaaaaattagctgggtgtgatggcgggaacctgtaatcccagctact

SEQ ID NO: 134608 - DNA, 1054 bp, Homo sapiens
tgcccggcctcccaaagtgctgggattacaggcgtgagccactgtgcccggccttcttcatgtaatttttatattttgaaatgcttattgggaaactgagacgtatttgctatttttttttttttctttgaaggcaggctctacctctgtcattgcccgggctggagtacagtggcacaatcatggctcactgcattctccacctctaaggcccaagtgatcctcctacctcagcctcctgagtagctaggaccacacccagctaatgtttaagtttttttgtagagacgaaggcctcaccatgttgtccaggctggtgttgaacccctggcctcaagtgattctcctgcctcagcctcctaaagtgctaggattacaggtgtgagccaccacacccaagcataattgctgtctttaattttgaattcttttaaatgaagaaccaactagatgataatgagtgataactgtacatgttttaagaactttattataccagataaatcaaagtgtcagactgtggataacatagcattttgtgtgtgtacagcttatactttaattattaactggctggcttattttaaacttgaatattcctcataatcctggttattttttcaaaatactgtagtagcgattagagtatgattttaagaaaatgacagtcttacatatcaaatatgttttagactttttctgggttttcctattttaagtgagtagatgagtatgaaaaactcacatatatgggaaggacttctagtgattatcatgcctgtcagtatatagaagagaacaatatagcatatttaaattaattttgaggattagttttctgtttgcttgaccaagggttggcaaactatggctatgggccacatttggcttgccacctgtttttgtagttttactgaaacacagctgtgctcattcatattgtccgtagctcctttcacactacaaaggcagtcgtagttgtagtggagactgcaaagcctaaaatacttactctctggccctttacagaaaacgtttgcctgctgctgtgctt

SEQ ID NO: 134609 - DNA, 1067 bp, Homo sapiens
tctttgaaaattttgatgtctgaaatgtgatgtttgtatttattttagttctgagagactgtcttaactatattttggtgagcaattttgggtggtaaatgcagatttgcaagatgccttctatttctgtaaaatccaagcactggttttgtttcatttaaaacctcagacacgattattcatgccagtgacttaaaagaacaaactttggtgattttaagttttggtttggctttgttaaatagaggtaaatggataaacactcatttttattgaagtttgactatactttcctaaatactaaaagataacaggatttgtttcttgcattggtagtaaggatttgcttttgcactctgctgttgctagactgtctcatcatttttctttgtattaatatttcacaactcatcacattcttatttttattatttgttattataatgctttttcccctttattcttactatctctgtcttttaaaaacttgttctctaactttgttttccattttctctttttactttttccatacagtgttgttacagatcttataacagtcggtttaaaggtaggaatcttttactatcctttcatatgcatttttatatcttttggcatattttcagtctcacctgttcataaaattatctgctttattgtgtaaaagtctttaatttttacttagctccaaaataagtagacctgaggtaactttggattttacgtatttataaggaggaactatagtattatgtgtataaaatgtgaacaaaaaatttagcccaaagtttcacttaaattatcaggatgctttttgtttgctttgttttagcagttaaatgtagcctaggcttaggccgggtgcggtggctcacacctgtaatcccagcagtttgggaggctgagaggtgggcgggttgcttgagcccaggagtttgagaccagcctgggcaacatagtgaaaccctatctctattaaaaataaaaataaaaaaattagccgggcatggtggtgcgtgcctgtagttccagctacttgggaggctgaggtgggagaatcacct

SEQ ID NO: 134610 - DNA, 1039 bp, Homo sapiens
gtatctgtacctacggattaaaaaaaaatctccaactcggtttattcccattatgtatttgaggttttttttagcttgttacctacttttgatgacaagatttctgtgaggttgtggaatatatgcaacttgctagaacagtaaaagtcgttcacatgttgccatacagttgatgatatgctatttgaagatgaaatcttccaacagcttttgacctcattagatttcatttattttagtttcacaatattaagtgtatatgacatttcggattgattcatttgaatgcagattgcacactgctacagacatcaaagtggagttttagattttattcatgattgtgatgttctttatttttatttgattgaagcttcaaaaaatttcttaaaattataacttttttgggtacacagtaggtgtatatattttgggggggaattgaagctgtttttattgtttgattgaagtttcttcgagaacattgttgaaaacttatttcacattaccttattcagttgcattttatatgttgaaaaattttgtggtcgtaaagatttgtgtcactaatattttggttcaggcaggctgtgaatttagcatttcattatgtgtagttaattgtctggaaggtttgacttaaataatggaagcaggctatttttttgtgtcgtaaaatgtatagttataataaagaggactcttgaattttgcgtctttgctgttaaactgtaggataactgtgaagtgcaaacttactttttgatagtgtttaagaagtttactctcccttcacgctatttgtggttttaaaggtagtaatgggtttattggtttgaatatgcaaggcagttatacagatactgactggaaggtaagttcatttggaagttcaagtcggagcatgatttgccctttgtatcagaaccaataaccatagtgttacaccattttattttttatgcagcaagcgtccagttacttatcacatttaaattttagacaaatgaatttcaagtttcagaagtttacaaggaaa

SEQ ID NO: 134611 - DNA, 1001 bp, Homo sapiens
gctctggcaattggctatatctccactgtgctagtgacaatcatgcaggtgctattttgaaatagctaccagtcttgcattggtagtggttagtcatattatctaaaggaagtatagccatgcattgcttaatgatggggatatgttctgagaaaggcattattaggtgattttatgatcgtatgaacatagagtatacttacacaaacatagatagtctagctgaccacatacctaggctgtatggcatagcctattgcttccaggctgtaaagctgtataacatgttactgtactgactactgtaggcgtttgtaacacaacagtaagtatgtatctgaacaaacttagacagaaaagagataaaataaaaaaacagtattgtaatcttaagggaccatgttgcgtatatgggccattgttgattgaaatgttaggtgtggtacatgactgtatttgtgaatcaactgagggttcaagagagtaaacgctttttttgtgtgtgataaaaagtctttcattaaaatgaaattgattattttgaaaacaggaattgatattctggtaaataatgccagtgccattagtttgaccaatacattggacacacctaccaagagattggatctgatgatgaacgtgaacaccagaggcacctaccttgcgtaagtttgcaagaagagttgttggggaggaagttgcggtgtttctcagggaacttacatagttgtaaacagatttgagccaaattaacagtgtagttcaaaatctagtcaatccttataagggtctaaaagtccttcattcagtcaatagtattttattttattttttatttatttatttttttgagatggagtttcattcttgttgcccaggctggagtgcagtggcacgatctcagctcactgcaacctttgcctcctaggttcaagcgattctcctgcctcagcctcctgagtagctgggattacaggcgcccaccaccatgcccagttgat

SEQ ID NO: 134612 - DNA, 1045 bp, Homo sapiens
gcaggaactgaggcacagattttggtggctgtgaccaggatgacagcagtaaaggtggtggacagtggccagattctgatatattttcaaggtagaaccaacagtatctgctgatggattgcctttgggatgtgagagaaagagtcaacagtgactccaagatttctggaaaatagcctggtgcggtggctcgcatctgtaatcccagcactttggggaggcccaggtgggtgaatcacctgaggtcaagagttcgagaccagcctggccaacatggtgaaaccccatctgtactaaaaacaaaaaattagcctggcatggtgacgcgtgcctgtagtcccatccactcaggaggctgaggcagaagaattgcttgaacccgggaggtggaggttacagtgagccgagatcacgccagtgcactccagcctgggtgacagagtgagattccaactcaaaaaaaaaaaaaaaaaaaaatttaaaaaaaataaagatttctggcttgagttactagaacagtggagtcgccaggaactgagatggagaaagctgcagatagagcagatggagggcaagcttaggaattgtgtggggtgttgtgtttgaacatccaagtggggacagtcattaggcagcaggcctggtgaatgagggtcaggagagcggtccaggttggagataaaaaaatctgtgggttatcagcatatagaacatataaaaagccacaaaactacatgataccatctaggcagtgagtagaagagaaaggactattgtccatttcaacattgaaaggttgggaagaagaggaagacccacataggagagtaaggtaggaagatgaaaggaagatgaaagaggagatgaaagccgactgaagaaggagcttggggagtgatacagtttggatgttgtctccacccaaatctcatgtcaaaatgtcacccccagtgttggaggtggggtctggtgggaggtgattggatcatgggggcagctttctcctgaacggtttagcaccatcctccttggtactgccctcacc

SEQ ID NO: 134613 - DNA, 1075 bp, Homo sapiens
gtgttttccacccagttctctccgtagaacatttggtaaatcctggggccaggcgtggtggctcatgcctgtaatcccagcactttgggaggctgaggcggacggatcacaaggtcaggagttcgagaccagccaacatggtgaaaccccgtttctattaaaaatacaaaaaaattgccagcagtggtggcgcacgcctgtaatcccagctactcagaaggctgggttcaatcacttgaacccaggaggcagaggttgcggtgagcggagatcacgccattgcaccccagcctgggtgacagtgcaagactgtctcaaaaacaaaaataaaaacaaaaaaacaaaaaaaatttggcaaatcccttaagcaatctggactttgttttcatcagctaagaaatgaaaggattagccttgataattgtgaagggtggtgcttgcttgttacttccatagttttattatttgatttggagttatgagtgtatgtgtgtgtgtgttttctctacagccatacacactgctgctatggatatgctgggaggacctggtatcgaaagccagtgtagaaaagttgatatcattgcagatgcagcatattccattttccaaaagccaaaaagttttactggcaactttgtcattgatgaaaatatcttaaaagaagaaggaatagaaaattttgacgtttatgcaattaaaccaggtaatgcttttatagtttttaaaagtagtgatacgtttttccatattttctgcaatgaacatatctgttttttgtgtgtgtttgtgtgattgtaaaatgaatgtgttcttttaaaagctgtcttcccaatgaaggaagaaaacccataccaacacaacttaaaaaaaaagatgaatgaaaaatagaggtgagttgagggcttttgaagtgatatatatatatatatatataagcacagaaagtcagatcagttactagccacttctaaatctcgaaataagaaatgaaaattattttttaaagttggtcttaaaatcacagagtaaagattttgttcaagaatatgtggtaacagatggtacagtagtg

SEQ ID NO: 134614 - DNA, 1008 bp, Homo sapiens
tagccatacataggagttatatttatttgcgctaaagtatattttaaatattattcattaaactgagcttctaaatgacacaaaccacgtttatatttgtatcatccctgctcatctctgcagttcaaactaaagtaaatagcggattatagttttacaaagcactcttatatgcattatctatttagcctgcataacaattctgtacggaaagtaatgcttagtgattaagaacacgaaatttgggagaagacaacccagcttcatattgcagctctgctgctcactgctatgcagctttgagcatgtcacccagtttgtctgtctcagcctcaatttccatattggtaaacttaagagaatgatacatttcatacaagatttttgtaaaggctaaatgtgataatgtataatgtgtttggcacagtgcccagcatatagtacactcagaatatttagtagttaatatttacaagtggaaaaacaggctcagagagattgagcctttgcctaagagcagatggctaataggtggcagaacctgaccagattcaggtcttccgggtcctggtacccaggaatataattattaccttaggttttaaagacacagtgtaattgtgcgcaagttttaaaattttatttaaattaaaaatcctattaagtattgagaacttaaaatgaccagatactatgatattaggatataacaaagatgaattcattcctgccctccagaagtttgcttaaacttctgaaaaagagagagagagaggcaggagaccgaggcaggaggctcatttgagcccagaagtttgagaccagcctgggcaaaacagcaagaccccatgtcaaaaaaaaaaagagagaaaagaaaaagagaacaattgagattgttaacatctcactgtactacagttttgaaggctttgtggcctttaaatcttctagtgtgcacatgtcttggagttatcagtgtaattaaaacagttaacctatttgctaacc

SEQ ID NO: 134615 - DNA, 1048 bp, Homo sapiens
tttctccatgttgcccaggctggtctcgaactcctgggctcaagtgatccacccgccttggcctcccaaagtgctggaattacatgcatgagccgccacgcccagccttggcctcacaaagtactcagattatagaaggtttgtttatgataaatatttatagtttagtagtattttttaacctaatctgaaagtcagccttttatttggagagtataaagatttacatttatagtcataattgatgtgtgtttgactgttattctgtcaatttgatttatgcttttagatgccacttaatgcatttaaagtcattttggtcaaataggtctaattggtggcaagtctgtcctgctgattaattaattctgtgtggggtccttcactgccaagcattaaggtcatttgcttcaataatatcttataggtgctgttccagaattcaaagaagagaaactgcagctgcaaccaaaaccacgttctggagctgtggaagaaacatttagaattgttaaggactctctcagtgatgatgttgttaaagccactcaagcaatctatctgtttgaactctccggtaaggactgcatctggtaatctgaagtttttatgaaacaaaatggggtgtttcctttggaagaaaatcagcgtccaacagtgatcccctggatagttggctgcattcaagacccttactcttgaatgtagacattcaagaacagcaaccataactattgatttgtttttgttgttgttgtgtctttgagatggagtctttgtcacccaggctggagagcaatggcatgatcatggctcacttcggccttgacctcctggactcaagtaatcctctgacctcagcctcccaatgatttttatttctagattaagatcagtgcgtacggacacatgtaaagtaaaattttattacaaatactcccagtgttatataactctggcatatttgagagaaaatcctgcttagaagggcatatggatcatgacaggtagtatgatacagtaatttatcaaccataggcaccttgcc

SEQ ID NO: 134616 - DNA, 1682 bp, Homo sapiens
agtctttttttttctttaaggttttagattgggactttaaaaaaaatgaacgtggctgtgatttttacaattatatgtatttagtgtgtgtgcgtgtgtgtgtgtgtgtgtgtgtgtgtgttttgaagtttaggagtaaagttttgttttttcccgaactcgttaggattcgcaagacggaatcctctcccgacgaaataaacagctaacaagccagtcaggtagtgacagcttccatggtggaggttaaattggagtgcaataaacaatgatctagctttcccttcaggctgaagcctttatttctgctgatttaagatatgagatctttccctacccatgagaccatgaatgtcagaattgagtttcccctctaggattgtgcctttactattttattccacgtatataacccaacgattgggttgtgcatggatatggatacagtgttttgaaaaatactgtagggtgatgtttctgaattgtcttatttgattagctagctaagtttcttcatgaacggttgctgtgtattgtagatactcaaataataaatgaggttgaataagcacccagaaaattaattttacagattcagatttttaatacgcaggtatggatttatgcctgtatcaatctcaatctactgctccgttctggaaactcttttttgcccaccctgtgagaatttatattgacaaagttaagtctgacagttacccaggagattaaaaaaacgaagaagcagttttgggggccatgcatacaattatatggacagtcatatgtaaaaaatagaggttttcctaaaaaaacaaaaagcattatcatctaaacttgaaggaaaaacgtggaaaattatgtatttaaattttcattaaggtttgaaaattagtaaacagtgtacaatttaatgcacttttttaaagacaaactgatttttgtcattataaaaagtttagtatgcttaaaatagtgcttttttctaggagaaaaatttatctagattcttgtcccagttaaacagattaatattattgcatgcctaattttgtaaatgcctggagcgtagatttgtacacacattacttaaaacctagcagtgatcaagccaatcctttttagttgataaaattttactagtttctgctttgacttccagtctgcattaggtaaatgaatttaaattctgcacagaagcacagctcagtatgtggctctggtaggcccttgactagcgttccttgtccctctccattcctagtaatagcccaaagagaagaggtattgaaatttgatcaggctttatcgtgaatccaggaatggagttctagaccactctcagaatttcagcacttagatatacgtactcttccttagctctttaaaatatttaaaaaagataagctaacgattgaattgcttgtttatatatttacaaggctgtcagtggtagtgataagatttaacaaagagtcactgtgtagctaagcatcgagtgtggcctgtactgagaattgttttggcaaagttgtagttgtgcctgttttctgagatcatcaatgtagtctttatgtgggctggctgaaagataacacctagttttgtttatgtttttgtgtttttttttttttgactgataggtagataagaattttttgttttttgtgtaattagcaata

SEQ ID NO: 134617 - DNA, 1009 bp, Homo sapiens
tggacagtgacctctcattccagcttttatcatcatcctgcattgtttaacaacagcaccaacaccatgctgcttgctgaaaatgcagatttcattcttggattaatattctggtaccagatgtatgaggctggctctaaagaagctttttctcttaagtactgtcaaaaatagagaagctgaagattggagagaagccatttattttgaacagtttattttctgacagtttgtgtttgtaaagaaacctgctcataatatttacttaagagatctacatagttgcctgaggaagccccacaggtttctttttttcctttaaaaaaagtttccattgagcttaactcttacgtgatacttcttgactttgcttctgattagttgatttatggactttatttactagcatgattggagaattcttttgctagactgaaattgcactctgcctgtgctctggtccgtttcctaggtaacaaatgcactgcatagattccataatgaggactgtggttggctagttactgtgtaaattctgttgtttggtaaagcttagtctcaaattcaaataaaggtcaagaaacgaaaagtactgaaaatgcaaatttttgaattttattttgtatccaatgccaacaaagtttaataggcttttctggagaaaggcaaattatgcagccgtattcaagtttgttttgcaaagtcttacacttaaacagttggagagctttttcaccgttagtgttcatagtggtaatgctaatggctctagtgacaaagaagatgtatttcagaaacatgttattacacttgaaaataatatggaaagcaaagaatcttggtctaggacaacagtgatattcttatactgaaaggaagtaacattatgtatcaaaagaaattatacaactttgatgtgagatataacattatgttttttagagacacagtcgcactctgtcacccacgctggaatacagtggtgcaaccatagcttactgcctcttca

SEQ ID NO: 134618 - DNA, 1034 bp, Homo sapiens
ggtacctatctattaagtttagtgttctttttagttttcacttcctttctgagttttttctttcctgttctgtcatgaactttgtcatttcttattgtacatcctcttgttatctggcaagattcattttttagtttttcaatttctgatgtatgctgttcttccatagcttctatcatttaaaaattttttccccttttttcatttttttttctttttgagacagggcctttctctgtcattcaaggctcaagggattcacccacctcagcttcccaagtagctaggactgtggatgtgtgccaccactaccagctgaattttttttttttaaagacaggtttcactttgttgcccaggctggtcttgaattcttgggcttgtgatcctcctgccttggtctcccaaagtgctgagattacaggcatgaggcactgtgcctggctattttcttaattcctcttattccttttgaaatatgttacagttctcatctttttttcttactgtgctttttaattgttctctcttggtcatatttaaattagatggacttacctgtacttttggagaaggtttctgtgatggagatggaaattgataaatacagttttcctggttttatagtttgaagatttcctcctttgttgcttatctgaagtattttaaaaatatggccactcaattaaaataaaaatgaggtaccattgtacactcactagaatggctaaatgagaaagatgaaaaataccaagtatgaggatgtaggatagctgaaattctcctgcactgctattcaaagtgtaaattggaatggaaatgtaaagtggtacagcaatttggaaagctgtatggccatatctactaaaactggacatatgctgcaaatcctgtgactcattagttctactgtaagatccatactcacccaaatatatggactagaatgctcatagcacatttgtcattgctccaaactgaaatctgttgaaatggccatcagtcattgttgttcccttccgcagtgagtctga

SEQ ID NO: 134619 - DNA, 1035 bp, Homo sapiens
atctttgcacaagatcctggagttggagaccttgtaagatcagttataagtaaggtaagggagaaaggaaaggtgaaactgtttgggagaagctggtgtggtatttttatagtgggcagatctgtcagtgggacgtctctgattgtgtgcaaaaaggcctggatggtaattcctacttcctagggtggttgtgaagattaagtgaatcagatgtcatagtgagcatgaactgcttccccacagcaccctgcatatagtcaactctcagtagatacctgcttgaaaagcgaaagcaaaaatctctgggagcccaattcttccagatatttaagcagtcttgattcccacacatcctctcaatcttcagcatgtttaaaatttctctttacactgatcctggcacctgtgctttcagatctgcctttgcatcttaagaaatctctgcttgagcctgccactcctggtccctgtttccctcttttcttttacgggtttctcagataaatgggttacatatactgtctcttctgttttcattaaatcgctttaattccaaagaattctgctgcttatacctctcttctactcaaattctccatgtagctaaacatagaaaatggacacataaacaacaaaatgtactgtcaggtgataataaatgccatggagaaaagcagttcggtgtagggggcatagggagtgccaggcatgtgtaggggaggtttgctaatttttgtacagtagtctcagagagcttttctaataaggagacacttatgcagatctaaaggttgtgaagaagcaaattgtgtaactatatggggagaacagcattccaggcagccagtataaaatccctgaggtggggacaatgttggtgcatttgcaaaaaagcaaggaagatttttacagatagaacagagtgatcaagcaggggatggtgtgtcaagagaggtaggcaggtagaggtagatgtggcactgagagcatgtggaaattatctgctgcttgcttctgtttcctcagcaagaggga

SEQ ID NO: 134620 - DNA, 1416 bp, Homo sapiens
tgcaacctccgcctcccaggttcaagcaattcccctgcctcagcctcccgagtagctgggattacaggcatgtgccaccatgcccagctaattttctatttttagtagagacgaggtttctccttgttggtcaggctggtctcgaactcccgacctcaggtgattcacccgcctcggcctcccaaagtgctgggattataggcgtgagccaccgtgcccagccacttaaagaactttttcctaagaaactgtagaccacctttgctatcctctagtatttcatgcttcagataagggatcttactcttttttagtgctttatgcctaatactccagcaatagtcacccaggtttcaccttgtcctgtttaatatctcttccacctctaagtagctctgggcctgctttcctttcacctgagtcacattttatatctgtccagtcactgtgctgtatagatctacctggtgtatacgcctagcctgggtctttgttggggccatgattctctcctccttggtttcattccaaggatgtgattggcttgatatatgtgatcattctcattgcttgctttgaccttgggtcctgaccctcattgacccagttgggaccaattaccttactttcacttaccatatctacttatttatggctccatccttggttatagtcaaaaagctcagcccctttacccagccctgagactaaagctgggcaagatgaatgttctaaagtcctagttgagaaggtctcagctcagtccccagtgggtccttggaacagcccaggataccagagcaggtgctcattcccattgtgtcgaccctaacatctgacatctacctcttgggttacagcaggtgaagtagaaatttgaatccacatggcccagattgcttttagaatggatagtgggagtactctcaagttaacaggtgtaggtagcttgaattatcaagatacagggctatgcgatgacaactgggcaatgtcatttctacccacagcacagctagataccatcatagcactcatcctcacagccacccctcagaaatggatttcttgtttgcacttatgattccttatttgagaagtggtattacattcaaatgctagggattgagggtggttccattaggatgctgagatttttcagttacctggaaattggttgtgttcattttaaagtactaaccagccagcctgggcaacatggtgaaacccttcctctacaaaaaaatacaaaaattagccgggcgtggtgatgtacacctgtagtcccagctacttgtggggctgaggtgaaaggattgcttgaacctgggaggtcaaggctgcagtgaaccgagatcgtgccactgcactccagcctgagtgacaaagtgtcttattaaataaataaataaataa

SEQ ID NO: 134621 - DNA, 1082 bp, Homo sapiens
catcctctcaggaccataaacactagaaatacattctctcctggaatctatagcacttgacctgcctataagcatacaaatcttgggaaaatgagaatatcctgcagttttcatttattcataatggtatgttcccagtaatggggaagtagactgattctggggaccaccagtggtctgttcattgcttgaataattttgctattcctaatgatgccattactcctgctttatcggtgtttattgctgcaattattcatatataaaaataattttgtctagtacctattatatgaagggaaatctattacttagttcttttttatgtaattttctagtcctcatagaatttcataattttactttctctgaatgagaaaagccacattgtgtccttgattattgttactgttttgcatacttattacattgcataaccaaaatatgaacagacccgcaatttactgaatctgggtgagcatagaagaggaggaataggacaaagggattcaggggcttttagggttcttggaagtgaaagaagttggaaagcttcatttatattctttcttcttcttcttcttcttcttcttcttcttcttcttcttcttcttcttcttcttcttcttcttcttcttcttcttcttctttttttttttaaagagatggggtctcactttcttggccaggctaggctcaaaatcctgggctcaagtgatcctcccatctcagcctcccaaagtgctgggattacaagcatgaaccaccatacccggcctttatgttctttattctgatatatttccattgatgaattctcccattccaatcattgactgtcagtggtcttagtgtctctcttagtccgtttgtgctgctataacagaataccttgaaactgggtaatttttttttttcttgagacagattcttgctctgttgcccagactgaagtgcagtggcactgtctcggcacactgcactctccacctcctgggttcaagcaattcccatgcctcagcctctcaagtagctgggattacaggtgtgcaccaccacgcccagctaatttttgtattttt

SEQ ID NO: 134622 - DNA, 1065 bp, Homo sapiens
accattctcctgcctcagcctcctgagtagctgggactataggcgcccgccaccacgcccagctaattttttgtttttttagtggagacagggtttcaccgtgttagccaggatggtctcgatctcctgacctcgtgatccacccgccttggcctcccaaagtgctgggattacaggcgtgagccaccacatccggcctagactccactttcttgagaaggcaatattgacataaattatttggcattcttctgtagagtggtctgttctctcccatttatttatttatatcaatatgaattcttatttattttatactttggattagaacccatactactttgttgctcaaattgctctagctttagctgctgggagctctttgaactgactcctgtgtccctttgttgtgctcccatcagttcgttttctgaacattttcttattttctggtactattaggtgctcaagtatctatttttgaaaatataaataattttgcctctgattttctacagaatttgaaaatactttgatgtgcttatatgagtttggactgttgaacagattacattttttcattattggattggttttattttttgtagtgatttatatagctacttctcataggtgaaaatatatagggttacagattttctctgaatgaatattgtatttatgaccacagttttatactttcaattttttaaaatataacttttacttcgcaaatcatattagagaatttttacatttctctggctttcagagacatttatggttgccagtagctgaacggatatcattatgctggaagtgtttcagtgattatatattctgagtggtaagattgcttagtctaaaaaaaggactccacaatatttggcttttggttgtaattaccagtcatgcttgccagaaattaagtttagcttttagaagcctagaattcttaatatgtttgtctctaactaaatatttcagagactgttatgaaactgtcagtaattccattatatattttatgttcagcttattctgagttacagctgatgaaatgac

SEQ ID NO: 134623 - DNA, 1031 bp, Homo sapiens
tataaaaagatgttcatgaaggcacttacattagttaataattagaacaggctgggtgcggtggctcacgtctgtaatcccaacactttgggaggccgaggcgggcggatcacgaggtcaggagtttgagaccagcctgactaacatggtgaaaccccatctctactaaaaatacaaaaatcagccgggcatggtggtgtgcgcctgtaatcccagctactcatgagactgaggcaggagaatcgcttgaacccgggaggcagaggttgcagtgagctgagatcgtgccactgcactccagcctgggcgacagaatgagtgagactccatctcaataataataataataattagaatagagctaaacaaaatgtccaaaagtaaaggattggttaattataatatatccatcattaaaaattatgtagaaccatggttctcaaatgcacattcttatattggctacaaacactagataaaaacacagattcccaaacccaacctcttggtcggtgactcagaatctctgtggtttagctaagaaacaggtcctgtattttctaacaagaatcctaggtgattccactgcacagcctgatttggaagaaccctgggcagtttcattgcacagcctgatttggaagaaccctagatgatttcactgtacagcctgatttggagccactgttacagtgtgtgcattggctcctagtcagctgagcccaggggtcttaaaaccaaatgaaatgacaactaagaaaaaagagttaaaatctgtgaggactctggaaaacaagaaaggaggacttcagaagaactaaaaacaaaaatactgcaagaagggaaaaagattgaatcagattctgacgacacagaaaggtaattagtgctgagcacctaacacaagtcaaagaaaagtcttctcccctaactttatcctcccagaaaaattagtgggtgagttcttccaaaaggaacatagactgtccccaaactggagcagcaaggcctggtttggaggtggtaggcgt

SEQ ID NO: 134624 - DNA, 1072 bp, Homo sapiens
cttcttttgattatttccctttaggagtgacactgctgatcctgtaacatggaggattgtcttcatacctcatctgagaatctgtccaaattggtcagctgggcccatagccatgggactatttgcagcctcattccaaacctgaaacacttgctttctgaaggttcccatgggaacctgacagcaatgtggggctgtagtgctggccatgcttatcactggccactaacagctacttgcagagctgggtcccaagagagggtctgtttccaggataacagaagttttaactctgatagtcccagtataatcggggtgccctctgagacacagactagccctgttgaaaggtaccctgggagaccagtgaaagcaaagctagactgtaaccggaccagagactcttgtgacttctcctactgtagtgagccctctgaactggatgaaactgttgaagaatatgaagatgagaacaccctgtttgacatggtttgtgagtcttctgttacagatgaggatagtgactttgaaccccaaacccaaaggcctcaaagcattgctcgcaaaagacctggggtagtcccatcttccctccattcaagctcccagacgcagatggttgacgaatgcagcaatgatgtcatcatcaagaaaatcaaacaagaaatccccgaagattattacattgtggcaaatgcagaactgacaggaggagtagatggaccagccctgtccttgacacagatggcaaaacccaagcctcagactcacgctggtccctcctgtgtagggtctgctaaactgattccccatgtcacatctgccatcagcacggagctagacccacacggtatgtctgcatccccctctgtgatctccagaccaattgtccagaagactgctagggtatctctggcttcaccaaacagaggaccccctggtacacatggcaccaaccaacaggtggccatgcaaatgcctgtgagcacatcccatcctaacaaacagatcagtatccccttgtctgccctgcagctgcctggacaggatgagcaagttgcctctgaagagt

SEQ ID NO: 134625 - DNA, 1026 bp, Homo sapiens
tagtcatagaaagatagaaacaatgactgtgttacatccaggtgatactatacaggaaattcataagaattatggccatatctagttgacgtaccttagggctgagaggacagctgtaagattgttctgttgatattgcagcgttagatttaaggttgatacctgtcagctgaatttttatatagtaaagttatttttgaaagttttaaaaatatgcttctccatcagtagcaaggtgtttagttgctgtttgaagccaaaataatgttgggtaaggcatatcatgacaatagacctaatgcttttcgtattatttatttgactgagccaacttgacgttgctattcattttagttgctctggtagttaataagtattttaaaaagcaatgtacatttctaaaagaggtatttgatcttttctcttaaaatttaaaagaatatggaaacttgcatttctggaatctgtgagccaatgggaatggattgagaggagaatgaaataattgtacgaggcccctgcacctgtaattctaacgttctaatgttctttaattctgacattcaatgtttatttaatctgggccattagtatataaaggggttggatctcatgctttggcttcatgactcaattctagtaggctagaatagaaacgtggacaaggatgaacaaatgtgcagaaatctgtggcatgttttagtttatttcagcccttctcaaaaacgtcgtgtattttgggaaaagcttcctagaaacctgaggcccctgtgccttcatcctgaaacgtccttggattaagttgctttacaaacttcttttttccaattttagtatcaactttaagattcccaaagaagacctttcatttatgatttttttgaagacatagtcatggtgttattaagaagatattcactgaaaatatttatatcctgattgaagattatgcttttcagtttattcacttttatctttttttaaataatagttttattgagatacagttcacatataaaattcact

SEQ ID NO: 134626 - DNA, 1126 bp, Homo sapiens
ctgtaatcccaacactttgggaggccaaggcgagtggatcacctgaggtcaggagttcaagaccagcctggccaacatggtgaaaccccatctcttctgaaaatacaaaaattagcccagcgtggtggcaggcgcctgtagtcccagctattcggcaggctgaggcaggagaattgcctgaaccccagaggcagaggttacagtgagccaagattgtgccactgcactccagcctgggctccagagcgagactccatctcaaaaaaaaaaaacacaaagaaagaaacaagactaaaatttattttcttagccatttcttaaccttttcctgtagtttcctgaaggaagagctgagttataatttttgaaaaataagagagacaaagtaaaaattcagctttttatttttgccatcattttcttccttatcacaaaccgggtacacatctgaagattgatatggcaggcagctctgggctgagagagtggagcctggccacccggagcttagagtctgatgtgtttatttatttttatttttttctcagatctcttagagatgaatagaatcagatgtatttgagtttattccttactctgcctcctgctggccttgtgaccttagctacgtcatttcacttctctgaaactcagttccctcatttgtaaagtaatgataatgtctgcctgtcagggttattgtgaggaccaaatgcaaaaatataggtaaagcactaaagagagtacctgacatatgataaacattcaataaatggataatagccgcctttattaatatttttattttcatcatcatcatcattagattgtgctcaatactctgtgagaagtgaagtagattctggtttcatgtagttacacccatttgtctactaaaatatggtccgtggaccagtatcaccaccagcattacctgggagcacattagaaatgcagagtttcaggaggccgcgaggaaagaccaaaaatgctgtgtctgcccagcctcccccaagccctcagtgcccagggccagatctgggtgcaggagcggagattaataggaaagtctagagccttatttccctcactcatccaggaagtgaaccttggaactgatctttgg

SEQ ID NO: 134627 - DNA, 1033 bp, Homo sapiens
cactaaatagtttatggtagttactcctgaagagtaggaattgaaagagttttgaggtgggatactttttattctatgtacttttttttggttttaatttttgtaatgatgtgtattgccttttaaaattaaatttaaattaaaaacaaaatctttttacatgacagaaagcaaaggggctcacacatcccttttttgcaccactcaatgttattgtcagggttccagctctgccacgtagtggaactaaactgcaggttctgaatatacatcagtaacccccttgaatgtgaaattcatgcagcttggcccataaccagttcccggccacgaactaaaaggccacggagggggtcagtgaaagctgaaaattgtcttatacaaggtgatggcagatttaacagcagctggaccacatgcccaccttttaggggggcttagattactggtctaaaaactaacaacatttgaaagaattgttccataattggggtggataaagagtttatgtctgaccagggatggaggggtgcagtgggactatatttgtttttttgtttttgttttgttttgttttttgagacagggtcttcctctatcacccaggctggtcttgaactcctggcttcaagcagtcctcccaccttggcctctgaaagtgctgagtacaggtgtgagccactgagcccagcctatatttgtagagttagtaagtaaaacaagttgtcaagatccagagatgggcagaaactaagggcttcagataattcttgtgacagaataccctcctcaagcaccaactgcaagggagacttgtctgttttttgttttgttttgttttgttttgttttgttttgttttttagacagcagagtcttgctctgtcacccaggctggagtccagtggcatgatcatagttcactacagcctcgagctcctgggctcaagcaatcctcccacctcagcctcctaagcaactaggactacaggcatgcactaccacatctggctatttttattgttttttgtaga

SEQ ID NO: 134628 - DNA, 1187 bp, Homo sapiens
ttggctattatgaataatgctttgctatgaatagtcatatacaggctcttgggtggataggtttttcaattatcttggggatatacctaggagtgaacttgataggtcgtatgctaacgattttaactttttgatgaattaccaatcaaattgttttcctaagtggttgtgacattttacattcccaccagtaatgtatgtgggtccagtttctccacatccctgccaacatgtgttgctatctgacttttgattataggcatcttagtggtgtgaagtggtacctcattgtggttttaatttgcatttctctaacaatcttgagcatctttttatgtgtttctgctatatttaatataagagttttaaaacatagggacatccatatattttcacttaagttagcagtgatcaatattaatattttcactttacctgtgatacataaataaacctgtttctgacctccttcatatctcaaagtgattgatagaagcagaattttattaatttccatataaaaggacacataactgtgacaataatagaaaaacaattagatacaagataatccataatgaagtgacgaagctatagcactgagttatagcactgagtgataaggctcaatgctctccaagatagtcacacagtgatccattgcggtgccagcagaaaacattagatttcctgatttttatttaatctaagaaattaagctggccgggtgcagtggctcacacctgtaatcccagcactttgggaggccaaggtgggtggatcacctgaggtcaggagttcgagaccagcctggccaacgtggtgaaaccccatctctaccaaaaacacaaaaattagccgagtgtggtggtgcatacctgtaaccccagctactggggtggggtgggggtaggcggagctgaggcaggagaatcacttgaacccaggaggcagaggttgcagtgagctgacatcatgccactggcatccaacctgggcgacagagtgagactccatctaaaaaaaaaaaaaaaaaaaattaagctttactaacatttaatatattgattggcagtagcacttatacatagtgtaaataaatatacatattctggggctgttgtttgaaagcattttttttttttgagacggagtttcactcttattgcccaggctggagtgcaatg

SEQ ID NO: 134629 - DNA, 1079 bp, Homo sapiens
tgatccgccttcctccgcctcccaaagtgctgggattacgggcatgagccaccgcacccagccgaaaacatttttacatatggagtatacagtaaaaaaagctgggacctctaggacaacaagtgaaatgaccgattatagttgagaatttttttaaaataactcaattattacttaatttttcacccttcatttagcagggaaaataatacctcttattctagagtatactgtttctatgaatctgactttagagtttgattcaaagaatataaatatatctttttaaaaaatagtacctaaaattatattttacagaatatttttagtctctaggatatattattaagatttatgttacaggttactagctttttaacactttgtatactgttagaattaatgctactaaattattattctgtgttatggaaggcaaccatctcataattgaaagaaaagctttcttttcctgttttgcctatacttataaatgagtatagaatgctaatccatataggaaaatacctaactttttttctctatagtgtcatggaacaacataatttttattttataatgaacttctcaaaaatatgtgttgctattgtccactgacccacttagaaatcagcatcctcctatccattaggttattacttcttgggtggaatttaatgaatattaatagcctaactcagaagagaagcaggtaatttattatagctttgtgcatttccatttttatgtgttatctgttttccttttgctttatgtgccatacatcttttgtttcaaattgattaataatacctttttgtttttgatttgtactatgcatttttagtaaaagatgccttcatattttgatccttactgattaatatatgcaataaatgtagatatgtaaattgagtaaatttaaaggaaggaatggtttctaatcaaatgtttgtaataactatttctgttgtggtatagtaacagtatttcatctcttaaaattcatcagatgttatctctaatgttttgttagagtttgttctcagtcattgcagccataaaatttcagcaaactt

SEQ ID NO: 134630 - DNA, 2086 bp, Homo sapiens
acagacatgcttaaaacaatgcctaccatgttgagatgctgaatatgtttttgttgaatgttgaagcaaatatgcaaatagtaaagtttctagaaatgaaaaaggagatcactttcattttctttgttttcttttggctttatatttttcttatatagttttagtgtttcttttctgataatcaagttaattcacttatttaacaaatattaactaatgagtgcctgctattcatttcttgaaccatggatgaaacagtggggaaaaaaaggttccttgcattctagtctgggctcctcacagagcttacttaatgttatagacgttaatcaagtagtcatagaaatagataattataaattgttagacatgctgtggtaggaaaaagcggagaatttgttggcataaggagaggataatggaagatttttttttaaggaagtgacatttgacctgagaatgaaggatgagaggtttggaaatggaggccaggagtgtattcctgatgaggggccagctcgtgcaaatgctttgagagcgaagatgccttaagatactgaaaggaaagcatatttgaaaacttgcattgaggccactgtcgttggcatggaggaaaccatgtgagcttattttcagatgcgactggtgaggtgaccagagccttgtggattgagatactgaagattgaagtttcacttaaggacaataggaattcagggaaggaatttaagcaggggagtgacatggacaaactgggaatccagaaagctcatacactcaggctgctgtgtggagaacattttgaatgagggcaagagtgagcatagggaattctcagtagctaaataaggaatttctgtgtcacccatggaaaataaatccaatgccaaacccttattcaagtcttaaaatctgtaattttatatgatcaaaaggaatacatcagaaatatccaggcattactatgttaatagtagtttttctcttggaacatgtcacaaagcagtatatcctgagaaaaaacaagacacacaagaaaactgaagtgtataattaagacagaatggactagactcttggtaattaaagagtactatttttaggccaagcatggtggctcacacctgtaatcctagcactttgactttgggaggcctgggtgggaggatcgcttgatgccaggagtttgagaccatcccagcctggataacataacaagaccccatctgtacaaaaaattcaaaaattcgctgggtgcagtagcgtgtgcctgtagttccagctattgggaagactgagacaggaggatcgcttgagcccaggagttcgagattacagtgactgagccactgcactctacccttggtgacagagtaagactagagcaaaaaaaaggaaagtaatattttaaattaaaattttgcattggaaagctatgcatcacagtacttccaatggctatctttggatgatagatttaccaacagtttttactttcttcatactttttgtattttgtggggaaaattttatattaaccatatattgcttttatgataaaactaatgaatttatttttattaggggaaaatgcatcatgtaacgttttccttatgtgtatagtgaccctttaaacttttttaaactaaagtttattcctaaattagaagatgcttatatacagcagatttaagggttttgtaaactcactgaagtgaaatgcagtcatagttgaatttcttctgaactgtgaaaggactcatttttagctttgaaaatgatttaatgttcaataaaaactttttttctgaagagtcagatattgaaaacaatggaacaacatgtataggttgttgagataatgcctgtttagaatattctgtgctgtatactaatggagtcattaaagaatgagctgaaaaggagagccatatgtgcaaagctgtggcttcatggctgaagctgtggaaaatgtaaatgtcacatctataatgaatccatgtgtcttctacaactgccttaactcaaggaaagtgagagttaaaaaacaagattctttttggaaattgtatatgatgtcttgtat

SEQ ID NO: 134631 - DNA, 1046 bp, Homo sapiens
agcatgatttattacattaattacagtcctgtgggtttcatgctgctaagccggcaaatgcagctacattctaaagttgatttaagaatatattttggccgagacgaaagtgcttcttattgtgattaatatagtacaatatttattctcttgttctactcttctttcaccttggctgtagcacagaatgcttaatttcttttctgtgacttggaactggaattcacttttagttttgaggagcttcatctagttatttatccgcacctgtcatctggtctcctttttgcctttttgtgtcttggtagattcacctaatgttgcatctcctccacgtgtgaagcctgtttgaattcactcccttctagcacagcagggctgtcctcaggcttgttaggtcacacctgcaatgttacgtctctttttgaggggaaggaaccattgaggaaaaacttcattgttgtaatttaatttttaaaaagtagcattcttaaaggggagcattctctgattctacccttgtttagaactgtactgaattcatacagtcacatagtgtctcttcttacagtgacacaattagcttatcaaatcacagaattttcagctttatggaatggacggtctcctaaaagctgttttagatatagatattaactctggttgttcacatatgtccatggcaggatattcttttatattaaatacatgaatgcctgacttcagtagcctttgtagaatctagcttggaataattagcaaatatttgccagaaattaaagtagcaatagaggaggagctcgggctaggtaggaagactttgatttcatgagttggaacacattttctaagcagcagtatgtttaaagagttgaactagatgacttatatgtccaacactgagctaagtggcttactttcctattgtatttgatcttcatacaactcttaagagataggtacagtttatacccattttacaattgaagaaaccaaggcttagtttacagcactttcacagatttcacatagctcattaagtggca

SEQ ID NO: 134632 - DNA, 1040 bp, Homo sapiens
agacaacatcgtaacatcagcataatctcttttttaaaaggaggttgaagggagagtgagggagctatccattggttttatgggttatgttcattctggtatggactttagttgaagtattatttgcttttttccttattctgttagtaagataaagatattgtcttgtagtaatttgtgtgatggccaacgggtccttaattcctaaggaactatccctgggagaagcttccagcggcctcataagtcattttaataccatttttacagatgtccacaccaccttccctgactctctgaagggtcctaacaaagaataaggtgattatggaattctcactgtgagtcccaacatttaattttatgccactcacttttgtttttaatgctttctaaatacaatcagtatggttggtctgaagtggataagtgaagtgaagttgtgtaattacacatggagttatctccgtaacctccctttctgctttggtgttaattcagtcaacaaatacttattgaatcctactacttttttcaagtgcttttctagaccctgggaataaagcagtgaaacctcagctcttttggagctcatggtccattggggagagatagacacaaaacaagtaaacaaagagatgtatggaagaagtaacaaatagatgtatggaagaacttaacagcaaaggaagaataaggaatgttagaggtagagaaatgggtgttgatttatttttttttaaagcaccttattcaagtgtttggcatttggaggtttttgcatttaacatattcagtctcttctccttgcatatgtattgatattactataaaaacatttcatgtggctatcccattggtctagctttattcccctaccccaaaatcaggattggtgtcttacagcctatgagcacaagccagactcattcccatgtctttccctttgctcgtgcagcttcgtcctaagatgccctatcctactgcccttcctaaacaaatgatacccatcctttaaaaccaacccaagtcccacccag

SEQ ID NO: 134633 - DNA, 1067 bp, Homo sapiens
ccgtgagttcctcatctccaagtatccttctgaaacaagagagatttatgtcatcccttgcaaggagttggatgcctaccttgcctctttctttgttgatgccaggcagaaggatgggtccgaatacgaacccaacagcttggccaattaccagtgtgggctcgaaaggtacctgaaagaacacaggtatggctatagcatcaccagggataaggaattcaagcgttcccaagaggccctgaagcagaagcaaattgaactccgctgtaaaggaaaaggaaataagccacacaagtccatgaagctcacctttgctgacgagctcatcctgcggaaaaggggactgctaagccgatataaccccgagggtttgctcaacctagtctggctcaacaacacaaaagcttttgggcattgcacaggcttccatggatctaccttaaaatggggtgatatccggctccgggtaacagagacgggtctcgagtacttggagtggatgggtcaggacactggagacttgaatgccaaaaccaagagaggggggacagactcccgtgtgtatgccacccagcacgccccacagacctgccctgtccaggactataaggagtatgcccagcggcggcctcccgccatgcgctacgaggatgcccctttctacttatccatcaagccagtcgtgaacctggcggctctgcattggtacaactgccaggcccttggcaagaacaagctggccaagatggtgaagaccatgtgtgagaagggcaacatccctggcaggaaaaccaacttcagtgtgtatcagagctgcagcaccttgtctgaggcccagagcaaccagctcgtgctgatctgtaacaatctgagccagcaggctgcccagtcagtggccggccactccaacaatggcaatttcatcgtctccgcctcctatgactcttcctcagacaccgcttgaccaggtggcttgagcaagactccagtttggttactgtgtccggagaaactgtgattatacaccgcttctcgttccccttcctgtgccctcagtgttaattcac

SEQ ID NO: 134634 - DNA, 1062 bp, Homo sapiens
tggttctcaggcaacacaaagtagagagggaattctgttttttaaaaactgtcaaaaaggaaattgagagtcatcctagacttaacatgcttgcgtcctcaactcctgcttttcgttcccaccccaactccccttttttgtctccttaataaatggctttatttttttaatttttaaaattctatattaatcaagaggagacattaactttactgctgacgcaaaactgtattcagctagatccacaatatgaaaatgtataagctcaacatcaaattatttacatcttctcttttttaacttaattagagttttagctcctgtgcctcattttttacaatgtatgagaatctagatgtttagctaacatcttttctttttggggggaaagggtagaaggagggaataaaggtgccattctttttgggagatacatgattttaaaataatacccaaagtctaatattttggctaaaaagactgttacatagctcattttaactattgtgcttgaacctggaaagaatgtttctttttttgtccctaagaaatgggtataaatgaagtttgacaggaaatttaaagctaccaaagctttgaaaatgttgccaagcattagattgcctataaagaaggtaaaaggtggaaagtcttactaaaaatctagaagcagtagtcgagacaacaaaaaaactcatcctcttcaaagttcatattccctgaattatttacttagaagcattaaacagtctcttttctcctgaggcaagggtgtgtattcgactctgtgattgagatccaaggaatattggcactcattttaggtaacaatattttgttaccagattttgctgaattcaaagcattcttgaaaatgtgcgagatttttctatagtaaatataaatgcgtttatctgtgatatcctgcaattattataataattttggttaaacatttgtggcagtttttccaaggtctttgttttcaagtcttgatgcctgtggtgaattattagttaagatatttcaaaaataaaataaatttagactttagagccacaa

SEQ ID NO: 134635 - DNA, 1030 bp, Homo sapiens
aaaaggatcaaatttctatcaacataattaggaagtttctgaagtaaatttatttagagatagtaaaggggaaaaatggtaactaaggaaagaggcctacagtaagtagatgtagaaattcaaacttacttaaatgcaaattatttgtatttctcatcttgcttactcttctgaaaaggaactcaagcataaatatttaaacgtttcacaaatttttattttacaaatcatatttaccagatcatagttgaaaaagttcaaattttagatgttttttaaaaaggtacagtgtgatttgtcttttttttgtaatgttgaattatgttagacttctaatgtttgtcttgatattacactggaattagacagcatttttaccatttatacattcatttcaataagagctttgaaaatgctttggcattgtttgtttgtgataagtagaattaggaagatatcagcaatatagattcctaacagtaattgtgtatactgtgttttagtgatttttatgtccatttattttctgtaattcttttataaatcccttagtgtacttccactagaaattaatttataattgtttatttatattggatgaagtaggaggtccatgtttagtattaacccactcagattaactttatctaactgaacttttatatctataacccattagattgttacaactttttaaacagcatttataatgaaataacttttgttttataaagcatttgttacaaaaaaaaaaaaacaccttgccaaaaatcattacgatttctatgcattgtgtaatattcagtgatgttgagattttgcatgttgttacaggtgctctttcatatgtgtgtttgtggtgttgatgtggaattgttaaccactgctgctatcacttattgtagttaaactgaaaaactgtgttaaaaggctgtgccagtcaacatttctatgtgtgacttaagtaactgtgtacttcattgtttaatattttgagccagcacttagtggcctctacagaaggaaatat

SEQ ID NO: 134636 - DNA, 1383 bp, Homo sapiens
tttccaatttctcccacaattttaaatgttttcactgccaaagttagcagtagatttgctaggttaatgccatggtcagtaatagtttgtaccttttatgttgtagcctgaaaatgtaactctaaccccgtaggcctgaaacctggtgggaagatgattgaaagtgttttagattcaacagattgactatgtatgacttatctattaaaatgaagaacttccatggtttaatagaatgaatgctgtattcaacaaggtcttccatccttcttataaatcttaagactgtgtttaagctttctttcacttttactctatcccttggaagttaattgggaataaaaagatttatcaatttagtcactataatttaaggccaggcatctgcttggaaatacaataaccacaattaatacttagagaaaattgtttcaacagattaactctgctattttaaaaactatagtagtgttctttgaggatgcatttacttttccccaaatttgatagatagttatttttatatattttttctggccacttggcttctaactgattaacatgaaaaacgcacgtgtgcctgtttcactcaaatcatattttacaactttttaaaagctgctacagttatagtttgtgaaagaggagaaaggtgaattgcaacagagggaaattactgttactgtgtcaaatatgtgactgatgcttttggtcagataatctgctgcctgtcaatatttgtaataacagaattttttgttaagagtactctcatctttattttgctgctcactgattttttacactaagatgttctcatctttgtcgactcactgtttttgcttcatatttgtctgtgtacttgtgctctaaataaaaatctagttttatgtctagtttattccattgtgtgtataatgtttgcctctgatgtagtgtaattttctattgtttttgatgtttgttggtacagcctaaaacttatggaaataagaaaagcaatccaataaagtcagctaatgagtgtcaacagtgtctctataatgagagcatgcttgagtcacagtgttttgtctgtatttgggcatgatgaccagtcttcattcatttaatgaattgtcttctgcaaagctggctgatttttgtagctacaacaaacaagttaaaccacgttttgaaaaacatgttgttgacctggacattgtgcactggcctcaggatatacagtcaatgcagatgagccaagcagcccatgtgcagtgtttctcaccactgaagttggggggaagccctggaaggggaagcattgcgcatgtgactgtgccaacacagatcatagggtagcaacaatcctttagtaaaggatctacagttgaattaatc

SEQ ID NO: 134637 - DNA, 1092 bp, Homo sapiens
atctttgttgcattttcccatataaatgaatcacccttattaaaacaggaggagggagggatttgtggtgacctaccgctgccctccctttctaagagaagaggaggccatggggtatgataactaaatgaacatctctggaagttcctccgtctgatatgtgtattctgacataacagaatttcccaagacttctttgaggaaggctgtccacgcttcaggcaaagtttacccattattattatgattttgaatattccttgttcattacagtccagaaaatctgcagaagttctccatgttcagtggttgaccagaatctgattgttgcgctcaattaaagtgcttattatttagctaaaacaacttatatggaagttaattatttcaggaaatacataataagaccaaaaaaatcactggataatatgtagatatattttagttccattactattaatagcaattagataactctccctccccccattgaggtgagaatgggctcctagatacttggtggtcaatagaactgatttgattaactttcatttaactgtggttattgttacatctactgattttttcaaataaaaatttctagaaggctcagatttgactaagactgtgttacgtgctttctcacagctgccatatattctcatgtaatctttacaaccgctctacaaggtatgtctaattatttccattttacttattgagaatctaggctcagaggagttaaaattctgaaaatctcaccgataagttggagaatttaagtttgtaagttggagaatgcaggttttctgactccaaatctagtgctcagtccatgagacaaaactgcctcctggaggccatggaagtccattaactttaagaaagttaaacacagttttggtttgtttggcaaatatttcatctctcaagccatactgtgtcacccctccatgtattctcttactaaatgattgctcacttgggaacttaatcgatcctggaaagcctggcggttccccagtattttctgcctactgggaaccttctgtctttatccaataagtaatttatattacctgtcatctacct

SEQ ID NO: 134638 - DNA, 1051 bp, Homo sapiens
aaatttaatattttctatggggctgtattttccaaataatagcaacaaaactgtcctaacgttttcactgttctgtaattttgttttaatatagaggatacccataatttcttaacactggaaacatcattctgaacgatgtaggaagcggtcagtaacgtgaatgatgttattgtaccgtctccagctttttccttcttcccccagatggtcgcacctgtgcatacatccctgtgcatgtgggggcacatgagtgggaaagtgggtgtcactcctattttctgtcctagagtgtcagcgttggaagggatttttttttgttcctccagtccggccctctagttgatagtccagtagtctgttaacaatttgtaaggacctgggttatattttaaaggtggttgttgttgttgtttgggttcacttatgtatatgcagcttgactgttcaacccagatttttaaacaataaaaagatttaatgtatactttctgttttcttagcttagttattttaacttaatcagcagcatgtctggtttctgaatagttttttagtgtcacattcctggaggtaatgtttgtctttgtagtttgcgatgttaggacatatgagaattccacacccatattctgtgcctctgagccaatcctctgggtgaaatagttgttccagcagagttccctctggttttctgactgagatttgcctcactgggcaggcttgaggtcccatttgggatggtgtcatggtgattttatattgaccatcatgtacatgccgctaattaatgtttttctgctctttaaatgattatttatggcttttggagactacatttaattctcaaaacttttaatgtagaaatttactgttctgtatatagagcagttaaaaaataatttctaagaaacagcttctgaaaaatatttccttcttttttttttttttttgatggagttttgctcttgttgcccaggctggagcgcaatggtgcaatctcggctcactgcaacctccgcctcccgagttcaagcgagtctcctgcatc

SEQ ID NO: 134639 - DNA, 1019 bp, Homo sapiens
gatattttacactgtatcacagatacagtattttatataactttttgtaactgaccttatcttggccttgagtcccatcctctctggtggtagcgtaaaactgaaaattccagtttgggtcaatatttagtgaaagttctactttcttttcagagagtttgttcccccctttcttccttagatgttttcaaacacacagccccatcctactcaaaccaagtgaagcaagagtggacaattctagaattggctgtgccatgtaggttttttttagaatttgaactgatttccttcattttgatgaggtggcaactgtccccattgtaatggtcaccattgcagcgaggatagccttacttctgcggcgcagagctcctcagggggcctctggctcctgtccttcctcaggtccatccaactactccttgggcctccttatggtagccctcattgtcttgagttgatttcactaggtttctgttctctgtcatctgcaacataactgacatggttctaaatctgtctctaaggagataacacattagtatattttctacactattgaagcctctacctaatgtatgacttttgtagctcaggtaaagagatctttttaccagtgttatcgtttctagtctgtttgttagtcttcttttaaatagatatggcctaaatcctgtattcctggctaggaagcacttctctccacccctctgctttgagttacaaattcaattcaatttcctatgtatttattaatacctacagataaagtactgtgctttgggggacacaaaggtgactggtacctgctcttttaggaggtcaccgtgcagaggatcctattctggtacaccaatagttataaagcaagccacagcctaggcaacatagtgagacccctgtctctactaaaaaattaaaaaaaaaaaaaaaagattggctaggtgtgctggtgcatgcatagagtcccagccactcgggaggctgaggtgggaggattgcttgagcctgggagg

SEQ ID NO: 134640 - DNA, 1050 bp, Homo sapiens
gaaagaagaataaccaggatgatgagagctgtggaagctgtatcgtccaaggaattgattatgtaccgtgactgtaacttttttgtaatgctgtttaactctcaatcagactgtgaactggatggtcacgaagtcattccccaactcctagcaagtttgactgaatatatcatgtccacagtagattttcaagaatcatttatagtacttaactttaaagaaacaaggctgcttttaaaaaatgaactaataggcttaaatcaattgcatccatatttgctgtttataggattgctatcagtataccttttgcgtttatagtcaacatgtatcatcctgaaatattctttctggacttataactacttccccctttttcactttaaaacaaacctcaagaataaattactaaccagtcttaaccatcttttataaacatatgctcttataaatgttgtgactagatgcaattaaaaataatagggaatgtggtaggtttttaatttgtacatcctcttatttagtgttaccacataaatgatgagtttgtgtggttctgttttccatttttgttctaactgaaaactttttggctgggcacggtgcctcatgcctgtaatcccagcactttgggaggccaaggcgggcagatcacttgagatcaggagtttgagaccagcctggccaacatggtgaaaccctgtctctactaaaagtataaaaaattagccatgtgtggtggcacacgcctgtaatcccagctactcaggaggctgaggcaggagaatcgcttgaacctgggaggcaggggttgcagtgagctgagacggtgtcactgcactccagcctgggtgacagtgagtctttgtctcaaagaaaaaaagaaaaagaaaacttatgcaagtcgagctcctttttaattaagtaggaagggattaggttaagaaagtctctcaacatgacccatctttagcagtatctggggtgcttatttaagtatgcagtcccactaccctaccctagtcctacagaattagaatctgattcaaa

SEQ ID NO: 134641 - DNA, 2191 bp, Homo sapiens
ttctccttcttcttctcctcctcctcctccccctccccctccccctcctcctctcccttcctcctactcctcctcttcctcctcttcttcctcttcttcttttttaatgaattatcttatccaaatagagggagtctgctattactagagtttgatgacatagcatgggtgggcagagaggggaaaatgggagatgatagaaatgaatgtgccagaggtttattttgcccagaatcctggccacagacagtatgctaatgcctgattgaagaacagatttagctgaaaacactgcaaaaggagtatgaatactccttctacagcctacaccatccctagctagtctctgctcctctcccaaggagaggaaaaagtttgcatcctaccacctaattcttcctgtttataatcagtataaaattcttagactccttcatgtgggtacccttaggagtgcctaggtctgctctgcttggaaaatgtgctttcctcccatattcattcttctggcctaatgattccagtctcctgagccatcatcgtccttatctttttttttttttttttttctgtagttctgttttccagtcctttaatctttctttttgtttttctaaattagggatcagaaactcaaattcttacagataatgtaaacaaggtgataaggattgtaatgagctggagagtgcccagctaaaggggacaactatttcttagttctggtgaattgttgccgtgggggcatatagatcacttgttgccagatcttgagatatatttcaagagaagctaggaatctgagaaattagtgtacagtttctcaatgtttacatgttagtatttaattctgatttttaaaacatagctaggagttgctactgggccataacttggcaacctctaccctatatcttacgtaagtttgaagctgaaaatccagcccagtattaagtatttgacaaaggccatatctctttgtatcctgtcagttacgctccatttctttctcagaattgctttctggtcagttgaaattctttgacatgttccttgaaaaattatccaacatatctgaatggaagcagttgagaagaagaaatattttgatctgagtatgtttactgctttttccccccatgaaaaaggcatgcagaaagaggcttcaaatagaagactaagaacatctgccctcccaaagattgactcggcaggatagagactgcacaggcccctgcagcatttgggtcctcaaagattttgttaaaaaacaaatgctgtaacttataccttggtgattaaaattctgtagaactaagtcttaaaagtcctcagctacactttaaatataatatgatttgatattatattctgcttaagtattcatgaattatgctgttaaagttactgggaagtaggagggaagaagtaaccatttagggaaagtacttactggtgaattcattatcatgttagagaataggagttttgctttcttggttctagatgacttaggttataaaaataggtctaaaatgtttctgattactctctctttctcccttttctcctattcccctcttttttttaggttttcaaaacaaaaatagagttgcaatcttggcagaactggacaaagagaaaagaaaactacttatgcagaaccagtcttcaacaaatcatcctggagctaggtattgacactataatgtgggttttttgtttgttttgttttgttttgttttgttttgagacggagtctcgccctgtcccccaggctggagtgcaatggtgcaatctcggctcactgcagcctccgcctcccgggttctagcgattctcctgcctcagcctcccgagtagctgggattacaggcacctgccacgacacccagcaaatttttgtatttttagtagagatggggtttcaccatgttggttaggctggtcttgaactcctgacctcaggtgatccacccgccttggtctcccaaagtgctgggattacaggcgtgacccaccgtgcctggcctgtaatgtggtttttatattcagtgatataaaaatttcttggaccaaataattcaagttggctggcaatgatttttttctttaacactgcaatctattcattgtgttttctttgtataggggaggctaaactttacctgtgcccaacttagttcttatt

SEQ ID NO: 134642 - DNA, 1065 bp, Homo sapiens
gaccagaaagcaattctgagaaagaaatggagcgtaactgacaggatacaaagagatatggcctttgtcaaatacttaatactgggctggattttcagcttcaaacttacgtaagatatagggtagaggttgccaagttatggcccagtagcaactcctagctatgttttaaaaatcagaattaaatactaacatgtaaacattgagaaactgtacactaatttctcagattcctagcttctcttgaaatatatctcaagatctggcaacaagtgatctatatgcccccacggcaacaattcaccagaactaagaaatagttgtcccctttagctgggcactctccagctcattacaatccttatcaccttgtttacattatctgtaagaatttgagtttctgatccctaatttagaaaaacaaaaagaaagattaaaggactggaaaacagaactacagaaaaaaaaaaaaaaaaaaagataaggacgatgatggctcaggagactggaatcattaggccagaagaatgaatatgggaggaaagcacattttccaagcagagcagacctaggcactcctaagggtacccacatgaaggagtctaagaattttatactgattataaacaggaagaattaggtggtaggatgcaaactttttcctctccttgggagaggagcagagactagctagggatggtgtaggctgtagaaggagtattcatactccttttgcagtgttttcagctaaatctgttcttcaatcaggcattagcatactgtctgtggccaggattctgggcaaaataaacctctggcacattcatttctatcatctcccattttcccctctctgcccacccatgctatgtcatcaaactctagtaatagcagactccctctatttggataagataattcattaaaaaagaagaagaggaagaagaggaggaagaggaggagtaggaggaagggagaggaggagggggagggggagggggaggaggaggaggagaagaagaaggagaagaagaaggagaagaaggagaagaagaaggagaagaa

SEQ ID NO: 134643 - DNA, 1021 bp, Homo sapiens
gctgttagtggattggggaatgcttcaggcaaaaggccacaagttcccaaatctcaccagttgcagtttctgcctgatactggtcagactccagtgcctttaagtagtgaatttttaatattttagtattatatttgtggcaggattagaccaaccagactactctgccagtactggaaattgaaagcttgctgattctgttttagtttattagttatatttaggacaaactaaaggttacatgagtttcgtagaattatagtattgtaaaaagcaagttgtggtgacagctttcccagcagtaaccagctaataccattctgttctcctctcacatagccatgtgcgatttgtgtgctctgtggactaatcataggtccacattcccttgtggttgttgacctctttatttttccattaaattataagggcccatattaaaaataacttaatttgagctcagatgaaaactaagagaagactattttggaaagataacatgctgctaaaaaccacacaatgcactgcaaatgaaaataaattttaaattatcccactattcgcacagagatttacaatatgctggttacttttttcgtagttgtagtaaaaacgcaatcatttttagtattgcctttgactgacccatagtcagatccactatgaaacatcccctaatctaaatagaaatgaatttagattagccctttggcttccgttgctcctttgtcagggatttttgttgatgtcatggaactgctgctactaggaaccagcagagggagtccacatcatgttctagagactcccggactccagtgaaattttaaaattcttatttattcagatctattgtatttttctctctctctttaatttaatttttttttaagaggcagggtctcgctctgttgcccaggctggagagcagtgttgtgattgtagctccgtgcagcctccaactcctgagctcagcatcccaagtagctgagactataggcacatgctaccacgcctggct

SEQ ID NO: 134644 - DNA, 1043 bp, Homo sapiens
gcgagtttagcttctagagtcgcccctcctccgaggcccagccgaggtggactcgcaccgtcgcaagaccggccaggcggtggcaatgaataaaaagccagtcttggtgctagggacccaggtgttctccgtcccgcccctgcctggcagccccgcccctcccccgccccgggccacgccccaccctggcccagcccccaaaagtaccgtttgcatctcccgtgagcctcttcgactgtcactctttggaaaaaaaagtgacgtctgcactgaggtggccgctaaagtgcgaatcacgacgggcggtggccgttgggtcccggcgggaggcggggtttccgctccctggggcgcacgtcagtcaggaggcggaagcgcagcgggggcgggaaggttgtagtgccgcgagttgagctcctcttgcctaagtggtcgcgccccctttaagagcagcgattgtaaggagaggcggtcccggtgtcctcgggtcccaggtaagtacgacagtctggaggcaccgggcaatagaaaagtgtggctccggtgctaacctgtcgccgccgtctttgttgctacaggcagcgacctcccttccgaccttgccacctaacatttctggctcctacttgcttccttcgtctcgttcacagcccgggcccagccggctctgcacatccgtaggcagggacctttctggcacgccagtctaccctgtcacaagatggccctgttgtcctccagtcctaaccccgcattgctcgctctgtgtttcagccgctggagacacctaacgattcatttactaaaaaccggtgtctgttttctatcccttgtgtctttcccgggctccctagactaaggcatcactctttgctgccaatgaaatcaattctttgcctccggcactgtgcccaccttttaaagagcgggtttgttaagctttttttttttttaattaatagtatggttgcttgaataagactttattttcccttctgaaagcaggattagggtcttgctcatcttggatctccccaggattt

SEQ ID NO: 134645 - DNA, 1083 bp, Homo sapiens
atgattgctctgaaccaaaagtttgagaccagcctgggcaacatatcgagaccccgtttccacatacgcacacagcatggtggcatgcacctgtaatccaggctactcaggaggctgaggcgggaggattgcttgagcctgggagttcaaggctgcagtgagctatgattgcaccgctgtactccagcctgggcaagagagtgagaccctgtctccaaaaaatgttgaataactgaataaatttgctttcttatcgacaaaaattggtcttaaaatagtgtaggaactgggggttaaacctcatttccttctcagttctgtgtgggacactgaattaattatctattgctgtgtagcaaattaccccaaaacttatcacctggaaatagtgtctgtgggacaatctgagtggttctgaattaggcctttcttgaggttgcagtcaagttgttggcttgggctgcagtcatctgaaggctggattaggggaggatccacttctaagctcactcacatggctgttggcaggtcttagttactctccatagggctgtttgatgtggcaactggtttttccccccagagcaagtgatccaagagagctcaagactctagccagtcttgtataacttatcttggaaatgacatgcctctgctgtattctgttggtcacacagattgacactggtacaatgtggggagagggtgtgaatatcagggtgtgtataccaagaggtggggatcattgggccatcttggagactggctactacagatagccatttaaaatatttacctaacgattcactcatggatgatacctgactcagaagtatgagcattttactaataagcacttggaagacaaattccccgtaccaccaagatctggttagtggtgaagaagtcagtctcaagtctaattaccgatggcttcctttaaagggtctgttctgtgtaggagggagagtcttgaaggcattattaattattgaatatatatgtatttttttgagcagagacttactctgtcacccaggctggagcgcagtggcctgatcctgactcactgcaacctccacc

SEQ ID NO: 134646 - DNA, 1014 bp, Homo sapiens
gtctttcctgtctctgcccttcaccttggggcttttcccaccccacatctgaaagccccctccaacttcacggacctggtgaaaacacaacctctgcgacctcagctgatctgcagacatacccccagctagtggggctgccaataggaataaacaccccattctccctactcctcaggtaaaacccaattttcaagtcatattttaaggtcacggtattggtaatttaagtttcaagtggcaaaccaaattgaaaacagtattaacaaaagggaatttatgaccccctataaccaggaacccgttctaacttcaggcacagctggcacagtcggatcctgaactcaaatgatcttgcccctcttcctctcctagctctacttccctctggcttcattcttaagccaagcactctctgcattgaaggacacgaccattcacaatctagtagaaaggcaagacattctttcccccatcatccatctcataaatctcaggaaagactgcctggctctgttagggtcacacatccaccagggatgctattttggctaataaaagatattgatgttagaccagaatgggaaggatgaggagacaagccagggtatttctgtcccaacctgctctctgcctcagatcgtgccactggcagcggctgcctcccctccagggcccccttcctctaaggtcccagctcctgctcaatgaccctgccacaggtctagttctcacagaagctcctgggttctacttaacttcgcctcttcccctaaccctccagtcctgagggtaacagcaacttcctgctactgctactctctgggtcaatttaccacccatcacctatgcaactaactccttgtattatagtctctctgtttgaaataacttcactggcttttattccctgatcagacctcaactaatatagaaatcgacaaagcataggccaaaatgtagaaagaaatgtggagagtacaatatcaaggaataacaaccaccaacacctcc

SEQ ID NO: 134647 - DNA, 1053 bp, Homo sapiens
gctaagtaaatacatgcagcatttttcacatgctaccgcaaccatctgttgatgtgtctctcttcttcactggaccattaacctctcgggggagagatcttctttatctttctctacagccccagcatgtagcacagagccaggtatgtagcatatgctcacgagctataggggttttgaaaagcgcctgcactcggccacccaaacacgctgtgtgctcttcccgcctctgtgccccttctcaagcaggaacccccaaacaccttttccactatcccacttcccccccaccaacacacacacaaaaattcacacaaacaacaattcctgatccctgcgctggctgccaaaatgaagaattctatggggcaaggcagacataagacagcatatgagtcctctaatgtctagtaaacaaaccccattgctcatacatgcatcagcgcctgttggccaggctgttgtttatgtacttattttactttgagaggctctcatttatcgtggaacaccggccttcctcccagtggccttcactaacacctgattttcaaactgcgatgacatcctaccccctactttattgtcaatatgcactttgtctaaattctgacctcaaacctctccatcttctattccagtctctatttggatctactgggattatacatctatttaataaaaaagagcttcctggaggcagcatttgtttgagccttgaagtttgagtaggcttgcaacagtggccttcaggcatcctctgtcctgaatgcctgacttgaaaccgtgtccacgtcatctttacacttcactcgcacatgtgcttcccggtctgcgcccccctctcaaagacggcaccactgttcagcatcaatctcctggactttctagtcagtcacccccactacaccaaaatctgtcatctttatattttctaatctttctcttgtcaggcaacaagtccaaccaaaaccaggttaattcttcctatcttacctctttcacggctggtctttccccatcccaagccctgatcacacatccccctgctca

SEQ ID NO: 134648 - DNA, 1052 bp, Homo sapiens
aaaaatacaaaaattagctgggcatggcggcgcgtgcctgtaatcccagctacttgggaggctgaggcaggagaatcgcttgaaccagggagttggagattgcagtgagccaagattgtgccactgcactccagcctggtgacagagtgagactctgactaaaaaaaaaaaaaaaaaaattatttgtttaaatttacggggtacctatgtaattttgttacatggatagattgtgtagtgaaatccagtgcttttagggtacccatcacccaaataatgtatattgtactcaataatttcacatcacccacccctcttccatttcctccaccctttcgagtctcctttgtcattccatgccctatgtccatgtagatgatgaaagttatgtatagggaataaagtagggtgagaccttgctttggaggatggtggcttttccaaagaagatgatgtttgagctggagaatgaaggaatacatgtcttacaaatggacagaaggaagagcaactcaggcggaagaaccagcacatactaaagcttagcagtgtcaagtgatgcacgcacagcgagcaaggggattgatgaggctggaaaggttggtagggtcctggctgtggtctgtagtggcaaatagtaaggactttaacctgagtaattgggagaccaattaagtgtttgtcgtcgttgttgttgttgctgttttttaaagagatggggtctcactcttttggccagggtggaggagggcagtggcacaatcatagtttactagaactccagggcttaagcaatcctcctacctcagcctactgagtagcttggactgtgggcatgtgtcactgtgcctggctaatcttttcattccaatcaagtgttttaagcgggggaggaacagggccgtgtttggggttagagtcactgatcaagaactagctgggattgggtgggtggagcctggcggcaaggagtccaagaagaaggctgttgcagtgggaggttgggggaggcagtttcagtagggctttggctcactggattcagagagtgt

SEQ ID NO: 134649 - DNA, 1060 bp, Homo sapiens
cgtttctgtcttttgatcctcccttcacttgcagaagtgcttggccgcatagcatcctgggctgtggggctggcacttggcatcacttctccatcactgcagtgccatcctgcaggaaagtgtccacttccccaagagcttgatgccaggagtctccactactgtgggtgcagccatgtccatgcagtcatcctgagggcacaactaaggcatctctgtagcttggcatggaccaggcaccaccctggcacagacaggaagagctgaatcttcacttggcttctgggattccactcactgttggttccttatgtaccttactggctgttcctcctctgtctccttggctggttccgtctcatctccctagctctaaatgttggactgctgtaggactccattctgatatggcctctcttcatctgcatggtgtccctaagcaatctcatccagcctcacacatctacacactgataactccaggccagaaacctctctcctgaattccaaattcctgtctcccactgccttcttgatgtttaaccctgcatctccaacaggcatgtcaagctagttatctagctcactcttaattccaaggataagccttggaattagcctcggctcttccctttttcatcccatacctaagccatcagcaagtgcttctgaaataccatgtccagaatctcatcacttctcactctctccactgctgctaccctgactgctgtcatcccctcttgcctgcattactgtaccagccgcctgactcgtcttcctgcttccaccttcccaccttcagtcatatatccaggcagcaaccggagggattatttaaaacataagaaacatcagtcgcatcatgtctcttgctttttaaatttaattaattaattaattaatttttgagatggagtctcactctgttggccaggctggagtgttgtggtgcggtttcgactcactgcaacctctgtttcctgggtgcaagcaattctcctgcctcagcctcccgagtagctgggattacaggcacctgccaccacacccgactaat

SEQ ID NO: 134650 - DNA, 1080 bp, Homo sapiens
tttgctgatgtggtgttccgtgccaggaacacctttctcttccattgaacagctctgcagagtttatagaggactttctcacacatccccagtaatctccatgcagcctagcctggaccaggttttgctgttttccagtgaacgtcagtaggtttaagtggttttcttatgacctcatagctggtaggagaactagaatctaaacccgggtctcttgccatcctgccaagcccaggtcaaacctccctctctgaagccttcctcggagaacagaattattctggctttcttctgggctctagtacacaggtcacctaaactagattcctcaagtaaattccttattggctccctttcctccacatctagaatagcacctagcagtccatgggaacttgataagtgtttggatgaatacataagcgaacagattttgctttccatatcttctaatacgtggtttgggggagtatagcaccatgttaattaggctgcttaaaactcctgtgtgttggaaaacacctatgttttggtctatagaataaatagggagtgattattttgtcccactctttctgccatctcatagaaacataatcaagtatttcattacttgaagaaggttgcttacaacacatttaactgtatctatattttgggaatgtaatttttttttttgagacatgacctcactctgtcacccagggtggagtatggtagtgtgatcacagctccctgcagcctcgacctcctgggcttaagcgatcctcccacctcatcctcccgagtagctgggactacaggtgtgtactaccatgcctggctaagtttttttttttttttttggagatagaatctcactctgtcacccaggctggagtgcagtggcacaatctcggctcactgcaacctctgcctccctggttcaagcgattctcatgccttagcctcctgagtagctgggattacaggcatttgccaccatgcccggctaatttttgtattttttgtagagatggggttttgccatcttgacctggctggtctcaaactcctggcctcaagtgatctgcctgcctt

SEQ ID NO: 134651 - DNA, 1057 bp, Homo sapiens
gtctgagtcatgtcagtgggaatgtgggaattcgatctggggcagccaggtagccagtcaggtggcgctccagcctggaaggccatctgtacttttgggttgtaggctagcacacttcaggattctaaaaagatgctgtgtggaaactgtgtctcaggcctcgaaaagttccacggaaaaacatctcttctagctgctttgtggtgagatgcagatctaaatcaatacaacattattgagtgccacaaaactagtactgtacagggagaacctgttctgtacggggagaaaaaaatgaagtgaagacactgtggaaggaagtatgacctatttgaatgtagtcacacgtttccttctcatttagcacatcctcttgtgttcattttaggtttggattgaggatttaaggacagcccccagccccataggtagggtatgggtgtcacaaatcattaaatgtggaagtactatactagagggcagtttgaatttgggtagctcaggtaggtcgaaatgtatttctgtttcctatttttagtttagagagacagtttagaatctgtcgtgatttttttccctccctaggtatttttgaggctctaataattataggttctctcctaagaagcttagatgtaacatctaagctcccaaagaagattggcatttgcatgtgcacatgcaaatgttggtgcataatttttggcccccaaggtgcctatgggtttcagagagacagtccctattgtagaggaatggtgagttttcggtaatttttgaggcaaggacgctttttttttttttaaagatggagtctcgctctgtcgcccagggtagagtacagtggcgcgatcttggctcactgcaacctctgcctcccgggttcaagcagttcttctgtctcagcctcccgagtagctgggactacagacgcatgccaccacacctggctaatttttttttgtatgtttactagaaacagggttctaccatattgatcaggctggtcttgaactcctgacctcaggggatccacccaaggcaaggacacttttag

SEQ ID NO: 134652 - DNA, 1065 bp, Homo sapiens
actgccaaaccttccatgtcctctactccccactgacaatcacactttcaaattagcgtgcgtgtaaagggggttcaaggacattttctacttattaagtaacctcaataacctgaagtaacttcggtgacatgggttagattcctctgggttcttttttcagttgtggcccaggtagaaccagtagacagcctttgagacctttggcatttggatggcaccctttcctcatttccagtattgatatgactccagtcactgtttttcttgttctttttacctccactgttttttgtttttttttttttctttcattctctaggttaaattagtatctggagggtggaaaaagggagaacgcagaggcttgtgttcaactcactgagtttatctagaggtctagctttctaattttttaaacaagtgtgtcacattacacatacaaacatgaccgcttcctggttattgagcctttgggatttttctaggtttcactctgtgttctttgtatcatgaacatctttgaacagaacatttttgagattatccctttgagtttattctccaaagtgggcttagctttagttttacaacaaaatcaacaatcaagaatattcagtttgtatagaacacattcattcattttttttctttttttttgagatggagtcttgctcttgtcgcataggttggagtgcagtggcgtgatctcaggtcactgcacccgccgcctcccaagttcaagcagttctcctgcctcagcctcctgagtagcggggattacagacgtgtgccaacacccctggctaatttttgtatttttagtagagatggggttttaccatgttggtcaggttggtcttgaactcctgacctcgtgatccacccgcctcgacctcccaaagtgctgggattacaggtgtgagccactgcgcgtggccaacacattctttaagcatctgctgtgtacctggcacgaggggggtaaattaagaaaagtaatatgcagtctgtgtattcagagagccatcattttacccttaacgtaaagatgccttgagaggc

SEQ ID NO: 134653 - DNA, 1075 bp, Homo sapiens
gagaatcaaactgcaaaatgctggagtgacagaactaggccatcttttgcttatcaaagaaatacaaggaggggaggagttacttgtgactggaatgtcactttgcaccccgtcctttgtcctgctgtgtcagccttgtgtttgcttttcccatggccagcactgctgattcgccaggtgtttcctcttttatgctctcttaactttagctttaaaagtggagacatagactcaactgcccttcatccatagggaacaataatttagtaaacaaacttagataccttttctggcagaaagatggttcagaaagatagcatggagacctgtgtttgccaaagttatgaccctgatgaatcttcagacttgtaattgactcacccaccccaccgtggttcattttaaacccactcctgcatgggggagttgccagggcctgtattgatccttcctcgtttttgcctccacttccttcccacccctctcggggccacctgctttgccacatcccataatgttgggatcttttatctccttacatatgcatggggcggacagacgtgagcagtgtaaatgatcgcactggcatgggaagcacgttgaggattccccagcagttgccattcatcggtcactaagccatgatgactgtgttctgttgcaacaatggcaagactcttggtgacaaatgatgggccagattttctttacgggggaaaaaaatcaacattttttttttctcatttcttgtacttgttccctctacttgacccactgatgataccatgtggggcccataggttttggagatagctgtggataccatccacacctaaggatcttgcagagtaaattctgatgggatccaaggggctgaggtggccaccgagtgatagagtgagtctgccagtgtaagaccacatctcttgtatcaaaatgtttcctaaaattccattgtttatccattgtgactgtttttgtttttcgttttttggtttttggttttttttttgagacagagtcttgctctgtcgcccaggctggagtgcagtggcaccatctcggctcactgcaa

SEQ ID NO: 134654 - DNA, 1163 bp, Homo sapiens
gtctcagacacagtttctgtttctttttccaaattgagatccaaacaggatctgtacattgattggtatgtttcttaaatattaaaaaatccttctttgtccatttatttttccttgtaatttatttgttaaagaatcatctgtcttctcttcattggaaaagagagatagtaaagttccaggttattaggaccacttgaaatcacaacaaaatgttctaatgttttaaaaaataagtgtccgagaggaatttattccatgtctgtaattaaaagtcatcttgtgagtgtgaggccctccttgggcaccctatgtatgattttgccttccccaaacccttggtactttccttccattcctgttttatttttcctcctaatgcctagagttacctactatatattttacttgcttcttgtctgcctctcctctagaatgtaagctccacatggttttgtgatttgttctctgctgtatccccgtccctggctagatgaatgaagatgtatgaaggcagggcagaagcagggtggggaatgggtgtgtagaggagggcaggtggcgcgaggcatgaggagaaaagtctcactgtgcccttcgcctttttgatgtgtcatatcaatgggatgcagatccctataaagttctgtgagaagttcagatgatgactctcttctgcttgtcactcaatgatggaggggcctctctgcagacgccggcttggtctcttggcctctttaccccactgccggctcgggcctcatctgacagccataggctggtttgaccaattttatcaatagagactgggctgggggcccatcctctcagaacatcaccaacagcatgcaaaggtgtcccaatgagggtggtggtagtcagcagtttgtcttgattcagaacacgttgcccaaccttcagcgtggttggattttgggccagctgcaaagccacatgctggaaggcagcaggaacagcctgaatgagccactgctgtgccatgagccaggtgtggccttgaacagggcccgccaccgtcccttagtctcctcatctgtagaatagggaagatgcgcgttcactctgcagggttgctgggagccttttgtgctgtccagtgatgcagggctgttagggcggatcctccagtcagcctgcgccag

SEQ ID NO: 134655 - DNA, 1094 bp, Homo sapiens
tggtagccactagccatatgtggctatttaagtttaaattcaaatgagtaacattgaataaaaatgtaaatccagttccccagtcctgctagctttgtttcatgtgctcagtaggcacgtggaggcagtggctcctgggttagtgtagattataaaacgtttccattatagcagaaagttccattgaacagcactgtaaatattcctactcaaagatgaatgagtgtggggagggaatgtcagggcacttaggagacagctgagtggcaattgacgaaaaattattgcaattttaacctcattttcatttcatgataaaacacttcctaaagcaaacttttcagaggaagacttgaggtttccggtattgacacattccattagaaggttgaacccacaacactctcaactcttcagttgcctgtcacctttagcacaggcagggatatggggtgcccgtgcttagccaaggagtgactccttcctgccttgactcctcacgctgctggaaggtcccctgtggggaaagtgcatgattagaaactttcatagcaatttatttcttttgagttagtggaaaagaaaggtctcatcactcttggtttgccacttgtgattctattaaaggaagaagaaagaaactcgttgatgaaacagacacctttctagaaggtctactgcaagcttttctgttttgcttggtgggttcatagcagcagagcttggactaagtgaggggagccccaggcacagatttacagggcattcactgtcaggtgccaaccttgtactcacatgggccaaagagggagtgtctccttacattttgcaccccgggtgcctagcttgcctcactcctgtcccatccagggctggctctcttggggcccattgagccttcactctggtgggctggctgcatggttctaggaattctggacttgcacaggtatagcccctttagcacatacaggcgcatactgtgtctgagcctctgtcacactgaacctctcaggtagggagtgcatctctctgctctttctatacctggaccagagtagaggactagtaagtggctaatgaatgaatcattg

SEQ ID NO: 134656 - DNA, 1113 bp, Homo sapiens
gaggcacacatgggtgccctgcacacaaaactggcatctcttgccttgagctcctctgagcacacatttgtcaaaggccaaagccctacattaaaatgctatcaacacgctccctcctctggaggcatttatttgaaagcaaaaccttgggttttcaggtctaaggaggagctctgaaaaggggctctcctaacccagatcttcaaacccatccaaacacaacagagactcgtgggggaaacacccccatttacacacaggaagaagaaacattgcaattcagactcatatgtctttggttccttttaggatttactcatccacacttgaaagtgtgtgcagactttgcaaatatacagcatttgtattgccctgctattctcctgtgtcccatattggaactagagaagaggtaggttctcccagatcacatgaactattccattgctgtgacatttgatgatgcctttcctcattaatcagagaattgcaataagacaactactggccagctgcctcctctgaaccccacatcataaataaactggaggcttgtttatgcttttcccaatagcagatacttttaaatggagagttagagaagtctgagaaaacaggaggaaagttacttatgcatgtcaaaaaaatttgaaattcaaagaagaaatatacagcaggctatttcaagtttttcttaaagaggtttagaagactttctcaaaagggaactatgtcacttgaagtttcacaactttcactttgctttggtgaatttcaccatcctgtgcagctggagtttgggctttgtggctgcagcgcttcccaaagctggcttctctctcctaactcaagcacttcactgagccctgatggcggccagggagccgacaggcccaaagccaggtcaaacccccgacctgccaaatgtatcccaaccacaagtgaggccttttatgtttggtgtgctggggcccatgaaccaaactgtctccaagccatggctcacccctgggagtccacttccaccaatcgaggaggtttatacccaagcctcgtggacaaggagctgacccagaatgatgccaatgagaaagacaggcctgagggagctgg

SEQ ID NO: 134657 - DNA, 1001 bp, Homo sapiens
ttctaaacctctttaagaaaaacttgaaatagcctgctgtatatttcttctttgaatttcaaatttttttgacatgcataagtaactttcctcctgttttctcagacttctctaactctccatttaaaagtatctgctattgggaaaagcataaacaagcctccagtttatttatgatgtggggttcagaggaggcagctggccagtagttgtcttattgcaattctctgattaatgaggaaaggcatcatcaaatgtcacagcaatggaatagttcatgtgatctgggagaacctacctcttctctagttccaatatgggacacaggagaatagcagggcaatacaaatgctgtatatttgcaaagtctgcacacactttcaagtgtggatgagtaaatcctaaaaggaaccaaagacatatgagtctgaattgcaatgtttcttcttcctgtgtgtaaatgggggtgtttcccccacgagtctctgttgtgtttggatgggtttgaagatctgggttaggagagccccttttcagagctcctccttagacctgaaaacccaaggttttgctttcaaataaatgcctccagaggagggagcgtgttgatagcattttaatgtagggctttggcctttgacaaatgtgtgctcagaggagctcaaggcaagagatgccagttttgtgtgcagggcacccatgtgtgcctcccttttccaggtaccggcggacgtcgagaaatgtcaggatcggatggagtgtttcaatgctgacctgaaagctgacatggagaggtggcagaacaacaagaggcaggacttccggcagctactcatggggatggctgacaagaacatccagtattatgagaaggtaatgagtgtgcccaacaagactggtttctaatggccagagcctttcacatgggcctaccagaaatccacaagctgggaatcctgctagtctcatctccttcccttattttagctgcttagtcttgg

SEQ ID NO: 134658 - DNA, 1104 bp, Homo sapiens
gtggcgtgtgcctatagttccagctactcgggaggctgtggcaggaggatggcttgagccaggagttcaaggctacagtgagtcatgattgtgcactactgtactccaacctgggtaacagagttttttgatcctgtcacgccatatatatatatatatatatatatatatatatatatatgtatgtatgtatgcacacacacacacacgtatacacacatatatatacacacatatacatacatacatacacacatgagtgagtgtgtgtgtgtgtgtatgtatgtatgtatgtatatatatatatatattgcgatagggtcaaaaactctgttacccaggttggagtgcagtagtgcagtctgttacccagagttcctttcttctgtaactcccacaccttccctctgctgttcagcggccttcctactactacaaaaccaactatgtcaaatgtctctgttgctccctttggtaattaatcccagcgttcctaaagtcctggtcccaggaggacccaaccctggtcttaagtacgtgtttatctgtcttcccactatatcacaggcagggccactgtcttggggcctggtattgcttctatacatatttaacaaatgctttttgtgcacttgctgtgtgcaaggggcagtgtgtaccaaattgataaacagcaggattcctgccctgtggagggtatgtgttcatcaaaggagcccacagcttcagagtgagataaggaaaagaacgggaaactgggggagaaaatactagggggcataatgcagactaagggtgggaggggcaagtggagtggtcaggaaaggccagtctgaggaaatgacatttcatccgagtctcagagacagaggcttggaaaacatatattccaggtataggagacaacatacgcaaagtccctggggcaggaaagagtttggtacatttgaggaccaaatagaaaactggtatggccttggtttatcatggctgacatacaaagtccattgcagatctgaagtgatggcctagggagagagcaggacctggaatgccacagaccccagatcatcttccgtatataaggtgggcttcagagtttag

SEQ ID NO: 134659 - DNA, 1208 bp, Homo sapiens
aactcctcccacctcctcagaattcctccttcctcctcagaactcctttcacttcctcagaattcctcctggctcctcaggattcctcttcagagctcctcccacctcctcagaactcctcccgcctcctcagaactcctttcaccttctcacaatttctcccacctcttcagaactcccgctcctcacacctctcccaccccctcagaactcctccccacctcttcagaacctctccccacctcccccaaacccctcctgccttctcagaacccctctccacttccccaaaactcctcccacctcctcagaactcctccctaaatgactcagtacaaagtcctcctccacccctggggctgctactgagaagccttatgtgattaacttgccctctttatgcaagagactttccaaagggcgaatcatttctgctctcagaggacaatgccagagtgttctgagttcttggcctttcacaaggatctgggatgaaaagaggttggtgtagtggagagaacatcagcgtgggaaccatgagctctaccatggacaagctgtgtgtctgggccagttatttaacctgagtcttgtcttccccatccatgaaatcagtgtgtatgtgtcgagtaataattctccttcatagaggagctgtgaggactggtgataactaatgtaaagtatgtcaccatgtttggacataataaaactcaataaacactggcttccctcttccatattcccttttgagagattcaggtgtggcccaaacaagcaaacttgaggttggtgaggaagagtgggctttccacccgctccaagtcaggtgcctggcctgctccaactatgatttccatcctgcataagcgccacccacacctggagcagtgtctccatccctgccgagattctagggactcttcaggggtttcctgcttgggcttttttctgcttttttgaaaggaaaagaacttcctccagtaaatccatttccattcactggatctgagctttacagactaacatgaatgcatttaagccttgcagagatattgctgtctttcataaagatggggtgacgcattcaaaacaaacacctgttacctccccgtttgtaatagttatggatgacacatgcaggcatcattagacaaaggtaacccagcaggatcgacaacgaaagggtaggtcagagcagaattgaa

SEQ ID NO: 134660 - DNA, 1347 bp, Homo sapiens
ggctggtgtctcatgaggtgaggaggctggcccagaaggaaggggacgttaggtggtgaagcaggctcccctgggcctctgagggccagcagtcccaaccatttgcctcttcgttttgaccaagcacaaaagagatattccctagaagtgtcacacggaggcttctgtgccaaagactgccttgtagaggtctcatcacctcacacttcttgacttcacaaaattgtggccctgagatcagtactcctctcttaagtatttattattattattatttactttacctcaagcagacagacataggttttgaggcttgaatacatggcagtggaatacaaggccctccctagcagccgccccaggcctggaaagtgggagatttcattcgcccgggttaaaaatccagaggaagacagaagagaggagtcctaggaactgagcagattttagagacgcaaatgatgtttaagagagccttgtgatttgtagcaagcatgggcactgctttttcttactaatgtggtagatctacacgaacattctaggctgttctgctcagagcgaggaaccactgctcctcaatggggagggaacataccacccagccaggcttagcattgggttttatcctttaataaaagttttataatgaatcctgttcaccttaaagtgtgattatggagatgattggctccatattccaccacgtcattccttcaactcaccagacacctttctttagttgaaataaaccagcatgacctggagatcatggtgactgtaagctaagtctgttttcatgccagatttcagccccacccagagtgtgctctagatgttgttgatttgaatggttttcccagttcccactccacatggggaagttgaatgaatgcacacctgctgctcacttcttgtgaggctgccttttgtgatcaaataacaggaagttctgctttagaggagggcacgatgaccatgtggcagtctgcaagtggaattttgggatggcagcccgaggaacatccagagttactgtgtgacttggtcctgccatcgttagctttgaaatcacaggcattgggctctgttttgacaccattcattggactgcgggacagtcattctttacgttctctcttgagctggtgagagaggaggaagagggaagtcaagagcaacctccaaggcctatgtcagcctcttctccttgggtcttggggtgggttagaactgggttccagtctggccagatgggttgctggctgcactgagggtgattcttctcagaagatgggctgcctgtggtcaggacagggcataccagtctggactccaccttcccag

SEQ ID NO: 134661 - DNA, 1054 bp, Homo sapiens
gtaatgaatgtgggaaaactttcaaacaaaatgcatccctaaccaaacatgtgaaaactcattcagaagataaatctcatgagtgaagttaatgtgggaaatttgttaactaaatttaaggttttgttgaaccttggaaatatgctgattttaaagagtgttagaaagcctttagcaagatgtcacaccttgttgtacatgagaaactttgaaaatggatcttcatatagaatcagtggatggaaacaagggtttaaacttgatacaaaaccttttataaaaaatattgttttaactactcaattattataaatgatctacatgttcagattgaaattgaaagctttaaaaattgtgaattatttgaatattcaaagcaatggagaaacaagttatatatgctgacagttcctgtgtttcttcttgttttgtacttaagcaccatatattagagttgaatttgcatatctgtttattgccttatgtaaatgagtgtggccatctgtataagcctctttgacattttcacccagctctttcttaatgtctgtgttggcttctgcatcagcagaaatctttttaaaagggttgttatatatgtaaaaaatgttaacaggaaaatgagagaaaataaagcagctgaggatacaaatgtgctggtagggagcgatattcaagatatattgtgaagtgtgaaaaagtaggttgctgaaccatgtatatagtatgttcccctttgtgtacaaaagggtatgtttgtttaacctctgtctcttatctctgtatgtgtatgtatctttgtatgcatatatacatgtatctgtatgtgaatagactttgaaaaaatacagaataaacttcatggtggttgccattgggcagaggagtataggactggggtctaggataggagcaagacttccttgtatatttggatttttaaatcatgcacatgtattatttttataattaaaatattttaatatgcataaatcaacattatttaaggttgtcactgagcccctccacaacatgtgagatcaacatgtgagat

SEQ ID NO: 134662 - DNA, 1101 bp, Homo sapiens
gtgcctgcacgttcctcaccagctaagctgtgctgagaagtgggtaagctaggtagtagcccacagcagagcccaagaccacaccaaggaaaatccaggtgttgtaggacattacggccagcatgatgaagtagccgatgaccacctggatgacatggattagagactggccaaagtgacacaaataccacctagataaaaaggagaagcaagttaatcctggtaatgagctggtaatgaggaagctgggagtagatatcagggagtagaaagctgttgagttacgtgacccgattgatttataacttgtatgcttaacccaggagtgatttctttctgcccctcccacccccgcccccagaaaaaactcgagatttatttttaaagagacatatcttcactacatttggtttcaagcttcctggcatcctaggcaaaggggaaaatgagggtatctataatctgtctttctgataaggaataagagaaaatcatcagtaaggcatatttcccccctgaatctacttcgggaggcagtatgacaatggaaagaaaaagcatggtcttaggtgacattatcagttcctagacctgccactaactaaaagtggcctagacaaatgtcttaacctctctgaacgtaagattccttatcagtaaaacaggaatgagaatacttcccttgcagtgcagttgtgaagatctgagacacccatgtagggtggctagtgatggagcgggcaggcttattaagcacaggtgaggctggggctggacagagggcagaacagggaccctaaatggttgcctgattcgagtgggaagggaggagaggagagcttgtcatcctcctcccaccaagtgggatacattgcttcaggacagctgcagatcccctcctggatatgggagcctagtgacccatggaactggtgagatttgggggagggtgggtggccacctcatttgctagataggggcctgcacctgaagatcactgttccctaaagaaagccttctgagcctctcaagtggctggctgttcacagagtgctttggcctgggcatcaggagacatgagctctagttcacttggctatg

SEQ ID NO: 134663 - DNA, 1128 bp, Homo sapiens
cccgaagtagattcaggggggaaatatgccttactgatgattttctcttattccttatcagaaagacagattatagataccctcattttcccctttgcctaggatgccaggaagcttgaaaccaaatgtagtgaagatatgtctctttaaaaataaatctcgagttttttctgggggcgggggtgggaggggcagaaagaaatcactcctgggttaagcatacaagttataaatcaatcgggtcacgtaactcaacagctttctactccctgatatctactcccagcttcctcattaccagctcattaccaggattaacttgcttctcctttttatctaggtggtatttgtgtcactttggccagtctctaatccatgtcatccaggtggtcatcggctacttcatcatgctggccgtaatgtcctacaacacctggattttccttggtgtggtcttgggctctgctgtgggctactacctagcttacccacttctcagcacagcttagctggtgaggaacgtgcaggcactgaggctggagggacatggagccccctcttccagacactatacttccaactgccctttcttctgatggctattcctccaccttattcccagcccctggaaactttgagctgaagccagcacttgctccctggagttcggaagccattgcagcaaccttccttctcagccagcctacgtagggcccaggcatggtcttgtgtcttaagacagctgctgtgaccaaagggagaatggagataacaggggtggcagggttactgagcccatgacaatgcttctctgtgactcaaaccaggaatttccaaagatttcaagccagggagaagggttcttggtgatgcagggcatggaacctggacaccctcagctctcctgctttgtgccttatctacaggagcatcgcccattggacttcctgacctcttctgtctttgagggacagagaccaagctagatcctttttctcacctttctgcctttggaacacatgaagatcatctcgtctatggatcatgttgacaaactaagttttttttatttttcccattgaactcctagttggcaattttgcacattcatacaaaaaaatttttaat

SEQ ID NO: 134664 - DNA, 1036 bp, Homo sapiens
agggctgtctgtgctcttttgggaatctaagggtaggagtcttacagatctgggtcagttaatgtgcacaaaacgttgtggcatatttactccctttgatacctaaccctggaacttttaggctttcaaagaaagtcaccactgtagtcctagctcatccctggggcatgatggttctgtgaggaccagtccagtcatcctcttgctcctgcaggcttagtcctgcagtctaggaagccatgcaaagaaggtgagagggtcccttctttccattgttcatggcacctgagggattcttcactttgagagcagcttccattcccttagaactcatgggaccaggacttatgcagagaacagtagtgagaaaatacttgtggtcattttcttgattccaggatcttccaaagattatgcaatcagtctttaaaaaaacagaataattaattttaataaaaaatgtttcttgattttaaatgttttaaaagataggacccaaaattccacttcatctggcctggcatcatccttgcaggctttggatatgtctcccgtgtgcggacctgggaggcagtgagaactaattatttctttgttgcttaacaaaaggcggtgctgtttggcactttcacagactggcttatctccagcaaccactgcagaagacagtgttatcaccattttatagaggagaaaactgagacttagagaggtaaagtaatttgcccaaagttacatatctaggaagcctcagcacaagaattcaaatcctggccatctgattccagagcctgggctcttggccagcacagcctgactgtcactggttgggggaaggggcggtgatgcttttagaaacaggcttcttgagacaccaggcagctttccagttccctgcaaacatgggggaatgccctgatcagtcctaaaggtgtgacatagtctactttctagggcagttatttcttattgtaaattaactagtggctattatatttgcttctgcccgcagggagagaagatgctgagtaattgt

SEQ ID NO: 134665 - DNA, 1048 bp, Homo sapiens
atatggaaaaatactgtcgtcgtggcctaaggtggcctgactggctctgggtgtgatcccatcatttgaaagagttgaatttggaggcttggccaactggagaatcctaagaggtgaagaacacggggccacagcctcccacacctctagcctgactggcaccaccctcgctccttccagctaaggtagtgggggtgaaagggactgatgggccatgagagaccctctcttttcacagcttgagctcctggcctttctcctctggcttggcaagggaacaggacctacccggctagcagggattgatgctacagacaggcacgaactgaatagtctctactaaggcattctctgctctggtgagcaactgccaaccagaatccatcttcacagggccaggcaaaagggaaggcagcgtgatgtgtatacaagtctctgggctaatcccacgtcactaccaattagccagacctcgtacttctctctggacatcaatgacgtgatctctaactctgacagtataggattttcaagtgtggctcacagcttctgttttgtcctgactaaagttctggctctacatttactagctatataagcttagttaaattatttaatcttcctgagcctcagccctctgatatataaaatgggataaaagtacctacctcattggattagtagattaaatgacaacatctgtgaagtcgttttcagagtacccaagaactacatgttaactggacagtattggtactaataccaataatatgctcactaattaaaagcttccaactatatttagggcagtcacttagaatatactcaatttggtttttcccccttttttcctttttttaagggcagaattgctattctggattctcaaatgaaaatttaactcttgagaagaaagactcatggaaggaactggtacattccccaaaggaacacaggcaagagggaagggctccgatacatgcaagctggagcatagatccatcacagctctctgctcaaggttttggcaaaaggcaaaatccactct

SEQ ID NO: 134666 - DNA, 1090 bp, Homo sapiens
ggcagccataactccctgtttactagttcagtctacatagagttatgtgaggttggttcatcacctgcatggagaacacctatgtttaaagtgacatcatactttgttattattcaggccaaggtgacagaggagttagcagcggccactgcacaggtctctcatctgcagctgaaaatgactgctcaccaaaaaaaggaaacagagctgcagatgcagctgacagaaagcctgaaggagacagatcttctcaggggccagctcaccaaagtgcaggcaaagctctcaggtatgtgctaggtgggggatgctgggattgttgccatttaaactcaaggaattaagctgttttcttcctctcaatttttttggcatgatgctcatgaagtttttgaaggactacaccaaaaattaaaggagactagtataaaacctacatgattgttttacagaaggaacagcaaaagaactgactattcatgtggaattgatcagtgccacagttcccttttgtttggggaggtgttggcttcaaaatctttggtacttatgattggcttcaaatgcctggaatagttgatgtgttgttctaactcatgactcagtggaagtttaaaaaagaaatgcttcctggtgtggtttcttctttcctagaagatggattgcaactcttcagcctcacactcaaggcccatcctgcttggcttgtctcccgttatattgtccagttcatcctggccctgaccatgccagcaagcctgctggctgctcttcagctcatcctgtagttcttgtcttgcttcttatccatgctattctctggacttgacatgcccaccattaccaatattcgcttttagtcctcttcaaaatctgcctctttcagaagctttcctagttttctctagaacatttgatctctttaaaaaaaaatcctttatctcatagtgcattattataacccttatcacagtttgataagcatggtgttttgctcatctttgtaaagtcctctcctccatattagtgttagttcagtgcctggcaagacatggtgattggatagaagatttgtgaagaccagcaggtt

SEQ ID NO: 134667 - DNA, 1047 bp, Homo sapiens
ggaaacaagcatgattatgagcaacatccagcgaatcattcaggtgagggtgattaagaacataccactcaggctgaaggtcttacccatcctctcttctcagaggtactactctttaacacctccaccccagaaatagcctgtgataaacgctacactgggttagacaattctagaaaatccattatggcttaattctgtccaagtgacttatcactatatattctgaaggaaacattgcttttttgaccatacttcagaatttcacttctttttttagccatttattcactcaatccattggacctagtgatttgtatccatcaggtgtaatctgatgtgttgttttaacatacatgtggacataagttctagtgttttgtctcaaaacatgttaacaatgtcacctgtcagttcaagttgattctcttctatctggcacttttctcccaagacacttaaattgtacatcatatattttgaaattaggaaaatgaaagattgaagcaagagatccttgaaaagagcaatcggatagaagaacagaatgacaagattagtgaactaattgaacgaaatcagaggtaatgacaggtacggggcctggctaggatggacaaaagggtttattatgtatatgcccagcttaagtacacgtatttgtttagggcagtacgtatgtatttctgccatttctgtttcctgcctgtcatgtgaattattgcctgttttctgagaggcattgcagtagaaggagcttagtaggctgtgatgtagggcagacctgtgtttgattcctgctctgaccctcattcattctgtggctctgggcatgttatttattcctgctggccctagtttctttatctttaaaactggtattattacttacagaactctggtgtcaactcttctctcttctgtgtgggctaactctattttatccatcagaactcagccaaaacttcactgattcccatataagacctaaggattttgtactttttgtagatacttctgaagatttggaggggtgggtggggagga

SEQ ID NO: 134668 - DNA, 1077 bp, Homo sapiens
cttaattttaacttaattcttctctagtggttagttctttattgaatataatcgtcctttctcaattgaagtgaaatatataacttagactgatttttagtattcttttactttgatagaaaacaaggaaagggcgatggtcttgaaaaaattttttctggaatatactttatattttacatttttgttttatttcttggaaaagctctatgtagatttaacatcttaaaggaagataggatttctgaggcctattgttataggattatttttttctggtctggaaatgcagtgtaaataagaatatttttattaaaaattttatgtgctacttattcattttagaataatttaaaattatagaaaagaaacatattgaacaaaaagggcattcatctttatatattgctttgtaacctgatttttaaacctaatgttgtatcataaacatttacattaacataaatgatttaagtaaataaagtggtttaaaggaaacccagtgttccattatatcattttattataattcctttcactctgttattagacatttaggttggttaagagctgtagaaatctaaaactgggatgtttttctagaagagaatataaggggacaaggtgaagttctaaagtaaaagaatgtctgaaactttggtctttgaactatagcatagcagattacagtcactgtatattgtgcctcaagattttctgtttcttatatgaagcaggaggtagaataactttgtttagagttatagctttgattttatgaaaagctttggttttatgaaaataaagaatgttggaaaaacatcctaaaactatattatccaaaaacagcatgttaatcaggtgcagtgaatcctacgttatctgattttcattgagtaccttgaggactatggggatgatttgtaagaagcgaagaggctggattatttcttgcaaaagaccactttttttgtgggaatagattagatttgtcttaaggcagttactggcttggaaaatgatacattctgaagagtggttagtttagctgcttcagacaatagaacatcaacctct

SEQ ID NO: 134669 - DNA, 1016 bp, Homo sapiens
tgcaggttagttacatatgtatacatgtgccatgctggtgtgctgcacccactaacttgtcatctagcattaggtatatctcccaatgctatccctcccctctacccccacccgacaacagtccccagagtgtgatgttccccttcctgtgtccatgtgatctcattgttcaattcccacctatgagtgagaatatgcggtgtttccttaggtgaagtttgccagagattctggctctgatggtcacagtgttagttcccgcgattctgcagctccgtctcccatccctggtgctgacaacctctctgctgatcctgttgtgtcaccacccacatcaatacctttcaaatcagggtaagatactgcagttgtatcaagctcttttatggctcataaaaatgattcttagaggggttcagaaatagagatatagttaaaaactaaaataattttaaataactggaaaaaatgggatcagggaaatggggaagatacttgcatcagatttttctgacaaaggtttaatattcataggccacaaaagcactaactcagaagaatacttataaaattctggaagaaaactaagccaagggcataaatacaaaattatatactcatggaaaaaatgtaaatataagcatttggatggaaagttgttcatctttactagcattcaaagattatgcaaactaaagaagagttaaaattctgttttacagtcattaaattggcacacatttaaaaaaacaatttgcttatccaatataatttggacttgtgattctggattttgttttcaatcttggaatatggtctatttgctttcagggagccagctcttcgtaccaaatctaactccctcagtgaacaacttgcaataaatacagtaagtataagagtcttggccaggcatggtggttcacacctgtaatcctaacactttgcgaagctgaggcaggaggatcactacagtgcaggagttcaagaccagcctaggcaacatagtgagacct

SEQ ID NO: 134670 - DNA, 1061 bp, Homo sapiens
atgagatttgtgaagcatcatctccatcttgggtacatagagattatttggctagggtcacaaagttaataagtggcagtgcctggatctgtacccagacattctgactgcaaagccatactcctaggcactttgatccctggcaagataactggcttccgtttggtttacttctaaacatgtaatctgttttgttagtggatgaagctatttgagaaagagcagtagcaataaaggaatgagtacttattgagcttaaactacatttatgctgctttgattttgtcttgcaggtgtgcattgctaagtgcaacagtacctcttccctggatgcagtgctctcccaggacctcattgtggcagacggccctgctgtagaagttggagattctttggaagtggcctataccggctggctctttcagaatcatgtgctgggccaggtaagaaaatgcaccctgcaagttcttttgtaaacttatatagcatgagggctattcccagggaagatactattactgtgaacggctgctgttgtcaaatagaaatattttaggatccccactttagacactgcaattgctttgggggcatattatgaaatgtgaatgtgtaaaagatcctcagtgccaccctgtcacttctacttagggaaagtgggaaccaatttccccagtactattatttttgctagttgttcatgtgtatgtcttgtcctcctataccagttttacacttgaatatattcttatgggattaagtcttaaaacttctttttagaccctccttatagtttttcttatagtagatactgtaaatacattgaacttactgtgttttaatattattgagcccttaaaagcaatatattatatgagagaaagacctttagactatgagtttagaaaaatctgaattagagatccaattatatactaatttgactttgatcaagtcatttatactcttatttttttccatttgtgaatggaggctaatgatcttgctctgcttactcggcagggttagtgtcagcatcaaaatgagataatttatttgaa

SEQ ID NO: 134671 - DNA, 1037 bp, Homo sapiens
tattcacataatagaatactacatgacaataaaagagaataaagtcctggaacatgaagtatcaaggcttactcttatagatacggtgagtgaaagaagcaagacaaaagagtatactctgtataatcctatttatacaaatttaagaatagcaaaattgtctgggtgcggtggctcacacctgtaatctcagcactttgggaggccaaggtgggcggatcacctgaggtcaggagttcaagaccagcctggccaacatggtgaaacctggtctctactaaaaatacaaaattagtagggtgtggtggcgtgcacctgtagtctcagctgctcgggagcctgaggcaggagaattgcttgaacccgggaggcagtggttgcagtgagccgagattgcgccactgcactccagcctgggcgacagagagactctgtctcaaaaagaaaaaaaaaaaaagcaaaattaatcagcgacagaagtcagaatattggttatctcagggtggggattattgactaggaagggcatgagggagcttcctgtggtgtgggaaatgctctgctattttttaaatctggttgatggtcacgtgggcacatatatgtataatgaacatgtattttatgtttttcatcaatttaaaaacaatttgtattttcttttacacaaccagccactcttagtcaccccttgtataaatgaaaacaccaacaaaatgaagacattgccaattacagttaaacagtaagaccaaaatgagaagagattaatgtggatagtgagaagataaaatttaaagttgaagccttaaaggatgaatagattttgagtttagtatgaagcacaacctttgatacttattgctgattttatattgctgattttatattgccttttaacttctgctgtctctctttttttttttctatctgtcgttgcttgtctacagtataggattcttctttatatcagtcaacaacagccagttacggttgctaggattcatgtgaactttgagctaatggtaagacttcat

SEQ ID NO: 134672 - DNA, 1039 bp, Homo sapiens
atttctgtggtaaaacttgaaaagccattatcttgtctactgtctttagggagtgcttgtaccctcaacagctgtcaaatgctcaaagaaagcctctccactgagatagcatgaatgatagatatttatatttaaagagtaagggaatagtatatgagctttaaattataaactgctgggccgggtgcggtggcgcactcctgtaatcccagcactttgggaggccgaggcagaagaattgcttgaacctgggaggcagaggttgcagtgagccaagatcatgtcactgcactccagcctggtgacagagcgagactctgtctcaaaaaaaaaaaaaaaaaaaaaaattttaaaccgctcacctgtgtccctgcctagaggctgaatgactgttgttcccacttctgtatgacagaaaagaaagctggttctgcagaatttagggaagtattaatacttgttgtttctcttccttttatagcacaaatggtcaatatgtaaagcagggcaaatttggtgctgcagttctggggaaccacacagccagagaggtgagagtgctcccacatctcatgtatattcagatgtcccaaataataccaatgagctggcttttatctggcttgcccgatgtcttgtttatcagaagataaggatgattatttgtattgaatgttaatttataacatcaagcatatagtaaatgatcacattttgcttactattgtgcgttaaaacaaatccaaccattcaaaattgttaaatttgacctttgtgatatgatcctagcttaagaatttgggcatttttttgtttgtttgttgttcaattgtggggtgcgtgtgtacacacacatacacaaatacacacatatatatacacatacatatgtatatataagataaaatttgccatttaaccatttttaagtgcataatccagtgccattaattgcattcacagtattgattgagcaaccatcactactatccatttcccaaacagaaagtgtaaccattaagcaataactctacttctt

SEQ ID NO: 134673 - DNA, 1048 bp, Homo sapiens
aaggatggcagggaccatgtttgatgggtaagtttgtatcatagcttcatttcaattgaataaactagtaaaaagcaggagggggagtagtcagtaagggtgactagaaactgtgatttgctaaaagcaagaatttacagtttgaagataccatagagagcacctgaactagtcacttcagtttataggtggaaaaactgaggtccagaaaaaagaaatgccttgaccaaggtcctggggataaacagggtcaactgatgatgttcaaatcacatacacaatcttgatttcaaagacactttgctgtgtccaatatttttatttatttttttttttaatttttaaatcagctttcctagcttgaagtgtttctagtattgaatggtgggatgtagtcaaggaggtatttgttcaaggttggagatgagcagcttttataataattccaggtttgggatatatcagtgaaatttcatttttcattttctactaacagtgccagattggcctcactttttggactggatcaggcagctgctggccatggaaatgaatttttccagtacacagccccaaaacagcctaagaaaggccagggaacggcagcaacaggtaagttaagagtgtattagccgagcgaggtggctaatgcctgtaatcccagcactttgggaggccgaggccggtggatcacctgaggtcaggagtttgagaccagcctggccaagatggcaaaaccccatctctaaaaaaaatacaaaaattagccaggtgtggtggcgtgtgcctgtaatcccagctactaggggggctgaggccggaggatctcttgaacccaggaggcagaggttgcagtgagccactgtactccagcctgggcaacagagcgagactctgtctcaaaaaacaaaacaaaactgaaacaaaataaaaacaagagtgtattagggttctctagagggacagagctaatagaatatacgtatgtgtgaaagtgagtttattgaggagaactgactcacacgatcacaaggtaaagccccatgat

SEQ ID NO: 134674 - DNA, 1083 bp, Homo sapiens
agatcgacccccctccaacaatccgccggtatctctcagccacgccctccagcgcatacttctcagtcactcacccgccgctcggcgagaggaaatcggtgtcgtcctcgtcccccgcaccgaacattgcgttggctttcaccgggttgcggggaggaagctgggtattcccagagtcccagggcctgtcaccgccgacgtcgtaaaatgccgcggcggcgtgctgctttccggcagggcgaactccagcacggtctctggaccgaaagtagactgggctctggagaaggtggggcaaaggcaaatgagaggctcgcgcgggcacgagcgccgagtgacgtcaggcctctccagcccgcagcggggcggagcttcacagccccttgcagggattggtcggtaatgctagggggcgggagggggcgggaaatcctcggcctcggtggcggtggtggacacgtcgagccgggtagaagtggaggggccgttcgaagagtcgtgagggggtgacgggttaagattcggagagagaggtgctagtggctggacttgacctggaaaggtaaggcttctctcggcccctctttcgcacccctgtgcatgggtaccgtccttttcccagcgggacaaggaccttcctcgccgctttcctcagctccgcggaaggagaaagagctcgggactggagggttaaagactggggcttcggcccggcccctgcagtggcatagccagagtgaccttgggccggggtgctcggtgcctcagtttccccgtgtatgcaaccggccatttgtccagttcttccatgtgcctgctggtccagaagattttagagctcagaggccatggatttcaatcccggcctcctcgtaatctcagaatttacagatagggagacgaaggaactaagcacccgggtgactagtccgaggtcacaaagagtaaagggcagactgagactggattcctcgtcctttgattcaggacatagtgagctagtgggtgaacaagaaccttatcagcccttaagcactgtgtgcccttacagagtgactattgaaagactgtagcatacacctc

SEQ ID NO: 134675 - DNA, 1018 bp, Homo sapiens
ttttttcttttattttttcttgaaacaggatcttgctttgttgcccaggctggagtgcaggagcacaatctcagctcactgcaacctctgtctcccaggctcaagcaatcttcccatctcagcctttcgagtagccgggactacaggcatgcaccaccacgcccagctaattttttgtatttttgatagagtcggggctttgccatgttgcccaggctggtctcaaactcctgagcttaagcagtctgcccaccttggcctcttagagtgctgggattacaggcatgagccaccatgtccagcctcatttgcattcttgtactgcattttcattaaatcattcaagttccttttatcttgtgtaacatatttaattgcattttcctactgaataaaaaaaagggaacagttcaaatgttttctagtttctgtcttatgccatattaatttccaatattactcataggcaaaccaacaacattattatccaaacagtttaaatgctatgtaatataactaaagcaaagtttagacaaggaggaccattgtctacatttgattataacaataaagcagttaaagcaatgctttgccaatgtatatttgtctgactagctagttttgtttaaatcaaactgtgaaaggctgtatacttcaagaaacatgaaagtgagccttatgtgtgacttagttcctttcagagattaattttgtcatctaatgagcaagcaagctattatatttcatatttactgtaccttaaaattggaaagtatttaacatattttatttgacccttacaatactatgagattggcagcgtaggtattttaatatctgttttgcaaattttgcaaattttggtgatttgcctaatgtcacatggctagtatatggcaaatgtgggtccagagctcagagcctttgatgcctcgtgctgcatgctttctccactctaagatactatctagaaaacactgaaattgtcacataaatcatactaaagcacagttagcgg

SEQ ID NO: 134676 - DNA, 1029 bp, Homo sapiens
ttggccaggctggtctcagactcctggcctcaagtgatctgcccgtcttggcctcccaaagtgctgggattacaggtgtgagccactgcgcccagccctattattcagagtgcatttcgacaagtcaagtgtgcatttgtttctcactgaaactattctttttttgttgttttttgtttgtttgtttttttgagatggagtctcactctgtcgcccaggttggagtgcagtggtgcgatctcggctcactgcaagctccacctcccgggttcacgccattctcctgcctcaacctcccgagtagctgggactacaggtgcctgccaccacgcccggctaatttttgtatttttagtagagacagggtttcaccgtgttagccaggatggtttcaatctcctgacctcgtgatccgcccaccttggcctcccaaagtgctgggattacaggcatgagccaccacacccggccctcactgaaactattcttatatgtacctaaacttttcagaccgaaataggctctaaagatgaattagtctgttccttgactcaggaagctatgaccagaaaggctaaattacctaatgtaatagaaaaccagggctagaacaaaaatttctagtcttacatttttcaaattgtaatcattataaagattaaggtgggcttcagcccaccaattccccttgcctgggaattatccagaacactgttgagtcagtgtttgagagtgacagcactgtgacaacattcagcatatgaaagttcacacaaagccatgataatcagagatgatctgatattttaaaggagtagaataaatggtgacatttttatgaattattctcaaaatttctgtttctgaccctgaaaatacaaatagtagaaaggcatttggggcttttatgcattattcacagaatgccaaaatgtagcctagagcttggggctgtatggaagtccattttcaccccacttagagccacttagaggtagagcagccaagagtactgcagataacagttgt

SEQ ID NO: 134677 - DNA, 1477 bp, Homo sapiens
cagcactttgaggggccgaggcaggtggatcacctgaggtcaggagctcaagaccagcctggccaacatgatgaaaccctgtttctactaaaaatacaaaaagtagccgggtatggtggcacacgcctgtaatcccgcctacttggaaggctgaggcacaggaattgcttgaacctgggaggcagaggttgcagagatcgtgacactgcactcaagcctgggcgacagactgtgactctgcctcagaatcctttttaaattaaaaaataagtaaataaaatctggagttcacaagtcttagattaatcactaatgttttgatgaggtatgagtgacaagtcgagtttgtttagatcactgttgaaggtgtatagtatagattatgtagtctattaaacacttgctgtgtgtctcacagtctgctgcccatgtccctcccagaggctagttcaccttcatcgtatttattgattttttattgagcaagtaccaaatttgaatcatttgaccaaaatgctgttgaaatctggacacgatccctgtagcaatctctatgcgtaggacctgttgccaaactaaaaacccatgggacttttacaggaaatgtcaccaggagactcagctagaaattagtagagccgggatttgaataccttctgactccagacttttttttttttaactcctacccctagacctagactcttaacaatagtctgtaagatcaaatgtcacctgcaaagggtggcatgtgacttttagaagctcttaaaatccaggaataaattcttcttactaattcttgtagaatagtcttaagttgtgcccctcaaaccattttatgcccagaaattagatgattcttctcatcttcctaaagttttaacagatgccattctggatcctggaaaattaaacagctgtagccataaggatttaatctataaagatttttttccttctgtaaatctgcctcaaagaagaacttaagcaggaaacatgagtgcctgcatattacctttaaatagcttccaattgccctggaaataaaatttagaatccttaaaatgacctttaagattttttttttgagacacagtctcgctctgtcacccaggctgcggtgcagtggtgtgatcttggcctcactgcaacctctgcctcctgggttcaagtgattcttctgcctcagcctcccgagtagctgggagtacaggcatgcgccaccacgcccagctaacttttgtatttttagtagagatggggtttcaccccgttggccagtctggtcttgaactcctgacctcaagtgattcacccttcttggcctcccaaagtgttgggattacaggcgtgagccaccatgcctagacattcttaattgagtatcctttatgcttccctcttcaacctcattagcctctcctccgctcactcagtatgttctgttcatactaaccttgatcccttatttctt

SEQ ID NO: 134678 - DNA, 1045 bp, Homo sapiens
ttttgagatataagataacatgtagaggactgttaaaaaagcaagactaggctgggtgcggtggctcaccctgtaatcccagcactttgggaggccaaggcgggcagatcacctgaggtcaggagttcaagaccagcctgactaaaaaccccgtctctactgaaaatacaaaaagtacccggacctagtggcaggcacctgtagtcccagctacttgggaggctgaggcaggagaatcgcttgaacccgggaggcggaggttgcagtgagccgagattgtgccattgcactccagcctgcgtgacagaccgagactccatctcaaaaaaaagcaggactatagtaccacaaactatctaaaagttgtaaccttgatgatttccttgatgaacctttataacattaattattaccatgaactaattttgaagacccacaggttcttaattattcaggtccctcattatcaattagagaaatctactcaatgatgccacattatcaaatctcttcagacatatcagtgacccagggcaaggtatatacaaatcccaagaaaacctttcaaagtatgcacctgttttgaagtgtcatttgtgcaggatatatttcacatccaaatatactaggagatagaacaagagcagaatctacttgctctcattgtcagtagacaatggatatattgtaatggaatcctatgcaaggcttaccgaatggtgtatgaataggaagatacaaagccggtggagattaatatataaacatacactgtaggctcaaacacaaaccaatcctgataagtccttacgctcactaaaagctttattttaggaaaagatcccacgggaatatgccaaagctaaattacatcaaaaaagttaaaacttacaaattaattattaaagcataataaataaaagtgattatatttttttctcttcccacttaaattttcagtgatgtgctgtatgtatttggataagttatcttctaaagcaatcgaacacacctaacccattctctctagaatagaaattcaact

SEQ ID NO: 134679 - DNA, 1087 bp, Homo sapiens
attgctttagaagataacttatccaaatacatacagcacatcactgaaaatttaagtgggaagagaaaaaaatataatcacttttatttattatgctttaataattaatttgtaagttttaacttttttgatgtaatttagctttggcatattcccgtgggatcttttcctaaaataaagcttttagtgagcgtaaggacttatcaggattggtttgtgtttgagcctacagtgtatgtttatatattaatctccaccggctttgtatcttcctattcatacaccattcggtaagccttgcataggattccattacaatatatccattgtctactgacaatgagagcaagtagattctgctcttgttctatctcctagtatatttggatgtgaaatatatcctgcacaaatgacacttcaaaacaggtgcatactttgaaaggttttcttgggatttgtatataccttgccctgggtcactgatatgtctgaagagatttgataatgtggcatcattgagtagatttctctaattgataatgagggacctgaataattaagaacctgtgggtcttcaaaattagttcatggtaataattaatgttataaaggttcatcaaggaaatcatcaaggttacaacttttagatagtttgtggtactatagtcctgcttttttttgagatggagtctcggtctgtcacgcaggctggagtgcaatggcacaatctcggctcactgcaacctccgcctcccgggttcaagcgattctcctgcctcagcctcccaagtagctgggactacaggtgcctgccactaggtccgggtactttttgtattttcagtagagacggggtttttagtcaggctggtcttgaactcctgacctcaggtgatctgcccgccttggcctcccaaagtgctgggattacagggtgagccaccgcacccagcctagtcttgcttttttaacagtcctctacatgttatcttatatctcaaaatgaaaattatgactgttcagtttccctttctagcttttagccttaaagctccttgaggaaagactccatgtgatgttcatttct

SEQ ID NO: 134680 - DNA, 1161 bp, Homo sapiens
tatgttttggagctctaaaaaataatttagataccagatagaatcttttgcaatccattttctttcattcttttccagagtgtttaatttttttttttttttttttttttgagacggagtttcactcttgtcacccaggctggagtgcaatggcagctatcttggctcactgcaatctctgcctcccaggttcaagcgattctcctgcctcagcctcctgagtagctggagttaaacaggcacctaccgccatgcctggctaatttttgtatttttaatagagacggggttttgccatgtttgccaggctggtctcgaactcctcacctcaagtgatccacccacctcagcctcccaaagtgctgggattacaggcatgagccaccatgcccggcctcagagtgtttacttatttgataagttattagtcctggacataagactaactcaaattaagtaccacaaaataagtttaaaactattgttctaatacttcaattttacaataaattaagtgccacaaattgtgaaatgactcgccatcaatcatagagttaatatgtcagagctaggacaaggacccagaccttctagagctacctagaccagtgttcttttagtctaccaaactatggcccacatccttcctgattcttggcacggcccatcttagacactcctagttttgaggtagatgattacccatctgtttgtgtctattatgttgtatggtatactttaaatttaacttgcgcaaactcaatagtcagttggactgccttaggtaccagatgtctgtttggagccataaaatcaatttgttttgggaagaaggagagcatttagttcaggtaatgtgttaaattagcagtttgaatacatttatatcattaccaacacttcacagtgtgaaagacttagaattgaaatgcctattcaggaaatgtagtcagccactgatgaaactaaattgttttattccctgttccatattctacattgtgtgtttcagtgtaacaaacctaatttaatgatatcaagcagtctgaccaaaaggttattgttgttctgattatttttcttatcttaatcagaaagtaaatatgttcttggcagaggcaatagttttcagttacaccatcttagccgttctcctatctg

SEQ ID NO: 134681 - DNA, 1879 bp, Homo sapiens
gctacttcctcatgctcatcttcatgacctacaacgggtacctctgcattgcagtagcagcaggggccggtacaggatacttcctcttcagctggaagaaggcagtggtagtggatatcacagagcattgccattgacatcaaactctatggcgtggccttatcgattgcagtgggaagttgttgaagacttgaagacgtgattcctgctccaatcatcccttcttgctcctctttgtgcacgtacacacacacacacacacacacacacacacacccctgctcaacagaggtttagtttacagtctctgaactaaagtagtaacctcccaaattgttttttctaataagctgagattcccatttctcttaaggagaagccacccatgagatgtcttttccttctccatcatcttagagccaagttatatgttcttgtctaatccatgtagctttttgttcaatgacttgatcatctgcttcctttttgaatttttaacagatagtaagtaaatttggtggttttttcccctgggtcagtgatggaaaggggttaacttcagccaggattgatggcagctgagggaaattcttgcccaactaaacccagaactcaaacttaacattagaaaataaggtccagggccggacacagtggcccatgcctgtaatcccagcactttggggggccaaggcaggctggatcacctgaggacaggagttcgagaccagtctggccaacatggggaaaccccgtctctactaaaaatacaaaaattagccgggcatggtggtgggcgcctgtaatcccagctactcagaaggctgaggcaggagaatcacttgaacctaggaggcggaggttgcagtgagccaagatggcgccattgcactccagcctgggtgacaagagtgaaactccatctcaaaaaaaaagaaaagaaggtccagcttttggattcaatgagtgggaaatacattgtgcctttctctagatgtgatacgttataccaaaatctttgtagtgtgcagagcggtggtttgagactaaatacaggcttagaacttgcagagtgtgtattcttggatggctgatgcatcgacttgcattcccacttaacactttgattagcatgaacttgccaatcaaaaaatgacaatcaatttgagaaaatagaaatagatatttttaaataaaaccattcacagtttactttgtcttgataccttggtttgtcccagctgaagtgaagcaagagagtttgaattaatttttccattataatgttttcgcatgtctgcctctaaaactgtgattttcaagctttagcgtgcatcagaatcacctgtagggcttgttaaaacactaattgctgggcctcaacccaaaagcccccaaagtggcacttctgagttcctgctgatgttacaagggaccacacttttgagaatctgtgctttaagctaaggaaatattgcctggtgggttggctgcctggtattgggcatggaaatttgaattgctgattggtagatggtgtgtctggacttaactcacgtagtaaatactgctgatcaatacctaatcattccacatttattgagctccacctgtgtgtatgtgtacccaagcacacatgtgtgaagggctatagccaaagtatttttactagcctgtatgaaatcactagtccttatttttaaaggtctatggtttcttggaagtagtttgattgttgagagagacctttgatctgcagtgtaaatctaccagtcatgggccagaagggcaaaagcccagctttctctttggaaagactcaggctgtggtttgttgatggccaggttttcctcaggctccaacaactgtgcttatacca

SEQ ID NO: 134682 - DNA, 1035 bp, Homo sapiens
gtactggtcttgggttctagtcataaggggttccttataaggagcaggcggaggggagtacactttcatgtgatttaattttgatcctgccctctccagctgctccttcaaaagatacatcaaaagatagaaactctgggctgggcacagtggctcacacactttgggaggccaagcgggggtgcagatcacctgaggtcaggagtttgagaccagcctggccaatgtggtgaaaccccatctctactaaaaatacaaaaattagctgggcgtggtggtgcatgcctgtaatcccagctactcgggaggctgaggcaggagaatcgcttgaacccaggaggcggaggttgcagtgagccaagatggcgccattgcactccagcctgggcgacaagagcaaaactccgtctcaaaaaaaaaaaaaagatacaaagtctgcatttgatataatgccttaattactgggtctacaattaatgttgactgttttagattgtaagctcctggagagcagtattgctgtagtaggaatgttttaacagtgtcatatgaaaaagaacaaaataaatattttgattttgtgattctatgcaagtctttctgcccagagtgataatgcaataagctagtcttttcatagtctgcatagagtctggccattaccatcagtttttaagatgtccatattgtggccgggcgcggtggctcacgcctggtaatcccagcactttgggaggctgaggcaggtggatcatgaggtcaggagatcgagaccatcctggctaacacggtgaaacccgtctctactaaaaaaaatattaaaaaattagccaggcctggtggtgggcgcctgtagtcccagctacttgggaggctgaggcaggagaatggtgtgaacccggaagtcagaggttgcagtgagccaagattgcacctgggcaacacagcgagactccgtctcaaaaaaaaaaaaaaaaaaagatgtccgtattttaggtggtatgatccttttaggttttcatctcactctccccc

SEQ ID NO: 134683 - DNA, 1087 bp, Homo sapiens
acaggcatgtgccaccatgcctggctaatttctgtatttttagtagagacggggtttcaacacgttggccaggtgttgaacacctcctcaagtgatcctctcaacacctcctcaagtgatccgcctgcctgggcctcccaaagtgctgggattacagatgtgagctaccgcgcccggcctttcttcttcattttttattaacctggatccctgtcaaacttcttattctttcgtttcagcatagatgccacctattcaaagaagcctttcgtcacacctaacccctctgttctctgtcatagtatgttattttattagccttttcaaagggtatacttttttattattgtttagtttgttttttccaccagcaaagtctatcttattcattattatgttccttaaatgaatcctttgagtcactactgctactatctgaatttcagtccacggttgtgactcagagcgtcactacaacagtactgtctgatttccctgccattattcttcccttttaatccattctttgtactgtttcagggatctttctcatctgtaaatcctcctgagcgtggcattagcaattctttgtgacctggctcctccttgcatttgcagccctattcttcaccagtcctcttctatgttctacgctccagccatattgaattatttgtgactgcaagctcaacatgtttttcttacctccaggccttatttgtttaaccctctgcctgacattttctcattcttgacccccttgacctgattaactgaggactcaatttacatattacctttttttaatgaagccttccctgatcctctaagcttagttagatgcccgttacaaagtcccctctagccctctgtgcttactgctatagtgataggtaatataatggattatagtttgccagtactctctgttgtttccccaggactaagctacttgaaatcaagaactgattcctagtcatcactgtatagttagcacctgagtcagtatccagtacattgtggcactgagtgaaagttggcagtcttcacagaccaagtggtagcagtgtaggggctcattgactct

SEQ ID NO: 134684 - DNA, 1050 bp, Homo sapiens
ctggagggccgggtatagtggctcatgcccgtaatcccagcactttgggaggctgaggcaggaggatcacttgagcccagaagttcaagacttgcctgggcaacatagcaagcccttctctctacagaaaaatttaaaaattagccagttgtagcagtgtacatgtagtcccagccactcgggaggctggagtgggaggatcgcttgagctcaggaggttgaggctgcagtgacccatgatcatgccactgcactccaccctgggcaacaacaagacctcatctcttaaaaagaaaaaaaaaaggttgctaggtggtttgaacagtgagagaatagtaaaggcttgctcccatcttaggggaactttaataacagtgtttaaaactgtgttaaagtgtactttaaaaacagtattatctcaaccatgtttaaattctgatctttttttttttttttaacaggttaagaaatatcctctcagttgtcggtactgatgccttgaaaaagaccaaaaaggatgatgagaagtctaaaaagtccaaagaagaggtagaacatgtctttaacttcacagtataaacatgaaggaaatgaggggataggtctctcgttttctgctttcaatggtttgttttgctgagatgttgggggaaatgtttttgaaggctctaccattcaagaagagttgctggcagtagttttggttcctttgtaagtatgaatggagctaagtgagttttccagtcaggaaagaatcatggcattcctggtataaccatgtagttacatatcatagaaaaaaattcagtagaaagtcctctgcctgatttcatcctattaccgaatgaattcaccttccttctgggcagttaaaatggagaaatgacagttataagaggagtagaatgcttcagatttgacctttctgctcttaatttgcctttcagtatcagcaaacctggtatcatgaaggaccaaatagcttgaaggtggcaagactatggattgctaattattcgttgcccaggtaaagagagcctccagtagaag

SEQ ID NO: 134685 - DNA, 1044 bp, Homo sapiens
tggagtttcatataacttcatttatcaatgtatgtgtcttctaacagcagcaacaaaaccatagaagaatcttgggatgggttaaaactgaaaagctgctttgttgttctttttatggtggaaaagcaaaggagctcttagattaacctattaatgatcaccgtgtgtgtattttttttctttttaagtctttgaataatttttgcagtcagattggggatgatcggcctatctcctactgtcactttagtcccaattccaagatgctggccacagcttgttggtaagttccattttacaatgacattttttcctaaatggggaacaggctcaggaagaaaattagcatttgcgttagacgtctatttctacgtcctctttctctgcttctcatgatcacaccaaactacagatgtcagtcagtgctctacctgttgtataatacaatgtagccttggtttagccgttctcgctcttcaccagtgaccccagagatccattacacaaagcactctgtcacattcttgacactagtattttggaacaggtcctgtagtgagtttatagaccaactagtatccataactcagtctggcttttctttttcagttatgtgacctcgctaagatacttaatttctgtaagcttcagtgttcttacctgtaaagtgggatgaggtagtgtttgcaaggcattttgccttgacagtgcctggtatgtagtaaggactcgttaaacgttaattattggtttatctttgttttattttcttatcaccacatatgcagaaaactcaggatgtggtaactttgttgttttgtttgagtttggttgtgtttttctgtgggacatggctatctaatgagaaaggaaacttagattgaatacacaggagctacttgactaggctgacctttagatgggttcaggagaaagccaaggttctgcacaaatgagtccacctctccaagcctcattaccttcactataaagtttgatcgttcctgccgtacctgcttcacaggtctgttagaaagatcatcc

SEQ ID NO: 134686 - DNA, 1006 bp, Homo sapiens
aaggctgaggcaggagaatggcttgaacccgggaggtggaggttgcagtgagccaagattgcgccactgtgctccaggctgggcaacagagtgagactctgtctcaaaagaagaaaaaaaaaaaagccctagaggtttacagcgattccatggttttcagctagcacctaaggcagataagcttagttgttgagtcattgtttatgtcagaaaggagcttcctgttaatatggttatatgaatagtttcagaagcattaataacttaagctataatggcttagaatactttatgtgttgtagaaactgaataaatatcagctggttgattgttagtgtgatttggttttagctatgaccgttcatggcgcttatgggatttggaggctcaagaggagatcctgcatcaggaaggccatagcatgggtgtgtatgacattgccttccatcaagatggctctttggctggcactgggtaaggcttctcccatgtagtcaggggcagttcagtactctcacctcttacctatacctgcttccacagagaactggattcaaagtgttcatttctaaattattttctcaggggactggatgcatttggtcgagtttgggacctacgcacaggacgttgtatcatgttcttagaaggccacctgaaagaaatctatggaataaatttctcccccaatgggtaaaataaacacactgaatgaggggcgaaaaagggttctgggtcagtaagtactctatttctaacttcaatactgcatccaatccacagctatcacattgcaaccggcagtggtgacaacacctgcaaagtgtgggacctccgacagcggcgttgcgtctacaccatccctgctcatcagaacttagtgactggtgtcaagtttgagcgtaagctttcctcctattttacgtctaaatgacacagacaaacagtattgtgttcccgtggaatgcaggccaggctttagcttaactgagcagtaaaacaggag

SEQ ID NO: 134687 - DNA, 1681 bp, Homo sapiens
ggatttccatgtcagcccccactccaggaaggcagcccaatccctaggtgatggggaacccctctcacggttgaaaatttattacctttttacgccctgccacgaactgtgtagacattgtttttattaatcttttgtttggccgggcgtggtggctcacgcctgtaatcctagcactttgggaggccgaggtgggtagatcgcttgagctcaggagttcaagacgagcctgggcaacatggcaaatgccgtctctgcaaaaaaatactaaaattagctggtcgcggtggcttctgcctgtgattccggctacttgggaggctgaggtgggagggattgcttaagcctgggaggcagaggttgcagtgagccgagattgcgccattgcactctagcctgtgtgacagagcaagaccctgtctcaaaaaaaaaaaaaatttgttcgaatgccttatagccttcctcacagcacccaggattgtgactgactctgcatttttaattcttgaaacttggctttccataacatggtacatgcttcaggactacatatgacccagagagcaaggtggctgaactatagtctggaagccctcaggtaaagaggcacatctcaccactcattggttaaacaatgcatcatagcgagcacttttcctttccctggagaatgggatgtgaagcagtagaccgcagccacgccgatggttatacagtgaagaagacttcacctcttcctattgagtttgcttggaatgctgacagcatcaggcaactctgaactgaacatttgctttgtcagaaaatatctttttttttactttgaagtttggcaaccttcatgttaccccaaagcaaaaccattgtgtcaggagtcaaacaaatgtttagaaagcaaacatgacgtctctattgtacaacctcctttctcttggctgtttaaaggatgtacttcgtgtattaaagggtactttatgttgaagtaacgaaaaaaccctaatgggtgttcctaaacctaaaccttttctttattccacatttgctacggtaaaatcctgttacaaaactaccctataaagaattattttctatagttaagcattttctgaatcctagccattggtccatagaggtctcttttttttggtttgggatataatggatgatctcaaatatggattactctgatttatgtctccttagcaccttgttaacaattttttttaaaatagaaggctgtttgcattttgggccagactgccagtaagccaggcctggactcaattacaattcttaacttgtctgtcatgcacctcttttcacctcaactatacagcctctgaactctcaaattacacagtaaattcaaaaaaatatataggaatttggaagaagaaaaggttgtctacagaggagagttattaaagaaaggcttcttggccgggcacggtggctcacgtatgtaatcgcttgaacctgggaggcggaggttgcagtgagccaagatcacaccgttgtactacagcctgggcaacagagcaagactccatctcaaaaaaacttaatttgctgttgcagagaggttgacaatggctttggtcagctctattctgtggaccctgaatgtgtgatatatagccaaacaactggtttgttttgtttcattttgagacagggtctc

SEQ ID NO: 134688 - DNA, 1017 bp, Homo sapiens
tctggcaggcacagaggacatacggatcgatgagaggacagtcagccccttcctgcaattgtcagatgatcgaaagaccctgaccttcagcaccaagaagtcaaaggcctgtgcagatggcccggagcgcttcgaccactggcccaatgccctggctgccacctccttccagaatgggctccatgcctggatggtgaatgtccagaacagttgtgcctataaggtgggcgtggcttcaggccacctgccccgcaagggttctggcagtgactgccgtctgggccacaatgccttctcctgggtcttctctcgctatgatcaggagtttcgtttctcacacaatgggcagcacgagcccctggggctgctgcggggcccagcccagctgggtgtagtgctggacttgcaggttcaggagctgctcttctatgagccagcctccggcacagtgctctgtgcccatcatgtgtccttcccggggcccctcttcccagtctttgctgtggccgatcagaccatttctatcgtccgctgacctctggccacaggaagccaggtccaccgcccaccaccctttcaggccatgtttctactcagtgtgcttttcccaaatgatgtgtgtggtgtttctaagagaaacagggcccataaccagtgggcagctttaggagggatggggatctgtttcagatctaggcataacctgtaaatcacaggtgtccaaacttttggcttccctgggccacatttgaagaagaattttcttgggccacataaaatacactaacgatagctgatgagctaaaaaaaaaaaaaaagtctgtgtataatttttgtgatatctgccaccacagataagcaaaaaagtccttgcattcaaagggttggagattgctgctttgagtgctgggtacctgtggggaacctactactccctgggccttagtctcccaaatccaccatgcatctgcccctctgagggtgtcttcactttgtctctggcatctagcatggtgc

SEQ ID NO: 134689 - DNA, 1251 bp, Homo sapiens
tgtagtcccagctactcgggaggtggagaggtgggaggattgcttgagcccagaaagtcgaggctgcagtgagccaaaatcgcgccagtgcactctagcctgggtgacagagcaagaccctgtctccaatacaaacagaaaaaggaagggaggttgggcaaaggtggactgagggtccacactgactgcaccctcactcccacattgtgctggccctggggccacaggtgaatggacgtggtctttgcccttaagtcagcacccatgtagggtcagtcctctgtgcttccttatccaggggctgtgatgatgaaggaaggagaaggccagggctatgctctgtgatggctgtcatcctgccttccaaagctacatgtaatagacacactgctttgtccctcccctgcccctaggacgagcggggttccgcagctgactccgaggagtccccagctattgaggcaatccatctgttgaggaagaccttccccaacctcctggtggcctgtgatgtctgcctgtgtccctacacctcccatggtcactgcggtgagttccctccctcccaccagccctgctgccacccacactcctactgcccacttctcaacagggtggggacaggccagggcccaaggtgctccccaaaacccagtcatctgtcctgaagggctcctgagtgaaaacggagcattccgggctgaggagagccgccagcggctggctgaggtggcattggcgtatgccaaggcaggtgagtgaaccaccagcagggatgggcacctctgggtcaggaggtggcagagtggctaggagggccccagagttctgaaggccaccctctgccccccaggatgtcaggtggtagccccgtcggacatgatggatggacgcgtggaagccatcaaagaggccctgatggcacatggacttggcaacagggtaagggcagggaatgcagcacagggctggcaggagatagtctgcaccagccctgcccccgtgtctgctaagaatcacagaactgccgggcgtgttggctcacacctgtagtcccagcactttgggaggctgaggcaggtagatcacttgaggtcaggggttcaagaccagcctggccaacatggtgaaaccccatctctactaaaaacacaaaaattagctgggcgtggtggcaggcgcctgtaatcccagctactggggaggctgaggcaggagaatcgcttgaacccacgaggcagtgagctgaga

SEQ ID NO: 134690 - DNA, 1022 bp, Homo sapiens
cccagctaatttttgtatttttatttttatttctatttatttatttattgtgagatggagtttctctcttgttgcccatgctggagtgcaatggcacgatctcggctcattgcaacctccgcctcccaagttcaaaggattctcctatctcagcttctgaagtagctgggattacaggcatgtgccaccacacccggctaatttttttttatttttagtagagatggggtttcaccatgttggtcaggctggtctcaaactcctgacctcaagtgatccacccacctcggcctcccaaagtgctgggattacaggcgtgagccaccgtgcctggcctaatttttgtatttttagtagagacggagtttcaccacattggccagcctggtctcaaactccagacctcaagtgatccacccgcctcagcctcccaaagtgctggggttacaggtgtgagccactacgcctggcgcctgtcttcttctaatatgcctcttctgacctcctcactcccattggagccatggctcacttctggtcaggctccatgcactcaatcagccctgcctgccaggactgtagtgcccacttgatgagaaatcacctgtgaaaatgccaggcatggtctggcacacagtaggtgctcaagaaacaaatgttaatgccccagcttccttctgtcttgtgtccactaatttggcatttggagcatatttttgtacttcacgtaattaaatatttactgtgtgccaaggtcagtgtgtgacagagcactgtaggggaggcaaaaatgaaccaactctggaccttgccctgcagaagctctgtctactggcatgaggtaagacaggtccacagataacttacataagagagactgcaatctggacaagacagcctcagtgggagagggaaggagaaccctgtagatttgggtgcggggaggctgtggggagagcacagcctttcaggtaaagggacaaggttaggaaagcaagaaggtgtagcttgtgctcgtggag

SEQ ID NO: 134691 - DNA, 1009 bp, Homo sapiens
gacgagtgccaaacttgattttctctaggcacagctttctccctctgtgcctcctgcttcctttctctctcctgcctctcctctgctccccatcccactttctcatctgcctccttttctcacttctgtcagtctgtaagctttgataacctgcttaatactccaaagtgtgagttcctctgatctcttgattccttagttctaatctcacgttttgtttttaagagatggagtctctcactctgtggcccaggctggagtgcagtggcatgatcatagctcattgcatccttgaaatcctgggctcaggtgatcctcccgcctgagcctcctgagtatctgggactacagatgcgtgccaccaagcctggctaattttgtctcatgtcttctaaaaattattttgtgaagccccttcacaaaaaaccttaagggaaatctgatggtgctcaggaatctaactctccctaaaccatcctctttaactgcttctaaaatatctctgttggcctttcttagcctttttctgtttccattcagtgctccaagcgctttttgtttctaagttgagtgcttggggtttgacaggtagtgacgtgtagtttgacactgttaacttgttaaatacagtgaaaagtttgtgagtgaagaatgctgagaagattgtaatgctttgtacaaataaaagtcttgttaaaaaatgatgcctcctgtttcatgctgcttgttcacagtgtgtttttggagagagcccctgatgatactctccatgcagtttttggcgtgtggtcctggccagacctttgtaaacatgagatactgcatcgccttggatgaccagcaggtgctgctcattcacaggcaagggctctgaactactgcaagagcatttgttttgttttgttttgttttttttgagacagagtctcaatctgtcgcccaggctggagtgcagtggcatgatctcggctcactgcaacctccgcctcccaggttcaagcaattctcc

SEQ ID NO: 134692 - DNA, 1090 bp, Homo sapiens
ttcttgtttttgtttttttttttttttttttgagacggagtcttgctctgtcacccaagctggagtgcagtgatgggatctcagctcaccgcagtctcctcctcctgggttcaagcaattctcctgcctcagcctcccgagtagctgggactacaggcgcacgccaccacgtgcggctcattttttatttttgtagagacggggtttcaccatattggccaggctggtcttgaactcctgacctcaggtgatccgcccgtctcagcctcccaaagtgctgggattacaggcgtgagccaccgcgcccatctgcctccgtttttccaattgtacaatgtaattagctcctgcagtccgtctggctcactttcagctctgtctcctaaccccttgttccgtccttacagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgttttgcttcatcaatctgaaggttatggccttttgacaagagggattctgaacgactaaattagtcagtttgctcgcttttgtttacttaaatgtatggttagatggtttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatg

SEQ ID NO: 134693 - DNA, 1443 bp, Homo sapiens
ggagtgatcaggaaagggtgtcagggagctgtgaggccctcttaccttagctgtgtcctgattaaaaagtaaaaatatgtttgcttttttcctccttattatcatggttacatgtgtttactgctgaaaacttagtgaaaagaagaaagtgaaaatcacttgtaatctgacttcccagggagaccactgttaactttctgatttatatcctcccaggcttatttccacacctatttctgtgtgtgtgtgtgtgtgtgtgtgtgtgtgtgtgtgtgtgtgcctgtgtgtatttaggggtcaaatttcaacacaattgagatcaagtttgtatggacaattttgtaacccatatgttttccttagtggcctgatgtgaatatttccttgcattggtccatgttcttctattagattaatctgcctgccagatctgggaagctgaggagggttcaggcccagcagggagtggatcttcctgcccagccatggcctcagggctgagtctgatgggtatcagggaaggctgctgcttgaacaagtgactgtgacctgagtgtgcaggaggcagacaggagcctgggtggggtgggaagccacctgctcttattcgtgcaggctcctctcacatctctctaaggatgcttatgagagcatttgagaaattctctcctgtttcctgcactggctctgtttccctgggtgccatttgtcgtggtgcccctctttcaggctgctgattttctttatccactgtgatcttcactgatctgcttatgagcaaagattcctatcagtggtttccaaacccagccaaatatcagaagcatgtggggagcctgttaaaaatacacagattcctagaatcttcttctggagactctagtttaataggtctggggtggagcctgagaatatgaacacttaagaagccatagagcgttcagactgtcatccaggtttggaagctatggattcagagtcagttttggtagcaattgggaccacttttactgtgaaggttttggctaagtttttctcagttcactggcctttccttagcaaagtaggtagcccctggccttctactgtgagctttgccttggtagaaccagatgaagatgttgcttagctggtagtttcctgagcacagacatgtaaagggagcataatcatctatggaaatataaagagacaaaactgttttgatgagaattcccttcggggagagtactgcatgatatatgtatttgtgtgtacacatgaacacaaccccttgtcccccaaaaggagtatgttcaagtgacattaattgaaggacactgcgttctgaggaggtggccttacttcaggggaagggagtaggcaagctgaggctaggacccaactactctagagggatttttttttctttattgtgaaaaatgatgtaatttgaagtcattg

SEQ ID NO: 134694 - DNA, 1039 bp, Homo sapiens
caaacaattaaatgtagagtttccatttgacccagcaattccactcttaggtataaatccaagaggaatgaaaacacatgctcacacaaacatgtgtacacacacacatgttcataacggcattattcatagtagccaaaaagtcgaaataacctgaaatatccatcaccagatgagtggataaacaaaatgtggtatatccatacaatggaatattatttggccacaaagggactaaaatactgatacgtgctacaatatgggtgaaccttgaaaacattatgctaagtgaaagaagtcaatcacaaaagaccatgcgttgtgtgattctgtttacataagtatccagaataggcaagtccttagagacagaaagcagattagtggttgacaagggctgaggggagaagggaatagggtgtgactgcgaaagagtatgggatttcttttaggggaggatgaaaatgttctaaaattagatagaggtgattgattacagaatcctgtgaatatactaaaagaaaattacatgctttaaattggtgaagtgtggccgtgcacggtggctcaatcccagcactttgggaggctgaggcgggtggatcatctaaggtcaggagttcgagagcagcctggccaacatggtgaaactctgtctctacaaaaaatacaaaaaattggccaggtgtgggtggtgcatgcctgtaatcccagctactcaggaggctgagacaggagaataatttgaacctgggaggcagaggttacagtgagctgagatcatgtcattgcactccagcctgggcgacagagtgagactccatctcaataataaacaaaactgatgaaatgtatgatatgttaattatatcccaatacagctgttaaaaaaagaaggaactaataatacctttaatatcctaatgttgaaagtcatccactgtcatttctaccacattctatttgttagaagcaagtcactaagtccagcccatgtctgaagggaggaactaggcttcacctcttgaaaggaagagta

SEQ ID NO: 134695 - DNA, 1068 bp, Homo sapiens
ctgccacttactggctgtgtgatttggacaacctgttttagctattttcttttttttgagttggggtctcactctgttgcccaggctggagtgcagtggtgtgatcatggctcactacagcctcaacctcctgggctccagtgatcctcccacctcagcctcctgagtagctgggactacaggtacacaccaccacgtccggctaattttaaaaaaacgtttttggagagacagagtcttgctatgttgcctagactggtctcaaactcctggcctcaagtgatcatcctgcctcagcctcccaaagtgttgggattacaggtgtgagccaccatgcccagccaacctgtttacctcttaataatcttcagcttccttgcctgtaaattgggataaaagtagtaaccatttcacggagttattgtgaggagtaaaagaaataaaaagcttatagtaaagtgctgagtacctagtaaacatctaagaaacattgactttgttctctccatgtgtgtgcctagcctggtagttcactatggccctgaactctgggttgagatgtgtgtgaatcctgtaggatgtttggatctgagccccacaggactgctagtggtgttatgatccagccaagattagatgctgactgcagtagattcaggagttttattttaccagcttgcccaggacggacctagaatcccttgtgagtgatccatgggaatctaaattatcaagagactgaatgctaatttattagtttatgctgaaaaatagaatttctgagtagactagaagacttatgctggccggagcaatctctttctgtaaggaaaaagagcttgggaaactacattaatatcagctttcacaggaagcagagaggccaggggattgaactgacccatcacaatttttatgccagtgctgtgtgtcctatgtcctcaccttcgcaaaccagggccacttttttgaatggaactcagggttctccttcttttaacacagtagccatgggaaattctcctgggttatgtccatagagctgtgtggctgcctgtttcccagcgc

SEQ ID NO: 134696 - DNA, 1025 bp, Homo sapiens
cgacccagcagtgagatttcccagcatccacctggctgcctgtacagtagtgagctccccatcaccagaggggcacaagcaaggctagagaaccactgctggaggcattcgaaagggactcccgatgtggtgggcggggctgaaccctgtggcttctgaggtccctgccagccagagacttgtgtgagtctttgaatggcttcacatgaacaaaagagcatttctgtcacctttcctctagttttttccaccacacccaccagggagctgaggcaaggttgtttctgttgctgtttccttaggtcagctgaggctgtccattgatgcccaggaccgggttctgctgcttcacagtgagtacggctttgtgcaggctcaccaaggaaggggcgggccactcagcttgctgcctggggctggggttgggggatggtggcaccatgggccaaggcttcttttctcatccttgtataaaggatgtgtccattgataaaagccagtattcacctggggctctttctatagagcagccctggtcctgccttggatgtgtctggagtccacatggtagacctttctcattgacaggctacagctgcccctgggtacctcaacttccttcttggccccagcagagcagggccacagaagagttttcctatcttccctcccttctttattccatcctttcttcttttctctatttttctcactcattcatttattcattggttgacaggcagcatagtatcatggttaagatcatagtctttggagccagaccactataatttgaaccctggctctgatacttgttgagtggccttgaacaagctccgttttctcatctgtcaagtagtggtggtaatactatgtatcttacaggttgctacaaagattaagtgagttactgttagtaaagtgcttagaacagtgctgaacttgtagtcaatcctgtgtaagtttttgttagataaaatagaaaactggctgggcacggtgactcatgcctgtaaacccagcac

SEQ ID NO: 134697 - DNA, 2622 bp, Homo sapiens
gggaacaccaaggagaagcacccacccctgtctagatggtgttgatgggatgccagggaagacttggcggagggggtgatgcccacacggtatcctgaaggaggaatgggcctgagccaggcaaagaggagcagggagggtgtggctagcacttcatgcacagggctagcaagtgcaaaggcctgggggtcagagagagcaggatgcatttgaagagctgtctagcatggctggagcacagcacaggaagagttcatactccacctgtttgtctgtccatgtgtccatccttccatccggcacatgaatagttacatgagttgctgtcatggcccccactgccaggactcttctgtttagcccagaaggccctgtctatctctccagcctccctggctcttgccgctgacggtaccctccacctccagctctatccagttacatgcactcccttgaatacatcttgcttgctcctgcctctgtgcctttgcacctgctgttcactgtgcctggaataacctttcttttgttttgaaccccttttgaaaaataactctccacctgctctgattttgcaagaaatatgcctgccttcatcatcattaagactcaggaaggaagggtcattttgccttattatttccccctccaggaatcatccccctgacccacctgtctgggctgggtttattgctttctcctttgtgtctttgtcacagccctgactatactgtgccacctgtgtctggcctctctgccagactgagaatgcaatgaggacagggactgggtgtggttcattgtcactgctggccagagagacccaggaggtcaccagacctgggtcctgccctcaagaaccacgccctcgagggaaatgatgcacacaggaacagtaaccaggatactgggcagagtagactagtaggcgcctgggtcctctggtcatggccatggggggcccaacgtgaagttcccaaggagcagcagaggggtgttctctgcctgccagggcctgactccagctgtgcaaacagtttttgcaaaatgcatcttggcctccaccactccatttgtcctgcacagtttgctttggcttcaccccagtctcaggcccttcatcccttcccaccggtccccactccttccattggtttcccaggccttgcacctcagactactgggagcactgtctgagccaaaccctagggctcaatgaaaaccagacgtaaggctgggtgcattggctcacgcctgtaatcccagcactttgggaggctgaggcgggccaatcacctgaggtcgggagttcgagaccagcctgactaacatggagaaaccttctctccacgaaaaatacaaaattagccgggtgtggtggcacaagcctgtaatccccgctacttggcaggctgaggcaggagaatcacttgaacccgggaggtggaggttgcagtgagccgagatcgtgccattgcactccagcctaggcaacaagtgcgaaactccatctcaaaaaaaaaaaaaacaaaaaaaacaagaaacaaacaaacaaaaaaatccagacgtaaaagaaaatagaactgaggctcaggttctatcaggtctattgtcttctttctatagacctcaggcaaatggtgctgcctactcttgtgaccacacctgcacccaccccacacctctccccttgcctttatttattattatttttctttagcaaacattttttgagcaattacttatttgccaggcactcctctgagcacttcaggcacattacctcatttaattggaacaactaccatgtgaagtgcatgttattatcactaaaccattaaaaatggcaaattctgtcccatgcaaagcaactcactctagcttatatggtgagtaagcggtgcagctgggattcatgcctgggtccgtccacccctgaggccccagcttgtgactcctgtgctgtgctgtccgccagccacagcacggctcacggcacaccgtgagtgccacggcatggctcatggcacatggtgagtggccccttcattcctagaaggcagtcttgtgtggtagagcactgagccgggagtcaagagacatgggttccaaatccagcggtcattcccattgttctgtgattgtgggcaagtttcttactatcttgggttcccctcgaagcctcattttccccattacatgaagggttagattctataaactgtagttctcttccagctgtaagattcagggaattgaatgtacctcgtaatgcattggtgagggtgctgccagagagtggaagatggtgggaatggcctagaccagagcaggttcatagccaatggtggttatgcagattaagggcctagtagcaggggccatagccctgctactcacagatacgcttttcttttcaggtctctttattcgtgtggatggatatgtctatgtgtgtctctctttctcgctgtgtgtgtgtgtatgtttccattcatccaccccaatgtctgaattctcttttagttatagaaggtaaaggcctgatcagcaaacagcctggcacctgtgatccgtatgtgaaggtatgtggtggggccggagatggagagtgggatattg

SEQ ID NO: 134698 - DNA, 1362 bp, Homo sapiens
tttccaagctgaaggatgttttgcctccctgcccccctttttacttcaactttctaacctctctgagccttggcttccttatttgtaaaatggggctaataatagtagcaacctcagagagctgtggggtataaatgggacagtataacataacacagggtaccagctattattgttattatttctttccccaatctctgaactctggggccaatgggaaggtaatgtacattttgtattttcctattagtgaaaattaatattttggtttttctcttactacataaagtagttttggttatgataggaaaatagaaaatatagatgagtaaaaagaagaaaatagaaaacacctatagccctcctactcacagatacgccctactgtatttcttttcagaccttttaaggtccttttcagaccttttcagaccttttaatgtgtatgtttgcgtgtgggtgtgtatgtttgcatgtgtgtgtgtatatgtctgtgtgtgtatgtttacaaaaatggaatttttttttttgagatggagtcttgctctgtcacccaggctggagtgcagtggcacaatctcggctcactgtaagctccgcctcctgggttcacgccattctcctgcctcagcctctggagtagctgggactacaggcgcctgccgccatgcctggctaattttttttgtatttttagtagagacggggtttcaccgtgttagccaggatggtctcgatctcctgacctcatgatccgcccacctctgtctcccaaagtgctgggattacaggcatgagccactgtgcccggcccgaaaatggaattattttataatagcatgttgtaacctcctttttgtccttaacaacataatataaactgttttatgcatggaggtagtcatctcttactttatttgtaatatagtttatttaaccagctgttgacgttacttccacatttttggaattatgactgactctatgagtcagctatggcctggagctcagcccttactaacactccgatggtctgattgatttcgcagtcctgtccaagaggaggatgatcagaagcgtctcttggttactgtgtggaacagggccagccagtccaggtgaggagagctgctgagctggagggggactctgctctgggctagtgggtgacagccaggtggccagcatacaccaggggttcgattagtgctttctggataaatgagtgatagtggcaatactaaattgcagaggctgcccctccttgagtctccatcattccaggtgttaccaaggactgtgttatcaatgagcatttgctgagcactcggtatcaaacaaggcactgtgctggtcactggg

SEQ ID NO: 134699 - DNA, 1498 bp, Homo sapiens
tttatactaatagtaggtacatttagggagattctacttgtgatttgccctgcactgtcccaggcactgtaagtgtatgctctcctttaatctgttttataaatgagatctcagtgccaagtacagtggcctaacgtcagaaagcttgtgaccagtgatgggtactgagcttaaggaaaaagtgaatggaaaaatctaagttcaatttaagtcatcaaattaaatataaattaggattaaatggtataaccctgtaacagaaataatttacctgagagggagaactaaagtgcatttcctcaaaaaataatctattttttcatcttgtaatgagtctgcaaccctatgctcaaaagtaaactgaatactattccccatatgtgctgcatgaagttacttcaaagcctttgtaacggctgttccctctgcccaaaatgctcttcattctctctggctcagttcataggtcttcttccagcctgtgagccctaaactacctcttgtgtccccgagccttcagaatttgttgcctgcactgttcatctgtcaatcgcaccctgtcttgtgacatcccctgtattgctgtcttgaactgctatttaaattcctggatgtttgtgttgtttccttaacgctgtggctccttgcccagtgcctgccaaccgtggacgtgatggattcatccatttgtcaagccttcactaagtgcaccaagcctggagctcagggactggtagtcagaattaaccaaggcttggttccggagactttgcatctagtgagagttcaggcactcccgagggtgagcgctagttcccaagtttataaactgactgctgtattgtcatatactcaggttgctttaaaagaagtctttcttcctccaaagatttttcaaaagcaggcataagaaatagctaattgaagaacacttagagagaggttcctgcttatggacattaattgtggcaatttacgctgcctgagttaccatgaaagcatgggaggccccttagcaggaagtaaaactcgagggaggctattaaccatttaacattctctaaacaccagggaatgaagatttcgcttagtgaagagcagagagaggttgctgagctaatgcattggcctggagactttgaaagtttcagccctacccagtaggaaagaagtgtacaacagagtagtatgggcacctggatagcagctggagttctcttgaatgtgtgacaaataaaatgaaattggtatgaggactttggcaaagtcttgccaaggcttttctggaatggcagctcagattagttttggctgtttatgatagtcactgcaactgcctcctattagtgctgacttggctacttcccaagggggaggagtatttgtttttggtggtgggctggggaggtggatgtggaagggcactttattggggtgagagcattgtcctttttgaatagattattaatagagccttggatgatgagagaggcaagga

SEQ ID NO: 134700 - DNA, 1043 bp, Homo sapiens
agattgaatttagcccctcgccatagtctgacatccccatgaggcctgaccctggcccatgcctacctgccctgctggtggccaggtcagattggtctcagcagcttttgtgtcaggttggtttggaccttgatctgtagccatctaagaactgctcagctccttcctggacctgagatagaacttcttgagcttgaggtcccataactgttctcctccactgagcatcaccaatgatgtgggcaaggaggttccctgtggggaccagctcttcagatctacctagcaccagaacggttaaaactcatgaagtaccgctgagcttctgtgtttggtagaggcagtgctgaacttgtcctgtgaccttgggaaagggaccaactctgagtctccatttttccctctgtaaaatggagataatagctcctctctatcctgcctcacagagtcagaaggatcaaacgagatgatgtgggtaaaaagctttgtaaaccacagtgcatcaggcaaacccatgctatacttgataatggacctcccgatagagcccagaaaaaaaatgctgactcaagtctcacttgttctcccagacagagtggactcattggctgcatgagctttggggtgaagtctctcctgactccagacaaggtgggtcctagggatgcttctgtcaggatcatcccaactgggccggggctggtacaggcagagtttctctgtcagctcttgggcagggcttctctctgtgagatggtgccccactgagacaggtgccctgtggggtggcctgcatagcagcactgtgtttattacctgcctagctgagagtttgggtccccttcttggtttgtcttgccagagagcagtttgttaggcagccccaagtcttcccaggaggctctgagtctggtgtctgctgttgaagacattggcagatcccttggggcccagagcactcctgggcctgccccagaagatgagggccaggtgcacccgtggtccgttccaggggtcctcttcatgtgtctaccaggcctgat

SEQ ID NO: 134701 - DNA, 1033 bp, Homo sapiens
tagttgaaaagctttcctctggcttctgtggggaactgcaaagacctttcctcctctctttctacttgccaagcacagagaggatggtgatcagggggcctccctcgtgattcatggaaattacatgggcatcaacaccgtaagtttgcttcctccaacatcacaggtttcttggtggcttgtaaagtcctcctgcgtgctggattctgcacacaggccctgagccccttgttctgaggtgcactggattttcctgaacttatgtgctcagagatgtctgtgggactcagcaaagagggtgtgcttctcagaggcttggttggggccgggggagagcccccagaggccatctcttcagctcctgtgctgtgcaggtggggagatggaggcccagaaacctgggtgacctgcccacagtcacacagcaaccaaagctgggttgaaccaaggaaccctctgtcatcaaggacttgagtgtgtggctgggcttccccaggggctctgagatgggcaaaagcagctgggctcaccatgcgctgctctgcaggatgctatcctgggactgccaggcaagaaataggacccaggttctggtcctagccccacactgccctgctgtttgaccataacctctccaggcctcagtttgtttgtcagtaagatgaggacgctgggttgtctgatgacctggaaatcccttccacatttgactttatggtccatgtgtatcaccagatcctgacagcaaaccacttccatggacaaaggacaaataaattgacttttttttttttttttttgagacagactctttctctgtcacccaggctggagtaccgtggcatgatctcagctcactgcaacctctgcctcctgggttcaagtgattctcctgccttagcctcccaagtagctaggactacaggcgcctgccaccacgcccagctaatttttgtattttttaagtagagacaaggttttaccatgttgaccaggctggtcttgaactcctgaccccaagtgatccatctgc

SEQ ID NO: 134702 - DNA, 1109 bp, Homo sapiens
tgtatgtccacagagcctggcatgctgtaggagctcaataattgtgtgccagtttgaaaagagcatccagatggcaaggccctctcatggacttctgaaagtaggagttgtggacctgtcaagcacatgggcctcagcaggcacatgagtcagtggctagttcaggttcagccaggaagcctatctgtgaccttacctgggagtcctcatgggatgccttggggccctggccacagattggcccccagaacctcagctctcttcctctgacccttggcctgagatggagtgagtgtgtcccagtgtttcctcccctgtgctctgggagggcagtgaccaggctggccttgactttgggcccttagcacagggcccgccccaggctaacgctctgtgaacctctgtgagaaaggaagaagggagccaggaaaacagtggatcaaaggtgaggctgagtcatgcagtgctggtgggcccttggatcaagggctggggctgctggggctcaggatggcaaagtttgcttttccaagaccttgtccatcccaggccctccccacatcagcctgggtttacttgctgagctttgggccttcctgcttggcccacaacccagtgctcaagttgtctgggctgagatagggacactgaggggctggctagctcctttgtgcctccagttcccttggagaggagggtggctcttggcaggggtgggctgtgggcttcctgaccttggggtagaggcaagagcctccagcttctggcagtgaccgggcagggctgtgtcctagatcaccatcccgaggggaaaggacggctttggcttcaccatctgctgcgactctccagttcgagtccaggccgtggattccggtaagttattgacagggggatgccaaccccacttgcccaccacacatgtgggctttgcaaacatagtctggaactaaaaggggagccccaaactggagcaaagtgtcctggcttttcaaaatgaaaagaataatatttttaagtgaccgtagatgaaactgccatttatgaaaatatgcccactttttttttgttgtttttatcaaaatgaaaataggtttttatattttgtt

SEQ ID NO: 134703 - DNA, 1638 bp, Homo sapiens
agcagggagaagggaaggcaaagggatgccttctttcaaggctcttgagaggcaccaagttcagtccctcatttcacggatgaagaaacttagagaaaaagggaggtccttgtctgaggtcaccatggcagcaaaggactccagatcctttgaaggggtcttaggcttcaggggcccctgaatggcttttctttgtccctgcagggggtccggcggaacgggcagggctgcagcagctggacacggtgctgcagctgaatgagaggcctgtggagcactggaaatgtgtggagctggcccacgagatccggtgacaggggacagcgggtggcctggggcctcaggctgatggcacaccctccccacccctgggcacactgccttgcctggcccagctcttgctgctccctcttttgcctagctgtgagcaggcaattccttttgctcttcaaggaatctgtttcttggcctgagaatggaaggttcaggctcagagcacttttggattccagagcaaacagcagggaagatgctctcagactctgtggttcaggacggggcaccaggaggttgctttctgctttagctaatttttgttacctaagagctaagcccatttgttatttaagggcatgaagatgttgcaaatgtttcaattgcacaattaaaaaaatattcttgaaaacattggagtctcccaaattttgatcctctagggtaaaaccccgatggccccattttaggtctgcttctggaataaccagatgagggcttgcacttaggtgacctgctagctttacttgcttatatcttgcttttgataagcatcatggattgagtatggaactctttcctgttgaaactggcctggcctcagggtccttctcaaccactgcccgtcaataggaattgacctaggtgacccatttgctgtctcttctttaaatggcttcttgcatcccttcctgccctgacactgggggcttcccctctggtgtctgcctcctcttcccccattatcctctctgccctgtgggccctcactctggctgatactggctttccccaggctcaacctgtctgtgtgatcccccaccttccaggagctgccccagtgagatcatcctactcgtgtggcgcatggtcccccaggtcaagccaggaccagatggcggggtcctgcggcgggcctcctgcaagtcgacacatgacctccagtcaccccccaacaaacgggagaagaactgcacccatggggtccaggcacggcctgagcagcgccacagctgccacctggtatgtgacagctctgatgggctgctgctcggcggctgggagcgctacaccgaggtggccaagcgcgggggccagcacaccctgcctgcactgtcccgtgccactgcccccaccgaccccaactacatcatcctggccccgctgaatcctgggagccaggtacggacagctggtgtggggaaggtgaagggtactgggtccctgtgggaggccaggaagacttgaagacccaaagttgtgtgatgagcagcctgtgaggggctgcgatgttgggcaaggagatggggtatgtgctagctctgccttctgcaaggctgttcttggtagggaggacagatgggt

SEQ ID NO: 134704 - DNA, 1042 bp, Homo sapiens
aggctggccatggggtttcattcacagcatggtttgagaccgagcagccctgcctatccttctactaaccctggtaggtggattacttggaggcttaggatttgtgataatcccctgactactcacactgtggtacaatccaccaagctcttttccatcaggtctcttgtgtgaacctcccactggccctggggcaagcgaggcagcaatcagtattatctccacttcaaagtggagaaaactttgattcagagaaggaaggaagctgttcagggttacacagactgtctctgacttgggaagtcagtgatcaagctcgggtgtcttatccaactcaaattcagtgatgatcttgagactgaggatggtgctttaaacaaagggtccagggcctggcagcacacatccctctgggactgatatgtagggccagatcagacaaggagctatgtgacatcttccttgtatctgttcctcctgtgcccatccagggctcatgctcattctactcctctctccgtgactcacagaagaggcaggaagtggtttgagttatcatggtttgagcgctgcccccagatttgtctatgatcagtggtcacttgtcaggggcacggggggagtcaacttgtttttcttaccttgcttggtgagaaggggctgggggtgggaggaggaagcaagtgtgaaaccttctgaggtgagttttatctccgaggctgtgggtgcgcgttggtggggagcttccctgaggtatagctggggtcaggccacctgttcccccctcgctgccagggctgctggcagcagaagacagcctgcacccaggacccaggctgggcacccaggtcagtgaggacctggtagttgcccatacagtagcaggaatgccttagaaggggcccaggagtgtgtggagcctgactgctttggagtttccctcccacctgcttggtccaggaacccctgactttttagcgactttgtgttttgtccctctgcctactagacggaatgtaacaaaaacctgtgcacaggctgg

SEQ ID NO: 134705 - DNA, 1014 bp, Homo sapiens
ctctgtatttgtgctacactcaagaagccaagccatattttgatatatattctatatttttaaattacaaaagtaacagtgattgcaaatataatacacattaaatcaaaatgtatcaattaaaatcccactccctggagtgaggagtgtggcatcttaactattttaaaaatgtataactatagagaaatgtgttgttttgttttacaaaattggattctatgctagatatttttgcacattgtactattttgatttacgatagacagatttctatttctgcccacatagctctactttattttttaatagttgcataaaattctgccgtatgaagttagcacaattcattttattcatcttctcttgatgaatgtttgttattttcttaaattacaaaaatgctgctgagaacatcctcatatgttcatatttatacctccttgtaagtatttctgtaggatagagtctcagaagtgaggctgtggggtcatctttaacaggttgatagctgaatgtcaacctgttggctttttaaatgtcaccaacagtccaacacacactcacggtacccttcagtgcatgccaagcccttctggctggttcttcttcagaagagacaaggtgtcaggtgtttgatatctcaaagggaagttcacatacttaataacactttgttttctttggagaatctaaaattggattttattgcttttgactaaaggccactgcaggatttgcaaaacaaagaacagtgtaatctttagtggcattaaaggatcaagtggattttcttagcataaaaatatgctgagcgtgcctgttggtttacctataatgtctaagaatagcctctgcctttatttttggagcagctaatgcatgaaaaagataaaagtgatgtccatgtctgtactagagtgtgagtaactggctgtttcttaaactgatttctcattaatgcaattaaacttatccacaaggaatttgataatattagctcacattgtgtgg

SEQ ID NO: 134706 - DNA, 1049 bp, Homo sapiens
tggggctcaggcacatgtgggagcgtggagggaatttctaacccaaactttccaccacgccctccactcgtgggaggggaagccagctgggagtatctgtcagtggtttggtttggcgcctgaggtctctgctgagaggggctcggtttcctctcccagatcatgaaaacaacagacccgtttgaggatgggtgacaggggcagagaggaaaatattacccagtgaaagaattctgttttggtggggtttgctcgggaaagcttcctggctgtttgcaaactgtcctgcctgcttagtgcctgagtgttcctcctcctcggaaacccattcagtatgagaaccgccactctcacttccccacaggaagccactgacaacttctccatctcgggctctggcctttcccctgtccatggaagggaaaagcaagtcacctcactgggtcagctcctccctccaggcgggctcagcctgaccacagggcggtgggaagaagccgcctgagcaactccagttccggcactggcattcccagagttccccatgcctgctggagggcattaggttggagttccagtggcctctgttcctgggctttcctgccatcctctccatacccccagcccctccctggctccctcacacccagcttcccatatgcccattctccagcctgcagtgtgcatattcacacatgcactcacaccgagtcccttcttctctgcttccccctccctgcccccagcccagacagtctaggaccccatcacatttgagggaggagcactggatgggccagggctcagtaatatgccctggttggtacatgaatggaaccctctctctgttgtgcacattacaaggctgaagctataacccaggaccctggtttgctcagcttcctgcgagaaggagggagggaagagaagcaaggctcacactggctacaatttgggtggaggtggaggttgcggggagaaggtagtagaggagctgagggcagtggctgggagtctgggatctgggcgtggtactgctgtgctgtgct

SEQ ID NO: 134707 - DNA, 1030 bp, Homo sapiens
cctccctgggcctcagtctctatatctggagaatggggacaataccccttctgcttgcctcagacagcgaagggggtttgcttaatggttgagttttggatctcagatcaggtgagagagggctctgggaaagtgacggaggggtcagacctgggccaggaagctatctctggggcccacccagcccgtgattggggatccctcctgcatggtccatgtattccttgcgggaagcgaggtccactctggaacccaatggctccttgttgcatttcaaaatgccaaggcagttggaatgtttaaaggaaaacccagatgcgtgctgcccttctcctccctcctagcccccagttctaatgttctagaaggggcagaatttctctcctgggtcagccccttgcagcctgttttctacagctgcagctcctctccggcacccttggcttcctcagtttgttgttcttttatgaggctctgaaccatgctgagtgctgcccccattccgtcctcctctcaaagtactgccagcacaaggctgtgacgtggaacagatttcagagaaagtttgcagtaatgcagggaggttggggaaggaggcaagggtgtcacagcacagaaaagttgtcaaggcaatccatccaccattccctgccataggaaatatgtctcagggagtgttcccccaacctcagcctcctatttccctgcagctctcatctcctggactttcctctcccttctagaaccttctcttttcttgccgccagcttctaacccccaagtttctgttattttcttacatagatccttttgactcttacttggcactaggatctgcttctggaaggccaaagaaatgtcccagtgtgttctcttaaacaaaagaaaccacctcctcttgtctccaccctcagcaacacaaggaaccagcagaagctttgaaattacagttttcttaaacatgatggacttcttaggcaggactccctccctccccagtccatcgctaggtgggaagaagtagaaagat

SEQ ID NO: 134708 - DNA, 1057 bp, Homo sapiens
gagagagatcttcgacctggtgcttgaggggagacactgggctgggatctagaccagtgttctgatgccagcctccatacccactcatgccgaagtcctgggcaaggccagagtagcggttttttgctaggtagaatgggactagccattcctgcccctgcctctctcacctctgtgttaaagagcagtggacaggaaagtgcttagaacagacccttgagattttctgtgcaggacctcctgaactgcaggaatctcagtgggggtgtggccgggcaactgtgcatcaccctgtttactggttaatagcccttcctctagagatcgccctgattcctgtacctgcctcttgcttccacgttttccaggaagtaccaccaacgaccccttgtacagggtcttgtcagtgtttcaaaaggcctgaaggtatttgtacctttacctgggccagataatacaggctaaaacaaacatccagtgtctgggtttcaggctggaatgatacccactcagtgtggttgagattcctggttatctcagtctgatcagaagcttagataggcagtgctgtgcctttgctgagcaacatctggcaagtaacttattacttgatttggtttggtagataaaatatcattaaggctggggtttaacccaagagatccttgaagatgaaaaagttgagagccactgagctatacaaatacttttcaattttcggtgaattttctattcactgcagggcggtgtctgttcaagcaaggatgcattagacacattcctgcctctgccttcgcttaagtttgtctcatgcaacagtccagggaacctgttttgtgggaggtgggacatggtctatattggctggccaagaggaacacacccctttgagaaggaactgtacacagtttgtgattgaaaatcattctttcagttcctggctaagaagtgcaaggcctagagagagtttttgaacagccccctggaggagaagacagttgatgagaagttagctttagcggagggcagagagttccaaagaggcagtggacattgc

SEQ ID NO: 134709 - DNA, 1017 bp, Homo sapiens
ctttccttcctacctatgtcatagggtcattaggagaactgaattaaatgacagaatttttatcaaagcaaatgaaccaacttaatttatggctgaagaggttttgttttttacaaagatacagttaattcaggagcaaggaggtaaggcaagagcgggattttaaagaggccaagaggagctgggtgtctggttggatttcaggatgcccatgtttaaatgcacaggtctgtgcccagtgcttctgggccagggccagtgcatctgaaaggtctgtgcttggctgaccaccccatagtcaggaggcaccgtctgagtgagttatgtgaggaagccttcagggtggcttatggccttgaccacagagcctgctattgagggcacagtgggcatcagtgttgggactgacgagttggatcacaccctggattaaaagagatggtttacctgtgagggaagccaggaaggtaatgagtgtccccaatttagacagatttaggcagatgggaattcagcctccctggagggagctggcttagtgctctctctcttggcttggccaagagagagagagaccaaagcttaggtctcccgaaaatgtttgcccatctaagccagccagctctgccccctgccttggaagccttctgggtcctctagtattacagcttcaagctctgagagccagagacccagccctacactctgctgttgagacaggcaatacggtcaccatctcaggtgaagaaataatggctttccaaaggagattcccatggggcagggcagcagagggtggttcttgtggtgtcagcaaaacaggcataatcatggctattaccttgcagtgtcgttggaagaaatgtcgaggtatcactggtaaggggcttagcactgtgcagggcatgggatttgagggggctgcctcagtattgagggtaggtggctctctcactgtgagaggccctcccaggatggggggagctctttcatacttttgtagggagggggacacca

SEQ ID NO: 134710 - DNA, 1025 bp, Homo sapiens
ctgcaacatccgcctcctgggttcaagcgattctcctgccccagcctcccaagtagctgggattacaggtgcacaccaccatgcctggctaatttttgtgtttttagtagagacggggtttcatcgttttggccaggatggtctcaaacttctgacctcaggtgatctgcctgcctcagcctttcagagtgctgggattgcaggcatgagccaccgtgcccagctggaaagttctttttaaaattgataatcagacaaaaggaattattagtaaggcagaattcctgcttcagaacagaaagaaaagaggacatggaggcccagggagattaaggaatctgctgaagcccacccaactgggtagaagcagggctgggaggctcgggccagggccagggccagcttcatggagtgatggcctttccaagctggaagggaccacagttcctgcctcaccccccacctttacatgggaacactggagacagggagcagagggccttctggtcagcatctgcctcacccggcttctccctgggaaatcttggggtcttttgctggccatatccttcccctgccatgggctagaggactctgggcagcggagggaagctgttgttaagtagaagctccaggagtgcctcagcgcaccacccagttccctgaaaccagcaggcagggctttctttcctctttccccagatgctcttaggaagatcaacttctgagcacttttgggcctgagaggaatggctggcactcagcatgggaagtgcccccactctgaagggtggcattcctgagggttgggttggatgcagggtagaagaagtccctagatattatcagctgatgtgatagtccaccccagctcaaggcctgctttcgctgcttctggaacagcttctcccaaacattgtttttgctggccccttcttaccgttcatgccttagcttgtgtgttgccctttctaagaggccttttctgatcacctcaagtatgacctctccctttatgaccttgg

SEQ ID NO: 134711 - DNA, 1023 bp, Homo sapiens
gccttggccttgggatcagagaagagcgctgtgaggaagatgggttctgtgagccaggggaggtggggagggttcctggctccacagagaatcagcctgaggccctggccctctgggcttcccacgtgctccctcagctgctgctttgtgctgcctgcccctgggggtgacctcatcggctctgtcctgctctccacaggcctctgctgtgttgggagccactgccttcctcccctcccccaacctgtgggcccacagctcgccagctggcccttgaacccacttccctgcgcctctggctgcctcaatgtcactggggattagtgtgcatttgcggcttttggcggacactcccctcctggctgcagcctcaccctctggagcccagggatgggcttgggcctgggagccccctgaaccagggagcagccctgaccgtccgtttctctattttccctgacgtcagaaggcagagtgcttattcactttggaagcgcactcgcaggagcagaagaagagagtgtgctggtgcctgtcggagaacatcgccaagcagcaacagctggcagcatcacccccggacagcaaggtaagggccttgacagtggctgtggcctggctgcctcgtttcccctcagccagcctagacccttgagcctctgcattgagctgggggccagcctgagcttccaacttggctctgggcaatgagctcttggcaagcggggacctgtgcccgaatgtctctcccccttggcatgtcattgggtctgctgagtgggtctgacagtgctcgtgtagagcgacagagccaaattaagcgtggcccatcagttctgcactctgttcttcggtttgcctatggcaaggtttaattcgggctggcctccctgatgctgcctggcatgcgttcacctctgccattgggtagcctgtgcctgggggcagcacactggtgtttaacattggccccaggcggatgcgatagaggggatgtttgcggcagaagctgttgtatgctgt

SEQ ID NO: 134712 - DNA, 1134 bp, Homo sapiens
gtcctggtggcttgtcctggatggtggctggggaagtggatgcctgaatgccaggctctggagaagagatgactccctgccccatccccctgcctaccctcctcctcaatggcccctctctcagtggatgtgagtgaggattaggaccttccccacagagccaccttttggccaggcctcgtgggggatagtgggggcagtgctgagttctaggagtgttcctggaagttgggggcagtgagtgctcagcctggcccaggtgggagagttcactgctgcccaggccttagcaggggctgctgtgctgtctttctgtcccatgctgagcattgtgataggaagctgccacacagtgccctggaaactgacttcgcatgctttccatggggcttccgagggccagggactgggctgggggtggcctagcagctctagtggagactgtgctgccgcagggctgaaggaagaccaaccaaggggacagccgtttgagcccagcccactcactgcctgctgcacctccagctggagcccagggttgggcagctctcatactcttatctaactgccagacctagagggagggaagcccaaggctgcaggtctgagggacacggctcatgggcaaaagggtatcaagaggattagagtcacttgcataggaaaagagggtcagagaggctgagggctggctgaggccagagaggttccctgaccttggacattctttgtgttgtgtaagacctcggcatctttagagaaaggttcttgtgcccctgtgagcttgctcagctgctatggccacttgaaccccaaaaatggtggcctagaagagaatacaccccttacttcccacttatcctcctctcaacctaggaaagatcagacatattgactcaacagtctaacaggggatgggctggatctgcccgtgaccagaccaatgccccccacccagcaagggagtaaacgctgcctgaagtgggaccagtgatacacagcatctctgtctgccagggctcagcccgcgggggggatttgtgagaggctgagcagctgggtctgcacagacagcaagctgcactttgatttcatttgattcccttacaaaatgacattaaggggaatgtgagg

SEQ ID NO: 134713 - DNA, 1049 bp, Homo sapiens
ccaccctgggggcagtcgcattctggaagtcagcgtgtgctggctgcaggagcctgggttcagttgcagcctcccactgggacaggaacagcgtcggggtgggggtgtgacagggaagcctcggtgcctcggtgattggcttggtcttgcagggagcggctgccagcaggccggctggaggcggctttgcgctgccccagcctgggagccctcaggatgtgtgtggggtggagcctgctagggatcccagtgccagggggtgccgttgtgagggatggacgcctctcccccggagcagcactttggggccagcttgggccctggggatgagccacaggggacccacagcctatgcgtgtgagcatgtaacccgggagccagctgggcccctcgcggggtgggcagaaggacgggctggcccaggaccctcttctttgagacatcccggactccatctcggatgaaagtgctttgagaaaccacagagttttctgtttaatggaagaaagaaatccagcctctctccagagtggcggtggccggctagacagggtgtgtgtttgggaaaggcgctggaggaggaggaagaggaggaggacaagtaggaggaggaggaagaggaggagggacgggtgatgcaagggttttgaaagcgctacctagatgtgggaggtggaacctggtcatttggttctgcttttcctagcaggtatcgctcccctggggaacttgggtaagtccataaatagctctgctgacacaaaggagctctgtctggggaaggcagccgcttgacacggccgccaggagctgccacagccacggccgcccgcctgcgggaggagccgggtggaaacctgggcgggcgagctggcaggagcggcagccaggagtcgcctgggtccctgctggagtatgctgggtaggtaccttggtgacaggactgtgtgtgtggtgggcgggcatccaagccaccctgtgcccctgtttctattgtttcttccccagggcagccattgataggcatgttgcaaccaaaccatttgtgc

SEQ ID NO: 134714 - DNA, 1049 bp, Homo sapiens
ctggggttattgatcctcaagccagtggtctgtgtggctccctcagaagaggcacagctgaagagagagtgcctatccccagctgggtccctgggggccttgagagctgcttcccattggcctcttaaggccctggagatggcagtctctttgccttctattaggttggtgtaaaagcaactgcggtttttgccattaagagtaatgtaaaaccgcaattacttttgcaccaaactatagatagatagatagagaactgaggcaggagaggaaggacacttgcctgaggtgacatgcgactcagcaggaaatcagggacaagaactcaggttcccctgcccaggcctctctgtactgcaccaactggatgtctcagagtatccaggtttcatcttggggctctctttctggactcaccagtgacatgtcccttttggaccttcgggctcactgactagagccctgctatcctctgggaaaagcagcatgtgcaatagacaaagccccttggtcggtgggctggagactgcggcaccttctcgtcccttcttactgatgatttcaggcaaatatgccttgtttctcacctcagtttctcctttgtagcaactagggactggaccaagtactgccaggtgccttccaaatatccagttctctgattctttgcaggccgtctcctcttcctggcttccaaaagtcaatggtcagggccagggcttggtgcagcagagaagcagcccccagcctgttccccaggcgcctctgggcaggagccttcgcatgcaagctgcagcccaagccgaagctgggaggtttgttgttgtttgtggagccaggcagtttccaagatgtcattgcttagggaaaaccatcattcctcccaggaataaacaaggctgcttatggctcagccccctaagcctggagaagctggagccactcacagcagaccagccaggctcagcctcagggagtgctgcctgcccctgcacaaccagctgtaccctggcttccaggattggagtggggatgggggcaggatggtg

SEQ ID NO: 134715 - DNA, 1050 bp, Homo sapiens
gacagcaggccgaaggcagccaggagaaggactgtggaatgggaggtggcatggctatgccacccctcaagtcaagggttggaagcaatgttcagccaggccatgaaatcttcacttctcagacctcacttcctgcagttcccagttgattcaaatagcagcagctctgtactgtcctctctgcctgtctcccttccgtgtctttccttctttccttccttccttccttccttccttccttccttccttccttccttccttccttccttccttccctccttccttccatgtgtgttaagcacctactgtgtgccatgtacttacaaattactagtggcatagatctaaaaggcccaatctttaatctagtgccaggatgttcaggtaatggacagtaacaacacagctttaatggagaggcatggggtggggaggggggtgctgtgggactccccagggaagcactcagttcagcctgggagcctcagcaaagcttcctacaagaggtgaagctgcatgtgattgtacagatgcttgcccattgaagagcaggtctccatcccagtctatccacccctcagaggtgtagacatgtttcccgcctatccatggaaattgcttttgtgtgtccagccacatgctcctccttgtctagggaggttgtataggaatatgggctctggacttgagggaaggatctctcctaccttacagtcttgtgctcttggacaagaatggagcttctcctgccttcatgtcctcaagcagtggtctagcctcctcgagttaaatgagataatagctgtaaagcacttagacatgtttcatgtgaatggattctgtgtcctgatagcagtgggagtgccactagcgcccatctcataggtggctgttattaaatgcagcgatgtaggtgaggtgcttggcgtggatctgacactgagcaggcattcaggaggcagcgcggcagcgttttgctggagggaaacagttggaatgcgcaatcagagatgtgtacaaagcaaggagctcaccgagaagcagtgagcc

SEQ ID NO: 134716 - DNA, 1031 bp, Homo sapiens
ggccctgcagcaggtcctgatggacaggcagacaggcccatgagagggtggagaaggggtgaaattcagggagggagatgttaaggccacgctgtgctggagtgaccatggctatcgtttattgagtgctcatgggtgccctcatggtgctgagctctggatactcattagctcatttattcctctaacaacattgtgaggagattctagaaatcctatgttatggctaaggaaactgaggcacagaaaggttaagccaaaggtcacccagcaagtaagtgtgaagttagtatctggagctccccctaatgtaagtaccgcctccatcctcctgaattttgccaaacctgctgtgttggagacagtggaggtagaggggagaggagtatggcctggagggtctctgagctggtggcggaggaaggactgggggtgtcagcctctgggtggtcaagaggccagacctggaggagctgggctgacgctgagccaggagagctaagtgttagctgagccatcaaggttcctggaagctagcattgagtcagggacctgaggctagggatccagagcatgccaagcttgaaggaacagcccatcttgaaagcctgggggtccaaggcagggcaggaattctaacagcctctccctttctcaaaggactttacagttcacagagtgccttcctgccctttctcacttggtccccttaggtctctggcacaggaagcagcaggcatcctcacccactttcatggcagagaaaaccaagcttggagtggggtagcttgggatcacacagctagcaaatgatggagtgaagattccagtccaggtcttctggctgcatgtccagtgctctgtcagtaaaatcctggctgttaagggccaccctgagacagaggcaaaccccagtttacacccccccagtgcaggaagtggttttcgagggcagatgcagagcccggcatccgtggtggctgtgatgaatcatcggagtgagagctgcaggttgtccctgggtcagcaaa

SEQ ID NO: 134717 - DNA, 1034 bp, Homo sapiens
ccctcaagaaagagctgggccgcaatggtggctccatgcaccacctttccctcttcttcacaggacacaggaaggtgagaaagctaaagggggagggagaaggatacatgcaatgtggggagggctggcccaggggctgcagggaatgagaagtcaccatgttccacccccactatcctggcagcctcccagcgaactttccacctgttggacagaagataaaactgaggcccaatgggaccaagaaggcagagcatggacttaaacacatgactttaggattccagatgctgtgttcttatagctccactggtccccacagaaagcagagcaggtgtagcttagcccaggccattgtgtatttggatttaaaagatctgagatagtagctggagaaatagagttacagcctagccagactagaaatccatcagccagtcacaatgacaacacacatttattccgtgtccacattatcctaagcagtttacattaactcattaactctcacaacagccctttgaagtagatagtatttttgtgcccattttacagcagaggaaaccgaggcaaagagaggttatctaacttgctccaggttacacagtgtatcagtgtctgaactagaattagaatctggttccagggccagtgctcttaaccaaccaccacaccgtttgcctctcgtgaatatttatatgtagatgaataagtatttatggatttcctgctgtgtaccaggccctgcgctctgcaacatggcaggagccacagaagtgtgtgaggctggtctcaacctgagagaaataagttaactgtgtgagccttgaaagtggcctaacagtgaacagattgcgccatgatcttgaagcctaccagctagtttgggtctgggctctgtttcttactatgtggctttggttgagtcactcaactcctctgagccatagttttcttctctgaaaagtaggggttaatagcactcacatcccagaatggttgaggatgaatggaagaggctggtgcctgataac

SEQ ID NO: 134718 - DNA, 2001 bp, Homo sapiens
atggaataattaagactgttttctgattttgtttcctgaaaggtctaggcatttcttttttgttgttgttttatccagaaaatgtcaggaaccttttttgagcaatattaagtggaaaaaatgtaaattcatacattatacaaattgagtagcccacagatttgtaggagagaccgccattaaaataagatatgcataattaacattattatgaaaaaactaacagtggattcacagaagctcattttttatgacatgcaactgaatcaattgatgaagacaaggattgaggaatccttggtaaggaagaaaattttcccttttctgtcttgttcacccttccaatttgaaaaatttattacttaaaaaaaatttagattggtttcaggcctctttgattgtgatgtggggttggtagtttatcaatatttgttatttttcaaaaacctgattactttcaaagggggaaaaatccattagccttgatcattttggggggtttgtgaccaaaaaaaaaaaatgcacaaattttactgacttaacaagaaaaagataaaagagggatgggcaaaaaggagatgaaaattctgattcttatccatcttccttggtagaacacttactttgctgaagaaatgtgatataacaccaactcagctggttttagcagcaacaaaataaaggaaaaataatcaaaatacaaacaaaagccaaacccaaggtttgcctttggaatatgaaagcatatatgcaaacaatatttcatgtggaggttttggccttaaaatgaatcacatgaaggtgaaacaaaaaagaaaaaaaaatttaagaaggcaaataaatattgaccgaattgaaatttgacagatgagaataaagtacccacccaaagatgaagcgttttgtgataaattagtatctaattgaacttgctggggattttgagcctatcccccaaaagttacaatttttctgtccaaaaacagcatattgttaggacttgcagggcgggatcttggagggaccttggattggaaattgatggtgggtcacctggggcaagaaaggaaaccctttgctccttttgccagccactagctggtcttgggaaaactggtggccccagtccatagattcccaaccctgttttgtggaaatttggatgtttaagtggaataagtcaaatatattatctctgtgaaatatatttgacaatggcagaggtttgacatttcccatcatcgccattgcatttgggagattttatttttttagtaacgaaatccttcagggctgactggtcacattctgacatatttggaatgagcttttttttttttaagtagcataattaaaaaaatttttttctgttgaattatttaggccgatgagtaggacggtcaaggaatttataatttccaaggggctttggaggcctcatgaggcagaaggcctgagtttagcagtgatgaaggagagatgggctggggaggggtggaggggggtaggggcatctgagaaaaagtcagggttgtagataacaggttatttctggtgcaaggaataaaaatattgcagcacgtccctttgtgtggcctggatctcctgacacacaattcagcttccttcattccattctgctgaaattttgttctgttgtctatggctagaagttgaaaatcatttctggttttgtagaactgttttttttttttttctgttttttttttttttttaaattggttattctgatcatgtttgttgtaaaggaagtagaggtgcatgatggttctattgggggcggggccagttttcttttgtttctattggtgtctctctctggattgagatctgaccttggccttggctctctcacctcctattttaggtggacgtgtgaccagaaatggacatgtgagctaatttttattagctcctgtctgttcaccacattctcgtagattattgggcaaaatatctggcaaattggacttgggggtg

SEQ ID NO: 134719 - DNA, 1981 bp, Homo sapiens
ttttctaacaaggtttgaaatttcaagggcctgctttatagtttgactttggagcaagctaggaaaagaggtttgcttatacttccagctctgcacagaggtgaacttgaacaagggttcttgcttttgcagaacgaaagcaacaaagatggctggtcagtataaggctgacctctccctcgtcctagaaaataaacagccaatggcttgtttcacttgagaaactgggttttaaaactcctccagtgtcagatacaatatttttctcacttttgactcagctcttggcatgctgcttcctctgacctcagaatccttacgtcttctccttggtgggtgataagaacttccttgccatatatgactgatgtatataagccgacttctcatggtcatgaggaaattttgaattttttccatgttcttgtgatgttttgggtcagttgtaccttctttctggtgatgtaaaatgaagtggctcttttcaggagccctagcccccacaaggtcttgctgtgtgaccttggacaaatcactttttccttcagagcctcaatttttgcatttataaaatgaacacttgggatcagatcaaggataataataaataggtttcatttctgattgtaactccaaggaattggttatggctgcctggatcactgtgttgagaaggattctgaggccatatcccgactcccatattctagagagaggggtgcagtggccaaacagcattgtaaatcagagtggagagtgtacctcttagttaccattcccaggcgagaccttgaatcatgggccattagtggcctgtgaagtcaatttagtgaatcacaatcagaattttttaaaaacaagaatagactagaatataggggaacaaaaaatagcagaggcataccacagggtacaggtgagtatcctctcatgaaacttgtatttatatttgtggatgtatgtgtgtgatttgaaatagatttcctcctgtgggtcacggccaaaagagtttgaaaggtactggactagctgaaccgccatgatgtgctgcaggtatactgcactttattgcttatactttatttttgcatttattatctcaattaacttttaggtgaaccctgtgggttaggtgtcctgtgccacatattttgagccctggttgagcccacttcaagggccacatatgaagaaagctcagccacatgggcagcccaggcacataccccagcttgttggccttggatgagtctggaaggacatatggaaaggcagatacaagtttgaaggcagcgtctttgcaaggtcttcttgctggagaggagatctaaagtgtgtggagtccttgtcttttgttccccacttttagtttaaattgccagagaaatttttctggagttagagagtctgtgtttgtgctatatttaatttaatcagacaaaaacacagtctgtatttttgtgtgtgtgcacttccttaaaaatcccagaatttctgtcttagtctcctcatcttttaaatgtgtcaggtcagcgctaatagaaatataattcaagcccccgttgcgagccacatatataatttttaattttctcacagtgtattaaggaaagtaaaagaaacgggtgccattgattttaacatatttaactcagtatatccataatactatcctttcatcaagccatccatatgaaaattattaatgtgacaagttacagtcttttgcgggggtgctattgagtctttgaaatctaatgtattttactcctacagtacatctcaattctgaccagccacatttcacctgttcagcagccacatgtggctggtggctactatattggacagctcaggtttggaccagttgtcgtcatcactggctggccccagaagggtagcaacacctttcagacctcttggttttgttggtgagacttcctatcagaatctcacatgctctgaggcatttcagcctgta

SEQ ID NO: 134720 - DNA, 1060 bp, Homo sapiens
gagaaggtatgcttgagacagaagtcccagtcttttgtaagctaccctcagaagtgatattctgtcacttttactgcattctgttcattagaagtcagttaccaggtctagtccagactcacagggaaggggtgatgtagggcatgagcatcaagaggcaaggagccctgggtgctgtccccaaggctgctcatcaccggccctcccggctgtgcccttggggcaaatcccttctgatcctcagtttcctcatgtgtaaaatgagagactgcttcctccctccgctagccagactgggctagtttcatctttggtttctgagatgatctggccagaaaaaccccaccccacaagactgaagccctggtaaccaggtgtgtgttttcatcccatgcagacaatttcaggtacacatgtgatatctgcgggaagaagtacaaatactacagctgtttccaagagcaccgagacctgcacgcagtggatggtgagtcaggcccctcactccctggagtcatgccaagaggcgcccttccttggagacaccagcccccagccctccccgcctccctcctccctcttacccagaaaaaggccaggcagtagctggaaccatgaggggaatgaccagccctggaggattctgggggcgggaacgtcaccatcatactccacatacacttctatttaggttaacccaagtgaaattgccatttttataggtcaaaatcagtagaatattggaatttcgtatcgagtcattttgtagtttcatattgagcatttgcatgttctgattaaattaaaccggttttaaaaaacgaatgatggccttttagcatcttagattatacaattagaaattagaataatacatttagccaacacatatttgagtctcaaaaatcctagaaagagggtcttagaccttggaagggccttaggggttccccgtctagccccacaccttcagcccatcttgagctgtgacaaccaggcccaccacctgttaccactggcccatctcttttctcacctcgtctttctctctcctcccaat

SEQ ID NO: 134721 - DNA, 1037 bp, Homo sapiens
cagaggagccacacacacacaccccactatgcctcccatccaagaagccatttctgcaaagagcttttcagatgcatctccaactgttatcatgctagagctccttttacagtgactatcgagaaatgcaactctggaatcagctgaagcctgactgtgtggctccagtcactctctgaaagtaacacccttgccttccccacaagccctcctttttccagtcccagcattctcacttccgctaatcactcctcatctggtacccctttcatatcttccatcattgtctcctccaagcgcattgcagtcagtacccaactactgccaagtgaccacagcaaagctcgagggtttgggtggcatctggctagcacagagttgagcaagactatcacctcctcccatatataatctatgctcctgttaatgcaacctgagtgcatgttagcttttttgacgaccacaccacaacattcacactgagctgatgaccattagaaactcctaagattttctcatgtgccttctctggtgcagtaaagttttgtccccgagtggagtccttattaagtatcatctatccttttcgcctatctggattaatgcttattgaatatgtggcttaagggtctgtgactgcatgaccttgttaaggcatgaaacatacagataaatagtgttgcttagaggagtttcagggtggttcgtgccaacttgtcagcattgttttctaataacaagggactaacaatttgtacctggccttcgtgagacccctggagggaactgccactggcgctggtttcgtagcaagaatatacctcaaatgaccaaacaggaatgaaaaacttcaggtgagactcccatgtggggctcctgggttctaggtattccatactcacgtctgtgcttctgatctgagagaggaagtgcatattggtatggcctttcaaggggaggacaatgcgggctcacgcctggcctctccagaccccttgctatgaggtggtctttagctgtgaagcagattcttacgt

SEQ ID NO: 134722 - DNA, 1024 bp, Homo sapiens
tttgtttgctttgtttttatacctccttaattagaatgtaaactcctttagggcaaaggatgttgtctgtctcattcttcctgtgcctagaatggtgctggagcatgaaaactcggtaaatgtttatcgaatgaatgaatgaaaaatgaagattatgataacagcagctaaccttttcagcgcccttgaatccaatgccaaatactgcgctttacacactttctatcctgccatccctgctccaactttgtagccccatgttataattgaggaaaatgagattctcagaggtgaagtcattggctttgggtcacccagccagccagttagtacagtagtactggaatccagatgggtctgaaacaagaggttgtatgccccggtttgcccactggggaaaagagtacacgccccagctagaagaatcacacccaaccttgttgcatcaatctccataggcccctgaatctgagatacaatcatgtcactgagggctcttgagacatgaataggtgcagaaagaatgcttgtaaactctccagacctcttagatcaaactgactctgctgtttataataaagagtccccacttcctgggggctgatggggggtgttgagtgtgtatgcctgtgtgtgtctgtgtaagtgcatggagctgtacatgtctggagatgtttgcaagatttccagcgtgttcccagatgtcagaaggatctggtagtgagtgcctgtggcttgttagcaatgggactcagagtaggcgtcttcagttctatgagactcagtgttctctgtaaaatggagatgatagtcgcccccgagcccagctcatctgactgttggaaggagtagatgaagtcatctattatgcacgtagtcctgggtaaacggcagcacatagagagggtctacaggtttgagcgtgcatgtgcgcgtgtgtgtattctggtcttgtgtgtgtattttagactctggaggagtcttcaaattctagggttctaaaacatcatagctgaagaggact

SEQ ID NO: 134723 - DNA, 1023 bp, Homo sapiens
ttcctcggggtgtgataaggatggaataaatgctttaatatatgcaaagcactggcagcaggcctggcctatcattcgtgctcaataaacattagcttttgttagagttattattaaatcattccaccaagagtggcacgcagatagtggtagaagccccgggcgaggttactgccctttagaagttcccaggctaatgaggacgtgaagcatgaacacaaataatgaagatacaagggagaaagtggagaaggatgctaccgaggtgcaaaaatggcactggggatgggggggagagattgcttccggcttggggtatcagggatgcttgcccaaggagagcgcttatgagagctgggctttgaaggatttggctcagaagtcatgagggatgggaaggacatgcctggtggaggggacagagtgaggaaaggctgggagggaggaaatgagatgcatcctagggaagagccccagaatggtgacgagccccagctgtggagtcagctggccctgggtgacccttgaactgattaggaattcccgaagagaattcacagctccactactgactagtcgtgttgctttatctacagagcctcagtttctttgtctgtccagtgtgggtggtgacaatctggggggtccttgtgagagtctaatgtggtagcatgcatgtgcctggcacaatgttggcactccgggttcgcagccgctgttagttaatgccagcactcaggcggccagaggtggatgtaagccctacatccaggaccttgaaggcctaggaggagccatggcaggagccacgggcacctaccagcatccctgggggtgggcagggcttggtgccgtgctagcatctaacccagccgcgagcttccttctgcaggtcctggagccctggcgtggggcgggcctcctgccggcgagcgcctgcgcccttccctggcgtgagggtatgtgcctttggactacatcgtggaagccagcaccatgcagtccatgggcatatacacttgc

SEQ ID NO: 134724 - DNA, 1040 bp, Homo sapiens
cctgccctgacctctcccctgtctctcccctgcagggcctgcctggcgttcctggcaagaggggcaagatgggtatgccggtaaagattttccgtgtctattacgcagactctagcggggaaccccacctcccacggccacgctgccctggccacctgctgcctggcatcttctgcttctccccctgctttgagtgtgggggccgcatgtggggttgtctggccacaggacctgctgctggcacacggcgtgactggggcctggctggggctggggcttccatgggctctggacccctctggggtagctcctgtctccctgtgggcatcagtggctctccagtgcagttctgtgtctgggggcttctgtctaaggtatttgtgtctgtgggtctgctgtgaccgggggaccttggctagaccaggtgactctgctcccatctcagggaacactcagtctccacatcgtcttggtgtcatccggctctgtccagtttgctcatgcacacgcaaagccagaggacaatggggtttatgggcagtgcccacagcaggcatgaccgaaagaggggctcagcggtgacccccaattcaccagctttctctatggctccccatcatgggaggaaattgtttttccctttgtttggacatgtgcagaacatggagaaagagccaaggcacggagagattaagtcacttgcacgatgagtaaacaatgcagccaggattggaactcagttggtttgttcccggtgtctttgatctcagtggctgcttgaggcagcctctcagggtccctagttggcagtcatattataaaaataggttccctagactcttcgcctggaaggaagatcattcattccaattattgagaagcgggaaactgaggctctgagaggcagaatgagataccagggtccctctgccactgccctgcaggttgactccttgacttggaaccatggtcagaccaagtctgggcctcccatcgctggtggttggtgaggaagggagtatgaagaggaggcctggagc

SEQ ID NO: 134725 - DNA, 1019 bp, Homo sapiens
tcttgggacttaggaagggtctcgaaaacacctctcatttcctctgcattccatgagcctcttagtcttgggcaaaaccctctccctcgctgagctcctggatcctagctcagcccaaagaccccccatacagtaagggagtggatcagatggcaccaagatctttgaagctctggctctggagtcaggcaggcccttcccacttacgcagccaagaacctgtaagaccagctcacgcagacctcagtttccccgtctatcaagtgggcacatgtctgggagcatatcaggaaatgcttgccaggaaggggcctatccctgttccctccatagagaggcagggaaccctcggtgtggggggtgtggggggcagcctgagccgctcactgccgttgcttctctataggtcgagtttgccatcagccgggtccagatgaatttcctgcacctgctaagctccgaggtgacccagcacatcaccatccactgccttaacatgaccgtgtggcaggagggcactgggcagaccccagccaagcaggccgtacgcttccgggcctggaatggacagatttttgaagctgggggtcagttccggcccgaggtgtccatggatggctgcaaggtaactctcagagcccctcctaggcccttcatgtggggacaactggaaaaacacttgtttggaaaaatgtgtttctattataagattatatctaacattttaatagtatactatattaatgtgatagatatgatttcatctttgtgtaatataacagttttctaaaatcgtttttactcactttcctctctgggaagctatgaggggaggtctgggctggtaaaaattctttgggctagtagatgttgtacttacttgcaaggctctttcaaagaagatacatttcttcttcctgctcccaccctagtcaggctaatttcttctcattatattttttggtcattttcaaatgtcctgaacagggtgggttgtcaggggaggggaagacagaaag

SEQ ID NO: 134726 - DNA, 1006 bp, Homo sapiens
ccagcctggtccccacaacgtgcctcccccgatggccatggtaatactggaataaggtccttgtgataggcaccacatgcctgaactctccccaccccatccaccttgtatttgtctgttctcacattgctataaagaactacctgagactgggtagtttatgaaaaaaagaggtttaattgactcacagttccgcaggcttcagaggaagcatggctgggaggcctcaggaaacttacaatcatggtggaaggcaaagaggaagcaagtcccttcttcacaagacagcaggagagacagagcgaagggggaggtgctacacacttttaaacaatgagaccttgtgagaaacagcacctgggaggtggggctaaaccattagaaaccagccccgtgatacaatcacctcccagcaggacccgcctccaacacatggggctgaaaattccatgtgagattcgggtggggacagagccaaacaatatcacacctccactcctgtttagggtcttctgcctcaaggttactcaaatgcatcctctcatttccttgcttgcagcagaaacagaaaaggatttttttttatgactagttgaagttttattacaatcttgctattaggagaaaggccttacagtagtctcagtttagaaattcacatttgtttgcttgtattgttttaaatggacacataatgtacatatttatggggaactgtgtgataatgttcccaacacaaagaaatggtaaatgtttgaggtggtggaaatgaccccgatttgatcatcacacattgtacacagaacagcaggttgtattatgctcctcatctttctagattggttcagatgccccttctaggaagccttcccagattttcgccctgcagaagaaaatgtcttcccacagtgctgggctcccacagcactcggtgcctgtcatcctccatcctggcacgtgtggggctcttcccaccagggacagcgtcttatccagtgcccagcca

SEQ ID NO: 134727 - DNA, 1070 bp, Homo sapiens
ctgcagagggcacggggaggctgtgcgggctgcgtagctgtgctggcaaaggagagcctgggcgtctgggcagttctgagggattgagccataaagggaagggtccctggctgtggaatgactgagcgggcggagaagccctgtgtgggtggtggggaagaagagtccatcccacccaggaactgaagatagacacctcaggggtctgttagacccttgagagagcaggggcagtggcggcttgggtgtaagaaggagatgtgcagaaggagggtgcagtggctgctacttccttgtggggccagtttctccagggatggcggggaccctgaactccatagccctccccagctcacactgctggagtcttcaccaaaccccactcactgccttttaggagcagccctgctgccctaacgagggctggctggaacaactctgcctttatctggcatgcagggacacctgcccatagctctccttcaaggtcaggccatactttcagacctacgtgcctttgcctccgtgctgttcccgctgcctggaatgccctccccagtcttctcccccaaatcctcattgtttctcaagcccaccttaaagcttcctttggtaacacttctgtattgtactaccccccaccgtttaaaatcttggaacacttttactcttttctatattctttgcatcttacgtagcgcctggtatatagtaggaagtcatagggcttttttaaaaagttaatttgcgcccactgggtgctcagtatgtatctttgtactttgaaatgtgacctcagggaggaggagagaggttaacagttctgaggctgttgcccttagaagctgagtcaatcagggacttcaaagctctttgagtcccataccctgcctcccaacccaccctagcagggtgatatccccttgcgatatcaagagcaggtggtactttctctattttacagtgaggaaaatgcaagcccagctatacacagtgagtaacagcagccaggactagcacctgtctcctgatgcccagcctgcttctctatcacagcatcgtcccagcct

SEQ ID NO: 134728 - DNA, 1056 bp, Homo sapiens
attcgttcacccagcaacaatccgcgcagcctggcggccctcggagccgcgcgcgcttcccggacgcctaacgcaagtttcttttcctctttttgtcgcgggggggaaggtagaacaagggccagtgtcgggtaggcagccctgacaatggtaggaactgaacgggctgcaaaaataagtccagttccctcttggtacacctgcggaggagaatgaggtccagagagggggcgcgactggcccaagggtgcacagcagggaggcgcagagctgggctctccccagtgtgatggggctggcacaggcagaaccagagtctgcttgctgcgtgaccttagacgacacttccaaagctcctttcccgggcttttgttgaaagaaatgacggattggagtccatcattacctatgtttaaagacctgcttctgagatagtcggaagggaaaattgctgataacaaacctgggctatgttggagcagagagaagctgagacaggctgcagtgaaaagagacattgttcctgtcctctagaacagaaggagaagaaatgggctggaactgaagcatgaaagactaaagttagatacatacagggacttcccaaacgacttttccaggcgccttctctggaattggtgggttttatttgggggctgttttgttaataaaacaatggctgcccatctgttagagagggcctaagtctggtttacttactaacaaacaggggagcggaacctatggtgttttgggactctgggtttattcctggggcagtcgtctcacagttcttctgcaggagggaggcgatgtccacgtggggcctttgcctcctaaagtccagccggtttgcatttaaaacatgtgattggggctgtttgttgcaaggggatttcatcagctcccaccgtcctgcagactctgccagaggcgctaggataggggtttccagagagactgggaatggtcccagctacagggccgtcatactgagagggtgttttggaaattggtgcacaacatggacacttcagtttccccccgtgggggcgt

SEQ ID NO: 134729 - DNA, 1924 bp, Homo sapiens
caagctctggctgatgccaagaacttcagttcccaaaggtaatgatgctgtccccagagacacccgccaagatcccaacgcttatcagctgccgagatgcaggggagaagttttccactcaggtgttgcattattcagagcagtgtggccaagagcagttagagtggggacagaattccagctgggcctggcaccactcagctgctcggcctcccctcttccaggcgtgatggggtctgactccttctccgcctgttgggtcttttggcaggatgatgtcagatccacctcccaggggctgtcaagcttcaagccactgcctcgcccaccacctctggcccaaggcaacgacctcccactaggccagccaaggaagctggggagagaggacctccagccaccttcctccatgccttcctgctcgggcactgtcttctcggctccacagaaccgcagcccgccagcgggcaccgcacccaccccagggacctcctctgcacaggacttgccctcttcccccatctatgcctccgtctcccctgccaaccccagctccaagaggccgctggacgcccatctggccctggtcaaccaacaccccatcggccccttcccacgggtccagtcacccccgcacctgaaaagcccctctgcagaggccacagtggctgggggctgccttctgcccccatcaccctctggccacccagaccagacaggcacaaaccagcactttgtcatggtggaggtccaccgccccgacagcgagccagacgtcaatgaagtgagggcgctgccccagacgcgcagtgagtacagcaaggccaggctctgtggtccttgggggtccctgtcctcttcaggtcagtctacctgatgacacagtgaagggggggaccagctacttgttgagggggctcagggccagagtggcgaagggagttggagaccccagtttgaatcccggctctgccactgactggctgtgtgactgtggacaagctgccgtctacaccttgctttccccatcataaaatggagataacagtgacagtcctgccaggttgctgcgagcgtcggggtgccttctccagctccccctaccctggccaccctgtgttcaccaggaggactgaactcgtggagggcaggggtggcttcccttcctgtccgccatggcctggcctggagtagatgctggaaactgaagtggcagtctctggacccctggcaggtctagggtcagggtgcaggaagaatcttggggaggccagctgacgctgtgccccggtttgctagaggacatgggctgtggggtagagggaagggcagagcctgcctccccaccctgaaagctgtggagctcccgcctgtgagtgagttgggagcattttgttggattctgctgccatcttgcggctacagtgatacataggccccgtaggacattccctgagcgcctgcacagaccaagatgcaaaatgcagggctctggcgctcgcagcctagtgaggggaggcagctgagggagagcaggcagacgtggtgagaagacccagggctgtcacagatggatcactgctgtctctagagctggcactgagctggacatgcagggataataagagctaacagccgtactaacaataagcactttgtgccagtgttcaaagggccttgcctatagtattaactcatttaatcctcccagtagccctatgaggttggtactattattatctccattttacaaatgaacaaactgagacatacaaagtagtaatttctggctaggtgcagtggctcatgcctgtaatccaagcactttgggaggcggagacgggcaggtcatttgaggtcaggatttcgacctcaggagcctgggcaacttgctgaaagccccatttctactaaagatacgata

SEQ ID NO: 134730 - DNA, 1003 bp, Homo sapiens
acgcagggcactgggacccatcctaggagtctggacccccacaccggtactccactctgtctctcccaggcagtgtgctctcaagaaagcccctcactcactcttggcctcagtctccccatctgtacaaccacggaagacccccatggctcctccagttctgagagtcttctctgcatcaggaggtgctggaaaatatttgggggaggcacagcaaggaatgacaactctatattcccacctcttctgtgtatatttgaacaaggactgcagcattcctccagagagagaaagagcttgaaataatcacctttattcaccactaagtgccgctgtgtggtctacaacaccacatattagtaagcttttgctgcagtaatgctgagtaataaccctaaaatgtggacaacaacccaaaacataacatggccaaaatcccttcctgcatggagctcacacactcctcatacctctgctaaatcacttgtcacattgctttaacctcttcgtgggtttcccttccccaataaacagcgagagctggtgcaaaatggaggcccagaaagtgtggaacagaaactggaaggaaagcacacactccccggccacttgcaggattatcttctactatgcggccttctaaacattcgcctcccacatggtaggaaaatgttctttgttctagtgttcagttgggcaagatgacatcaggtggctggctatcgatgaccgagatgccccagacactggccccaaatggagccagtttccatttagcctgaattcctcggatcatgctgtgtggttattgatcccaggttaaatgtggctcattctgcagccatttcccctcaaagcagacacagtcaatcaaaggaaatcagatccagctttcccccattcacaaactgtgttgattttccatttgtctaacagagagccagccctgagcattttatgctgccttcacacaatatcatttcccccataaagatgttggccg

SEQ ID NO: 134731 - DNA, 2064 bp, Homo sapiens
gacaaatgtcttttctttagagcagtggggactcgcctgtttccttcaaggaggcaggcagaatgaagggatgctggtcatggcagtggggtctttccctcccctctctccattattcctgcccaaagcattcaaggtaaatagaaaaggggtttggagaacgtgtggattttgcatgtgtgtgtgcgcgtgtgcatttggggaaggggttgttgctgcacccacccattccctaaatatttatttgatgtatcttttctttttgccttttgctcatccttcctccccaggagcggctgctgtggcttatagacctgatggaggtaccgtccttcctgccggtggggactgtgggagtcccttaaccaggggccggggtagggggctgtggccttttctgccacccccgtatgtctgcacccagtcctggtggggaccaggggttcttattggtgctgactgtctttccaggtcatcaggtttcctgagctctgcagtgagaatcccgtccattcaaatcccagctctgccactttcttgctgtgagacctcaggaagtggtttcacctctctgagctcagttttaggatctgtaaaatgaggatggtaatttctgtcccgtgatgttgagagaccccttggcctttgcatatgccatgtgctttctgtctggaatgttcttctccccacttcatatgacctgactttctcctatgtgtgcttcagccctcagctcagaagctgcctcttccaagaagacttccctgatcctcccaaggggagtgactttcaggccacggctcctcttgcccccgggcttcctttggtcacagctcttgcctcattatgtcctattataaaagcctgtacaggtttcccagttacccaatgtgactgctgactgcttgagggcagcgatcgcacgtgcggttaccattgagtccctatccctagtgctcagcacagaccctagcccataatttgggcctttattaataacaatagtggctgagatttgttgaatgttctctatgacactgtggtagtgctttccattcgtatcttctttgaccatcccaggagctaggagttgtgagtactgctgtgatccccattttacaaagaagaaaaccaaagctcagagaggagaagcaacttgcccaaggttgcatggctagtgagtgatggagccaggattcaaacccaggcttgcttgactctgagctctgttgttacccctgccatctggctgtgattcttccctgaaggatctcaccagctccctgttaagcatcatttcgtcatctatctgcctctctcctcccttccttcttcttgtccttcctttctgttaacaaatattgagcatttactgtgtgctatgtacattttgaggttctggggatacagtggtgaacaccaaagaaatcctttccacgatggagttgaacagacagcaggaatgccaggcaataacacaggatatagataactgaaatacacagtaagctaaatgatgacaagtgctagggagaaaaataaagcaggcaagggagactggagaggggtggggtggttagggagtgacccttgagtcaagacctgcaggtggtgagggagagagccatgccaacatctgggagaagagcatttccaacagaagcagctgcatgtgcaaaggccctgaggtaagagaatgtcagagaattccaggcggccaataaggccagagcagagggagtacgggggcagacatgctgaggactttgactctgagtgagatgggagtccttggcaggtaagagcagggaactgatgtggtctgacttcgatttaacagggtccccctgattattgagaataggtaagagtgggtttgtaccaaggtgaactggttaattcctaggaaccagccacacccagaggtctgtgggccacgaagggcctgggaaggtcatgcagcctgagttgctaaagatgtgatgatgggttctgcaggcaccagctcctcctgtggctgggtcagcccctgccctgttgtctcctgggaacccctcttctccc

SEQ ID NO: 134732 - DNA, 1042 bp, Homo sapiens
gatctcacaacagaaggaataaacaaggtaggacatcctctaaggggtattctctgcttcctcacagctccctgagtgaggaggtctggccagccagagggtgccgagtgacttacactacctcattccaactgggcagccccttatctgcccaccccccagcccacttatctgtgactgactgctaggttctgggcactacctctggcaccagggttgatggcaatgaacagagcagaccaggtccctgccctcatgcgggttttactcagtgaaggagatgtaaagacaaaacaaattctaattaagaaagatagtactatcaaggcaaggtgctgggggttatgagggagaataacagatgaaacaccacacttagacaggatggaagggcagagggggagtggcatggccactcagctctagagcagctaagaattcctgggcttctatctttctgtcttgcagccaggattttacaagggcccagccggctcccaggtgaccctgagcagcctggggaaccagacacgagtgctgctggaggagcaggctcggcacctgctgaacgagcaggaacacgccaccatggcctactacctggatgagtaccgtggtggcagcgtctctgtggaggccctcgtcatggccctgttcaagctgctcaacacccacgccaaggtgacccgtgccctgcctcccaactggcttcagcatttccagggctctgcatcctgccctgcccccgctcctttgctgagaacctacaaggggtcaggcctgaactgaacactgggcagagacctgggactgaggcagcctcctgcccccaggatgctcacagactcctgggggaaacagacatttaaagcgccctgtgattgggtccctgtcgcagtggcttccaacgctgagtgcacagaatcacctggattgctcttaaaagcagtgctcgggccccattccaggctggttaacgcctcatatctggggatgggagccagctgtcagtcatcttcacaagccctccaggtgactgtgc

SEQ ID NO: 134733 - DNA, 1017 bp, Homo sapiens
catttgttacagttgatgagcaaatatggataatatttttattagtccatactttatataagggttcacagttcattggattttgatcaatacataatgtcatgtatcaaacattatagtgtaatacagaagagtatcacccctctaaaaatcctctgtgctctacttctcatccttccctgagcctcaggcaaccactgatctttacagtgtctctatcagtttgcctgtttcagaatatcacatagttggaaccatgcagtgtgtagccttttcagactggcttcctccccttagcagtatgcatttaaggcttttccctgtgcatttttatttttccccatgaatttttgctgacttttctaacaaaagcttgttgatgtttttgttgggataatgttaaatacataagtgagctgagagagagccgatgtctggataatgctgaaccctttccaagaaaaggggatattttatttgttgagtaattttgagtgttttagagtgttttagaagtgtgtgaagttttcttcatataggtgttgttaacatttcttgttaagtttattccttggtagttttttctcttctgttgctactataaatgaggtttccccttccttccatcttatcttccagctggtcactgtttgtgtctgtgaaggctgtggacttgagcttgagaacttgattcttgcaggtctacagagcagcttgaagcaggtggtagactggattctggtccagctttgccccaactgcccaggaagccttggaccagtgacacccctcctctacctctcaccctagttttctttctttcagaatgaggggctggattaaatgtacaccatttcccagagtgtgattcctgtaaaaacaaaactgatttgtgtttttacctctttgtcttccctttgattgtaaaaatcaaatgctccttccctgctgcagcctgtagagctgggctgcatgtacccagcctccctacatgccctggccttgtcaaatgcaacc

SEQ ID NO: 134734 - DNA, 1049 bp, Homo sapiens
ccctgaggtgacaggagacccctggggaagcagggtggtggctgccgtgacctggcctgagccttgatcctaaggagggcagatggagcctaattgagaccccggggcgcgaacagtcaccccccgactgaagcctcaggtgaacgtggccactgtggcgtgaagagcatgagcaaagtgtctgagtagtcccgggtgttggccctgaggggatcccggaggccatctccctcagcaccttccccccactacacttgcagctgtgaccaagagggggtgaggggcttcctcaaggtcacccatcaagtcagaggcagagctggggcaggaactggaatgttctagggtatcttccaggccttggcctgggcctccttgccagtcggataagatgcgctcttcaaagtacgagagggggctttgcagcctgctgtccccggaagggatggctcctccagtccctctaatgttatcctctccctctgacaggtgaacctggtgctgggggacggccggtccctgggcctcacgatccgtgggggagctgagtacggccttggcatttacatcactggcgtggacccaggctctgaagcagaaggcagcgggctcaaggtgagggagggcctgagggagggaaaactctgtgcatggagctctttgctgctgattttaaatagacctccagcagagcaatcagcactccaccttgaggactggtcccagctggggagccctccctggctgctgtacctctaaattcacagctcacagcagcagcggggtggccgcctacgcagtgtgggcagcaggccagcccgaacttgtcgtgctgctgttttgcaaacactgctgatggcctgtggtggccctgacctcagggtttgttacgatgcgtggagaggatagaggagagaaagtgataagctgggttgggggtgccctgggcagcttcaggcctggcattcaatccagacaaccagcagttattgaaatattactggctcccattttaaagagggctaactgtgtgcccagcgtctgtgatc

SEQ ID NO: 134735 - DNA, 1029 bp, Homo sapiens
aagcagcaaggacagcatgtgcaaaggccctgaagtaagactgaggccagtgtctgcaaggattgagcagatgggagggtgggggttaggtaaggtgcctctgggagtctcaataactcatataagaatgtggggctgggcacagtggctcacacctgtaatcccagctctttgggaggctgaggcaggagggttgcttgagcccaggagtttgagatcagcctaggcaacgtagtgagaccctgtctctacaagtatttttaaaaaaattagccgggtatgatggcatgtgtctgtggtcccagctgcttgggaggctgagatgggaggatcacctgagcccaggagattcaggcttcagtgagctgtgattgccccattgtactctagcctgagcaacagagtgagctcctgtctcaagaataaaataatgcagaggtgaaggctgcatgaatcatactccagggaggacccagataccgaaggaggcaggagacaccctgaaccatcccagagacaggccgtcccagattccacagccccagactggcgcatctaccctcctccctgttcctcctcttcctgacacagtgtggaaaccccatttccctattgggaaggggcatgagctgatgtctctggatccctggctgctggatcctgggtaaggggcctggtggggtctgattctcttctctccagcagcctggtcccatcttctgatagtccaaaaagccacggccagactcttggactcgtaaccataacctccacagaggaagtatacctctcaggaagtgggttctcagggcaatagtagcataaaaatcacacatgtagccaagttacccctgaaaatccttatgccatcccctggagctggttatagttttatagcccttttcaggagtgtccttctctgtgccgtggtatgagacctgtcccgtgaggctgaagacaaagtacagagggaagaacagatgtagtgcttagggagtcagacgtggctgctcttaaatcactgtcaaa

SEQ ID NO: 134736 - DNA, 1139 bp, Homo sapiens
tttttctttgcttttctttttgacctgtgtagtgtatgttataatacaggctaagctgccacaataaaagagcttaaatactgtgatttatttattgattggcttatttatctatttggagacagagtctcactctgtcgcccaggctggaatgcggtcacgagatcctggctcgctgcaacctctgcctccagggttcaagcaattcttgtgcctcagcctcctgagtagctgggattacaggcgtgcaccaccatgcctggctgaatactgtgatttaaatgagagtttttttttttctccgtcatgtaacagaatagagggacagtctcatctgggggacagttctgctccaggacttatcctgggacccagattccctccatcttccatcccccagggtcttgccccttctcgtggttgaagctgggccacatcaggtcccctttctacctcccaggaaagggaaagagaggcatctctttaatttcaagatcaccaaacttcccactggcctagacccaggtgcatggccacacatagctgccaggaatgtggccaggattgctgctccacagggaatcttgtgcagtgtgaatcttgggcataagtaacagaaaccagccctggccattttacagagcagggatgtactggaaggacaggggcagtcccagaattgaagccgagaatctcagggtgcagcctgcagtagggggatgtccaccattccgttctcagtgtccttcccctgaagattcccaaagagggagcacctcacgggctggcagggatgtctagggactttgattgacaagaccaccaagactgtagccagtgggagaggggtggttgcccaaagcactgtggggtgttctaacttgcagaagggggcagggacaccaatagatgtcccctatggagccctcctgaccccagacctgtactgtttcttgaaacacaggaaggctgaaatggtccctgatatcttacccttctctctgggtgctgtttgcattgcaccccttggttactcctggaaccaagaacatagctcctgcaggcagctccctggtgtgtaggaccttgacactgactgccaggaggccacatggcttggggctctgggccaagtgcca

SEQ ID NO: 134737 - DNA, 1056 bp, Homo sapiens
caaatctatcattatttttcagacatcggccgagtaggtttttaggaaatggctgattaatccaccttgaattcagatttttcatctgagcttgaattaaattggaagcccatcaccttttcaactgagaattgtcaaaaagtgatgaggcacagggatgtcaagagtctgggaggagactaaatcccatcaacgtatctattcatggaatgagaaaacgatatggatataaacagatattcctgatggatctctgtgcttcggacatcgatcccagacaacaaaatgtgccattgcaaacccattggggctcatcttgagtgaatatatttatgactctgagaatcttgttcttccttaaagaaaaaaaaagaataaacagacaaaacttaaaagaacatttataaagcaatttacttaaattataacagactaaaagccaggctttgaggataattgaagaattgcattaaagaggaatcaatatctttctggaatctgttctgtccttatgagttgttttgcaaaggggtggacagcctatctgtcactttgttgcaaatttcttgtagcattattcccaaggtcaggattttatccctctctttgaaggtttatgtttttttcttttcacacagccttaactcacccaaacatttagaagcaatgacagtggagagcagggactttaaaatgtcaggtctttcttccagcctctgagatcccggcattcgcagcatggaagcaaaggtttccttctgcatccttacattgaaccctcagagaaggtcaaactcttaaaagagggtggaaggaatgaacagttggtttttatatcttttttaaaaaaaactttttctttaaatgttcttctttccttaaatactctcctatccagccgttggtttttaaaaacctacttcgtgaggcccaaattaaaggcatatctaaatagcactaaagaaaaccagaaaaggggagaagacacccacgttcccatccttctaactggacatcatacatttctctgccatctcccctggcctttatccttgt

SEQ ID NO: 134738 - DNA, 1072 bp, Homo sapiens
gaatgtatagcttacagagcaaatagctctcaggcactgggaacgtagttctgcacagacatggcccttgcctttgtgaggcttaaaagctagtgcaggtgatagtaacaaatacttgagcaaatgtgtggttacaatgtgtgaatagggctgtggattcttatgagcattaaaagagataaaatctctgcttggcataattaggtggcctttgctactgccattctgtggttttttgttttttgtttttccctgaaacagttttgttagctcttaagtggcctgaggaggccgtttgtgtgatccacagtgcactggcttgacgctgctgtttttggaccaggttgtgtatcctgaagcaagtcacttgccctctcaggacctcttgttctccacttggaaaatggggccactggaccaaataagcggtccctaacctttttggaaatgagactcctgcctgaatgtaaaaaataaattccctagcccctgagagtgtttgtcctttctgccatttgttaattgagaaatataacctcatgacaacaggcttccagggatttaatcatgctttttaaaggagtgtgtgtgcttactgatctacagcccagggctactgaaaaccagttggagtatgatggatagtgttgggtccagggtggattcatggatcctttgcaggcatttttcccccttcccccctcccccgacctcctttgcgtacaagaagtgaagagtttgggggaaaagggacacatgctctgcttctgcagagaaatgcttctcagggggttggactgttctgtaaacccccactccccgccagcgcaggtgttttgaactccagctgagggcctgctggctgctgggaaactcctaggcagcagaggcccacgactacttcctcctgagtgccgttcagtggcctgtgtccaggtgagtcttgagccgtctccctggctgtgcacctgatgttggcttccctcatttgcttcccagcccatcaacccctttggaggaagcccttgaggctttcagaaacttctttgtagcttctggaaaaaggccgatc

SEQ ID NO: 134739 - DNA, 1120 bp, Homo sapiens
atttaactttatgtatccagtttcccgtctggtgagaaagatgcttctatccctattttacagatagtaaaaatgaggctcagagagaaatgatttatccataccctgggaagcaacatagttgggactcagaagcctctttttccatgcaaggcgaagatactgatcttagtaattccttggtgtttctcctagtataggagttattctatctgacatccaactagatttcaagcatgtctcctctacttgtgcagttaggggttgtgtggtacttggaaagctttctttgagggtgttgggaatgagaagaagccttttgttcttgctccggtgactggaaagttctttgttcttcccagaatatttccagtcatgcccttgatagtgtatttccagaatgacttctcacagtttgtgttctgatggctcatcagtaacagaagttgtatctgtcgggagggataggagaatagattggggaagtgcaggaaaaaatgcttggaataggtaagaataattctgagtgccctagccaggtaggatttatgttttatacctttatcctgtcaagcctggtgcagggttttgtatatgtcaggtagctgtgaattggttttaaaaagtattaatttggctgggcgtggtggctcacgcctgtaatcccagcactttgggaggctgaggtgggtggatcacctgagatcaagagtttgagaccagcctgggcaatatggagaaactccgtgtctactaaaaatacaaaagttagctgggcgtggtggtgtgcgcgtgtagtcccagctacttgggaggctgagacaggagaaacgcttgaacccaggaggcagaggttgcagtgagcggagatctgtcccacagcactccagccttggggacagagggagacgccgtctcaaaaaaaaaaaaaaacaaaaaacaaaccaaagtattagtttatggcttacatacttctcagatttttttttttttttttgagacagagtctcactctgtcactcaggctagagtgcagtggcaccatcttggctcactgcatcctccacctccagagttcgagattttgtgcctcaggctcccaagtagctgggattacagg

SEQ ID NO: 134740 - DNA, 1097 bp, Homo sapiens
tttgagatggattctcgctctgtcgcccccaggcaggagggcagtggcgtgatctcggctcactacaatctctgcctcccaggttcaagcgattcttctgcctcagccgcccgagtagctgggactacaggtgcctgccaccatgcccggctagtttttgtgtttttagtagagacagggtttcaccatagtggccaggttggtctcgaactcctgaccttgtgatctgctcaccttggcctctcaaagtgctgggattacaggcgtgagccagcgcgcccggcgtggaccttaaaattttaaaaaagtttgtgttaatggcatatttcattggagtgaaacaaaacactggctcccatatgtaaggcccaagaagaacaagatttaagagaaatacgattttctgtttaaatatttttgatttttagaggcccctgtcaaaattgaatgttgaagatgtttgccaaaggcagtaaatggtattatcctgagttataaatgcagggagccatgggagttgggaggtgatgtcttgtgaaatcatgcggagctactgcataatgttcaggccatgagtgttatttatagattgttggtttcgaaagtatctttagctttgaaatacagcccattatagctgatgggaagatagcatgtgaaggattggggtacaggtggccgaagcagacagtagtaggccagaaataatactggagtgaatgtggacttgcagaaatagttcttggagttttgagagagagacctgttaattgtttcagactagcatcagggaatgttgatgtcatggggtcatttcattacaggtccaaagttctgttctgaatcaggatgtggaaggttaagttcattttcactcattcgcgtggactctagacagttggtatacaatgatgtacagtgttgtataacaaagcttaattttagatgcaggatgtcttttgctctcaaataaataggttgatggtctagaacctctctttttttttttttattggtgagcggagactcaaagcagagattatatgttggctgtccttgtggtctgttttcatgtagactctgaccaaacctagaga

SEQ ID NO: 134741 - DNA, 1088 bp, Homo sapiens
cttctgagtatactgataggtgagcctgggtttctccaaaagtcaacaagtagcttacgaaatgtacctgaccaaccagagcattgttctgataatccctccgtgacatcactccccatctccaggcattgggatcccgtggcagttgcagcactgaagtggagaaggagacccaggagaagatgaccatcctccagacatacttccggcagaacagggatgaagtcttggacaacctcttggcttttgtctgtgacattcggccagaaatccatgaaaactaccgcataaatggatagaagagagaagcacctgtgctgtggagtggcattttagatgccctcacgaatatgaagcttagcacagctctagttacattcttatgatatggcattaaattatttccatatattatataataggtccttccactttttggagagtagcaaatctagcttttttgtacagacttagaaattatctaaagatttcatctttttacctcatatttcttaggaatttaatggttatatgttgtctttttttcctatgtcttttggctcaagcaacatgtatatcagtgttgactttttctttcttagatctagtttaaaaaaaaaaaaaaccacataacaattctttgaagaaaggaagggattaaataatttttttccctaacactttcttgaaggtcaggggctttatctatgaaaaagtagtaaatagttctttgtaacctgtgtgaagcagcagccagccttaaagtagtccattcttgctaatggttagaacagtgaatactagtggaattgtttgggctgcttttagtttctcttaatcaaaattactagatgatagaattcaagaacttgttacatgtattacttggtgtatcgataatcatttaaaagtaaagactctgtcatgcatttttccccattcttttttttttccctgtctccgtgacaaccagtggttcttcatttttgatcatgcgaaatgcattttgacccagatggtctgcagaacttcacttaggacattagcacacaaatagcacacatatcacatacccatttatatacata

SEQ ID NO: 134742 - DNA, 1048 bp, Homo sapiens
aggcacttcttacatggtggaggcaagagaaaatgaggaagaagcaaaagcagcctgataaatctatcagatctcgtgagacttattcactatcatgagaacagcacaggaaagactgacccccatgattcaattacctcccccttggtccctcccacaacacgtgggaattctgggagatgcaattgaagttgaggcttgggtggggacacagccaaaccatatcaccaaggttttgttcttggacttctctaacattctattggtgagaccacattcatttccaggctttattacctatactgaagacccaaatttctatctcaaacccatttctcttgagctgtagtcattaaattgcttatttgatattttgacttggatgtctggtaaacatctccatcttaacatgtcagtttggagggcttaacaaactgtatccagttttgttaaggctttactctccttattgctaagtgtagcaactcctaatctctgccaactgcaaatacagatttcccaaactggagaaacatgaagcaacactcatgttcaagtgcttagactcaatgtttaaatgggttgccaacagtatttttattctggattaatggagttgtgcttatttacttaactgcttgactattaatactgagccaagcaacccaacgttgccagtcacagaaaccaacagcagagaggttttatttttttgagacgctctttcgcccaggctggagtgcagtggcataacgatcagggctcactgcagcttcaacctcttgggctcaagccatctgcctgcctcagactccagagtgcagagattacaggtatgaaccaccatgcctggccgggagggtttccttttgtacacttaatacattatagggctttgtagcagtgtccctggcctctacccactagatgccagcagaaccccttcagttgtgaaacaaaaaatatctccagatattgtcaaatgtcccctgggtgccaaaaaccacccccagattagagaagataaggcactatacaagatgtctgg

SEQ ID NO: 134743 - DNA, 1142 bp, Homo sapiens
ggaggccaagatgggtggatcgcttgagcttaggtgatcgatgccagactgggcaacagggggaaaccctgtctctacaaaaaatacaaaagaaaaaaattagttggatatggtggtggcgctgcctatagtctcagctacttgtgggggctaaagcaggaggatcgcttgaacctgggatgcagaggttgcagtgagccaagattgtgccactgcactcctgcctgggtaacaaagttgagatcctgtatcaaaaaacaaaaaagaaaagaaaataacttacaaagcaggatggcagcattctagatgctactgttgatgataagtttaggagagaaacaaggctggttgttcagagagcatgactgggttgtctacaattatcttaggtggtttttaaagatgaaaagaccgatagtctagttacctagttaaaaaagcccaattgccttcaactgcccttgcctcttctccacagccgctagaggggagttctccctcttctgactcttctgaccctggcacttgtctttctgttcatagtgtagaaacagatccctgacccctatctgccccggggggattgctggccttcctgataggaattcagaggattttttcttctgacttaggcccggtttcctgacaaacagcatgtgatctgtctgacttccagcacacctcctgccaagcacagctatgtatttagtcccaagctctcacgtacagttagtctacctctcccatagtggagtccgtcatttgaggatgtgacttccgggagctgaaatcaatgtaatggagccactagcaacggaacattctgtgggacacactttcggaaataatttctaaaatagctcacatttattaacatcaactttataccaggtggcattcaaggtactctatatacataatctaattttcctaccatctctatgaggtaggtattatcatttctattttgcagattaggaaactgaggctacagggtcacagagccaatttgtggtgaagtctggatttaaacccaggtctgtctgagttcccagcctgaattactaatactgcattctttggttcaatttgttcaggccatggcaatgttccaagtagtatgtctccatgaaaagtttagg

SEQ ID NO: 134744 - DNA, 1050 bp, Homo sapiens
ccttggcctgcgttcgggccagacggcctgggttcggcgcggcgggcagcctgcggggggtccttcgtgcgccctggggcccctcccccgcgtgccggccgtgggagcggctctgacaagcctcctgggggcccgcggttggggagggccagactgatttatggggagaaggagatcccccatcctcagccgacctggacagttccagagggcggagactgagactgggacgagacagctgcccaaggccaaggccgtgtatggcgagacagctccagctggcgtgaaggagcctgggtttcaattctggcccagtccaggactggctccttgaccttggatggtacactttcttttctgggtcttaacgtcctcacctgtaaaatggagagctcggactcattgtgtctcaaggtttttccgccccgaaacttctgtaacaggccctcttagggtctcgtgttgtgtttttcacaaacaaaacaaaacctgacttaggaaactgacgaatctcagtgctgcacatagttcccggggaggctgggcactcggtgtctgcagagctgggggcctttgcgcaataggacttaagagtatgttcctttgcagatgctctctacgggctgaaaaagaggggagttgaccttgtgcaagatggatatctggaagttctggttaaaatgcagaatcagcagaggagacccagagaagctctagttttcctgcttagttgcaggggcctcaaggctgtgctcactccccctgctctgcctccaccctgctgtctgtctgaccttctgtgttatcctcgggctggtgcagggctgagctggatggggaaatggggttcaggacatatgataggcatctgcccttgaggtcttgccagcacccctcctgccctctgcagcttcctggttgaatgaggggctgcaaggtgaccacacaggctgccctgatgggcatgtcctggcctctggtccatatccctttctgcttggcactggcctctcttggctctcacctccacctttgccaagcccaggagcc

SEQ ID NO: 134745 - DNA, 1103 bp, Homo sapiens
taatccctgtggattgtttttctggaagcaagctgtgttttgggaatgtgagaggagagcagtaattgcccgtatcctgacagtactttagttaactgagccctctcatgcacttcctctccctgggtgctcacaacagccctatgaacaagggaggattactgaacccaccctgcagcacagggtgcctaaagttgacgtctggggagaggtaatttacattattccctcctgtgacgggcagatgccgacctggtgctctattgacagtcatgtctctaatcccagcaatgacctttgaggcaaggtgggtggtccgagagtttaggtaacttgtcctggatcccactgttagtgacagagccagggttcaaaccctgagccctctggttcctgatcatgttccgaaaggaggtggatacctcccagcttgatgtatgattttaattgttttctgtctcttcagtgtctgtcttttgatatgtactgagcacatcatatgtagtaggtcctctgttaaatgcttacacattaactcattaaatccttcgacattaaatctgggtagaggctgttacactcactttgcagtcgaggaaccctagactcaggctcatagagtagccctggccatgctgctaataaatgccagagttggaaatcaaggccagggcctcagattccaagccatgttcttagccacaacgctagagaaaactgttggttttccaaagctgctgtaacaaattaccatgaacttattggattaaaacaacaccaatttattatcttccagttctgtaggttagatatttgacataggtctcactggactaaaatctaggtacaggcagggctgcttccttctgaaggctctgggggagaatctgttttcttgcctgtttagctcctagtggtcctctgcattccttggctcgtgatccttttcttcatcttcaaagccagcaatggcagatccaatctttttcacatctccttctctggctcttttgcctccctcttctacttttaaggacccttgtgattacattgggccagctggataatctgagataatctcctaattttaaggtcagctgatt

SEQ ID NO: 134746 - DNA, 1040 bp, Homo sapiens
ttgcactccacactccagcctgggcaacagagcgagactccatctcaaaaaaaaaaaataaaaacaaaacaaaacaaaaaagagacacatcaggtgggctcagtggctcacccctataatcctagcactttgggaggctgaggcaggtggattgcttgaatctaagagttcaacaccagcagcctgggcaacatggcaaactctgtttctacaaagagtacaaaaactagctgggcatggtgtcgcatgcctgtagtcccagctacttggaaggctgaggtgggaggatcacctgagcgcgggatgtcaaggctgcagtgagctgtgatcgcgccactgcgctccagcctgggtgccagagtgagaccctgtctcaaaaaaaaaagaatggacacatctttttagacaacttgagtctttcagtttctaaatagtatcttgggatgaggtgatacactatctggcatgtccttcagattcactggggggtgcagtggaggttggggtgttggggacgggtaccgagtgaggatggagatgaaccaagagtggccatgaggtgacctaacagttgcagcgggaggatgggttgctgtcatctacttctgaatatgctaggaaattttcatagtaaaaagctttaaaggaaccatttgagaaatcctcccttgtgggtatgacattgggagactagttggcaagaaggctgtgactttgggtctcatgggtcagtcagtgggaggaaggaggtctgggaaccagaggaggtggccagtggatgggagtttggggcaagggccaccagtttctccaagaacttcaattaggatgtgtggcagctgtggtcttgacaggttgtcgtaatgtgaatgtggaagatttcagcctggttaaatttagcttggccggcccctggggtggaaggggaggcacaggtggggtacggacttctcaccctgcttctgtccccacaggcaaccaggttgattacctcagacctggttgtgggccacaggtgtcagctctgaagggtttcactc

SEQ ID NO: 134747 - DNA, 1033 bp, Homo sapiens
caggatggtctcgatctcctgacctcgtgatctgcccgcctcagtctcccaaagtgctgggattacaggcgtgagccaccgtgcccggccttgttgaatgtcttctttgtgtggggccatatgcattcacttacacacggtgcctgccttcatcctcctaacagcctgcacagtgggcaatatattatcgttatcctcattttggagagaaggatgctgaggcttagagagggagggtcggcgacatgcccaaactcagtaagcagcagaggcagagtttaaactaccatctaataaagtaccacaaactcagtgagaaattaaataaatcaacaaatggccatggaggactaaagccagtgatttcaacgaatatctaccacctaataactaatctctaataactgatagagtctttagactgtgttgttccaggcttgagtaactacgccctttccacactcccagaaggctgaaagaagtctgactatgtcccagcaggaggtggccggggaggccgaggcgcagagaatcattcaggtgttcctgacactatcacacacccacgtctggaacctactgaaggaccgtggatgatgctgttcgaacattcttggattgtggaagccaacagtggtggaagacccctcgctggtcttgcggcaacaacagaagatcttggaccccatgttttggtgcgcggtgggaggaggaaagggcactggggctcctggctctgcagctccaatcccagaaacccattgttatttaagcgctgggtcatagtgggcccttcccctctctctgacctgctgtagctccctgtggccagcagttccaggcccacctgcctgggcccaccactctgagggtcagtctttcctcaactgtgcacatttctcctacctgtggaaaggacatggagcctccactctgccagtctttccctgtagcgttgccttcttgaaccacagatgttggaggtccagcacagttctctgggcagggttgttttctagatgaacttaagact

SEQ ID NO: 134748 - DNA, 1434 bp, Homo sapiens
caggtgaaaaactgggtcagattcagccagttcctttgaaagtttccacaacccagaccaacagagagataggcaagaggcagctgtgatataccaaatggtcaaattgaaacagaactcatttagtttgaatgactaaatagcaatgatcagtgaacacctcgcctaacagtaaccaacctggaggccttctctctctctctctctctctcttttttttttttaacagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgagtttgttattttgctttgaattgttgagtctgaatttcaccaaagccaatcatttgaacaaagcggggaatgttgggataggaaaggtaagtagggatagtggtcaagtgggaggggtggaaaggagactaaagactgggagagagggaagcactttttttaaataaagttgaacacacttgggaaaagcttacaggccaggcctgtaatcccaacactttgggaggccaaggtgggaggatagcttaaccccaggagtttgagaccagcctgagcaacatagtgagaacttgtctctacagaaaaaaaaaaaaaaaaaaatttaattaggcaagcgtggtagtgcgcacctgtcgtcccagctactcaggaggctgaggtaggaaaatcactggagcccaggagttagaggttacagtgagctatgatcacactactgcactccagcctgggcaacagagggagaccctg

SEQ ID NO: 134749 - DNA, 1011 bp, Homo sapiens
gagtttaagatgaattattccgaccccattaccataggagctgggtagtgtatttttgaattaataaactctatttttttagaacagttttaggttcatggcacaattaagtgaacagaagttttcatatacaccccacacccacccacacaacctccccattatcaatatcctgcaccagaatggtgcatttgttacaatcaatgaacctacattgacacatcattatcacccaaaactgggtggtatttttaatccctgtttttcaggtgagaacaccaagacttaaggaggggcaggtgaccacccaaagttacatagcaaattagggatggacagaatggagcctgatgctctctccacagtgccacactccttcctctcacaacgatgccctctttcctgcaatagcttaagtacacccagattcatcgatatgtttataggtgttcctgagacgcaaaaacggacgcgagaacttctaccaaaactggaaggcatatgctgctggatttggggaccgcagagaagaattctggcttggtaatgcagccctgcatgtttatatctaaaatgcctgattctgccctccttgtcacttttcctaacccacagggacctatgggagagaaagagatgaggaagaagaactacttctggtggcagacacagaatgtcaaattcttaatgaaaaagactatcatttaaatgctctgaatcatcaaaatgtaaaccaaaaagtatctgagacagatctcaatcaatttagaggtttacttagccaacgttaaggacacgcccagaaaaaaagaacacaaagccacaggaacagcctgtggtccatgccttttttttttttttttttttccagagataatattaagagttttagtgtttaaagggggaaagccacaggaacaacctgtggtccatgactttcttttttttttttttttttttttttttttttttttttttcagagataatgttgagagctttagtatttaaag

SEQ ID NO: 134750 - DNA, 1021 bp, Homo sapiens
ccagcatgggcgacagagtgacagtctgtctcaaaaaaaagaaaagaaaaaagcaaagaaaagaaaagagaaaagaaaagaaaaggctcgggcagtcttaactatgcaagtcccctctgtgtaagttctttctctggggaaagtaatataaacaataataattcttgtcatgtgttcagccttgttcagtttacacagctcctttccacccataatataatggaaaaatcaaaataacactgaagatgaaaccagccagaattactatccctattttacacatgaggatatagaggcccaaagtaactgagccagcaagggagggagtcattactcaaagccaggtcaggctggctccaggcttaggtctctgaaccattccatgcagctgacactgtcctaacatcaggactccataagcagtgtggacagcagagcagctagagtctgatgtcccacccaatgacttccctcctgtccaccatctttctttgcagctctggatggcccatctggcctggtgacagccaacatcactgactcagaagccttggccaggtggcagccagccattgccactgtggacagttatgtcatctcctacacaggcgagaaaggtaaggttttgtccaagtctctcctcactctaaggagtgtctttcctgctgtaaactcttcccattcgctcttctccctgccacatttggtacaggatgataaaaatgcatgggtaggttgaaaaggccagtaatgttcatgtggctcccaactgaaacctcaagggagtctggtaggtcatttaaaataaaaataaaaatacatctccagcctctacatgttttcctggcccattcctcctctcctgttagtatctctgcctaccagtgtgagacaccccgtttaggaaacagttgtcatcttttacaaagaagaaaaccagaatctaaaatcttaaccagaccgcttcaggccatactgagcagtctcaacttttcagagaccacaaaagaagctagtttta

SEQ ID NO: 134751 - DNA, 1092 bp, Homo sapiens
tgaacatttatctaatagttaataaaataacaagaaagaatgcaaaaaaaaaaaaaaaaagtcaagggtaggagccttctttagtgaaacagcactaagaacaaagcaaaaagaccataacattttaaaagccattttgggcaggctcaaggagaatgtaatcagcagtatcatcatgagcagctctacagatcattaatgctggtttatttgtcttttcaaaaagaaaagaaaaaggtcttgcaggggatgggcactcagccactggaagacagagagcaaatgtaaacaatttactggctttgaacttatttaataatatgtgggacgggccaatgctgagtccagatgtggatttactgaattgcttttagacaaaactcacatatgcaaacatatgcttgacttgtattgaatgtgtctactccatctttcccctctcctgactctactggacttgttaatgttgaatgattttatttttggtatctcaggacacttctatctctgaaagccggggcatcactacatattgatacccctactggagagaagattgcacggactggtaaatgatgttgtctttcctccttctcccaccattttctctccctctagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacataacaggtctcagagaggctactgaatacgaaattgaactctatggaataagcaaaggaaggcgatcccagacagtcagtgctatagcaacaacaggtactgtaaataaacaggagagaacagagaaaagtcatgactcaggggtcttcttctcacagggctgagtaatcacaggagctttggatgcaggcaggctggcgctctgatcctgactctttcaattacagactgtgttaccttggacaatttggctaagtccttatgcaaaaaaagtatgatgccatttacttaataggg

SEQ ID NO: 134752 - DNA, 1029 bp, Homo sapiens
gcacaagataacactatctggcacccaataagttcttactgaattttcattttctaagcatataacacaaattgaatgatggacttgggtatctattggtgttcttggaaacgtgtgctatcctgacagagtcagtgctgctaacctgagttattttcactcctcccttctttcagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacaggtatttcaaatcaagtgagccatttgttcctcttcctggtccccttctgtgtaatctgtctaccggatcgccatgactttaacatctttgttcacattccctacttaatccataaatgtagtctactgtttcaccttctccccacactccctcttgtcatatgtacttaatgaacactccccactcccaccccagaaatgagaaggtcgaaatatttctgctttgtattcaaaatcctttagaccttgtcttgtccatagctcttgtgtgcttacctcatatcatcgtcccttgtgatcaacctggctggtccccagctacatttcagccttctcaaaagaaatataccaatgagtatatttccaaaacgtatttaaaacttttgccatctcaaaatctcaaccatgatcttaacaaacttacccagtgggctcgtcattggaaaaccaaatgtgaacttattttatcggtaatcactaatatcagagagactctgcaacacggactaaatccataattttctcaagactaatgattcctacagaaattaacaacggaatagtcaaacatctgtgtttcc

SEQ ID NO: 134753 - DNA, 1048 bp, Homo sapiens
tgggagctccttcaaagtaaagaatgtctgtggaaggcatccaagtaatcttggtttccttaatgcaattcaagagactggaagttgccaggactcatatcttttgaccagtggccagcaaccctgaggtagggctcccagaggcaagtgtggttaagatgcaacagttcctgataagatcattcagcacatcttcttggccagggcctgattatatgtggcaactgcatgtagagaaatctaattgccataccttcctttttctaatttcttttaacaaaactgctttttctctccctttggcactaattggtaacattgcttccttccatcatagccctgaattatcagatctctctacccagcaatggttctattaacaacctcaatcttaaaacacagccaaataattaactcaaatttatttttttcttctcccctaccccttccttttacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacaggtacatgtgcattctcccatttctaacgcactctctccacagtcttctttgcagggtgaagcctctccttctcctctcccattgatgtacaagccacagggcactaactcttccatggtgctaggctggggtgctgtttaacataactcttttccaacagcagcccaaataatgcattgccataaagacatgtgcctgatttatcactgaccaggatgtttacagcataaaatgtagttcagtctaatttgccatatggaatctagagaaaagaattctaacctctcataactaaaaagctatataactagacctgt

SEQ ID NO: 134754 - DNA, 1226 bp, Homo sapiens
cactcatttcacacaaacagctttgctctgtgatacagccattcttcctttagacataaagtacgagcagaaaaaggtggaagaagaaacaagctgagaacccagtacacaacttttgatccctgaaagctgatagaagaccaaagaaaaaacatcatacttgttcacacctgagacagcatacactttatcaacccaggcaggtagccagtggctagtgatgagataatctttctaattataaataatgaaataaagcagggatttctccctgacatgagtaagaaattccaagggaaaacacttgaacaatgatttctttattaagctgacacttattgggcactcgccatgtatcaggtatgatactaagaagttgataaatattaccatttaatcatcacgcaatcccatgaaacagtaccatcaactccatttaaaggtaaagagagggtggctcagagagaagctgagtgacatgcccaagattatgcagctagcaaatgctagtattgggattctaatcaaggactacttgcctccaaattctgcacttgtaaccattgctgtatctcttaccctaacccacaatcctacttttccatgtgaatttcacctgctagcaatgcatgctcccggtgggttgtgcattggtgcagatgtctttgccatctcaaggataaaccatgtagatatttccctttctggccattttcaactcctgaagacaactgtggccagggaaccacagttcaaattgcaaatgctcagagaccaagaattaaaaaaaaaaattatctttcccctttctctctttcctagagttgggctgtgggatgtttggtttcctcatttttggtttatagaactgacaaatacttttctgtccttcttcagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacaggtacttcctctccctgtcaatgctttctccccaaggttctttgcttccttttcaag

SEQ ID NO: 134755 - DNA, 1048 bp, Homo sapiens
ataatcaacactaaccagacaactcatcccaaccttagccaaaatgccatctcacctgaatcccagcgtgcaattgcctttttaagtaactcagcaactctgtgtccttatgcagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacaggtatatgaccctcctcccagactggagacatgataggagccagcatgtcattgaaatagagaaaattcacccgtgtggcagaatcctaccccaatgttgttgacagacagcgtgaatctctaactcaggaaggtctgtgttggaattccacctcactagctaaatattcttgggactatatgtgtatgtatatatatagatacacatatatacacacacacaaatatatacttatatatatagtgtgtgtgtgtatatatatatatgtgtgtgtgtatatatagatatatacttttttttttttttttgagtcagggtctcattcttttgcccaggctagaatgcaatggtgtgaccatggctcactgcagcctcgaactcctagactcaagtgattctcctgcctcagcctctacagtagctggaaccacaggtgtgagccaccacactcagctaagttttttgtattttttgtagagatggagtttcaccattttgcccagcctggtctcaaactcccgggctcaagccatcttctcaccttggcctcccaaagtgctgggattacaggcatgagccagcgtgccctacctctattcttgggtatatttctttacatccctgagcctcctttttgtatctttaaatcagcaatgaacc

SEQ ID NO: 134756 - DNA, 1057 bp, Homo sapiens
caagacatgttccaaaatgaaaactgaagctcagagcatcgctaacatagacatatagttttctaaatctgcaggacactgatcaataggaaaataccatttccaagagaaaaacccaaatatgcatgaaggcaaaagaaattttttgtttgtttgttttgagacagagtctcactctatcccccagactggagtgcaatggcgccatctcagctcactgcaacctccaccttctgtgttcaagcgattctcctgcctcagcctcctgagtagctgggattacaggtgcccaccaacacgcctggctaatttttgtatttttagtagagacagggtttcaccatgttggccaggctggtctcgaacccctgacctcaaatgatccacccaccttggcctcccaaagcgctgggattacaggctcgagccaccatgcccggccacaaaagaaatatgacattgttgtcctgctggtgttttaatagggacagcaccagtaggggatgcagtgaacaaagcctggcacttggactgcaatggcctatagatgtggcattgggtttgccattcccaggttctcagaagcaaaactttctgaggaatagtttaactgaccccatctctgtcattattcagaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggtatctctttcctttctatttatagcttctgtttttcccagcaggaaactgcccatgaataatcagacacgactagctttggaatggacttgttctgccactacttatgtctatggggtctaattgtgacacgaggccatcacgctac

SEQ ID NO: 134757 - DNA, 1067 bp, Homo sapiens
gaggcaaacatagatgtgttaaatggaatagctaaagaagtagaagcccaggcacctgaccttggtaagcatagaggaagaaagaaaacaggaaaagcgagagctcttgggtgaaggagccatgtggctataagtcctgaaatgttgcagagttttaggttcaaccatcagaagcaagaaccttccagctctgtatcactggattcttaatagcagaagcctgccaggcgccactcaatgtctgtggggcttacagagaaaaatgaagaatcagtggccctgaagaatttttcctggggaattccagggttttactgatggattgggccataatgtaagtctttttcttgatgtggcaccatactaaaaatatgcataacctggccacctatcacacctctcgcccaaagacccagccatgggttacagggccctacagaatctggcacggccagcccatcctctgacctcagtcctgccactcattcccttgctcacttcaccatggcctcttgggccttcacactgttccttaagctttctgagcctgctcccaccctcgggctttggagtgtgctgctcccactccctggataccactcttttcccagcacttcacagagcgtgctccctcatttcactcagcagctcagatatgacccagaacagagggcttctctgactaccagcctaaaaaggcacccccatcctgatctaccccttcaagctgctctaggtttccttgtgaaacttatctgccttgatattatgcaagtattggtttactataatatctatggcctgcctccccatcagtgagcagaatataaggactgattccatcatccactgctgaatcccagtgccctgaaggcagacaagtatgtggtatgagcttcatgagtgtttagggaccctggctacttcagagtcagcatttccatagaatcttctgattcttcccttccacctctgcattaacaccccaattctttccttaaggcataagggaaatcattcccttggaaagtcttcaattccgcttaatctggatagaaaaggaagga

SEQ ID NO: 134758 - DNA, 1897 bp, Homo sapiens
aaatgtcttcacattggggattaggtttcaacataagaactttagagaggcacagacattcagtgcatagcaatacagcatgtaacattttgaaactggctttttttccttcagcataattctctcgagattcatctaaattgcttcttttatcaatagttggttccttttaactgctttaaatctgagcagcattttatggaatggatattccatgacattattttcaatcttctcagactccgatggggtcatgtgggtgatgtataattagacctattttacaaaagtaaaaagagagacccagagatgtgactctcctgtggtccctcagctcctctgtggcagacctaggattccagcccagatgcagttgactttcagccccagaagcagccctgtcttgcagcctgaagagcattcatctctctgttctcctcccagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactggtgagtctgccctgagcttcctccaaactctaggttgattctgaggttagcagatctcctcagccagggtgtcctcacatgagaaagccaaatgcaaaagcaagccactttctccatctctgaagcccctgaacaccactttgaaagggctgcttactcgtcttttctacctcctgtcaactgatacagcaaatttcccccactgggaaataggggttttaaaatatttcttcctaggagaactttaaacatcagggtttgtgtttgcatttacctatgatttttgttttcttttcttaactgtgcatcacagcatcttttcaattgtttcttgtttatttccttcttttagcctaataattaatttacttttcattttacttcatttaaagatgaccaagatgttggtaataatattttttttgttgttgttattttctacaaactgtttttattccaggtcttttgctttctgccaaggttacccctgaagagtggcacacggccctttgagacttccatggtgccctctcattttctcttttctcttagtcattaagacattaacctagtttgtctatgacgacagcttaatcctgacattgtggcccatgcaacttgtgtccattctggcccatgcaacctgttcactgaacctgaggccatggttactcggtggctaaactgaagagacaaccaggtttttaaaatatttcttcctttatgaaaaataagcctattcaattttggccaccaaatattcgaaatgtataggtggaaaatgttacttttccagggtttggcaagtaatagtctttacttccaatttaattagtaagcatgtattgagtacctactgcatacattgtaccgtactgatatttgaggaaaagtagttcccaaagtcagcattgttatgtggactcatttgtgcctgctcatagtgcttgcggaagactagatactcagaatgctagacagaactcgagaaaaagagtgatccaaggaaatcaggagagctggcaaaggtgttatggcaagggatgttattccagttgaagcttgatatgcaagaaaagggttagaagtgtggacatatttggaaatggcttgaagagtctttctcacaatatcttcagtctcaaatcacagtcacttacttaagatagaagttggttttctttcttat

SEQ ID NO: 134759 - DNA, 1033 bp, Homo sapiens
acttgatgaggtgagcaagcttggtcaaggcgttctgtcttactcacctctataatataagaaagttggaccagatatgcccaaaataccctcccagtgctagggacacgtaactcaaagttcagagcagggagtgaggctcagactgcactttcccatgccaacagcctgcatctgagctaagacccaggaagcacagaaagttggagaggccagaaacacccaagggcacactgctgacctgggactccagcctgaaggaaatggactaaggaacagccaccacaggtcttaagatggatcacagcagggggtccctgatgccatctgcattttagaggcaacagaagatcttcagacctctgtggctgacagtggaaaagacaggtcaaacaaacctagagagattttagaggacacactgttgacaccagatgtcctttcttattcctgccagtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtgtgagtgagcagaactcttttgggcagcctcacctgatgtcagcccacccagtgtataaccctccctcgccacggcccctacaatcctatagttgttctttacagttataccaaataagagcctagaattaagtccatagaatcacttattaaagaaatccctcattttccatcaaatctttctccttgctctcctatatacttcctgccagagaaaatcattacaagtaacatttagcaagtgtttactgtgtatcagactttgttgtaagcagtctacatattagtataagagtcctcatttggccgggc

SEQ ID NO: 134760 - DNA, 1884 bp, Homo sapiens
gaaatagtaacatagccccagcctaatgcatttcacaaggcagtgactcataatcatcataggaatagtaagacttcttgaaaatgtgacaaaaactatgaatccgctccccaggggtggaaatacacacacacacacacacacacacacacacacacacacccctatgcataatcacacactgttttggcatacaagcctataatttcagggaattcaggttatgaattcctacctggtataacaggatgtgagtctcatctgatttcacacactacaacaaatggttctcaagccagatggagcctgagggtgcaaccgtccttcagctgaatttgaatctgggtgccctgggtagatacagaaaaatgtggctgcttaagcctggctgagaacttctgtttcttttgttgcaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagagggtgagtgccagggcgcagaccagcatataatggccatgatggagtggactcctagtat

SEQ ID NO: 134761 - DNA, 1008 bp, Homo sapiens
gattcaaacctaagacaatttgcctataaaacttgtgcccttcaatgccattctatttacattctggtgctttggaacctgctacattctcaaagaagacctttctattgggtaccaattccaactagaaaagtctttctcctgttgtgctgaaatttgtcttctcataaccaaccctccctccctgcatcatccccagcacataaacgcacacacacacacacacacacacacacacacacacacacacacacacacacacagaggcacttgttctgtccttaggggctacaagaggcaagccagtgcctgctttgccaggatttctacatggtaaccctgacccactcaaccttggttttctcaactacaaaataaacctgcccaggtctgtagtccttcctcctacaagatattttccagaccttttattgctgatcaattttctataaagattagaatctgtgttttctaaagagtctctgtagaataagttgctcattctgaaattataaaagtcctactatcagaacatgattcttcatgtctgacctaaatacctccaactgcaatctcaagtaagtttccctgggttcatccacaaaggagacttaaaacagccagttgtctgcatgagaatattttacattcttaaaggtcattatttgcttcctattttttccctctctcatataaatatttctagttctagtaaatttacctcctcacccaccagtgatttctgcagctcctctttgatctagatccaagttgctgctgagtttaggactgtattcaactaggcggtcaagctcaggcttaagtaaaaggaggctattgacatggactcttgttaggttttgttccccaggagcgcaacaaaataggaactactgtttaatgagtgcctactacgagcttgacaccatgctgggtactttatgtacaggtctctaatccttaattttctctggaaaggttttgactcctttgttatatatgaggtca

SEQ ID NO: 134762 - DNA, 1057 bp, Homo sapiens
tatttgttactgagtgttttgcctgtattatctcatttttctcactttcagttgaaagaactttattgtgcagttgatattagtgttaccattttacagatgtgaaaattaaggcccagacaggcaatgttacacaaccaaaacagctactggatggaaccctttggatttgctactacccaactatttctgacctaaaagagtggtgattccatgtggttcaaattaatagcaagtggcagagtaaagatctaacagtgtttgactgatgtagagcagatatcctcaaacattgcacagatgtttcttggatatttgtccatgttagtatttatcattcttcacaacaagtatctgtttacatgtctgctttctatacctgactgtgagctcattaagggcaagacctatccatcattggcttctgaaacaccccaccaccactaggctatcccatagcccgttcttacacttgttcaacacatctctgttgaatgcaagaataaaccatttagaaattaattctcagtcctcttggataatcactggctcccccagcatcttaactgggcaccagctaagccactgtgctgcctaaatggacaaccacttctcagttctggaattcttcaaacacctagggttaggagggtcttcgctttggcagttagagttttctcaattcttttatgacacaggttgcaccggactcactcaactatggagatcagatgtcctcaggaaaaaaaaaaaaaaaaaaatacacacttaaggctgtttcctggctcctctctcttcctgacacattccaaaaaggaatttatggatgttgggaaggacaaagggtgaggaatttctaggacatttaagaacgcccatgtaagcaactctatgcttgacaggccatgcacaataaaactctttggcctgtaagcgagaagaaaaatttggtgtaagctgcctcatgggttgccaaaatgatgtggaaacaaattcatctgcatttctaaacaataggaattctcctcgtcctcccaaacctagaatatttcatgta

SEQ ID NO: 134763 - DNA, 1028 bp, Homo sapiens
attccctcatttggtcctcaaaatattcaccctggaaatgagagctgggggacagaagagaggaggtggctcctgggccagatgaataactgacaggcagctagagagtggtggagaacagctttactggggtgcctagagccagcagcgtcccacatgtctctagaatcacctcctcctcctcacctctcatcacagaaagatctgagcaacaacatcccccaggtatgggaaccctgctgcccctggtgtactttggaaagaacacaggggttcttctcacccatcagtgttgtaagaggaataagagcttaggtttgaagccagaggtgtttggtattctccccaccaccatacatatgaccctgagaaagatacatcacttccttaatcctcagttttcacatctctaaaatggggacaatagcgtctgctgtcgttttgaggagaaaatgaggtatagaaagatcagcaatgactgcttaataactggaagtttggataatcattgtcattgccaaaaactgccatcactctggaagttaaaagaggcattgagccagtcttggattgtttcttgtgtgttgttcctcagcccgcccccagcccccgctttttatctcacccaatctgagggtgtctcactaggctggcaggtctgagacttggctgtattttacaagcaggaggttgtgttggcacaggttggagaaaaggtagtagcccggggctggaagttaatgtcaaattttgattccagaatgtcaggaggttttgagtttaggcatctgcagattctaaagctgacagctatgaagtacgatgctgttggaaactctttggaaaagctttctgtccggagggagggcaggacagggagcaccacttgaagaatgaatgcctctttttcatgtttttgtagactttttcccccatttttacagagctttcccatatgtgttttagaaaggaaaactactatccatcccagccaggcaagcccaattcaggactgaagaagatttatt

SEQ ID NO: 134764 - DNA, 1085 bp, Homo sapiens
aactgggctcagtccctgtactcgctccgaggtgccactgagcagctgctgcccagagcccaggcgagccctggtcccatttccagcttgaccaagtacaagaggggagccagggctgcggatcctactccctcttgctccccaggcatccgtctcacaattagaaaacccgtgtggggagcaaagcaaaaatcacatttcactaacagctactcggggtcgggggcgggcaggcgggaattcctactttcgccataaattgtatgcaaatgggttccttccctggccgagagccaggagtgagtgcgtctttcatgagctaaccctgttccgctgggagggctgttcctttaattcgccaactgaaaaagtgggaaaggatgtctggaggcgaggcgtcccattacagaggaaggagctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaaggtaagtctgttttgccctcatcactagagatccttatgatgtaaggattgcattcctggtaccaaatgagttgtgattttatattataattacaaaacatatggggtttttttttccaccgctggaaaaaaaaggagtgtgtattggttatatcagatgcaccttgacttttctggtcttgtaattttgtttgttttaactttatgaatagtcagacttggaaggaacttttcgtaaagttgttatcttctgctgttctgcagaggaaaagtaaaaattttctcttcaactgctctcctacttctagtctggctgattcacctgtatatatcttttattttgagggttagggcagtagagttttaaggcagactttgctcatagcctgcccctgggatgggttagagggagtttgatagaggagtgcagggagaatataaaagtttatatctaaaca

SEQ ID NO: 134765 - DNA, 1048 bp, Homo sapiens
gttgtgtggcccaagtacatttaaaatgctactttgtagtagaaaatgtgaaagtggtatcaaactttagagatagaattttgagcctaggaaagcaatttcagttttagaatcctcaagagactctgtggataacattcccctgtgtataaatatacatcaatttctctacagttgaaatattttgtaacaatcactataaataaatacaggatttaattttaaaaaagtatattatagaaggataaaacagccaattactatataaagcattgagacaggtgtttgtaactgtgatctaatttaaatttcatcatgatctatgaaaaagatgtttcctctaccaaggtggaaataggcttgaagaaagtaaactatttgcttgaaataacaatgctctagaactaacccttatctatcagatcagaaaacctatgcttctgtcatttaataagatccagtattggatgatggcttttctcaaggccctctgctttttcaaggcccttgaatttatagctccttgtagagaacaatccggaggcagaaagttgggctgttttccacatgaatactgtcaggtagagaagtcaccagccaatttgaaaacagaaatgggcttatctcaagcaagcccatcccttgggcaaagtgcaggggcttgatccaatgtattctgtgatggtttccaccaccgtgatggctgggtaagtcctatcttgtcaaaaagataactaggcaccatgaacactagatgtgactgtctctggagcctgaaattagtaaccacccagtgaacagcacacctcagtggctgctccaaacagagattcagaggcaaaagaagtgggatgggtcgttcgagactgaaggaagccagcatgccccacatggtcctgttctagctctcccacccccatttcagccagcgtactcatgcatacaaattcatcctcagctagcgggtctctgaatgttagccttctgaggcaccacatgacgggcttggtagttctctctcccttgttcttggttgctagagcactga

SEQ ID NO: 134766 - DNA, 1061 bp, Homo sapiens
atgatctcagcctgtctgtgaagctaaccttggaatgagatctggaagggatttgctgtcctgtaactgtgggtcaggaagcctaggaggcagcatatcagagagtcgtgggtcgagaagaccatcctaggggtaagatggtccctcctgaggcaagtacctgggctatccatgtgtctgtctgcctgtcccaagccttctccagctcaggttactgtgcctgactttttcagttcagaaaatgagaaaatcagctcagattccaccttccttgaactgagcagagtcatttcacataccatgtaaattcaatcaaatctctaaaaagatcagctgctttccaattcagacatgtaagtcccaaaatgacatgttaattctaagggaaatagagactttgagttcagagaacacagtgtcaaatctcaataccaaatttgctatatgaactttaacaaataatttaaaggctccaagctttagttttcttaactgaaaaattgagaagatatttaccacacaagatagttgggagtattacatggaaaaccatgaagaataataatagcatatccatttgttgtgtgctaagccctgacctaattataatttctagtggaatcatcaaagaaataatttaactgagaaacctcagaattgaaggatgatgggaaccaggtaagtggcagaattcagagtccagagtcaaacctgggtgaatctgactctacattcctgcctttcagtttgatattatattatctccatgttgtattcttttgctattttgctgttcttttccagctccctttctctaccttttctttctgcatcagtgaaaacatcatttggcccatttataccagaagacacttgggcttctcatctgaatcctgtgcagcccaacaccaacatgtcatggttctgctattagtgaatcacttaactcaagtaatgttacatatttggcaccaactgttaatttttatttctttacaactgactccaaattaaaggctatctgagacttttgcctgtggatatcagcagctgaccggtat

SEQ ID NO: 134767 - DNA, 1033 bp, Homo sapiens
aatgttcatttaactatggagcatctaatgcatgatgaatgtggttgtaggagcagagttcctgtcatgaagtaggtatttgataaatgtatcatatttggatcaataacccaaatccaaaaatgagtactcatttgagggtcccttccctcaaggatcatgcagtccagtggagaagttcattcactctcattcacttataacattatggtgcatgaaaagagaagccaagagtggaaagaatggaaactctaaaactcatacattcctctcctatcaccatcctcccaaacatccgctagtccctctgtttcctcctctgaaaacttatactgttcttgggagttctgagttgtctggtgtatctgtttcttttgctgggtgcttcaccttggcttcctcccaaatgcctccagcaactgtttatttttataaatgttgtatacacagggcagaagatagagaaaggggtgagccagagtcatttacgaaagcactttggcattctgctctggaaatcatttccgcaggaggctgccctggacagagtgcacttactctcagacctcccatccccacttccaagcagaagtcaatgcaatttttatttacagtcagaagctccatgaaattctgagccaaaaggcttctttcctgaaaagctggtagtggcctccaacattcagctatcacctttaacaggaactctttgttgtttgcaccaaacaaataaccagacacctgggtcagaagcagaattaaggacctaattcgtctccatccatggacatttaatggacacctactcgtgcaaatactatcacagccactgagaacacaagacataggatcctaaaagagcaggaagaggctacttttattgatgacatatcatatattgtcatgatttacatacataaaaaagatactatcattctgctttacagattggggaaaggaggaaagaaggaaggggatggaagggaaggggatggaagggaagggaaggtaaaggaagggaagggaagggaag

SEQ ID NO: 134768 - DNA, 1016 bp, Homo sapiens
ccaagcacacacactctatgttcaagaaacatcagctcccattttgtgcaacattttccagagctgtttagcttcttaaaaattccctttccctgcaaagcctctggtgttttccactacatccatcaatgccaacctctcgcccctggccatcctcatgtcctcctgctgttctcacatctgtggtctaagagaatacaagggtttcccttaaaaaaacatattcagatcctcccacagcctgtgtcctcacacatgggcaactgaataaataattcaaggccacccctggttttcctaactcctttatttttatctgtcttgcaaacacgtgttgactgggttgtttcagttatctgacaattggccatggtatattggaaatagtactggactgaaaaccaagaaacctgggtctgaagtctttgcgacctcatccattccctctgcctttggcctcagttttctgatgtgtaagccaaagatgttctaggctttctcaaccaaggttcctcttctaaattttaagacatggaaaatgatttgtgtaactatttcctcatttctcccaaagatggtatataataagtactattttagtttcataggagacaagttaattcattatatacaatggatgccttggagaaacactgtccaataggatttgctgcaataacggaaatattctatatcagtactaagattatagccattagccaactggggcttgaaatgtgactggtgtgactgaagaatcaaatttcaaattttatttatttttaattaaattaagtttaaatagccacatatggctaataggtgccatattggacagcacatacttagagctttaagctttaattttcatgaaacccaagtaagaaagatgagctctcccagctttggtatcctgcatgtctatgatttcattgtgtatgtttgtgtgtgtttatgtgtagatataggtatccatgaagacaatgtgaatgtgaaaggtaggaaacacatacaat

SEQ ID NO: 134769 - DNA, 1015 bp, Homo sapiens
cttaggtgagtcacttgtcctttctagtcttccgatgcctcaactttgcatgcaggaggttgcactggattaattcttctctctctctttttttttttttctttccaagacagtcttgcactcttgcccaggttggagtgcagtggtgtgatcttggctcgctgcaacctccaccccccaggtataagcaattctcctgcctcagcctcctgagtagctgggattacaggcacgcaccaccacgctgggctaatttttgtgtttttagtagagacggggttttgccaggttggccaggctggtctgagaactcctgacctcatgatctgcctacctcagcctcccaaagtgctgggattacaggcatgagccactgcacctggctagttcttctcaatttggattgcacatttaaaaactgggacatttaaaaattgcctgggtctcacttgtatcccatctccactctcccccgagatatttatttaatggttaagaataaggcctgaccattagaacttttaaaatctcataaggtgattataatttgcaacaagtttaaacaagtttaaaaaccagtgcacttaaacaagttctcaaagtgtggccccagaccaatggcatcagtatcacctgggaactgagaaaggccaggctctcaggccccagtccagcctagtgaatcagaaactctgagtgcagggcctctccaggtaatttggatgctagttaaagtttaatagccactgctctaaattatctccaaggccaggaatctccaaattctctttcactcatgcaactacttgctcaactcacaaatatgtaatgagaacattctatatgccagattctgtactggaaacagtattaggatgactcagaccagtccctttcttgaaggcactcaaacttaagtgctgagctcctacccactttgtaaaagtgccacgtactgtgccaaatcatcagtagtgaggtcgacactcttatgcacaatttgttctttcattca

SEQ ID NO: 134770 - DNA, 1069 bp, Homo sapiens
gtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattcttctggcctattgtaaaaaagaaaaaaaaaaagaaaaagaagaaagacacaaagaaaataatctaaacaccaaaaactaaacacaattccaatcctttttctgtacctcacgcgcataaatttgctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagc

SEQ ID NO: 134771 - DNA, 1027 bp, Homo sapiens
ctcaaaggagttctgggcccataaaatagggaagcagaggtgatggaaatgacatccaatgagtactgttaactggctgaacataaagtgactgcaaaatcgaatgtcagtgagactggactcttctgatgttcctcacctactattagctacgtggacagtcttgataattatatagtttataagtgaggttcttctccacatgtagagttgatactagtggcttgtattttaaaatttatttctagctgacaaacaattattgactactagttctaattactggggaaattccagagacaggtctagctgtaattcaaggtagaagatgtgtactcattctgtttttgttttgataaccctaaaacagagcttgagcacagattaggtaggtatccataggaaacagttatgaaggatcatgaacaggacccagaaggggaaaaagccagtacagggatgtgttcacaagattactattgatgtattgaggctcttgctggcttaaagatgcaaagctagattatgtcttctctagctccctatctcaattgtttaaagattgatgtttcttaaacttctaggctatacttgctcatatgagctgagagaggtcccacggcatcattgaaggccttggggcaggaagtgcaaagatatacctggcatatattcaaggaggtaggtcttggggcagcgcaaagtgagtttgaactcacattggaactgtccattgcaattgaggctgaaatcagaggctaaggatgtgcggcctttgtgaataaagtgggctttcatctcaacctggaaggatggaagggatttcaataatagagaacaagtaagaggaaattcagacagatggaagagcataaagcaagaaaatcatgaagatggaaatgaaaggtgtctggagaagtatagaatgagcaagactggaattcatggtcaagcggatgaaagccttgaaggctaggttatgatatctgaagttgattctttgggcacttgagagtgatgaaagttg

SEQ ID NO: 134772 - DNA, 1442 bp, Homo sapiens
aactacagaagtattaataacttgctcacgtctccacaataagtagtagagcttgaattcaaatccaggaaagcctgatccctcaggcctgcttccttaatctatataatactgtccactcctagttcgtgtcttttagtcctagttctgttgtgtgatttgtggtcttaatttccctctcctggtcttagttttctcatctattttacaacttgagattactaccttttcttccccttttgcccaggctgaagtacagtagcatcatcacagctcactgcaacctccacttcctggtctcaagtaaggagattgctacgaattctagcatttcatacttagtctctgcttgaaggagctacagcagctcattttctgggcaagacaagttgtaaattcatttacccatcagtttttagcctgtatgtctggcattctcaatcaaaactcttcaaaactgaccagcccttttattaatctttatatgcctttatatgccatgaaaggaaaggttgttcatgctttcaaaatgtagtttgtaaactgaatgcgttattaatactagtactagttattgttaatgctgtttctggttattatttatttagcatccttttattgtacacctaagggtatcaggctaagtactttatatgcattttccatagtcattacagtactctttttataaactaagaaaacaggtttagacaggttaaataaattgcctgcttccccacaacttgtgacagtgctaagatatgatctcagtcctatataactttaaggttcattcttttgttttgtttgctttttctactaccttggttactcatttcatggaatggggaaaacccagtggtgctagaagaggcgagattaatatggaatataattatgtaatttttctgagtcttagggcagccagagtagacacagcttaagggacagattctcatcgggagctgaagagatgtgctagtacagtatggtatgggatgtacagtattaatcattaggtcaagggatgtgggaagatggtaggctgatgttagatgaggtgggaggtcaagaattaatggcacaaagtgcacaacaggaaacagacattcaagggatcatgaagggagccaagatgatacatagcatgttggatactcattctgattggttgtacagttgatagctggcagaaaatgggcagcttacttaaagatttggaatgataagacaattccttttatttgtgtagtcttttggggaaactgaagtcaaattgaccttctatctgagtcattctcagtattacagtaatgaccagatgtgcccttctggaggagacgggctctatctgcctgtctcttagctccatttcaggctaagatccttcacaaagcagtgttttcaagtcatggaagtgggaaaagtggttctggcttttt

SEQ ID NO: 134773 - DNA, 1078 bp, Homo sapiens
cttgacccagctgacagacaatctgacagtgctaaagatcattgatacagctgggctcagcgaggctgtggggctgctcatgtgtcggtcctgtgggcggcgtctgccccggcaattctgccggagctgtggtttggtgttatgtgagccctgccgggaggcagaccatcagcctcctggccactgtacactccctgtcaaagaagcagctgaggagcggcgtcgggactttggagagaagttaactcgtctgcgggaacttatgggggagctgcagcggcggaaggcagccttggaaggtgtctccaaggaccttcaggcaaggtataaagcagttctccaggagtatgggcatgaggagcgcagggtccaggatgagctggctcgctctcggaagttcttcacaggctctttggctgaagttgagaagtccaatagtcaagtggtagaggagcagagttacctgcttaacattgcagaggtgcaggctgtgtctcgctgtgactacttcctggccaagatcaagcaggcagatgtagcactactggaggagacagctgatgaggaggagccagagctcactgccagcttgcctcgggagctcaccctgcaagatgtggagctccttaaggtaggtcatgttggccccctccaaattggacaagctgttaagaagccccggacagttaacgtggaagattcctgggccatggaggccacagcgtctgctgcctctacctctgttacttttagagagatggacatgagcccggaggaagtggttgccagccctagggcctcacctgctaaacagcggggtcctgaggcagcctccaatatccagcagtgcctctttctcaagaagatgggggccaaaggcagcactccaggaatgttcaatcttccagtcagtctctacgtgaccagtcaaggtgaagtactagtcgctgaccgtggtaactatcgtatacaagtctttacccgcaaaggctttttgaaggaaatccgccgcagccccagtggcattgatagctttgtgctaagcttccttggggcagatctacccaacctcactcct

SEQ ID NO: 134774 - DNA, 1097 bp, Homo sapiens
gtgctgtgcggcccaaatttgtcacctgtgatgctgagggcaccgtctacttcacccagggcttaggcctcaatctggagaatcggcagaatgagcaccacctggagggtggcttttccattggctctgtaggccctgatgggcagctgggtcgccagattagccacttcttctcggagaatgaggatttccgctgcattgctggcatgtgtgtggatgctcgtggtgatctcatcgtggctgacagtagtcgcaaggaaattctccattttcctaagggtgggggctatagtgtccttattcgagagggacttacctgtccggtgggcatagccctaactcctaaggggcagctgctggtcttggactgttgggatcattgcatcaagatctacagctaccatctgagaagatattccaccccataggggatgagaaattatcagtttcttctgctcccaagccaacttcccttcccttagttcttggttgttagtggcacatgcagaatagactcagcctatgtcctgattccagctgggtagttctagaacttcagaagctccatcttttaatgtttttatttgttatgtccccctccccgcttcccacctaaatttagagctttaaaagatgcactgcccaaataggacacacgatggtgttagctgaagtttgattagcaattaggcacttccaaggctttagtagagagagccactttagccctttgtgccatgtttgaaatttgcccttgtattaaatccttgattttttcccatttggctttgatgcccttgatccattgtttccttcctactataatgtgcttcatctgtgacactttctcttgaactctgattggattcactgtgcatgcttcagtgggatctgctccacctttcagtgacatttaagacatcatattcccgtaacattatgtctcagtctgatcgtctttaccagtatgaaagtcattcatttagtgctaccaaaggggatacacaagccctttaggaagcagtacctctcgcctggaggatctgtgccatcttggattgagaattgcagatgtgacagaatggattgaccctagt

SEQ ID NO: 134775 - DNA, 1009 bp, Homo sapiens
tgtgagtcaattaaacctcttttttaataaattacccagtctaggaggggcacggcagctcatgcctgtaatcccagcactttgggaggctgaggcaggcggatcacctgaggtcaagagtttgagaccatcctggccaacatggtgaaaccctgtctctactaaaaacacataaaattagccaggcacctgtaatcccagctactctggaggctgaggcaggaggattgcttgaacctgggaggcggagtaggccaagataatgccattgcactccagcctgggcaacaagagggaaactccatctcataaaaaaatcaaaataaaaatttaaaaaataaattacctagcctcaggtatttctttatagtagtatgaaaatgaactaatacatacacccttgtttgctttcctccattccttggctcaattctcagtccctcacttgcttcctggaatcacctcccaaatcaactactattaccacattccttagctctgggtcagctctcatagaactcaatccaagatttcatctatattccaggttctgtgcttggcaaatagaatacacttatgaataatatgtgattttctgcacttaacaaggacacttaatgactcaggtcttctgactatttgtttatttgtttgtcttgccatatcatatccatgcatttaaattcaatggcatttattgttttttaaaaatcaattggtcttctcacagtctgactaaatgaagttttattgtaataacctaattccactccctttttttatgtaaagacatgactaaaataataatccttacacacacattttaactggaaactgagccactgccccagtgctctattggcatctccatttttctgatatttatgtttctcctccctctgctcttagtaaatgttgatgttcagttcaccctgatcagtatttagcccttctggtcaatttatcttatttattgatctaagcagaaaatcaatacagtcttcatttg

SEQ ID NO: 134776 - DNA, 1117 bp, Homo sapiens
ggagggatgagtttgaagatttcaaagtcagggctgtctttgggaatttctcagaacaaaggcactgaggctattcagcaatttttcttttcttctttttggttttctcttcttgccttttatgttgcctccttccttctcaagcttttctgttatttttttccttttatcttccaactttttctctctgcccttctgaccttactttctccatgtactgaactttctaccagtttcaactttgaaacttttttggaaatgtggctactaacaattcattggaaggtattggtgcaaacggaatattggacaaggtgttagaaggcttgactctgccatttcctatcttggagtaagacatatattgtgttttggggcttcaacatcccctcaataaaatgggtatatgttgctaagtgatcgacatatccacagtactgtggttgtgtctcctaagatattgtgtcaccttcgctgccactgccctggttcagaccaccattgcctttgactggctacttccaaagcctcagtccaggcctcctttcctccttcagtttgcattctccatactttagttagtgattgttttcaaagtgatttaatttgaacacatagattttctgtttaaaaccttttggtgataccttttgccattaggataaaatttatactcctaaatgtggcctaccagatgtctttatcactccaatctcatctcccataagcctcctctttgcaagctctcttgtaactaccataaattactttccaatgctcaagcatccgtgctccttctcgtttcagatcatcacacatgcttctccttccatccaggacgctgtcttctctgctctgtccaacctcaccctgatcctgctttctttactaattcttactcatctttaaggtctcatcctaaatattgcctccttctggaagcctattttgattctcagatgggtgtgatgacccttttcagtgatcctttggaattttgtactcttctattgcaaaaatattgcacaatgttagaattgtctggatatgtctcctactgaactaagaattacttgaataatgaattgtgtctcacatttcacgaccaagccctcta

SEQ ID NO: 134777 - DNA, 1465 bp, Homo sapiens
aacaggacctgctttaagcaccaggaagtggtagagctacaattgggacctgggtctgactccagagtctgtgttttttgccactgtgctatcctgttgtctagcatgctataaaataaaatagaagagagtcttgtattgttcactcggtggccatttacaaagtgcacactccatgtacagaatgaagtcactgtgctaagtgctaggttatagagggattaataccttcaacaagtttatggttgtgtgtaagagagttgagtaaacaggcaatttcagcagtatgaaatgtatttgagacatttgccagaacccaatcttagctctgatacttaccagctctttgacctggggcaagttatttgacatctctgggcttcagtttccccatctctgaaatagttatgtgagcattctcagcttatacattgctgtgaagaataattgaaatactccagatcatctgcagccaattaagccaactgggttcctttcctcatgggggcccattgtgcaatggctgcaaacagcagctttcttggtagtgtatgcagcctgtttgttgtatgggttgctttaagggaccatggaaacaggcctttcagatgtatgtttatgtttctgaccttgcgctaccccagtgcaggctccaaacaggcatgcgaggtgcctttggaaagccccagggcactgtgaccagggttcacattggccaagttatcatgtccatccacaccaagctgcagaacaaggagcatgtaattgaggccctgcgcagggccaagttcaagtttcctggccaccagaagatccgcatctcaaagaagtggggcttcaccaagttcaatgttgatgaatttgaagacatggtggctgagaagcagctcatccctgatggctgtggggtcaagtacatccccagtcgtggccctctggacaagtggcgggccctgcactcatgagggcttccactgtgctgccccctcttaatactcaccaataaattctacttcctgtccaaaaaaaaaaaaaaaaagatactccagatcagttgtttagaatggtgctcggtgcatagtaagcagtcaataaatgattgctgtgagtgtgctgaaatatggatatgaacaaatattccaggatcacagaggaaatggcattcaaatgtgctgacgatgtggatgagaacttccctcaagaggagacatttgagctgaatttgaagataagctcatcagtgaacccaggggcaagggaaaggggatgtgtaaaggtcccaaggcaacagggagagaacattgtaggaactgtgagaagtttcaagtggctggcaacaaaggaacatgaacagaaagagcagactgtagaggaagagatgggtcagatcaccagggtcctgggactttatctgggaggccccagggagccactgaaaacttttaactgagaagtgtcatgccca

SEQ ID NO: 134778 - DNA, 1036 bp, Homo sapiens
gcttatcttcaaattcagctcaaatgtctcctcttgagggaagttctcatccacatcgtcagcacatttgaatgccatttcctctgtgatcctggaatatttgttcatatccatatttcagcacactcacagcaatcatttattgactgcttactatgcaccgagcaccattctaaacaactgatctggagtatctttttttttttttttttggacaggaagtagaatttattggtgagtattaagagggggcagcacagtggaagccctcatgagtgcagggcccgccacttgtccagagggccacgactggggatgtacttgaccccacagccatcagggatgagctgcttctcagccaccatgtcttcaaattcatcaacattgaacttggtgaagccccacttctttgagatgcggatcttctggtggccaggaaacttgaacttggccctgcgcagggcctcaattacatgctccttgttctgcagcttggtgtggatggacatgataacttggccaatgtgaaccctggtcacagtgccctggggctttccaaaggcacctcgcatgcctgtttggagcctgcactggggtagcgcaaggtcagaaacataaacatacatctgaaaggcctgtttccatggtcccttaaagcaacccatacaacaaacaggctgcatacactaccaagaaagctgctgtttgcagccattgcacaatgggcccccatgaggaaaggaacccagttggcttaattggctgcagatgatctggagtatttcaattattcttcacagcaatgtataagctgagaatgctcacataactatttcagagatggggaaactgaagcccagagatgtcaaataacttgccccaggtcaaagagctggtaagtatcagagctaagattgggttctggcaaatgtctcaaatacatttcatactgctgaaattgcctgtttactcaactctcttacacacaaccataaacttgttgaaggtattaatccctctataacctagcacttag

SEQ ID NO: 134779 - DNA, 1172 bp, Homo sapiens
tcctctgcagatagatcgggtgctttatatgcttctttatttaattctctcaactactcagcaattcattcattcattcatttaccaaatactcattaggacagagcagtgaaagtgctggcgtgaccctttccctcagagatgctatcctctaatgagaaaatcagacttgagactggagacttgaaccaacttatcacacaattactaatttaattaacacaaagctgccaggaaggaaacatactgcatgctctgggagaagaaaggggatacttgacctcaatttggctgttcaagaaggcctttctgaggaaggaagatttaagctggaattagaagggtatgtagcgttcaaccaaatgaactgaagaacagagaaagtgatctttttaaaagttctgttttattttttaattgacaaataataattgtctgtatttgtggggcccaacgtgatgtttcaatatgaggaagagtctcttgaaataaaaacttggcttgcttaatggcctagaaggccaatgtggctcaaacacagtgaggaagcctgggtcagtttattctaggacacagagatgggggcaccgagacactgcaagctgaagtggcttttaagacgttctgtaactggaacagaaggactgggattgccctaagatgaaagcttttcttctgccccactatggcatataccaccgaaagtgattgcttatacaaggaacagagaacagcttagtctgaggtcaggaatgctgtagacaaaagcagtgattaggaggtggtggggcaggccttgagtgcccggctacatttggaccttatctgttctaatttccctagagctatagggtggaactggattaatttcaaaataattctgtccatgctctagggtttaatatctcctgtgtctcctgggtcatccttggtgtgagaacactctgctcagatcagtggtatataaagtgttttcagtttttcattatgccatgtgtgcatctgtggggtatgtgtttgtgtgtgtgtgtgtgtgtctgtgtctgtgtcgttttcttccctgaagcatgctgagttcactcagggaaatgcctgggacttgggtgaaatcttattatttttttttttttggaaggcatgcagtacaaaatcatttctctccctacataaat

SEQ ID NO: 134780 - DNA, 1048 bp, Homo sapiens
ggaaggtgagactatagatctgcataaaacaacccattatggggcctcactacatatttaataaaaaaaagctcatccatacaaagaggagcacagcctttaatgattacttcaatcttatcggaataaatggttcttttggagaaaattgttcacctttggaagagaaggaatttttcccaggagtcctcagaagaagcaattttccaagaggtgccctgtagaaaacaaatgggccttaatttgcctcccgcagtgactagttgaaactcgcccccgcttccccagctcagaggagcggctgaaccagcacctcttggtcctttaggagtactttattttcatgaagtgccttataacaataagatctcagaacctgggcagctccaggccttttgcaagggagtaccatgtgggagaagcagcagctgattgctcaggcatgggactgagacgtgtacctgcttgagccctcgattttccttcacagacagaggacattggatgtgttcattctaaagcccctctggcttcatatttggtggccaggtcagctcatttgtaccttgagtctgactgtgagagtgtcaagctgggcaaacaggaaaggtgtggcttattcttcagagtgtacagcatgactaaattaacctcgatgttgaaattcctggcctccctggtaccagaggctcttcaacatctgataactctcacaggtgtctctctcctccaagccaggaagaagaaaagcctaagattaaccaagcctggatgggaaccccacagaatttgtagtagcccaaactctaagatcgctgtggtcatgttggattcagatgcaccataataatgaccataatacctaacattttttaaatgttgatttttctgccaggcaagtttttaagtgctgtcctcacaaaacttagtgataaggatggacattatcagtgtccccatattacagatagaaacactgaggcatagagaacacaagcaactttctaaaggcacccaaattcatgagtagcagaggtgggatttgaac

SEQ ID NO: 134781 - DNA, 1050 bp, Homo sapiens
taattttcatagatattgctgaaatgccctcttaaaaagcgatcctaatttacactcagagagtcaaggtgtaattttagatatggcaacaaatgcatgggacgtttatgggttcaggatgctgtccatcaccagtcaaaccaccctctgcaagccattagcaattctgtttacaggtgaggcgggtcctgccccaagggccttctctgcctggtttcctgcagtttagtgcctgcatagcttccaaaacagggttttagaaaaggctttgcagaatggggaggtggcttggttaacctcctgccctattcagagccctgggcttcctgaaacagtcccagtggatcgccaagggctggccaacagctgactaataggtgctgtggcatctggcctctctcggctttcggccaaatcccgaggagttcaaaagacctctccaactccctcatccattcctagcagaggcccaccactgaactccctgaataatgcattgcatttatcccctcttggtctgatggatggctgagcttttcctttatccacctgccttccttcgtttgtctgcctggagtttctaagctctcagctgtaccttgagcataggcaagagaagggagtggttgtttttttttaaagattagttgcacagctagcggtctgtcttcaaacaaaggccagatgtctttgtttcttactctaaaacctgaaatcaggacagaggagagaaaataaaaatgcctaccatttattgagctcctatgatgtgctagatgcaatgttggacaccacacaggcattatctcattttttcttcccaagaaaacatcatagccccgattttccagttcagaaactgatcccagaaatgtgacacagcctggttgtgactacagtcagaagatctggagcttgaatccatatctagtctatttagctcaggcttcgctcctcccacaaatcctgctttgcctggctgctgagaaggaaaaattttgccttttgtcacacttatcaacattcagctaacccctaaatatttcttgg

SEQ ID NO: 134782 - DNA, 1051 bp, Homo sapiens
tcacaactccagggccctctggccacatccagctttcttattgcacagagggaggcaaaggctgggagaaggctactacatttcctgacgtcaagggagtgaggctacttatgaacacagaactcagaacaccagccttgagttcttttgtctccactgggtttcccagcatgcctacctttagggacggttgggcaggtaacaagagggcagtgtgtgtgagcgggctgccaagagttcctgtgttttatgaggtgcagagtataattcaaaacctattttggggatgtctcgccccataaaatctccagcaggaatggctgggaatttgttttgacttccccagcatgtttttttaaagacctcttctccccatctcattttcctttcttctgtgtttcctttcttctatccaattctcaggcaccctgccccagtggcttatgaggggacacagtgggggcggcatttggggaaggagtcctgctatataggttaatgggctgacaaatgattatgagaaagcactcctttcttggatgattctgcctctgaaaagacattggctcaggaaatgacttcagggatctgcctttcacagtgatagttagacttttagatgccattcttgttgtgggagaaataagggtcccatacagctttctgtcttgtaatccagtagcagctcttccttcctcatttcccccatgctctttcctcgtttccaccaccctcatcactctcccagtctcttggcagtttctactgctgcagtttctttcttcaagtagatacttgaagaatcattcccaaaggttgtctttctctcatgtggaatcctcagtggctccccactgctttacaggattaagagtaaattccctagcagctgagtcctctgcataaggacccaacccgcctctattgcttgtctctctcacagttcctttgcctacacttcagccaaactggggtttttactgtccggaaaataagctttactttcccatttctgtgactttgctcgagctgtgtcctctgtcagggacaa

SEQ ID NO: 134783 - DNA, 1052 bp, Homo sapiens
cctctctttaagccttagcttcccccatctatttgctgagattctggattgtctctagcttctcttccacctcaagcattctagattagattatggaggataaagggatattagcatcatttcagatctcgggtcttggtagcaggtccaagccttccttcctatctccctaaaaaatacgcccaattttgttcatattgtatgttttctcattgcttgtttctaggcttggtctagacatgtggctctggcggcgggggctcagatactttgcaagttagaagttacagtgaccacttcctgttccccaccccaaaatgagtttgaggccaagaggaaagctaggaaattctggggaaaaaatggaaatggagccacgggggaagcaggaaggaggatgccagcagcaaagtgctgaatcccagaagagagagatctcattactggagtatgagtcatggtaataggctgaacaaatccccataaagtcagggctaatgttgtctgctggagcccatatcatgtcataaacacagtggtccaccccaaccagggctgtgttaattgtctgactcaatcagcggggctggggagcctgaaatgaaggattagttcagggcagtgagttccagcctccccagcgaccctggctctgcatcctggcaggcttgagctccttatagaaagactgtccaaggcaaggatggccagagagaggggcaaatagtaccacagagaggtccacagtctggatttgggggccagtcagtgatccctgaacccccaagtaactgggggaatcctggggtccttctgccagggacctctccatttctttctttctctcgattgtcttctccctccttagtcttccccagctttcctgttttctatttcttcttttccctctctctctttctttcttcctttctttctttctttctttctttctttcttctttctttctttctttctctttcttccttttctttttcttttctctttctttcttctttcttttctttctttctcttcctctcttcctttctttc

SEQ ID NO: 134784 - DNA, 1067 bp, Homo sapiens
cattgttggaagcaaacaatcaggcaatccattcaatttagaatatgaagggagccttgaatatctcttactttgcatcagcaaccacctgttatgatcatggcaggattgtgggagaagtcgaggaggatgttgattctgcctttgtatgtgttccacagaagttcagaggtgtcttggtcaaactgaggcagctgacacccagcacagtagactctgtggtaactgaataccttataagccattagaagtgctaaacacctcccattaaacttctccaaatcctattggttaccattacaatgattacattacaatgactgcaggtgaattgaatatcttatttgttccaggtaattttccatgcactttgaagatagaatttactttttcaccacaaataatcacagattgatgctcagggatagggaagaaattgtccaggtttccacagctggtgcactacggaggcgatattcaaagccacagtcagccaaaagaaagcccctaccctcaacaccatacagcactgagtgccacagcctaatagccagaccgcattccggctgttgcaaatatccatccaggcagtgcactgggaacttcaaagggccttagtgtttgctggtcattcttgaattttgatgtttgattcttgagataaacatgaggttgaattgaccagatacctcccttgagactggaacatatttataggctcagagaaagcacagtgtaaagaaagagcactagattaggggtctaacagttttgagttttaacctctgcttcttctcctaattgaatatatgatcttgactttgtgtttcacccctgtaaacctcaacattttaaaatcgatcagcatatacaccaatgaggagaaaaaatgagataaagtattttataatgactttaaactttctttttattaatataattttaattaatgacatcttcagcttcacaatcaactgtcctcaatgatctaagcatgcaattcagaattctctgaactagatagtgcacataggcttttgtttaacatagacttcagtaggtctttc

SEQ ID NO: 134785 - DNA, 1023 bp, Homo sapiens
ttcttattctttttcccccaagaactgatagttggcatataaatttcttggcactcagtaattagttacctaatgaaattgagcattggtgacatatattttttatctaatactcatgccatctctgtgaagtagatgctcttggatcatttatgggttagggaactgataaggcagatgtaattaatttatccaaggtcacatgggcaggtaaggagcagattagatttattttgctgactttactgttggacttgatggtcaagatcactgtgcagagcagcaagaatgcatgctgtctaagcagtgggcagtggcagataggagactgcactgggtttgggacgccctggtttagtgtatggtaaagccaaaggcagggtttgctcgtcaaggttgagggtagtagaccaacattgaaatatatatactgtagtgtgctgagatgcaggaaatggccctgaacatggagccctgaattaactctcaagcccaagcagaaacccagaaagacatgttccctgtaggtaaccagaagaggcctggttcagtgcagtccaactcagcatacatttcctgaaagcttactatgtgccaggctttggaagcatgaacataagtaagattcattccactccagcgcccagtgcttgttgagaggacagcaacaagataattccggaccacacctgttgatggggaccagtaatgggtcgaccagatatttattgggtagtcattatatattaggttctgtttgaggatctggggatactgtgatggatttctgttagcccgcaggagagctgaccctagtgtcagactgcagctggacatatcaagggaaggcagggacccacagtaagattcctgtggcttgtcttgccaccaggagatccttacactgtgcagttaaaaagggaaagatggactttaagtttggtctcagctattactggacactgagactttttaagccttggctttatcacttataaaatgggtataataatttctgattgc

SEQ ID NO: 134786 - DNA, 1026 bp, Homo sapiens
atgagccaccatgccctgtgctaatatcctctcttaagaggataccagttatattggattagagctgacctaaatggcctcatgttaacttaattaccactttaaagaccctgtctccaaacacagtcacagtttgagatcctgggggctaggactttaacatataagtttggaggggtatgtaattcagcccagaatattataggaggtagcttttgatcagatctttaggtgaaaaagctgtgcatcccaaggagcaacgaagctcgatgcaaatctgattgaggagggccatgtttgaccatgataagaattcaaacaaataacctctttcagttacggtgattgtcatctcagaaaatggagagtaagatccaaaggtcccaaagacattaggcaggcatatttattaaagttgagtgaaatctccagaacaccaagcatcatcagatatgctaagttcaagggaagactcgagaggattttagaaggagggtagctggataggtattacaagggaagaaggagggacaaagctgggtaataggagtaacactgggaaaagtcaaggagtctggatttgtcctaccactagtaagctgtgtgtccttgggcaagtcacttcaccatgctcagtgcaggtgtctgcatctttgaataagtctctgctctccttctgcaagtcgtcaggtgtaaatagctaaaaatgctctaccatcatgggaccttcaaagaaagagctcacagtgttgccgtctctcctactaaggaggagaaaacctgccctaatcatcatattcttctcacctggagaggatgtctggcgttccaccattagcaggtcactcaattatattaatttgaggaattttgagtgctaggtaccgaggggtaggagcacacagacactaggctctgtggctaattcctctgaagccttcccaggagagatgaacttccttggacgggctgtgggccgcttcctgacatctgaatctgaggctttaatgagtatttctcacaccg

SEQ ID NO: 134787 - DNA, 1009 bp, Homo sapiens
cccgccatagactataaactccatgagggcagggactcctctgtgttgctcacctagaatggtgtccgctgctcagtagatacttgttgatgagtgacactctccctatggtaggcccagggctgggcactggggaggctgatatgtggtccttaaatagctcacagcatcctaggggactagcatgtgctgacaattccagctcaggtgctacgagcagcaataggctgactgccatggcagactgaggagtggtgagtccagaggggtcttccagaggaggtgttgtctataacaagtaggcaggtggtggtaggaggggctggcctaggggcacagtatgcaaaagcgtggaggcaaggagaatggtgaggtcccatccccacgagacatgacggggtgctgtggtgaggctgtgcgtgaaagatggcagggtgggagatgagcccggatgggcagtggggcctgagcctgactgagggcttcgtatacccatggcttcatcctggggtgaggcagggacaagtcatctccaggttgcagaacatccacttctagccccttcccccaccgggcttagtatcaatccactggagacagttcccgccacatcaggctgagctcctcctttctcccagctctatgagcccaatcataccacttggaactcttgggtgacaagtgacagaaaccccattcaaaggaagttagacctggaaggggtttaagtgtcttgtgtaaccaactgggaggggcaagggtggggcagcctcagaaggggctggaagcaggacctctccatgctactcagtgctccgtacctctacaggcgactcacatctctcctaggtgggctgggagtgggggccacatagtggagcagcatccatgctcacactgtcttcttcttttttatttttatttttttgagacagggtctccctctatcactcaggctggagtgcagtggcacaatctcggctcactgcaaccttcacctcctgggctc

SEQ ID NO: 134788 - DNA, 1002 bp, Homo sapiens
agaggagggcatggatttgagaaatacttctcaaggcagatgccgagactcagggttggtgaggttaagtaacttttgtaaggtcagtcccagttctgatctagccactttggagattgtttgggagcagctctgtctcctggtttaaaccctcagcactccctcccgctgcatttagaggagcaggcggtagctgagtttccattagtgcctgttggcaacatggccctggccaagcctgcgctgtctgtgtgtcagtttccctgtcttaagagaactgctgactgcagcactttttctctggaggtgccagcctgccttgtgcggctctcctgtcaaagtccaacatttctggggcatttctgagaagcacaggacagagattattgccaagtaggagttctccttagccacccctgggaaccttctgaaaatagactctgtgagactgccagtgtttggactgcaaaagagaggagcgcagccactgagcaggcactgagttcctgttctttgccccttacgccaggtcctggggacagagatgaacgagacagtctttgccagtgagggtcgtgggcttaataggggagacacagagcttagctgcaggacgatgtgctgagtgcatcctaggaggcctgagaggtggttcaagactgactgggtcttgaagaatgactaggaatttgtcagcgaaggggcaggaataggattctggcagatggccctgtggacttgctggtgtgctcccaggggtgagagagaactgagtgctcagggacatgcttaggacgtgcaaagggttttcctctgagagatgagtgagagggagaagcaggaaccaggttgcaaggagccttgtggacaggactccaggacgagcagcagggaccggcggggtccatgcgtgtattacaagatcccatggctgagcttggaggggccaggaggccgggaagacctctttgggggctgcagcagtcccccaggtgggcagtg

SEQ ID NO: 134789 - DNA, 1110 bp, Homo sapiens
acaataaattggtgttatgtggtaccaggctttcgctcagcgtgtgaaacagaagccctacagtctggagatttatactgcatgttaaggcttgcttgtctaaaatctttttcaagactgcacgtaacagccttcatatcccccgtgtagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcaggtaggtggtgacacatgtttcagaggctcaaggatgccactggggcctgtgtctcagtttcctccatgccaagcaggggcccacagcagatgtgcccaccatttggggtatgtattagggaggagatggcaccgtttgccatggcttcactgtgttcttacttgatccgtcccacactcctgtagccatgacccgtctgagcgtgtctttgttgagtagaatcccgtccgcattctacacatgagggaaccaggactcagggagctgaggcacttagtcaaggttagaacttgtttgaaaggataaatattggaacccaatgtttattcttttattttataggctctaagtcctaatttgtcctcatggactagctcattcttttctactcatcatctcttttattttaggtgcctttttctggaccttctgattcctatcgacagctttcatcatcatatttgagtggaccttgttcaaaatctgttttaagtacttaggaatgacaggctccaaaccaggagtcaggcagagtagaagctgtcctctgatttctgtgtgtgggatgcatgtggtgtcatgacaaggtgaacgcccactctggctaatcagagaaacctccctggaggaagggacctgcaggttaaggaagagttagaactctctgcttggtggtgtgatagatatttcaccctttgtttatctaacctatctgttcttgccaaaggccagtaggaaggcagaagggaaatttacattttttgtcattatctcatttagttaacccccttttgacagctctcaggtctctcaaac

SEQ ID NO: 134790 - DNA, 1196 bp, Homo sapiens
cagaggtggcacgtgaccatgtcctcactgcagggtggctaggaaagcaggaatctggcattttggctctgtggtgtagtaagtggactcagtgagtgtggaggacagggagggaagcatctgtctgccacatagagaaggcaccttgcacacagtaggcactttcctgagggtggccgtgaatgtgaatgttacctgtgaaatagaggtatctagacagagaagttggcccttgtgttttgttgtgtgattgtcttttgccatgatgggccatcagatgtttttgagtagagagtaacttaaatggaatttgtttaggataataaccccattggcagaacagccgggaggcaaggttagagagtaaagtgataaggcctgaactttaggacggaaaagagtaggccagtgttggaagcattttggaggaagcagcagcagtcatgattgcttgactgggcagtggaagagaaaggggtttagaatggctcccagctttctagcttaggttagggattgtggcgataccatctcctgaggcaggaaacaggtgagagagagcaggtttggaaggataaggagttcagctttggctctgaggactgagtgacagagctgcctcagtggtgaggcgcggcaggcagctggatatgaattttgacctcgggaaagacatctgtgaaggtgaagactctcactcactcatcccactcctggcccaggtcttctgctttgttctcccttaggtaagatgtgggggagcccttcctgccccctctttcaagcttactctcatttctctttggcttctggtaattcctaacatagttaacaggagggattttcattgtatgttgtgttaactctttgtttaaaactgctttctagaaagttctgtctatactgatctggagactgtttataaatcagtttttatgtgtgtttttataggttctacaagcatttttgcttctggttcagagcttcatagttctctaacatcagaaattcatttcttgaggaagcagaaccaggccctcaatgcaatgctcattaaaggatccagaggtaagagttaaaggagtcactggaagtctggaacgccaaagccttctgtgtcatggaaagaatgcaggcattggagtctgaccaacctaagtatgaatcctgtggctctgtgatggctttacaccatt

SEQ ID NO: 134791 - DNA, 1572 bp, Homo sapiens
ttataaaaatatcagcattttagcaatctggtaaatttcacatgccagtctaaagatcacacatattcctgcataaacacagttagctccgaatagagtgatcgtccatgaagaacttaaaaacattaccgcccactccccgccaccccgctggcataggtaagacattcatgtgcttcaaaaaatttaaacctccattctttacccattaaccctgttttcccttccttcttctccacttttttcttttcttctgtatccttaacagtgtttttttaaatgcaaataccagcatatattcttactcttctcttcatcccagaggtaacgtactctatatccatgattctgtccatttgtcatggagcagtaaatcttggacatctttccttattgctctagagagagttcctcattccgtaaagcatgtatcttgaaagcagcttggcgcactcagaaaagcccgagtttgtctggttgaactggccggagtgtggaccctgctgtcccatttattagctttgtgacgttgagcaatatactcatttctcccagtcttaattgtttcatagaacagggtcattgcgagattaaatgaggcaatgttatgagtagggccttgctcagtgcctcactcagtaaatggttgcctttatcatcattatcaattttattttactattttattctgtataacgttgcaaagctctgcaatgggcagggactctaatgtcattcccatttttagagatggtagaattgagttctggaaagatagtgccccatggcagcagcacccgagtccttggacccttgtccaggtctcattcttctctagccatcatagctaccagccgggagggacatctttcccaagtaccgtgcatgctgcagcttgcaagggaaaccgaatggctccatctcgccctctccctccctcctccttccctcctccctcctccctcctccctcctccctcctcgctcactgcgcccatttcctgcatatacccccctcaccctcagggaaattgattgatctgagttattagttgtatcaaacacaggaaagaaatacacgcctgggcccttcacattcactcttggtaatgcctgaattagattcattctgttttacattttccctggcaaatccaattatagaattatttgggggctcaaatggccaccagctacaatggagcagacaattgctctggagagtaattcactctgacgggaaggtttacaaaagcattcataaagtatttacactggtggaaagacgtgctgttctcaccatgttgtcacaatgtctgaaaagacaaaggaatacaaaggaataaaagtggctccgcctccccctgctgtgaaatgtttaccttggggagcaggcctgagaaaggtatggcttcttacaatatcgaggtggaatattgttaaaaaccggcctctcatgtgttagagcttccagcttgtcactacttgtacaggctgatagtgatgaccctcagaggaaagaatggcctcctagcatcggaagtggatctcactagctcaggtttaggtcggt

SEQ ID NO: 134792 - DNA, 1020 bp, Homo sapiens
ttctggcaaacgcttgtcagcatctctggtggtctctttaaatagagtcctaagagttgaattatttggtaaaagacattggaaaataacttttctaaggctaagtatagaagtagccccaaaaggtcatacacatttatactcatgctaataagatgttctgttgagatcacttttcttattaccattctcactagcattgttttgctttatttaagtcttaaattagtaaatgataaatggataacatattcctttcaaaaaattagtctcgaaaatatctggattcattatgaaggtagtttaatcaactctcaggcaattcaagcagacttgaaagtgatctgttagtttcaccataaggaagattttaaattaatatttgatatttggaagaataaaaggctacattagagttagcattaaaattgtatggaatataattttttctatgtgatgtaaaatatcttcctcatggagggctgcagagaatcattacagaagtgtgtctgtgggctgtgggaaatagctcaccctccccatgcctaggaaagaattgccagttgctaaccatcttaacacatccaatactgtttggaatttcaggatccctgcataatccataaattattcaatttgttgggggttcagactttaaattaaaaatggcttccttcctgtagacttactaatggaacacatacaggaaattcgaactttgagaaagcgtttagaagaatctattaaaacaaatgagaagctacggaaacagttggaacggcaaggatctgaatttgttcaaggtaaggaaagaccttcctggaggactgtacatgtctgtgagtgcttcactgtgacgcatttgcctgagtaagcatctgtgtacaaagcaggtgcttgataaatgttcatttttccatcttggagaagtctgccagcctctggcatcctgaattgtgactggcatctcatttaactttggaagctggagagaaatagataggaattttaagataaaac

SEQ ID NO: 134793 - DNA, 1093 bp, Homo sapiens
aactaaaatctcaaatgcttggtatagagaggttatttggtaaacagctgccgtcgacccaagtcctcttgggtccctcccctgtaagccatgctgtgggacaggcacaatcccctgcttccccttgttggcttcaaactcaagcgcactgagcctttcttgcttttagaatgtcattgcttaatgctgtagggaaataaaaggtctgactgaagttgcaaacattggggagttactaagagtaaagtaatcgtaagtattcgtaagtcatagtcctggcttgggattttagcatgggagatgatttatctttcaatctcaatggttaaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaaggtaagctaagcctcattaagtgttttaaacatggcctgattaaaacaataatttgccatcttaaccttagtaagcagagtgtggtgacatttgagtatttctctgatgaaaggagatcccattagggccaatgctggtcattcagagtatcctttatcactagagaaagctatggttgttgaaagtgttggcgattggggaaaagccatttttattttttaaatgacgacttaatatgtgacttgccatttcctgcaggctgtgtgtcattgaacttgtatgtcagtgcagatttggttaatttcctattgtttatttcaaactcatcctaaggcagggtcatttcagagactcttctgctttgagttgcccaagagtatctagccccctgttctgatatttttatataaatacaacatttgtgattgtaggaatctactttgttttcctttagtgtgacccatggcccattgggtcaggccttttgtcttagtctatttggattgttgtaacagaacgccatagaatgggtgacttataaacagcagaaatttatttcttacagttctaaaggctaggaagtccaagat

SEQ ID NO: 134794 - DNA, 1524 bp, Homo sapiens
ttggtgtgtgtcagctgctgttgtaggcatttcacatttactagttctcaccatataaagtttgaagtaactattttaggatgaggaagctgtgggtcagagttgcatatttgccattacaaggcagagctaggatttgaacttgaatctgtcacactccatccaatgcatgtcctcttcctgttattccacattgtcttttgagggcaaagcctatgtcttgaatatctctacctgctccagctccaagttgctggcatgtagttggagatcagaaaataatcatggaatacatgaattgtataatttcttagcttgtgtctatggccaactgaaaatgccaaggtcttgccctcctttatttagttgttaaagattctgaatgctattattgttgctgtgtactttcctcttctttaaagatgtggtcctttgggcttctgggaataaaatagagaccagtctagggtgcagacttgtagattttattggcatcacgaagggcacttgcatcgttagagcgagtgggcagagaggtatcacagctcacaggaggagttttaatcagggcttttgcaaatttaaaagaaatactcttctcccattgcagcattgtcaaagatccctcccaattcaatcctccacttccattcttataataatagatcacatcccactggcatgctttagagagggcaaggaaggcttcccagagtggggccattcttagctgagatctaaagggtgagagttgaaggggctgggggctgtcaggagaatgtccaagcctgaggcaaaggagacacggtccctttgagcatgtagctggcacatagagggtcaaagctggagaggcaggctggttcttgttgggctggtcctcaaatgtgttaaaagtccaaacactattctataggaagtagggagtcttcgaaggaaggtaagctgggactagacatgatcacatttgccatttaggaagactgctggggttgcttgcagaaggagttggagtgagggatggaacctctttagcctcctcaaccaatgtgccactccttttcatttctgacagatttgtttttttccttctgttctgcctctctcaactgtagtttaacttgggccacttctaagtcaattaagtgggtgcccttggcccatgctgcacttctgcaagccagcagcaagcctgtgcatccatcacactgtctgggcaaagttgcatcaggtgtttacctgttaatgaatgcattgcagccttagagtctttgctgttgtctgagctcatgaataatgagactgtggctgttgacaagaagtaataggaagacgtgggagaaaaaaagagcatcaattaaggagtttatctctaatggagattcatgtgggcttttcacagcattttttttttttctcatggcttaggtggtccttgggaaatacaggttaataaccagatgattgctagaataacgatattgaaacctgcttgggaaccatgagagttttgagatttttaaa

SEQ ID NO: 134795 - DNA, 1061 bp, Homo sapiens
aggacagaaatgtggagtcttgagagcatccactgatgaaggcctgtcaacctctatctacctttcaagaagccaaaataccatgccatttttggccaggatgtaaccaagaggcataggtttgtgattgaagtagctataaggatatctccatctgtcttgcttaactataaaatgtagtaaagtaagggagagtgtgatcagacaaagggagagttgaaacattaaacctcctggatttccacttctttgctttaaaacagaggtactaacaccgtgctcataggatcattgtgaggcctgaaggagatagtagatattaaagagccatactcaggccctggtgcctggtcactcaggcctgtgtgactcatttctgatggtgacagtgccctgccatagtaggtgactttctaccacttagcatgttgcactgactcttggtgcccaggtggctggcctggtgggcgatagggaacctggatggccataccagccagccgtgtgagtttgtaggtgggaacttctagacttaaagcaaatgtgcaaggattcagtgatcttttcctctatactgtggtgtttgagaacttttccttttaggaatagttttgaaaattgcatgtgtgggtgcagtttaattatagtctcatttttcaagtacaactgtagaagagtttgtttttttctttagccacgcatcagtgtcttcaaagagctcatcccagcctgcaatttccagggttctgaagtatttttaaaataaagttgttagtctctttgaaatctaggctcatgtgcttcctttcaaacagcaaatgataacatgcaggaagagagcagagcgtcttttgcccagctacattctgagctttattttgttttcttttgtcatttttttaaatcatttcccctgctgtagacagtgggtttttcagctgtactcatgtactccttttcctagttttaatcctgcttctgagacccttcctaaagaaataattaaaatgcagataaagctgtatgcacaaagatgcttattttatttgtttataaaagtg

SEQ ID NO: 134796 - DNA, 5653 bp, Homo sapiens
tgccctccttccttcatctagccactccccttggtttattttttagttatttaccttgacacacccaaggagagcctacttattctttgtgggttctgcaggcagacgaagcattttagacttagcagataacacaaacatagaacttgattttctcctacaaaaagcataaaagtcccagaaacctcaccacagctccttttcttggggactaaaatgtaacacagaggtagctctttcttggattcatataaggggtctggctcttgaattatgaaacaagcttatcataaaacagttttatattcgaggcagtcatatagcatgagttcttaaaaatttaaatatagcctttaaaaaaattaatacaaagcaatacatgtttactgtggaataaaagataagcaaatactcctatagttgcatcacacaacaaagtgtgaataccctggagtatatatgcccagaccttttttattcatatgtgtattttttatggaaatgggactgtttgcatcctctccctttgttcagttatagataataagtatacattgtaagttttagtggctgcagggcattcttttgtataaatgtaccataatttatttaataattccccattagatgaacattcagattgttcccattttggggctattataaagaacactgtactggaatctttgtgcatatccttgctatttctttaataatgtttggttggtaggctccaagaagtaggatggtagcgttgtttcttaatgcttataaggggactctcccttggctccattaaactagggattccactagggatctggaaacctgcaatgtacatttttctggggtgagggtctataacttagattcccaagagggctgggatcaaaatagatcaggaactggtgttgcagccagagtttccactgtatccttgttcttggtgcctcccaagagcagttgtatgaataaggcaggtggtattttgtctgtaggtatttttgagtaagctgtgtttgacactgggaaaggtacaaagaagacagtttgatcagtgagctcaccacatgaacaaagatagctcctggaatcctttgccttagttctctgctgaaagaagtgaacctgaaacattggtttcttctcaaggccttccacagtctggagggggcctttgccaggggcctttgccagcccaccaccctctgatgatgatgatgatatgaagaagttgaaggagaaacaatgaggaagtgagaaagactgatctttattgggtgcttgcaatatgccaggcattgttctcagcctaagaggaagtattatttattatcctcatttattaacaagtgaggaacggagaggttcattcacttggtctaagtcagacaggaagtgacagagtctgaatttgagtccatgtagttcactttcacagtctaccctcctaaccaccatgatatcgtgcttttcacactcctatcaaattggattaactggtcaaacatttcttcttcttcttattattatactttaagttttagggtacatgtgcgcaatgtgcaggttagttacatatgtatacatgtgccatgctggtgtgctgcacccattaactcgtcatttagcattaggtgtatctcctaatgctatccctcccccttcccctcaccccacaacagtccccagagtgtgatgttccctttcctgtgtccacgtgttctcattgttcaattcccatctatgagtgagaacatgcggtgtttggttttttgtccttgtgatactttactgagaatgatgatttccaatttcatccatgtccctacaaaggacatgaactcatcattttttatggctgcctagtattccatggtgtatatgtgccacattttcttactccagtctatcattgttggacatttgggttggttccaagtctttgctattgtgaatagtgccgcagtaaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctctagcacctgttgtttcctgactttttaatgattgccattgtaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttctttagctgtgcagaagctcttgagtttaattagatcccatttgtcaattttggcttttgttgccattgcttttggtgttttagacatgaagtccttgcccatgcctatgtcctgaatagtaatgcctaggttttcttctagggtttttatggttttaggtctaacatttaagtctttaatccatcttgaattaatttttgtataaggtgtaaggaagggatccagtttcagctttctacatatggctagccagttttgccaacaccatttattaaatagggaatcctttccccattgcttgtttttctcaggtttgtcaaagatcagatagttgtagatatgcggcattatttctgagggctctgttctgttcccattgatctgtatctctcttttggtgccagtaccatgctgttttggttactgtagccttgtagtatagtttgaagtcaggtagtgtgatgcctccagctttgttcttttggcttaggattgacttggcgatgcgggctcttttttggttccatatgaactttaaaatcattttttccagttctgtgaagaaagtcattggtagcttgatggggatggcattgaatctataaattaccttgagcagtatggccattttcacaatattgattcttcctacccatgagcatggaatgttcttccatttgtttgtatcctcttttatttcattgagcagtggtttgtagttctccttgaagaggtccttcacgtcccttgtaagttgaattcctaagtattttattctctttgaagcagttgtgaatgggagttcactcatgatttggctctctgtttgtctgttattggtgtataagaatgcttgtgatttttgtacatcgattttgtatcctgagactttgctgaagttgcttatcagcttaaggaaattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagataacgttcgatcaatacctaatttattaagagtttttagcatgaagggttgttgaattttgtcaaaggccttttctgcatctattgagataatcatgtggtttttgtctttggttctgtttatatgctggattacatttattgatttgcgtatattgaaccagctttgcatcccagggatgaagcccacttgatcgtggtggataagctttttgatgtgctgctggattcggtttgccagtattttattgaggatttttgcatcaatgttcatcaaggattttggtctaaaattctcttttttggctgtgtctctgcccggctttggtatcaggatgatgctggcctcataaaatgagttagggaggattccctctttttctattgattggaatagtttcagaaggaatggtaccagttcctccttgtacctctggtagaatttggctgtgaatccgtctggtcctggactctttttggttggtaagctattgattattgccacaatttcagatcctgttattggtctattcagagattcagcttcttcctagtttagtctggggatagtgtatgtgtcgaggaatttatccatttcttctagattttctagtttatttgcgtagaggtgtttgtagtattctctgatggtagtttgtatttctttgggatcggtggtgatatcccctttatcattctttattgcatctatttgattcttctctctttttttctttattagtcttgctagcggtctatcaattttgttgatcctttcacaaaaccagctcctggattcattaattttttgaagggtttttttggtctctatttccttcagttcttctctgattttagttatttcttgccttctgctagcttttaaatgtgtttgctcttgctttcctagttcttttaattgtgatgttagggtgtcaattttggatctttcctgctttctcttgtgggcatttagtgctataaatttccctctacacactcctttgaatgtgtcccagagattctggtatgttgtgtctttgttctcgttggcttcaaagaacatttttatttctgccttcatttcgttatgtacccagtagtcattcaggagcaggttgttcagtttccatgtagttgagcggttttgagtgagtttcttaatcctgagttctagtttgatttcactgtggtctgagagacagtttgttataatttctgttcttttacatttgctgaggagagctttacttccaactatgtggtcaattttggaataggtatggtgtggtgctgaaaaaaatgtatattctgttgatcaaacatttctgtgggccaggccttgcatttcccctcttccatgattccgttcaaaccattatttttttctgtaagacttctactccctttccacttagagaaattagagaaattctgcctatcctccaggaatctttctttgttcacctgaagtggaagcaaaatttattctttccaccccctcccacccccggtttgtttatagcttgcacttgatattcacatctgagtttgtgatagaggctgttgcaagggtgttgggttagaaagaacaagacctttggagtcagacagactggagttcagatcccagctttgtgggtcatttatcctttgaagggccagatttcctctatgggggagagcagtacctgtcttatagagatgtttgtgagaatgaaatgacattatttaagcttgtccaatccgtggcccatgggctgcatgcagcccaggacggcattgaatgtggcacaatgcaaatttgtaaactttcttaaaacattatggatttttttgttttttaagctcattggctattgttagtgtattttatgtgtggtccaagacacagagtggcccagggaagccaaaagattggacacccctgatttctctcatttttaaatttctggccaaacaaaaaacc

SEQ ID NO: 134797 - DNA, 1115 bp, Homo sapiens
ttttctttgtggtacactttctttatcacacttcatgagaatttttggtagatcctctgacccttggggcacttgtttctacaattcagaatagtatttttgaagagtgtatggaaacttattgtttgcctgagttcttgccaatctgtactttaattgggggctttataaggttaaaaatgttgcagaagaatctttgttccagcctttgttggctgtgtgaaatcaaagaagagctgaccttgtacagtttcaatttttctaaaagtatatatacttgtacagctgcaggcttttaaaaattgtactctgtcatttttccaattagtgttaaggtcacaaaaattcaattctaaaatggtccaagtattttctttcccctcttttatcagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggtaggtagggtgaggtacgcgagtcttaagacatcagtaattgacccaggacttcttggaggggcacaggaggagctaactccttggccttagttatctttcacccctctgccttgatgaggtgacagcagaaccacactggctgctgcttcctcccagtgaccacttccacatggcttgtggtcggcactgttacaaaccaggagtccagtttagacgcctcaggggccgggctggtgaggtacatgagtgaagccagccagaaggcactgcctctcactcagcagtggtcacgtagttgccagttcttgcatcttacaaattttccagaaaagatgggattttttatttatttatttttttttgtgaaaactcatgtgttttaaatgttggcaagcaaaaaatccagtcaaccaagcaaaatttttatcagttaaaaagtatatcgaagagttaaggatggccagaggaagggtgaaagaaacctttg

SEQ ID NO: 134798 - DNA, 1191 bp, Homo sapiens
gggaagcatcattcagagtgttagaggcagactgccaggctttgaggaggggctctactgcttacctaccctgaaccctaagcaaattcttaagctccctaagcctcaacttcctcttctgtaaaatgggggtactagtgatgcctcataattacttaaggaaagtcctgggaactaatctttatttccatgagtgaacacgcttcttgccatgaagtacagaccaaattctattatcatgaggttattacagcaaagatattttcttgtcttggagggtgattcactggaaaaaaagccttatggagagatatctccctccccagttcctctttctctttcttgttcagccagaaatacttggtgagtacattctctgtcgcagaccctgtgctagatactggagaaacagacatggatgacacggtctgcaccctcaaggctcttattgagtaattatcataacattgtgtataataaaaatactgtattaggaatgcttcctttaggtcaggtagcagctgctttctgaaatgaaatgccatactttatggtatttgcatcatgaacagatacaagagtgtacctcaagtcacaaggagcagattgcagaaccagaaattgggacatgcagtctgatgaggatttgtgtgtgaatttctttctgagagatctcctaggtcacccagtccaacccacgttgttgcttttgtagcatttttccaggctggccttcgcacgcacgcctccggtgaagggcatctccttctatcttggaatggttagaggatgtttgtgttacttggattccttcactactatgtgccagacactgtgctagccttttttttctttttgcagattttgttccatataatccctaaaaacaaacacacacacacaacttttcagtgatgttctttccattttacagataaagctactaaagctcagagaggtcaagtaacttgcctatgtgacagagccagagtttgaaaccatgtctgttgaatttcaaagacaggtttttctactacattccgctgccccttaagtattcagacagctctctatattgaacggaactttccctgggcagccagcagtgtggcacagtggttaagaacagaagctgcactacaaccatatgagacatctctttctacattttagacacaggggaaactgagg

SEQ ID NO: 134799 - DNA, 1044 bp, Homo sapiens
acccacccgtccatgtgtcagcatgcttctctaccaggcagtgggctgggttctggtggttcaacatgaaaagacacagcctgctcttagggaccccacagctcggaggagacaatcatcccaacagcctgttagtattcagcgcggggctgcctgttgctgaggtgtgcttggtgttggtccgtgtgcccaggaggagtgggtcagaagagagcctgaggctgagactgggtttgtggggtttgccaggcagatcagtggaaaaggtgcagagatacgggtgagggcagaggcaagttgtattcctttctttttaaaattatgaagtattagaagcatacataagcacaaaagataatataacaaatactcatgttctcattcaaccagaatgaacaaatgcctacattctttttatgttagatatttttcccccttcattaaaaaaaatcactattaatccagatctaattcactctgttagaaataattgtcctcaagaatcctaaatttgtcatgggatggccatggggacaccagtctctggaaaaatactgagttgtggtatatacactgttgtatacttttgcaaggtccagagtcactgcagtgaacacatggtcacatgcttctgcgtgttctgggctttgaggagaaagctactctaccaggcaataaagtcccccttagctgaattgtggaaagttgtagaactatagtatttcttataatgcaaatattcataaatggtcttggggacatcttttgatttcttcttgatagttattaatacagacttcttaactaatcgacagcttccctttccctgtcagtacttcccttcattactgaatgtctttcatttttctgaatgtgcttccagaactttgtatgtgaattgcatctgcctgaacttccaccttttaattgttgcgcagctgaggctgggtgctgcgtgtgacatcttcattgctgtttctttttcacaaggcccttgacagatacttgggatgtgaataaaggattttacaggcatcttggcct

SEQ ID NO: 134800 - DNA, 1693 bp, Homo sapiens
ccttacagttgtttagttatagaaacacggagaccaagtatcctttcaattgtttagttacagacaagaggatggactttactgatatacatgtgtttgcatccggcctggccacttacctgctttgagcctttggcaagtgtctagtacagtaccttgtacatggtaggagctcagactgtgtgagttcctgtttcccttccattcccaaggaagaaattccaatgtgacatcttcaataatgtggtaggtgggactctgtttagagtccataaggtagcattttgtgtggtgttattttagaacaagcattaggttgactgacggcagtcttccagcttgaaattggctttggcatttgtgcacttgcagatatgttttctgctgccatatgacacacagatttggatccaggaataaagattggtggagactgaggacgaagcaaatgattgttattttccagccctctttgctgaggcatccacctcctcccacgtggtctccttttgccacctcaaactgttcttatccttgaacctgctctctcctcttacctggaatttcagagcagaaagcatctcacttttccgaactgagcagtggaccctgaagagctagtctgaggtctgactcttgaaccttcttgcactgtgacattggactagttgtttgacatctcggttcttcatctggaaagtaagaatgataatgtctcttatcctgtgagttctgggaatgcagagtttacttctggattatgggaaagtgtgcttgaaagcattttatatcctagaatgttcaagaaggggcccttactcttctttccttcttaagagacctcagtgatctcatttcttgggtcccaaatattttctgttttcctcttgggttccttctcctctgctatttaaaaactttaaaaaaaacacagccttattgagatttaattcacatgtcatacagtgcatccctttaaggtatacaattcagtgggtttttttttagtctattcacagagttggacaacaattttaaacattttcatcatcccaaaagaaaccttgtactcattaacagtcatttcccatttcccctgaacttgcccaccccagccctaggcaaccacgaatctactttgtgtctctttcaatttgcctattctggattatttcatataaatggaatcatgtcatatgtggtttttggtgactggcttcttccacttagcatactgtttttgaggttcattcacgttgtagcatgtatcagtacttcatttatttttattgccaaacagtattccatagtatatccatgtggatatgccacattcattagttgatgcacatttgagctgtttccacttttggttattagaaataatgttgctattcatgtacaaattttgggggtgataatgtttttatttctcttgagtatatacctaggagtagaattgatgggtaagatggtaactctatgtttaatctttttgaggaactgccagactgttttctaaagtgcctgtaccctctttacattctcaccagcagtgtgtgagggttccaatttctccgcttcatcaacacttgttgttgtcctttgattatagccattctaataggtatgaagtagtggtattttattgtgatttgatttacattttccttggtgactaatgatgttgagc

SEQ ID NO: 134801 - DNA, 1273 bp, Homo sapiens
ggttgcattgtggagatgtcccaaaatttatacagttttcattgtattgatgaacatttgcttttgcaggttgcagtcaaattgtcataacctgactttaggggtagggatgagaacctaggttttatcttgtgcagactttgtgtaggagaggtattattctgagggcttcatctatattcttttatcctgacaacactcatcaaagatctggaagccacaccccatgttcccgttgttaaccggtggttaaggggctgagctgggactcccactgtacctgactgcacagccacaccctttccctggatcaggctaccttccaacccgggtttgttgagtgaatgtttgcatgttgattttccttcagcttagatactgtctctaagctctgcacatcctatcaagtatgccagattgttaaaaccagattcttttggcaatgtttcattggacccttatgaaaatcctcttgaggtcacggcttgacccccccacggccaagaatccctatagaagggagatgtgttctgggagagaaggaaataggtcgtgtttctaatagtggttcagtgaaggctgttgatattcttgtttctgatgggtgttttgtatttgagaaatcaactgtacacactgctttatagcatcagaatggagaattaagtttattttctgaccactaaattactgcttttgcgcatacaaaagagagttagatatatcattagcaaaattgcttttgattgttttaaattatgcaccaaaactgtaatttctagaaaagagttttctaaagatatcagtagagaccagagagagagagagagagagagagagagagagactgccattatattaacggtactagaaatgcaaatttgtgcaatttggctataatagaaatgctctcatctgccccagctccttcaatttgtacctgtatatcaggaaaactaggtgtcttttgtttgtttgttttttttgtttgaatttttcattgtgtgagagatgttattctgtgttcaggaaaactggagaattgaatggacttaatttccccaaatatattaaaatatgtatttttttagtttgaaattattcctcttgctatgtcttcaaaaggaaggaaaccgtatttgtttattattatttttagtatctattagggattgtgctagatactctctgtttgtctgtatatatattatatatataatatataatatatataatctcatttaatattctcaacaagagtatgaatttggta

SEQ ID NO: 134802 - DNA, 1881 bp, Homo sapiens
cttagctttggcactactatctctgtgaccttggttaattagtgcttaacctctaagcctgagtttccttgtcaatgaggatagtaatacttccttttaggattatgatatttaaatagaaaggcatgtaataagtgctcagtaaataataattatttttattattctagacatttccttctttggaggttgcttattagttggatttaataactagattggtggcaaagaagaccctataagtaacaactcatttgtgtaggtcttgtcttccatttaaaaatcttaatcatttcaccagtatggagagatgggggtgatggctagtgtgtatatcaccagcagtaatgaagtcaagaggagttatttatagactggtagaagaaatttacagctttggataggggagaaagaatgttaattgcagcacctcaaagacatgcccagtacaggctttaactagatgcatctttgataccactcctctgggaccctcagtgatccaagaaggtggatcggtaaataacatctccatgggaattaggaactctctatcttcctaatgtgaaagatcaaagccatgttaaataatatgtgtctgaaaagagtaagtcagctttgtgatatataataaggaggatacattgcaagaagaatataataagcactcaaatcacaacatgggttccatactcttcttaggaagaactttcaaggattgggctgtaagggtgggagaacacatttccattgtgcacctgtagtgagtaagacatgtcacctgaggtggtctcatttcattctcctaaccacctcgggaggtaccattactacccccattttataggtgaggaaacagggtgaggagaagtgatgtaaacatctctatcctgtttctagaacatctccctgtgttaaagtgagtatgtatgcacctgcatgcctgtgtctctctctcttcctccttctcctcccccttttcttttctgtttctctctggctcagtgtgtctggcttattttcacttactcacttaccctgcatctccatcctctctccacacaccccattcccttcctccttattccattatttgaccaaatacttttatttgcagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggtatacatggggcccaggcattcctttgtttctctagttctaggggagaacaaactcattttgctaaatgggtttagatgatcgtgctgtgtaatttacctgagagagctcctgaaatggcttggaaggaatcttgccagtcatgaaattaagtaattaggctgcatgctagtggctgtgaggggacgtcagcaaagcctcatgtaagcccattataaagaggagaaagaaagctttctttgggaattattcctgggagcccccagaaaggactgccttgctgtcagcgagaggaatcagccctaccgaaatatcttccagtttcgacaacagcttaaaaaataccattgtagttgtgattctgctgtttttgctgagcttgaattaaagttctcttctcattatatctgttgggagccattcctatgtgaggagatactacaggttgttttccttaaaacaaaaaaggagaaacattcagtacatttgtattttttcaattaatcctttaggagtaatttttgcccctttcatattcttcctagtccatccataacagctgcttgggctttggaaccaaaaagagctgtg

SEQ ID NO: 134803 - DNA, 1042 bp, Homo sapiens
aacatcttatctaagtatttgccttgaagaaaacaatcggtttcaagtggaacatttttctcaagaagaacttaagaaaaaggtattgacctattaatttttagtgcttttcttttctttttgttagattgtttgttgtatcttgggttcctcatgagaggttaagattctgaaggcctctctccttccttcctgtcccctctgccttgttgtgtgtgcccctcctgtgtccgttaactggagtaccttccctcgtgtctgataaactccccaggcctgagaacccagccaggctcgatctccttgaggaaaagctctctggcccctcagtttagagttagccacttttccgtcaggctgttcacctcttttttttgtacctaatccaaatcgatgtccttattttactgatctataattatctggttatttgtctatatttccttgctaggctgtgaacatcttaaacttagtgattatgtcttatttctgatttcccattgcctggcacacatataggaactaataatagatgcattttgaatgaataacgttccaggtttgatcaataaatctttttttaaactggaaagattcttcaatgtgttgatcagtgtcatggttagagtggtttagtgtttcaaggttctgaaaaacattcttagaaataggaggtttgagaccgcatagtttattataaaattatcatgtatgtgtgactaagattcagtttctatctgggaataatttacattctgatagaagagacaggcatgtaaacaagtaattgcagtatgaggtgcaaggttgctgtatgggcagctgtacaaggtgtagaaatagcagaggagaggctaattgcctgtatgggagatgggggggtgagctcacctgatcaggggaggcttctcagcagaagtgagacttgaagtgggtttcgaaggacgaattcggagtttgcccaggtctccactttctcagcagagaaagagaaaacagcctgtttaaggcacagaactaagaaatagcaaggagaataaaa

SEQ ID NO: 134804 - DNA, 1088 bp, Homo sapiens
ttccttggtacattagctacatttcaagtgctcaatagacacatttagctagtggctactgtagttgacagtgaagatatagaacatttccatcactggagaaagttctattggacaggtttccccaagattaatgcacattctgggaggtgtgcattttcttggtctcctctgggttttgggcttctagtccatgcaagctctctgtacagcttagcactacatctcctctcccagaataaaaatccactcatactatgcgtttctgagtggttcacccaccacagtggagtttttttggcccctaatagattagtccttttctccttcttattgttggctcactcttcctttatttttttctcttcccacctgtcccccacccttaacttccagtatgacttttttgaggagtaacacagcaggagtcctctgtctccctttcttctgaagcccgggtgcccaagtgacactcaggccctggggagcctccctttctatacccaagccctcttggggcattgttcagaacagagacacattctggaatggagaattacgttattttcacctagttaacgcctatagcaaaaatttggaaatgacccaagtatccactaataggggatgagttaaagtaagtggtgggacattcacctggtttaatattatatagtcattaaaaatgattttgcaaataatttctaaaatatagggaattatgaagtgaggaatgcatatcagcattgtatgtctagtattatttcagccatgtaaattacgcataggggaaaagattggaaggaaatacagtctgccgtgtgttagttggtagtaggagcatgataatttttgttttctttatactgttgtatttaaaattctctatagtaaacctgtatatacttttataaccagaaaaaaacacaaatgacataaaaatcacaggaaggctttctgggctttgcatctaaaagtacaaataggtctgttttaaaacttctggtgtcttgttttaccaagtatcaacaacctgcaggctgagttaaacaagatttttgccctgcggaagcaactggagcaggatg

SEQ ID NO: 134805 - DNA, 1912 bp, Homo sapiens
gtcttctcagcttcatgaggggctcccaagtttcacaggctctttcttaatgaatgaaaacttggatgggactgaggcgggtcagggctaactcggactaacaaagactaaccgggactaacaaggtttcttaaaaggcttcctgttcatcttcagacttgtaatacattcagtgggagacagacctaggtccacatctcagctctgccactcagcagccctgagctcttgggtaagtaatttctcaccctgagcctcagtgtgtttgtgaaattgagattggctggtctgcctacttacctacctacttagatgtctacctgctttacagggttgtgttgaaactagagaggacactgtgtaaagacctaatacttcctggcatgtagtaagcactcagtaaatggtaagatttcttaagaataatgacagcatgaaaagcttacatatgtctcaatatttcatcatgcataaacttagtttacaggaggtttttgaatcctcagaccttggcatatccagagggcagaatgtgggctaaggaaggtagagctctcttctgtaactccagcactgttcactctggaaattgacaggaaaggtggatgaccctgaagacagatgatgtactgtgattaaaactggaaagggaagtcaagaagggaggaaactcattgtgagcaagaatgtggctgatcctttcacttttactatttattcttcacagcagcacttagaagttggtggatgatccccaaattacagaagtggaaatgtgcattctaagacacccggtgttccgcagtgaaggattatcagtgcttaggtcgtcttggctcccaacccaggttcttgctgatacactccccatcttgaggactagcacagtttccctgtaactcaggatttctcagcctcagcagtatgaggctttgaggctggataatttttttgtcatgagggcatgtcctgtgctttgtaagatgtttaacaatccccggcctctaccatgggagggtcggcacacctgatcctcccatggcagttgtaacaaccaaaaatgtctccagacatggccaaatgtcccctggcgggtgggggcaaaatcatctccagatgattatcattgctgtaactcatgaaaatcagcaatcttggctcataaatattgtcttctgtatgggagttgttagagtatgtggaaggaaggaaatgatgtttgttgagcatctcatatgtgttagcccctgtcctaacgtctttcccatgtaatatctcatttattcctcaacacaatcgcaaagcaaaggtattattattcccattttgcgtgaggaaatcaggactcagttagttgaactggcttgcccagtagtggtggcgtgctattttgagcttcgatctctctaactccttgtttctgctcctgtctgccctgccccagttccaggaagaggaaggtttttgtttttttctgagtgaagcaccttttgttctcccaactcctcacaccttgaaaagattctcaagttgggaaaacataaatgacagacacaggagcagcagctgtgtacttttcaccctgtcagaaaatggaagagggagtgaagcagttagctttccccagccctaatcgcaggagcttctctaaaacagtctctttttttctccctggttaaatgcctctgcagcatgactgcatccaagcgagtgctgtgctgtgacacctctgtgaggtttttcatcagccttacaaattgatcattatgattgtcttaaaatggaactagatacaagttgctagtagggccctttcccttgcgtgaagactgcttcacaatgaactgtcctcaaagcagcaagcatagaagattagacataatggtttattttccttccaatgtgtgttgat

SEQ ID NO: 134806 - DNA, 1038 bp, Homo sapiens
tgctctctgactgtggcctgagccagagccaggcacagggcctctctcaccttcgtttgattttaaaaactgggactagctacatatgtttgcataatataaggatgtactctttcaaaattctttccttaatgtcaaatgcccattgtcatttccaggaaaagaaacaatcatcagactatgaagagctgattcaggtcttaaagaaagagcaggacatctatacccatctggtcaaatctctgcaggaatcagacaggtaagcgtttctgtctggacatcacacatgtgaatgcgaacacacacacatgcacgcgcatacacgcacacaccctttcaatcagtgctgatctctaaggcagcaaagccctgccagtttgcttatggagcttataaagcttgggtggcgactgccctatttgatagtcacatatacctgttttctatcaagaattgtctgatttttggcaacaaaattgattactcaggttttaaaatcatgattactcaggttttaaaaatactttattatatatttagaaagtgcttctatgtgtattatctcatatgatcctcacagcctttctgtgaagtaataataatgctatccctgtgttttctataaggtcatgaaaactaagatagggtaagtgacttgctcaaagtcacacagatgtcaagtgacagaaccctgggactcaagcaagtctccctatctctgcagaattgctgaaatgagttgctgccagcaaggtgtggtggggagagccaactctaggatagaggccttgttctagccctgactctcccactttctagctctgtgtccacaggcaagtgctgctctgggcctctgtccatgtgtctgtacacacagggttggcctcagggacttctcagaattgagaagtcctttttttttttttttttgagatggagtcttgctctgttgcccaggctggagtgcagtggcaggatctcggctcactgcaacctccgcctcccgggttcaagcgattctcctgcctcagcctccca

SEQ ID NO: 134807 - DNA, 1078 bp, Homo sapiens
cccttcagtttgggttgtttgtctggtgttttcttgctgattagattcagtttatgcatctttggcaggaatatcacagtagcgatgctatgttcttctcattgtgtcctgtctgatggtacacagttggatttgccccattactggccatgctaactttgataactttatcaagatagtgtctgccaggtgtcttgactgtctagttatgcttttttccctttgtatttaataagtattttgggggaggtgttttgagtctatgtaaacatcttgacttttacctactagttttagcatccttttgtgtttcttggctgaattatttattactgtgatggttggcgaagggtgatttttctaattccattattctttttacatttattagtcatcatcatttttctataaagaaaaacctactctttttccctcctattcatatcaatatggatttatgaattcctgttttatttggtgggttataatctgttactatcagttattatcagtgggttataaaccattactcattatttcaatgctcaaatcatcccagatttggcttgtgggagcctttccaaactgggtctgtgtgtccttttgacaacattccatcattatttaagcatttctttaaaaattttttcagctttgagttataattgacaaattaaaattgcatgtatttaaggtacactagatatttggatatatatatacattgtgaaatgatcaccataatcaaattaattggcatatcgatcatctcacattgttacctttttttgtgtgatgaaaaaacctaaaatctaccctcctggcacatttcaagtgtaaaatacagtattttttgtttgtttgtttgttatttcagggtcttgctctgttgcccaggcttcagtgcagtggtatgatcctagctcattgcagtctcaaacttctgggctcaagggatcctcctgtcttagcctcccaaatagctgggactataggtgcatgccaccatatccagcgaatgtttttatcttttacttttttgtagaggcgggggtctcactatgttgcccaggctggt

SEQ ID NO: 134808 - DNA, 1050 bp, Homo sapiens
ccactgcactccagcctgggtcacagagtgagccccagtctctttatttatttatttattttttgagacagagtcttgctctgttacccaggctggagtgcagtgccatgaccttggcacactgcaacctccgcctcctgggttcaagtgattctcccaccccagcctcccaagtatctaggattctacgcatgtgccaccatgcctggctaatttttttgtagttttggtagagacagggtttcaccacgttggccaggctggtctcaaacttctgacctcaaatgatccaactgcctcatcctcccaaattgctgggattacaggcatgagccactgcacctggctgagacccagtctctttaaaaaaacaaaacaacagcaacaaaggaattttaagtgatcacttaagaattgtaaatttctggtgtcactttaaggaatcccaactgttgcagccttacagtcgtacccccgactcccccggccccaagaaaggtgtgcttttcagatcgtagttctttctttgtagaaaatgtgaatttattctgctgtgcccttggctattttgtgttggtttagaatttatcctctgcccatttctagaaagaacttgaggctatgatcatgtctccatagactctgggcagtctgttttccttctaatcattgtgtgatcctgagaatcaatgctagatgactagggaattgaagaatagagagtgaaacacactgaccatatttaactaactacagccggagattcatggcttggttattggcatggttgggacatcgctgctgaattttcagggtattaaaattaatgtctttgttgcagggctgtgacatagctactgaaatagacaccatctatctaccaggcctctaaattgccttgattaccaagaagtgatccattaagctttctccttacatgtctgctgtctctttagatgtggtctgcacattacatgtgtttccttcaagtcattaaggaaactatggtaaagtagaaaatgcccggctttggtgtcagaatgccagtcc

SEQ ID NO: 134809 - DNA, 1314 bp, Homo sapiens
ctgaagaaggcagaggcagtgggatgcggggtagggagctgtctggcgggaggaatacctttcttagtactgcagcttctacccttcttcctttataattaaggagggaggagttactaatctgagtgatgagagttcaggatattttgggggccattcttgttaatgggtgagttataagaacccaagttccagattcttttgctttcctgctccagatgtagccaggcctagtctttgctgggcaggccaactccctcatttcctcatcagtcatctttgtgcacttctacttctacttgaataagagaacctgggcagctccctaagctgcacacaccctcccttttcccaaacagtaacaacatcaactaccccaaacccttaattttatcagaaagcacttatctggatatgaaattgtcacagaattgtactttgattccccattctgctattgttgtgtataactcctttgagaactctggggatagcaggagtgattgacagggtaggatttggacactcttggccatgaaaagcaccaaatcctcgcttttcatctcccaggtgctctgtgttgagggcgtgccacaccttaaggcctgggttaactgttggatgacaagatgcctgtgagagggaggggcaagagctgaaccttgttgtggggtggtggtggtggtggtgatgccatggccatgtgaggaaaccgggtagtgaggatcagtctgggggttgtatgtggggacagagagaggtgacacggcttcatttgctctgcattagcttctgtgctgggctcccattgtgcattctctcctccagacctccaaggaccctgggagtttgcattattgtcttcatttaccggaaaggaaacactcagaaagatttaagttatccatctctggtcacactgccagttagcagtagaggcaggattcaagactagggctgtctgttttcacagtccaggaatatcgaaggaggtttggaaaaaccacccaagatgatcaattttcagttctgattgttgtactcaggcaagacatgccatctccatgcctccccaaaacatttattagaaccccactggtggcaagtgcatgagcctgtctgctgtctttgtgttgccatggcagcactcttcttcagggccatctctgcacacaaacctgccctccccctatggtcattttgctttaaactttctttgactgctcttcatatgaggttgaaggtgcttggttctgccccattcattagaaggagggcctcagtctcaggctagagagtccatcaatccaagtc

SEQ ID NO: 134810 - DNA, 1407 bp, Homo sapiens
aaccatcctttgctcatgccaacaacatttattgccagtctcattgtgcctcttctttagcattttgtagggaggcaattcttctgctgaaaattgagcttggatcagaggcttatgaattcactgtgtctcattgtgcacgaacactgagaagttgagccccgagagtcagttctccatgtttgtttgttttaattgcctgtgattgcagtgacctagtgccggttgactcagcatgtgttgtaatttgcagttttttatttattcaacacatttattgagtacttgtaatgatattgttaggctctgatgaatacaagctttggtttttactttggtagtcttatttacagtgaagaaggtgaaaaagtgaggatcacagataggtcccctgtattgtagtatacctccctgctgccaaaggggcccatatcccttgaaggaaactcaggagacctttgcaaaaacaaacaaaaaacccagtgttcccaagtctatgccctaactgggatgtttaaagtgtcctactcttgaggttggtaacagggatgctgcttggatcctcacatctctgccttcatacatctgagtttgatacattgtcagagcccagaaacctgggctctccttttagtgtgtgtgagtgtgcacatgtgcatgaatgtgtgtgtttggtgaagggtgagggaaatctttattttaggtgcactctctctggttcaggcgcttggtattctactcagggtgggtgtgggagagaagcaagctaaggtttttttgttctcctttataagcaacatatattagacattgccttggccatattccccagactatttcagaatgctttcatctgttatgagacccgtcatccgctaccctgacaagtgtgtgcttcagtacctgggcccttagctctgtggggatgcatttgctggctaaagcccaaaaatctaattaaagtcgtaccggtcacccagctggctaatcccatgtgctttgacaggagtgggtttaatttcagggtagttcagcctgaacctcccagttctcacatgtactcattgatggatatctccaaatgagattgtgacagcatttagaacatctcttggtaaatcagaatcaaaacatggcatttggagacagtgtctctacaggctggttggttagggctaagaccacagatctgaggtactatattttttactaatggccaaagctcctcttgccctaaaaaaaaatgtatatatatgtgtgtgtgtgtgtgtgtattaggtgtgaaagttttgagttggtctctttatagaataatgtgcagtttaaatgacctatgttggaagaagcctgaagccagaaacacgagtcaaactggtttggagtcctggctccattacttactagttg

SEQ ID NO: 134811 - DNA, 1049 bp, Homo sapiens
tgcagtggtacgatctcggctcactgcaacctccgcctccgggttcatgcagttctctgcctcagccttcccgagtagctgggactacaggcacccacctccacgcctggctaatttttgtatttttagtagagacggggtttcaccgtgttggccaggctagtcttgaactcctgacctcatgatccatctgcctcagcctcccaaagtgctgggattacaggtgtgagccactgtgcccagctgagaatttgtgctttttttctggtcctttaagaaaatacttctttcatacaaccatccacatcataagaaacattatcttatgttattccaaaatcttcctattatttttgctttggtttctgaatgttgtctatgttaatctttttcttttctttttttcccccacggcgaaaaagagcccaggtttcttggtttgtttcatgaggtatgaaaattagctcatcttgcttctctgccttctcttctaggggtctgaagactatgagactgctctatcaggaaaggaagccctttcggctgcgctgcgctcacaaaacctcaccaagagtacagagaaccacagactgcgtagaagcattaagaagatcacccaggagctgagtgacttgcagcaggagagggagagactggagaaggacctggaggaagcccatcgagagaagagcaaaggagactgcaccatccgtgtgagtaccgccctgcccttctgacacagtggacagtgcttttggggctatgtggctgtgtctggttgtagggtgatattcagtacagaagacttaagaaaatatttcacttattatctcagtacctagaaatgaccagcttcatttgatctatttggtatttcagtccttttattctcctcgctctctctctctctctctctctctctctctctcacacacacacacacacacacacacacacacacacacacacacacagagttgttatcgagttgaaaatacagttttgtatcgtgcttttttaagtttaatgttctctctctggtttgttgc

SEQ ID NO: 134812 - DNA, 1079 bp, Homo sapiens
gctgggactacaggcacatgccaccatgcccggataatttttgtatttttggtagagatgggggtttcaccatattggtcagcctggtcttgaactcctgacttcaggtgatccacccacttcagcctcccaaagtgctgggattacaggagtgagccatcacgcccagcctgagtatcatatttaatcttcacaatgaccatatgaaaatagagaccattcctcccaaagtgttgggattacaggcagcgagccactgtgcctgacgaaggatgtgtttcttgatatgagtgtattcagtttgtgaacatttgttgagctatacactgatgatttgtgtacctttctgtatatatgctatttttagtagaatgctggtaaaccagctttcagaaaaaaagaaggaaaaaataataatttaaaaaatagaggccattacttcccatttcacagatgtgtatatatttgataatcatatgtattttctttagttaactgtgtattaacgaaataccacatattcttgacttattttgcccatggactttgctgaaattacagtctctcaggctggccattgaactagcatgctgaccaccttttttttttttctccaaatgaatctgggtttgagccattctgatgtggatgaacattgtaagtgcttagatatatctctactttttgtcaacctaaataacagagagaatctctcaaaaagaaaatgatacttattcaggactaggacatggcagtgggaatacatgtgccatagctatgtgcatattcagggaggttaaggaagacaaagatttttaaagaaaaatgagaattacataacagtattgagatacttgtccttggctgcaagtatcaataacaaggatgacaccagtcgtaggttggatgggcagttgctgggcagatgtccttgtggaagtattttttgtgtaggattgcggtggcctttgtgcaaggttgtggtttttacagagtcttttgtgatagtttttgttctgaggcatttatgcctgagtaatctgtcttcatatacccgaatctatttgtcaaggttgttt

SEQ ID NO: 134813 - DNA, 1030 bp, Homo sapiens
tgcttttactgtcatcccgtatctcccttacctggctgctttggtcccagctgctcctctccaggtttcttttccagaccttgatgtttttgacctgccttctcctccctccgtcccccaatgttgtactacaaggactcctgatggtcagcccctctttcttcctcattttaatttcgtgttttaaattattttaacatgtttcttatcatgtttctagttttcttatacagcttatacctatcactaaataacttaataaatcaatacagttttatcatcaaagtaagtccatactgcctaaagcttcctcctcccacctcttgcactgatgttgcttttggttgtaacgtagaagttagaagttaaatctgatttaagactgtttgattcccaagattcatatcccatgacttatcttttgcagagcctttagttaacaataagaataattgaagtaatttggtttaaatcatggtacgctaggaacatagacaaatctttgcttttggaatctcagacttgccttctcttactgttttgacagtggttgatgaaatggagctaagattacactttagactgtttctctttttccttgcctagaaaataacaagcttcagaagctgaattcttaggaaaattatgttttccattgcttgggtaaaaatctgttggctgctgatagccagagagaccggcataaacattgtgatattttacttgttatgacgggtcttaaaggaaagaaaggaatcttatacatttaaatgttacccagatgtattatatacatttaacttaataaccccagtcttagtcaaaagactttaagaatgagttttgaggtcttacaatgtacagtgttggtcaagtttcttatcttgcagcacacagagatcaggaactgttgtaactcttcaggttatacatgtcaggttggcttttcagaggaccctcatttaatccttgcccgaggaggtagcagatttacaaaccagcgagtttttgcaggacttgaactcaagtc

SEQ ID NO: 134814 - DNA, 1118 bp, Homo sapiens
ttgactggagccaggctggaggcaggcaggggaccagttaatgtcacacgaattctgacgcttaatctcctacctgcaaaatgtgattctgtttgtgttcagccattgtatatgtctactttgaagatatctggccccatttccttcctcctccagctccactgagctaagagaacagcttagaattaatatttaaattttgttctcttttagactgattgaggagttgaagctgtctttgaagagcaaagaagctttaattcagtgccttaaagaggagaaatctcagatggcatgtcctgatgagaatgtgtcatctggagagctccgaggactttgtgctgctccaagggaagaaaaggagagagaaactgaggtgaggtgacaggacatgaagagggggctttaattagccaaccagactcctctgtgggagatggaatgcgcattcggtcctcatggttcacacacagcctgcttctaaatatgagtcccctgtcagctgaggagtgagcagaaactgcctttgtcaggggccctggcattctttttccttcttagtctcctgttcctataaagagttgcttaaagaaaaccagtccctacctgcttacctctgttttaccatgtgttgatttgttgttacctggggactttattttcatcctttgggttttcttaggatacagttgtggtgcattgttttccatcttgcctttttggttagaagtaggtgtgaggccaactttggtctgcaacttgagaggtagggtgggaagaggactaactcgtatcgggcttagcagtatgggaggggttcagtataccatctcgttcaatcctcccagccacctggcaaggtagagctcatggtctccttgtcacgtttagaaacgggctcaggctcagaggaattgttacatttttccaggttccaagagatgggttgctagtagctgaccccaaagcctccctggactcctgcccccgccctaggcggcctccccagcaagctcttttgaagaggttgggcaggccagggaagtgcaggtaggtcttagtccaggccttccattcttgttggagtagctgctgcatgtcgtatgttcacattgggg

SEQ ID NO: 134815 - DNA, 1057 bp, Homo sapiens
cttggccacaggagtccccaccaggcctgcctactttttcttttctctatgtagaacttgctttaaggtaactaaaaaaaaaaaaaaattcagttttattggtgtataaattacatacaacacagtgcttcaattttaagtgtatatagttcggtgactacctctcccattgattatgtgacgatttcaaagttgagcccctagagggcaatcttacacctctttccaggttttctggggcattgcactggtgctgcctggcaccttgtctcctagtgcattgctaggtgctttagttacctttgtctccctctttaccttcatcccaggaagctgtgcttcactagggcagctctgtctgactgcaaaatctttcttctttctcccaaactaagttgctttcttggtttagctgcagaaaggctattctgagggtcttctgacaaaatgctaattgttacatgttaaaaaaaaaaagtaataattataacaactgtcatttgttgagttccaccatattccaggagcagtgcaagattgttttaaatagcttgtctctggtccacaatcacaagtcacccctattttgtagctgaggaggcacaggctcagagagatggaattacttgccatggccaaggggcagttgatatgggataatttggtaattatattgtgttatttgataacacagcccagagagggatgtgttcagctgttcctgagtggggcactaggggtgcaggtagcaaagcttcctggaggggagcttaattagctttggcaggatgaatgggtgtttgtcaggtagaggtgggggtgaggcgggggtagggtggggaagggcattttaggtagaaggaatagcacgagcaaaggtgtagaggcatgaaacagtctggcttcgggagagaactgaaagtgaggctactgagtggagatggagagggtgatggtttcccgtgagagatgagactgaagctgtcggcagggccctctgatctggtaggccctaagacctaggacctggaatgcctgggaaggagtttcaccgttt

SEQ ID NO: 134816 - DNA, 1100 bp, Homo sapiens
gtgagtgggtagcagaaattcattcctggagaaatcctgtagccaaggctcgggaaggaagggcttctcgtccagaattctttcggccgtgtataatgctcctcaaggagtgatagaaatgattgtgaatcactgtgaattcaagacagtgatccaaaaatgagccccgggagtggggggtgatggcattcaatggtattaatcaggaaatggaaataggcgccttggctttggccagcggagaccccagcagagggtagcatgaggcctctcacagcatgctgctcagcaggagccagtgctgtgtgggcctcagaggccaagggctagtgtgcagagcactctgatcagagaggaacaggccgacgtgtgtgagcacattaattctgagaggtaatcatctcatttttcacatgaggaaactgaggtgtgagaggtaatttactgaggctaggtaattcacccagagtcccactgaggacataatagagtaaaaatttagaagcagatctgtccagcttcagagcccatgttctttctttccagttgttcacattgaattccattaaaatgatatgacactggggccttctgaagctttattggtgaaaagaaaaaagatattaataaagtctttattttcaggcgactcatgtttgagatttggacaacaagtatggccctcttgactttccattgttctcagtaaaaaattcacatggcttgtacatatgagagatcacatggctctcagttggaaaaattttatgtatctttaaagtagggcatgggaagctggtggtgaatagatttgttctgttgcagtttttctgagaaaccagccttaggtggaagcatttcctttattattttgccttctggaaacctgcagtcattttagaaatctgacgaggactgctcatacagtcttacagagtcatgtccgacactgtttatcttctggcatcggtggttgtagtcctgcgtctgatttgggcgtgccgttcccaccactgccggtcatgtggagagaatattccatggtgctctagcagtgtgtactctgtgttttatgttagagtaacacggagtatgggctg

SEQ ID NO: 134817 - DNA, 1663 bp, Homo sapiens
aaagaggagctgtaagcccagtgctttgggaggctgaagcaggagtatcatttgaagccagaagtttaagaccagcctgtgcgatatagcaagacccaatctgtaaaacaaacaaacaaacgaaaagacgggtgtggcagtgcacgcctatagtcccagatactcaggaggttgaggtgggaggatcccttgagcccaggagtttgaggcctgcagtgagctatgatagtaccactgcactccaggctgggcaacagcagagcaagactctgcctctaaataaaaaaacaaaaaaacaaaaaaacaaaagggagatttccaataaattgtagatttacagcagtcttccacaaacgatgcacccaaacccccatctactacttgagttcatctaatattctgtctgggatacatttgtagataagtttgagaagtctgccactgttcagctgtctcatattgaattccatttgccctggattctcacgtgagttataagcccaaggctgtgtgcaactccctttgttccagtcagttaagaggaagacatttggttggagaacattgcggtgctccttatagacagcttgccccatgtggttgtagctttaagtgagaaccctgaaatcttatattgaaatgacacatgccatgatgtggtctcctgttttccatccacatgttttatttttttttaagctgtaacacgttcccactgctgcatccaccacatgcatgattgtaaacaaccaccagtaattgctttggaatgggaaaaacacaccgcagaattgcttgtaaatttgcttggtggagggcatacaatttttaaatcagccttccttgtatgacatttatgccttgatatttgaatgctctggctgttagaagcttggagcatttacataattgttccaagtctcacaaaatctaggtctttcttttgagaccaccagtgtttaataattcccttttccctgtgccctgaggctaatgagggtttttggaatctaacatctgcctattacaagcatcctgtagtcagtctgtgctggaagcagtttccccattgttgacattcataggtcctctattttacattgtttcttttctttcttaatcttgttttgtagaacattgagctcaaggtggaagtagaaagtctgaagcgggaactccaggagagagagcagctgctcatcaaagcctcgtgagtaccatcatccgttgaaagcttgcaagtcgcccacactgggttggtcagtgaaatagagccgtacacttttctaagacagttggtttccatctggactctgaggactgcaaggaggtttttgtttttacttaattatttacttttcaacaagcttttaagatataccatgcttatagaaaaatgaacagatcttaagtgtacagcgtgaatgttcacaagcaaacacacctgtggagctaccatccagatcaggaaacagaacatgccagccccccagaagccctctttgtgttctcagagctcacctttctcccctaaagataactaccattctgaccactgttagttctgcctgtttttaaactttatataaaaggaattatatagtagattctcttttgtgtctggcttctttcctcaacaatatatttgtgagattgatctatg

SEQ ID NO: 134818 - DNA, 1043 bp, Homo sapiens
aagtttttataattacgtgttctttagaaacaggcagtggaatggtggaatggttttggagttgaattctactgttaccaggtaacttgtgtaacttaggcaagtcagtttagcttttggggcttgcttccagaattaagtgataatccctttgtcatagggttatttgtatgaattaaaatgagaagacagatgaaaagctccagcacacagtcagtgcttgacaattaccgtcttcttgaggcttcctttggcagcccaaagttaggattgtcagtttttctgtgataggactcttcggtattcctgtgtgcttgcctgtaactgtcagaagaaaagcctatcctcatttgaagtcttgacctgcaggtctttgtctgaaaacaaaccttggttctgaaaactgaaaaaagaacttggctttcttgaaaagacaggagtacaaacaatatttcagtgcctgtttcttggctttttctagtagattagcccttggcctgggaattattctgacttttctcctctgaagtttgcaccagtggaaacttttgaaggaggaaaaagaactctccttgagtttcagcagatgaacttaaattgacttgtcttgaagagggattgtgctgtacttctgagccttttcaagaattggaaagcttctttgtcccttatgaaagtttttttcttcactctgggagtggaaagacagtgaggatgtccccttttctggaagggagtagtgatgcaatcacaattttaaaggaaaaccaatagcctaaagcagtttatacgtgagtatggtggtcatgcgtctagaacctcttgggtgataggaatacaaaacgtgtctgttgccaactctatcaggcactgtcttgggtatctgtacatttgcatcttattgtaattctcatgacagtcctgtgccgtggagtttatcttcatcttacaggggaagaaactgaggcttatagatgagtaacccacctgatgtcatatagctactacgtgaggtggattttgagcccaggtcttccaatctc

SEQ ID NO: 134819 - DNA, 1040 bp, Homo sapiens
ttttgcacacagcactcttaagtacattagcatgtgtctctttcttaggacattttcctgtaaaatcatattattacctaatataaaattgttattcaagtttccccgggtatcatcatatggttgtttctgtaaaaaattcaagattctattgtacttagtagtcatgcctcttcaacctccttttatttagaagagttcaccaaacatttttgccttaggattgccattaagatttttgaagagttcagttctgttgttttgcagaatgttcttcaacttagatttatctggtagactcctcttgattagatacaggttaaaggttatagacagaagcactttggatggaattatttgctctcattgatttatttcaggaggaaaataatgttagtttatcccttcaatggtgataagagatgaatttttttggtcaagatggtgttcgcaagtttcctaaattgtaaggttaccttttccttttgtaattaataagccatttgtgggtgatatgttatgactgtctgaatattatgttctgtagtgatctttcatctaatgcttttagtgctgctgattcttaccttaatcaatcattactgtagaggttttaaaatagtgattttctgttccttgtattctacatttattaactggatttcttttgaaaagaagaaattcttcttttccttttcttcttattatcagtgtggagttttgaattctttctttattcagtcattattcattcctgtcattattcattttaatgctcaaattgtactaactttggctagtgggaaccacttaattcttctgggttagtagaatggtagcaaaaataagctttctctagtatttaacatttgaatcagttttgtagcctcgtaatccatagcgactaatgtatgtactatctgttggaccctctgtcttttgtttgcttttgatgacccttctgtgatatttttcagcaaatcactgaattgaagaaagaaaactttaacctaaagctccgcatctatttccttgaggaa

SEQ ID NO: 134820 - DNA, 1234 bp, Homo sapiens
tctgccttaccattgaaaactgagcttgaacagtgactttgagaatggaaagagaacaacagatgcatgaactataatgtggacagacacactgcatttagtaaatatcatcagcactcgcttcacaattcagagtctcaaaaaaagattgcatttatctattatttaaatttatttcatttatgggaaatttatatggtacaaatatacagtgtacttctttatgcctactgtcatatcaagtaaataattatgtattcatatcccctgcccttttaaaaaatagtaacctatctatataatgtcccatactgtagtgtttttatttaacaatgtatcttggacttaatttcctatgagtgcacaatgtggtctctcattcttctttatggttctatcatattctattgagttaacatactataatttacttaaccatggatgaattgacttttaataattcatattaactatagactagtagactatttgactttaaaaactttaaaaaatgaggccaagtgtgatggcttgcacctataatcccagcactttgggaggcttaggtgagaggaatccttgagcctaggagtttgaggctgcagtgagctgcgattataccacttcattccaacctgggtgatagagcaagacatcatctttaaaaaataaaaaaataaataaactttaaaagaaatgtaacatacatgcaggcatacccacaaatcatatgtgaacagtttaatgaattatcaaaaaaggagcataccctataaccatcaccaaagccaagacatggtacattatcagtgccctagaagtttgctttgtggctcattccaagcactatgcacttttcctccccaaaggtaaccatcatcctggactaatttaaagtcccttcctagcttgtgtttctgtcactctctttataacagggtaacgagaggaattttttttcccacaaaggcagagacttaaaaatgtatgaaacagagagggagaaactggggatgttggtaggattttggagaacatttagctatttaaacatggtgatagaagcatactaggaattgctttactgtgtaggctaatatctgttcttgaagttaagttagactgcacagaaaagtttactggatgaaccaaaccaaaaaaaaatcaggaattttctctataggcagtgaggctgaattgacagatcatagttactggagtcagacagaagtat

SEQ ID NO: 134821 - DNA, 1037 bp, Homo sapiens
ataaaattgtatttatgggccgggtgtggtgggtcacacctgtaatcccagcacgttgggaggctgaggcgagtggatcgcctgaggtcaggagttcaagaccagcctggccaacatggtgaaaccccatctctactaaaaataaaaaaattagatgggcgtggtgacacccacctgtaatcccagctacttgggagactgaggcaggagaatcgcttgaacccgggaggcggaggttgcagtgagctgagattgcaccactgcactccagcctgggtgacagagcgagactctgtctcaaaaaaaaaaaaaagtatttactaaaaagaatatgatatgctattaaaaattattttttaaaacgctgaaaaaaatacgtgatgagtgtttatgtgtgaagatgtactagcgtccaagtgtagcttttcacattttgccctatttcattttagttattttaaaaatcagctttattgagatataatttacataaaataaaatgcaccaattttaggtgttggatgaactctgacagatgtatattcccttgtaatcactattgtaatctatatgtatgtatgtgtggttatagttttttatatgtgtgtgcagttcttggcacgtgtaatgatcaccacaatcagaatatagaacagttccgtaatatcaacaacttcccttttttttgcttctttgtggtcaaatcctctcttcaccccaagcctgtggcaactaatgccctgttctctgtccttgtaattttgcttttcccagaatgtcgtataaatggaatcatacagtatgtaatcttttcagactgtcttctttgcctcagcataatgtctttgaattttatttacgttgtgtgtttcatagttgctgagcactattctgtcatatggatgtctactgtttatccattcaccctctgagggacgtaagagtttctcccagcttttggtgattattaataaagctgcagtaaacatttatgtacaggttttttgtgtgaacataggttttcatgtctctaggat

SEQ ID NO: 134822 - DNA, 1052 bp, Homo sapiens
ccaggttcatgcccttctcctgcctcagcctcccgcttggctaggactacaggcacccgccaccatgcttggctgattttttgtatttttagtagagacggggtttcatcgtgttagccagatggtctcgatctcctgacctcgtgatccacccgcctcggcctcccaaagtgctaggattacaggcgtgagccaccgtgcccggcctcaatgttttaaattcttatgttttactagcaactatattaaacattctaattaatttcttttaattcttagactagctttttgagatggttataataatcccttttttatagatggaggaactgaggcatgtaggaaaagtgaacttcattaaggccatacagctagtaaagtggtctggattgtatttattcattaatttgttcactcatttaacaatttgttgaacgtctactgtgttctagatacttgttaaaaccttggaggaaacagccatgaaagattaagtggattatattcatgtaataaacatgataataataaacatgcaaagagatgaaacatatacagattgtgaaaaattctagcaagaaagtaagagctatgtattagagagtgagctggttgggttcatagagatggggcccactttagatggtgtagttggagaggccctccccaaggcagtgacattggagctgaggtggaagggatgagatcgagccaccctggcagacgcgtcagaaagagctttgtaggcagacaagggcttggcttatttcaggactggaaaggaggccagtgaggctggaatattgtgaacaggggagaagatgatacctgatgtggttggagaggtggacaggggccagatgatacagcactttgtggctgtggcagggagttttattctaagaatgatggaaaaaagagctaatagagggtttaaccagggagtgatgtataccagatcggtctgaagtctaagggggctcttgttacatcacactgccttaaagaaattctttttttttttttttttttttttttttttgagacggagt

SEQ ID NO: 134823 - DNA, 2794 bp, Homo sapiens
agtacatatcaggacagtctgctttgcaaaatgcctgatgtgtttgctgggttcatcctctgatgtgcacattgttactttggggttagtttaagtaatttgtaaattaatggtttagagctttccctggagcaaaatcagtaaatcacaaaagacagcaagtaccagccgcgtgtactgtggaagcagttcgtgttgttttcctctctgtgctctattccccaataggaacactgggcagtttgcatgctgtgacgttttcctctattttacctttttacagtgctcccaaatgtgtcagaagaaacagtgtctcccaccagagcacggaacatgaaggactttgaaaatgtaagtggaaataccaaattactgcccccaacaaattgtgtctgctgccactgtccagccagacccaggaaagctgtgtttcttgagatctaagttcggtgatgccagaggcaggggggtgccatgtctcatggacatcttctgtgagacttttacgtacaaatgcagtcagccctttatacaagggccaaatataggttctgacgggatcagcagttttcaactttgggtgaaacttttggttttcaactttggttttcaggtttggtgtctttctggtgtcctaaaggtgaggatgttcgcatgttgcacagttgaggggagctaacatttgtcaaaggccttactgttactataaggcatgttatttatggtcccctatttgatgctcactgcaacctttgagatattttgtatcattcccattttgcaggttaggaatcttaagactaggagagagttgtttatggtcatataatacataagtgtcagagttgggatttgaatccaggtttttattaattccaaagccattattctttccactgcattgtgcctccccttgcattttgaagactttatctttgctgttgaatgaaatgtgagtagcctgtacctagtactgtgtagtttctttctgagaatggattacttggtgatggatttggcttcaatgcttgatgtcttccagcattgtgtctttcatttattagcagagggggtttgttgtcaagtaacaggaaaataaggttattttcccaattccagttctctttaacaagttacctgttcagtgctctcatttatcatgggaagaattagacccttcttcatttgtaagcaaatgaaatccatactatgcaagacacaagagatacttaacagagagaagatggaggacacagagagaaggacattccacaattatgtttctttctccccagttgtctttacagaacagagcagtgctgtctctggatttaatttagaatgctcattactgctaatagttatctgcaaaccaccagtgaccaattgaagaaatgacttgtcagatctctaatggaaacaagtaatttctgagctttgggttgttataatttcagctgtacaactcgatctatgctgtggggtctggggcctcaaacgaatgagatttgattattctacatcgtgtataattaaaatatgctctactattaaatggttgttcctgttttatcataagagtaataacagctactgtttattgagctcttgctctgagctgggtactttaagtgctaagctctttgtatatgttactttaatattaaagcggctctgcaagatagttatttcatttttgaagggcactgttttacattttatttctaaattggaaaatttcacagaatattagaattttggtttcacatcttttatctgcttattgaactgaaaggaatcctagaattgaacacaaccctctttattatatataggagaaactgaggcccagggatgtgatgtgacaaaattgttctcagaggcagtctgtgctgcctaaggcccattggcttctggagccaggctgcttgtttgtccacttctcctgggtgccctgtggccggtcacttaacctctctgtacttccctcattttaacaatgggcatgataacagtacctacttcatagggttgttaggaggattgaatgagtgaatatttgcaaagcacagagtacattctatgtgtttgccatgactgcttcttccttttcttactgttattgttataattactgttatttttttccactctgccatgtgattcaagttccccttgttcagatgtgttcttgatgacctaaatcctgttttacttgaaggtgagggagagccttctatgccaacatgttttaggatttatgtttttttctttatgactgtagtcctttggttgctgttaggtttttatggcattaatattttttattgtagcattttcaagagcaaattctgcagccggaattgaaatggccacactgttcttgatgtctccctttcaggtctttatgaatcactgaaatttttcatttggcctgagttacaaaatgcatgatctgtatgtagtggtagtctgaactttctgtgggatgcttataggaaatgctcttggcacctaaagctaattttaagagcatgcatattaaggagggggctgagatactttgggtttaaagtggaaactcatgattcgtcctattctagtctcagatgattgatacctaaccatcaggagttgcatttagttgggagctggcaacacataggtcaccttctggttttcctcagagttcatccatttaataaacattttttaatatatgccactgtgccaggctctctgccagggggaatctgcagtggattaagaccaggtaagtccccctgtccagagg

SEQ ID NO: 134824 - DNA, 1286 bp, Homo sapiens
tttgaggattcctgagtggctgtattcatttccatctcccgcgtaaattaacggactagggcccgctttggccctcaacaaagatggcacccgccctcgcctctccctaagtgccctcacaaaaaatggcagccggcctttttttgtctcttatttttgcttggcttaagcacggatgctttgcccttagttaagatggcacctatccccgcttccctgcccgtcctctggcgccagccggtcggcttcactgcgtgcgcctccgtgaccccgcctcgtttccgtaggaagaagcgccgggaaagatggcggcgtctgtggtttgaattccagcggcgccgccagagtctgaacaagagctggggtggagggggcggggacctggggagcccggcgggtcgctatcgcggggggtactagtggcgccgccgccacagacaccaacgctgtcgccacctctgtagccatgatggacttggtgttggaagaggacgtcaccgtccctgggacgctcagcggctgcaggtgcggccggggcattggtggtcgtggtaaccgggccggggttccagctggtgggatttcgttctaacgcggccttggggtttgctcttgagggtgtctggccaggggcagtgtgtggggtgggttccttcggagagggtctctggggggcccaccacctgacactctggagggctgggagccgcgacctgcaccacaattgccagtagcattgcgccatgtactttgtagagcgtgtgaagaacaggtaaggagttttctgaaagagtaggacgagggtggggccacttggagtatcccgttagtggggattggtggagaacagggaccttgagggcacctgatggttccttctggtttgagagtttgttttcattatggagagagtgtagccggtatgcccagactttgctttttgggtcacatagtggccacccaggaggcaatggagtgcaatgattaagaaccttggctagagttggacaaaactggattcaaatccagccctgtaaactgactagctgtgtgaccttggtaaagtgatttcaccggctttcccatctgtaaaatgggctagtaatatccacccaacagagttggggtgaggattaaaagaggtgatgcctgtcgagccatttgcttggcaggtgtagtgcctgccacataatcagtgcttaaaaaatgatcttgtgttgccattagtgtcattattactactgtcatcaaaggtgatatgaatcagggaataatggccaagagtg

SEQ ID NO: 134825 - DNA, 1026 bp, Homo sapiens
atccctttataggagacccctaagttgttctcagggtttggagatgatgttctggagggagtacaagcaaataatctacttctggtaatctgagggtgctttgcgtatttggccattgctcagaagaatagaggttacattatattacattatatgaaaattatttagtttttctatagccctttgtagtttgcaaagcacttttccatatgtgtgtcctctcttccacaccatagccccctgaggaagtaattgttgtccccattttatagatgaaaaggctgaggcacagaggagctaaatatcttgttcaaggctatacaatgtgtgtgattattaggcttggaatcagggcctctaactctaaagcacatgttttttcaactatatgcagaaattgcctagccatggacacaagaaagctgggaggaagagttctacttgtggatgtttttaattttttttaaatatcaggagcaatccagggccatacagctatgaagcacttagtgaaaagaacacaagaagatttactaactgaagttagtattagtgattagaaaacaaaactgccagtttgtgcttcattaaggtgaactcatctctccaagcaggaagggaaaatttgctttccctagcagttgctgcatatgtgtgtacagactgcacaattctaagaaattgtgcaaaatggcatacctgtctttctcccagatacaccgccccctgccccccccaaaaaaggtcaggattaaaggtggtgagaagtgaacatttattaaacagaagttaaaccaatagagagaaaggaggtttgttggagtctaagaggattttgaccatgtagaaattccttgaaacagaccttaaaaggtattgaaaaattgaatcacaaagaaagtttacctttaaatacttgttaatggctcctagatcatggttataatttttctcaatgggaaaaaaagtcttaaaatttgttttaaataagatcctctaatgtctcgagctttttgattctggaaa

SEQ ID NO: 134826 - DNA, 1037 bp, Homo sapiens
attttgacagcatctgtagaaagtgccaatgtcacggccatgtggacccagttaaaactccaaagatttgtaagcccgagagtggtgagtgcatcaactgcctccataacaccactgggttttggtgtgagaactgcctagaaggttatgttcacgacctcgagggaaattgcatcaagaaaggtaaaacttcacctaagtgattgtaaatttaatatctaaaactagcagtgaaaaatggaaggctttgtaaaaccttctaaccctaccagaggagtttctggaaatagattttgatagatatttgcctaaagaggtttccttccattcctgctgctcttctgacactccacagtcaactccagaaatttgaggaccaagacaaagtcattgcgacagtgagacaaaatgttctcacatttttctcttcatctatttttatttttatgttaataatttaagaatcctatcatttcttttattctttgcttcctttattctcatcactttgagggatcatcaaaggtcttttgaagtagggacatctaatctggttagaagttccagctgagaagctggagttcattctagcatctgtcctaactttgggcctaagtttccccatgtacaatggaggaaataataatattccttttgaattttaaaagcaaaagttatccacatggcaaaatatttcttataggaaagctcagtaattaaaattaatgattatgaattcaggatgagttaggatattgagggtttattaggtcacagagagattggaccatgctgttctacaaaccactctttgatattcttaacatgctgaacacgaggctgatgaacagttggtctatggcaactgtcatctttctgccattttcttgatatctttatactgtagtgatcaaggcaaaaagattcagattgaaccctattactagctagagatcctgctactcagttctcttacctatttgggaggcacactttgtccatagttagctgacagaactgatgatttttcttattag

SEQ ID NO: 134827 - DNA, 1042 bp, Homo sapiens
cctcggcaagttaatgcaggaacagaaaaccaaataccacatgttctcacttataagtgggatctaaacattgagtacacatggacataaagatgggaacagtagacactggggactactagaagggggagggtgggcggggggtaaagggttgaaaaactacctattgggtactacctgggtgatgggatcattcatacaccagacctcagcaacacagtttactcatgtaaccaacctgcatatgtagcccctgaaaaaagtcgataaaagtctaaagaagaataataaaattttaaaaaagattaagtacatggaaaatattaaatggactgaaatgaaaataaatattgcgcttagaagtcatcaagagttaatgaagaaagcacacatagactttggagccagattatgcaatcattaaacaaagtttgcatgcctatcacatgccaggcactgtgctaggcactgggaatatagcagaggaaaaaacacataaaacccccctgattccacagaactgacattctagatgggaagagagataataaacaagaaaataaaatttatggtatattaaatagtaagaaatattacaatttcagatagtgtggctaggcaagatatgttgagaatatgacattagaataaggaacaaaaagaagtaatagagcatgccatgcggatcccctgtggaaaagtattgccaatagagagaacagcaagtagagtccctgatgcaggaagatgcctgatgtatttgagcaacagcaaagtcattgtggctgaagtggtataaattgggaacaggagttagggggtagtatgtaaagcaaaatatatacacagatatccagaataccattcttttgatttatctatattttccaaagtttttatacagaaacattggagagaggtaaagctatagtaatctagacagggtggtattggttcaggataaacaaatagataaaaaagaaagcccagaagtaaatcatatgtataaagacatttgatatatggcagaggaggtactaaa

SEQ ID NO: 134828 - DNA, 1051 bp, Homo sapiens
tggaagtttataaactggtatttggtggaagttttaacactggctcttataagagctaaaccccgtgtgaggaaagttgctgtaacaacatcatagcacctttgcttcaacttcaaaagaaaaaaaggctatggtaaaaagctttaataacagacaatgtgatttcataggcaaccaattagcagattaatggatcatttaactttctttacttaaaaccaatactccactcaagaaagatgaacccaaaatgcatcctctaacactgaccaacataactaagtacaaatgaagtcaatggtgtaccccattagcatgctgcgttgtatgtcaataaaacaagccctcccccaccccgagccctggcccctggcaaaacatagataaatgattgtgcactgcgtgatgataccattaggtgagaactttggttcatgcagtcggctgccgcagaggttgcacccaaaacccgcagccccggcacccaaagtcagtcagcggtggtggctcatggtgtcagccgtgctccttccacaacaccaggtgaatactgtggtcaggcatgctggtggcaaagaccaagcccgtgtcattgtgcccatccagtccattcagccaggatgcttcgcctgccaggaagcttgagcctctctttgatttcctgtactctggcagaggccagcgactaatcaggctctctgtccgcaagtccatgatgtacaggtagcggttgtcaaacagcagggcaaagatatctccaaagccaagcaaggccaagtttgctatctcaggagtcttgatgaccctacaaggatgagagttagggactgtgaaagaaggcaaccttgcttctgtttatgctactgtaatcttttctggagatatttaaaaccaatattaaattcaagcaaatttagagttaaatgtttttgataaaaagtaaaatataaggagaaaagctcagcccacttataaaaaagccgggagcgggagaggtgcgttcagtcattatataatattggcatggaagggaaaggtggtgtttgatcaa

SEQ ID NO: 134829 - DNA, 1050 bp, Homo sapiens
ccaagtgactaaagtgctactctactcagcaggcagcaaacaaatgggtttctctctaaaaacagtaaaggctgaaaatatttaaagtttcccaaataacttagaaacatttattaataatagattcataaaaagttattatgaaaaaaactagggaagaaacaactaggggaagcagagaaaagtagggagttgggaggacagccctaactttctcagaggcagtttccaagacatcaatgacaaaggctaggagacacctagctaaacagcagcacaaaggaaaacaaaaaacaacttagcttctgttgtctgcgcccttagtgaagcaaaagattaacaagaaaagctgatgtcctctttggaggaactaagagctgagctaccagacaagcagtagacaaatactgctctgtgacatatggtggggctcctgtgggaggagagtttagcctaggttttaaggacaccaccaaactagtataggttcaagagagcaaccagaatgggaggacctggagaccaggacaaggaagaacagctgaaggctatcagctgagatggggaaggaaagagttggcaggcatagggtaactgtatatgaggatcacttctgaatagtgaaagatgtgtaagagacagcccagacattataagctttagaagacagaactaggatcagaggcaaagagttacaaaggagccaatttcagtctcatatcaggaaggatgggggacattcaatatttatcaagcatttacatgtgcaaggcaccgaacttcataattaacatgttatcttttttaattatttttatttatttatttattgagatggagtctcgctctgtcaccaggctggagtgcagtggcgtgatctcggctcactgcaacttccacctcccggattcaagcgattctcgtgcctcagcctcccgagtagctgggattacagatgcccgccaccacgcccagctaatttttgtatttttagtagagatgaggttttaccatgttggcgagatggtctcgatctcaaccttgtgttcc

SEQ ID NO: 134830 - DNA, 1008 bp, Homo sapiens
ttgtatttttagtagagacagggtttcaccatgttggccaggctggtcttgaactcctgacctcaggtgatccacctgcctaggcctcccaaagtgctgggattacaggcgcgagccaccgtgcctggcccattattggatcttttatactgtcccgtgtgataggcattatcttcattgcaggagctggagttaagagagattaaataatttacccaagattgcacaggagaattaagacttgaacctgtgattcttggctataaaacctggggtctttccagtatacttcactttctatctgacttcacaaatgcagaccattttaaggacaagcttttctgtagtgatgtgatctctcatctttcctcattttcttttttctgtagatttggccaattgggagagaaatcaactgtaagtgcttaaagacattgtctgtctctgaggatagaagtatctgcctgcagccaagacttcattttgatggcaaatacattgtctgtagttcagcacttggtctctaccagtgggactttgccagttatgatattctcaggtaatgtttccttcgacctcacgctttacctttgaaagcctgctgcagttcagtagtaaagacaagactaaatgtttggatgtaccagtcagtagctggcttttaggaaatgtatactgtatcacttgtaaacagggttatatatactgaacatctcagacaggaaaaatattttagaggaagtaagcaaatgaaaaagagttacgtactggaacgtccgctgcctgactgtgagtcatgagccacttctttcagatttaacatgcttttctggaaaatgaggggcatggatgaaaagatctttcagatctccataagttctaatattttaagtcctatttcatattctgttgaaattctgcattgttttacaaacttggtaaactttagtggtatctagggatcaagtgaccttctgttgactagtagaaagacagagacttagagaa

SEQ ID NO: 134831 - DNA, 1104 bp, Homo sapiens
cgtggtggctcatgcctgtaattccagcattttgggaggtcaaggcaggcggatcacaaggtcaggagttcgagaccagcctggccaatatggtgaactcccatctctactaaaaatacaaaaattagctgggcctggtagcaggcgcctgtagtcccagctactcggtaggctgaggcaggagaatcacttgaacccagggggcggaggttgcagtgagccaatattgtgccactgcactccaacctgggcaacagagcgagactgtctcaaaaaaaaaccaacaacaaaaattaagaataagctgaacataaatttatgtgaatttctttttcatttacaaatccaagttaagaaactacacaggacatagagctagcaaatcatctcttcttccggtgggtttaaaatggcttggactaagacactccccctcctcttcctagaatgttcaccctttgccataccactttcattttcttatgttttccagtttttctttaatgaagcaaattaatggagaaaaaaactcaccttaatctcatatttgtctgcacttaagaggatgtagtctccaggactgtgcaagagagacttgactttgcacttctgcaaaactacctgcaaatgtaaaccatgttacggaaagatccttttaatgctgctcctataatgattttattctttaaattaaaatacaaaaatgagcttaacatatgctagaatagctaagccataactccattaccaaattaacctctactaaaagttttactacaatattctctgttattagcagtatctaaaagtgtctaacgttagccagatgaggtgggtcacgcctataatcccagtgactcggaaggctgaggtgggaggattgcttgagcccaggagttggaggatgcagtgagctatgattgcaccactgcactccaacctgggcaacagagcaagaccacaacgcttaaaaaaaaaaaaaaacagtctaaacattggcagcatttaatcttagcattcgtctagaagcaaacattaggactgattttttaaaattataaaatgtaacttaagagagggaacagaaaagaaaaaagcccgtag

SEQ ID NO: 134832 - DNA, 1045 bp, Homo sapiens
agattacaggcgtgagccaccgtgcccagctgctaattaaaaaaaattttttgtgtgtggagatgggggtcttgctgtgttgcccaggctggtcttgaactcctggcctcaagcagtcctccctcctcggcctctcaaagtgctgggattataggcatgagccactgtgcctagcccatgttaactttttacatggaaaagctatatagtgtaaggcagtttggtgttgtggaaaatagttgattggggctaggacactgacggtgatgtcttggacaagttactccaccttcaggacctgagctgtgtcatctgctaaatgttcctgtgaacacgaaatgaaatgttgggacagcacccagcaaggtgcctgatacttagtaataggtctgtttcagttgagtctgcaatccagacttctgaatgagtgaaccctgcttcccctctcaccttagcctgattgattgcaaaaatagctagaacctgatgtttatatacttatctcaagtgctaacagaatgttagcttttattttgttactactataatttacattgttactttatctttactgtaattaaatgaggtaagataataggtgcttgtctcctgttttaaagatcaagaaactgaccgagtttagatggtcttgtccaaggttgcaaagtcagcatatggcagattctggtcccaagtccagtgctttttcatttatgattcacatagttatgaaagcagatcatttgcatctacgtcagtgtctacgggcttttttcttttctgttccctctcttaagttacattttataattttaaaaaatcagtcctaatgtttgcttctagacgaatgctaagattaaatgctgccaatgtttagactgtttttttttttttttaagcgttgtggtcttgctctgttgcccaggttggagtgcagtggtgcaatcatagctcactgcatcctccaactcctgggctcaagcaatcctcccacctcagccttccgagtcactgggattataggcgtgacccacctcatctggct

SEQ ID NO: 134833 - DNA, 1031 bp, Homo sapiens
atcttggctcactgcaacctccgcctccccagcttcaagttaattcccctgtctcagcctcctgagtagctgggattacgcctggctgatttttgtactttcagtagcgacggagtttcaccatgttggccaggctggcctcgaactcctgggctcaggtgatccgcccgccttggcctcccaaagtgctgggattacacatgtaagcctctgtgcctggccctagactgtcttatagaacactgtactgttccttcacaaaacttaacacaatttgaaatgatatatttacccatgaaattgtttaataaaactatttctcctattagactatcatccacagggtaaggactgggtctattttgcttactcctgttttctcagccccctcatagaatgggatggtaaactcaagaaaagtgcttctgcgtggtatatccattattaatactgcatttgatcctcacaacaatcttgttttttttaaaaaagaaaacattacaatattttactaaagatcctgtacagttttctttgtcctacttcttgtaagcgttattttttcaaaatgaaaattgcttttctgattaagaaagaaacatgtttattctaaagggaaaaacacgcccacaatcccaccagaaatacccaccttcaacattttgatgcatgaacacattcagaaaccggtatcacactctacatatttttttgtatgtaatctgttttatttgccccctctatccacctaatatattgtgggcaactttccatgtccataagtcatttatttgttaaaccatgtattaagtaccttctacttgctggtcactgttgtgtaccattatgctttgtaggtacagcaattccatcttatgactcacctaacacttataaggcagtgtctaccatcctccacgccctccctcaaaaagcctgataagcaggagacttcttccaagtcttcctaccttggtgacccattccgtgtgcccggtgagtgtgttcaggcatgtcccagcagataaagc

SEQ ID NO: 134834 - DNA, 2176 bp, Homo sapiens
gctatttcccagcctcttgtgttgagcagctcccttcctttcccccatttacccactgctttagcctctgagaatcatagtctgtaatgtcaagcattacgtttatgagcagccttccaaaactcccttaacaggttgcgtccctctatttcccagtaacttgtattactgtagaccgctcatcatacaaatataatcttgcttccccaccagactaaactccataaggacagtgatcttatctgtcttgttcacccatgtgactggagttacttgcactgtacctggtgcttagtgattctttgaagtaaaactagccgttaggctaataaaaacacgtattttttgcttcattttatttgtcctcctatatactcttcttcagtctttgctgtctgctaccacttgttagaaattaatatttgaaggtgcatgtatgcatggaagtatatgttaaattgagtgttatgttccacaatgttaagatgtaccatgacttccaggtgattttattcctgatcaactttgagaaccctgctctaaaaatttttattactgttgcctagacattgctgaggtttttcttaacttcatacctttactattccctctgcttgcagtattcttttttctttccttgataaactctgctcatcctttagggcccatctccaatatcgcctcttccctgaagtcctccctgatacccctgggcagagttagtcattctccttgatgtttccctagcaagaggtaaacatttatttttttctgggcttcctcctccactccctacttagattgagttccttaaaggaagaatcagtgtcttcatctctgggtccctaatgttcctttagaactggtatacatttgaaaacaaatatttgagtacacactatacagcttacactgtttttggcgctggggatacagctgtgaagaaattcagacacttttgagttaatggcttaatctaacctttgagatccttgtttttgttttgttttttctctctttacattgggttttcttgagtctgggtgctgttttgcagcttccattctttatattttgtcttactgttagtgtgtatcagagtaggaccatgtacgttttgttttcctgcataaattagataaagtattgtgtagtgtcaggcaggcagtcctaagaaggaatgccattatctccaacatttgttttgcctctcactgtagctaccacaaataaaagagattgtattattcctaggactttccaccttagaataataagctataatagtaagaattttgaaatagttttatcagaaaattgctagttgaatagcatcattcttacggtgtctctggttgggaaattatataattggggaaaataaacattattgaactctattataaaagacccactgacagagacatgttttaactttgtgtaattatatgcactagtatttagcgtggactacaatgatgaactggatatcttggtgagcggctctgcagacttcactgtgaaagtatgggctttatctgctgggacatgcctgaacacactcaccgggcacacggaatgggtcaccaaggtaggaagacttggaagaagtctcctgcttatcaggctttttgagggagggcgtggaggatggtagacactgccttataagtgttaggtgagtcataagatggaattgctgtacctacaaagcataatggtacacaacagtgaccagcaagtagaaggtacttaatacatggtttaacaaataaatgacttatggacatggaaagttgcccacaatatattaggtggatagagggggcaaataaaacagattacatacaaaaaaatatgtagagtgtgataccggtttctgaatgtgttcatgcatcaaaatgttgaaggtgggtatttctggtgggattgtgggcgtgtttttccctttagaataaacatgtttctttcttaatcagaaaagcaattttcattttgaaaaaataacgcttacaagaagtaggacaaagaaaactgtacaggatctttagtaaaatattgtaatgttttcttttttaaaaaaaacaagattgttgtgaggatcaaatgcagtattaataatggatataccacgcagaagcacttttcttgagtttaccatcccattctatgaggg

SEQ ID NO: 134835 - DNA, 1515 bp, Homo sapiens
agtggttcttgactgaaggtagaattgtggctggctttagtcatttcagctttttaaaaactggtcatttggtgctttcctaggatactgtgccattatcatagtgactgtatttagtggattctcaaaaatgtctttttatttgttgaggcttattgaagggtcattgtaagaatgaattaatcattaggattttaaacttaaagcaaagtcctgaattgtcaccatgattagtatagaattttcatcagaggcagaaataaagccaacttttcccttcagaatcttaagaggctttacaaactttttgttgagttgtgaatatctggggataatttatcccaggttttccttgaggtttcttccttcacgtatttcaagatgactggagcaattagcagttagcttttgcagaagttagcccaggctctgaggtttgtccttgacttgccttagagtggaatatatttcagcaaacacctttactatttaacaatccttatttgttcagaactgttgggtaatggacaagcatgcaagtgtaaacatgcagtcatgtgtaatacctatttatttgaagtcaaatcagagagctcgtgatagccaaggatttatgaaatttttcaagtggaagcaccaagggatgcttttagtctaatgaccttctgtagcctgaaaagttaagggaaagtgtctcacccaaaaagcttggattctgtcctagtgcttttgactccgttttggtgactctaagcaagttgtgttactctctccgtgctttgatttcttcagtggtaaagtaaagtgctagaggaagggaccgttaatgttcttgaagaacaccatgattttgggattgattttccttctttagtgtgtttgttttcttattaacctccctgtttttctcttgaagggtcagatgacttgtctgcaaagctgtgggatgtgagcacagggcagtgcgtttatggcatccagacccacacttgtgcagcggtgaagtttgatgaacagaagcttgtgacaggctcctttgacaacactgtggcttgctgggaatggagttccggagccaggacccagcactttcgggggcacacgggggcgggtgggttgccctttttcaagggtttttacaacttagcctcatccttttaagccaggagccaagaatgtgaaatgcttttttttttttaatttaacctgcttttttcaaccctctttcttagtcattgcagttatttccctttattctagttactcttatttcgaatgttttacccagttttgctttttcttgctttcttctatgtgtgtacccttctggtgggaagggtagttttcattctctctctgtttctctctctctctctcattctctctctcccccctcctgtttcatttatatcctattgaacagacagtcccttggcttttatcagattccatacctctgaactgagtaaatcctacttgtgtaaattccactttatttgtagcattagggctgaa

SEQ ID NO: 134836 - DNA, 1039 bp, Homo sapiens
aactgcagttacttggagtggaagtaaatgggaaatattcactgaattctctaactacctggaaagttaatatctacaattctacattttaagattattctcttggtgggtctgtatgttaatgtgatttttattctgattaaattcatcaggtttgcatatttaaaattacgctgtgcagtggttgaaaatgatccaaagtattagtttaatttttctaacagcagcatccctggaactgtgaagagaggtatttgtgacagaattgtacatgtgtttgtgtcatcttgttacttaagagattgaattctcattgtggtggaattgggaaaccctgaatttggcaataaacttagtgactctcacattagtgccttgagtaagcaatagacagttttattgaagagattaatggctaatgacattgaggtagttatctttctctttcgcaatttatttctgaaatggtaagaaaggaatctattatgctttgtgctgttcagtagatatttacttatgggatgcctactgtttgaaaaacaatgtgagggcatacacggatgaattagagcagttttttcttgtggaacatacacactgggaccaggaagatgacctgactgaggtaaaagtctctgtgtggactatagcaaatcaagaacacttgcctttctaaagagtgcagctggtgctccattgtaataaattattgccatgtgggtgggattcagggtcagagttgttagatctgacttcaagagaagcctgaaatctagagttctgtgcaatagtctgattttttttaaagtattattaagatttttaagatactgaatggggagggatttttttctttcgtgcagtgtgagagtccacatttctttagtcctctttcacctctatgctgcatcactggtgacctctttgaaaacatgttgggttagccagtgcagcaaatgggagtccagaggggaggctgacataaagccagaaaggagcagagaacagtgattcctaaaggattctcaggagtagactt

SEQ ID NO: 134837 - DNA, 1858 bp, Homo sapiens
aatataggcaaatcacataccttctctaacctgtagtttcctcatttgcaaagtgaagatgataatgtctattttctggtgttttataaacatcaggattattaatttgctttatttgtgcaggcctccaggacccctcatggctctcgggggcacgtggttaagagttgtcactagctcatatgaggtttagaaaaacagactaaagccacataagttcttttataattcatgttctaaacaggcagtgccataaagaagttggaagaaccagaattcctgaggcagataacttaccacacctgcttttcttccctaaaccttttcatctgaacatctgttgcaaaaccaagtagtcagttctatgattttggtgacaggttgtgcctgccatgacaatcagtgtctcaggttactgctcaggagactgtttctgattgtcacatcctggtgcttgcttttgtgattttagtacccaaatagaatgtattaaggaattcattaaggaaattgttttataatggttttgatgggggaagggtgtattgtaaaatatactgttttataatgaattgttggtaaatctattactatgaagatgcatgtagcacgtgctagacttcaagaggaataagtcacacacgccagtctgtttcactgacatgttttggattcatgatttgttaaagtatgttttctcaaatgtgttttcttttgtgtgcatggaaagtgttcagataaatatggtgtattaactgtaaagttgtaatgtaactacgcataaagttgtaatggcagattttttacactaatttttaatacttcatttgttagcagtcttgcttgaacagtctttttgagcagaactaatacaatattttgatgtgccacaggtaaatttttccataaccttatggagagaaaggactttgagacatggcttgataacatttctgttacatttctttctctgacggacttgcagaaaaatgaaactctggatcacctgattagtctgagtggggcagtccagctcaggcatctctccaataacctagagactctcctcaagcgggacttcctcaaactccttcccctggagctcagtttttatttgttaaaatggctcgatcctcagactttactcacatgctgcctcgtctctaaacagtggaataaggtgataagtgcctgtacagaggtgtggcagactgcatgtaaaaatttgggctggcagatagatgattctgttcaggacgctttgcactggaagaaggtttatttgaaggctattttgagaatgaagcaactggaggaccatgaagcctttgaaacctcgtcattaattggacacagtgccagagtgtatgcactttactacaaagatggacttctctgtacaggtaagagatgttgaaactgctttttgggttttgttttgtatttcatagggtgtaatcttgaaccagtcttgagctttgagaatgacaagtgttgattatatgagatatgtacagtgactttttttctctaatcctgagtggttccccccccttatcctcttccttctctctagagaacacaatcatttttataaaattttatgagaaaaacacttcagactgtcttttaaacattatgtgaattacaaagctatagattactttttctttgtgtttcctccatgtgtagtcctctgttgctaaattctgtttctttttctgttggcactgatatttgaggaaaaaaacagtggaaaaattggtatctaatcctagcaagtagttagatcattatggccaaattacttaacctctctgtatctttaaaatatgggaaaggaggtcgggcgcagtgg

SEQ ID NO: 134838 - DNA, 2176 bp, Homo sapiens
gccacagctccctctcctccgtaaaatgaggataataagaaaaactactgcagagctggtgcaagatcagattggaggagggacataagcgcgctgtgcaaacctggatgtacggtacgaaaggaacctccgttctaggttgcacccagcctaagcaccgtgagggccgcgcggcacgcgttcagcttcccgggacgctcttctccccacccctactcccggcctccagcctcccaccacccacctccgggcggggaccggaagtgcagccgcttccgccgggagccgcggagctgagggacgcgcggagatgacgcaggcagcaccggaagccgctcccctgtgaggctgcggaccgggagcagcggccgcaggtccgggtctgtatgcgaggcggggccggtcggggaggggactcttaggcgcccgcggctctgctgacccgccgcgccttggctgtttttctttccctgcaggcgccatggctgcggagcggacccggccgctgcaaggctctggcggtccgagcgtgcctagtagctgtgaacccggcgcgaggtcccgggccccggggcgctcgctcaggtcagtgccgcgcggaacacgattccgagagcaagggacctgggagcaacgaatgggttgatgggatctggattttagagacgggaaaacagggttttggagttactgcctcctactgcctccatttccttagctgcgaaatgagttaacagtgatgtcccagggctaccaaacgtttgaaagacgatgaagtgtgatgaggtggtttatgaagtacaaagcgctatactgcgccataattgtgggtatgccatgaaaacaggtgtgtatgtggggtgctgcttgaagtaaagcaaagataacaatattaatgctaagtaataatggtaactgacatttactgtaggcttacagcgtgccgagtactgtgctaaacgctttacttgcactgtcttgtttaaccctcataaaaacccttgtaggtaatgctcttggctgtattttacaagtgaggaaacagggcatgagacaggtgaagtgatttgcccaaggtcacccagcaacaagtggagttgcagaacacatattttataaacattatttgtattctttcaaagctttaaaaaaattcaccttaaaactaaaggctattttttgatagtatattatacttaacatggttttcagttttaaaaggtatacaataaaaagggacccctcattcctattctgcagctctccagttctctctggaggcaaccagggttatcagtttcttgaatattcagaatacattttatgcatatgtaagtttataggtgtgtatacattttcagcgcctctgtgctctttgtttgataagaaaagggggaaatgaagcctccttccctctaccactaacaattatgttgctttcactcttgactaggccaggttctgatagaggaggaggggaaaacacatttacactgttttccagaaggtcctgtctctaatacctctgagtataggttttgggagaatgggtactgggcaaaatattgagcctgctacttcctgtgccattctgggaaggccactccacttcttgagccgtaaatttcctcattaatgttagttaagggcggcattactgataccttccatgaggttatgaagatgaaatgagataatgtttaccagtggtactttttctttaaaaccaatataaatatgtgagttgcctaggtaacatagggagttaatggcagaacctgagaccaaacccaggctctcattttccaatttaggagtctttttgttgcatgacccactttgtgattattgatactgaaggcaagagggcaagttgaatgttaactctggggtagggacgtagggtaagggggccaaacagcagggaatgtgggtagaataaggcacctactgggaaactagagcctccaataaacaggtgctcttctttataaaattaaacccctagtaagtttgagcccttgagtttttcttccaggtattttgaagagaaacttagtgataagatgatagggtcaaaagagatgttagtggtcatgtccattccacccttagtgtcacagaaatctttactgccaggtgttcatagtagtaaaactaacaaaaagtaccattt

SEQ ID NO: 134839 - DNA, 1049 bp, Homo sapiens
atgtttggatgcaatttcatctcttctgtacttaccagtaagtaggtagggaaataatgaaggacagtgggatatgtttgggagaataaatctgtatgaatcaacatgataaatgtgatgaagtaaatacaagaagataaccctcattatatgactagtgacatttttaatttaaaatggaatcatagagtgttagaactgaagagactctagagactgcttaatcaaccacattcaaagaaaactgggaaaggtctgggctggatttgagaaagagtcctccagacttagccagtttcacacaacaaattaatgacagagtgccatcagcactcaggtgtctgacttctaaataagtgcttttctccagatcagttaacttttgatgagattttccttttctttcctgtagcctgagcagcagactgatgaccttctgaggatgacagaatcctggttttcttctttatctcgggatccactggagctcttccgtggcattagtagtcagcccttccctgaactacactgtgctgccttaaaagtgtttacggtaggtattcacttccataggtccttctgggaccctgccagctcaacacttgagtacttaacagtgagccagagcctgtgccatctctggggatgcacaagtgcatagtatagtttctaccttctgctaccttagagactaagtaaggagacagatgtgtaaacagattgtttcagtaaaagatattaggtgctgtttgaggtttgaacaggatgctatgggatcacacagttaattccagactttttatctgccatcctctattaacctagccctggtcttcctaatccttatttcccgtgcagaaaataaggcttctggcacctaatgctccagtggtaccaaactgtttgttttgtgtctctggacctttgctggggtctccgtatctaacactcttccttaactttgcttcttaacctcttactcactcgtcaaggactaactccttgtcttcagcacactttgcccagattgacaaggttgagttaaacaa

SEQ ID NO: 134840 - DNA, 1029 bp, Homo sapiens
agaatgaataaataaattcaataaagctgcaggatacaaaatcagtgcataaaaatccgtagcatttctatacactaacagtgaactctgaaaaagtaatcaaagatacattcccatttacaatagcattcaaaaaaaattaaatatttatgaataaatttaaggaggtgaaagatctgtacactgaaaactataaaaactgatgaaggaaattgaagaagacacaaataaatggaaaggtatcctatgttcatggattggaaggattaatattattaaaatgttcatgctgcccaaagcactatatagattcagtgcattccctccaaaatttttaaatttaatgacatttttcacgaaagcagaaaaaataatttttaaatatacatatttcagaatacattgttcacaataaagatatatgattttttgtcagttaaaagttaatttttttaaaaagatacctatagcctcttattgaggtggaatctgttgctcttggagctacgtactgttgactttggttttctggaaacatcagtgctatttagaacattaggatatttttctttttgaatatcaacaaaaacataaataaaaatactagtaatgacatttacagtatgtttcacagattaatcacatctctgagtgggagtctttatctgttgtaggatctactcttgccattctattctgggttttggttgattagtctttcttgaacacttccagaaattggagatgtatgcctgccttaggtagcctagcttattttattaatgaacatatccatttaaaaatttcttcctggtaatgagtctaaacttgccttcctgtaatttgtatccactggtcctttttctttgttctccctcttgcatatgccagtacttcaatagctggtcccagctccattgacgccctctctcaggatcacacatcacaggtccttcagaatctcctaatggtctctctgatctccaggcaacacactactctaacctttctatgcttttctggcctgca

SEQ ID NO: 134841 - DNA, 1040 bp, Homo sapiens
gttatctttgtgtatataggttttgatttttcttatcttaaatgattttctgattgtcctgtgttctttaaacatggctgaatttattaaacccatatgagtaaatcagtcactagttacattgcttcagtgcatttgagtgtctcaacctaatgagacaattaattttgttaattattttttagcattgtatcaaattttgtgacatagaaaaaaacctgtaaatggtcagtcaaaacagtttaggatcaaccaccaactaaataaattttttagttattttctttgatcatggttggatatgagatgataccaaagaattattgttaatttcttaatatgtggcagtggcattataattgtgtaaggaaacatatgtgttttgtagagatgcatactaaagtatgcaggggtaaatggcagggtgactaggatttgctttaaaatagttcagcaaaaagtagggaaaagagatgaaataagtaaagcaaaatcttcataaccataaaatcaggttatgtgtatatgggggcttattgtattctcattacttttgtgtatgatatttcaaaataaaacacaaatttagaaaatattttaggaagcagctaggttatagtggaaacaatagtggacttcaaatcagaaggtcaagatttaaatctaaactctgcctataataacaatatgattacagagaagtcactgcaaatttctaggccttagggcttcatgtgaaaagaggagccaagattattgacctttcgaatgtgataagaagaattaaataagataacctgtatgagagcaatttataaactatgcaaatcctgtgcaaaatctccttgtttttgtccttctgacattttagagccacctgtatagaaatggtgacatcactggcatatactcatcatgggcgacaatatcttgctcaagaaggagtaattgaccaaatttctaatataattgttggggcagattcagaccctttctctagcttctatctgccaggtaaggaacactgatgcctatggaaa

SEQ ID NO: 134842 - DNA, 1006 bp, Homo sapiens
agggcaggagttcaagacaagcctggccaacatagcaaaaccccatcgctactaaaaatacaaaacaattagccaggtgtggtggtgcatgcctgtaatcccagctactggggaggctgaggcacgagaatcgcttgaactcaagaggcagaggttgcagtgagctgagatcacgccactgcactccagcctaggtgacagagtgagactctgtctcaaaaataataataataataatctgtgccaaagtaatttcttatgcgttcactgaagtttttctacttaaagagacaaataatggattttttaaaactcatttataaaaagtacctagtcctacatttaacttaaaatgagatctatcaggcgtagggctgatttgacctttttcttttttctgtgtttttttttttatttcagctaattatagagatttcttccgtgtcaccagaatctttaaactactgtaccacaagtggattggtaacccagctcctgagagagctgactggtgaggatgtgttggtcaggtgtgttgactgagttcttaaagtgaaatatcctcttttgaagggctgggaaacaaccttgggacatctgtgattttctctattagagactttgcccaggttgcaatctcatgactgatgtgtgtcctgaaggagggatctttagaaaattgttcaagttacatcgtgacaacatactggaacttgggaaagccccacatgacaattcagctactttcaagtgactctgttccatgtccctaggcctgtgtgctcttaaaaagttgcaatcatgtggtaactgccattttgaattactaatattttatcatattcatttattttggcattgttaaatagcaacactatggcatgatagaaaaaacatgggctaggccgggtgcggtggctcacgcctgtaatcccagcactttgggaggctgaggtgggcgattcatgaggtcaggagttcaagaccagcctggccaacatagtga

SEQ ID NO: 134843 - DNA, 1004 bp, Homo sapiens
atatatatatatatttacagtgcaatataattactatgatagagaagatattgaaaccagacttgaaaaaatttgtagtagtaataagaaatggcccttatttgtaccagctttgtactaagcactatgctaaaatactcacatatattatctttaattcttacagtaaactttgtatgttgttatcattaacctcatattgatggagcaattgatccaagaccacacagttaatagggtgcatgtttgaaatagaatcctctatagtctaattccatcttcagaacactttcttactttgcatgtcatgataccatactatgctgcttttccttctacctctcagtttcttctcagcctcctggctcattatcctccgttgaatctttaattgttggagttgatgaaaacagagttccaagccctgctttcacggtactctactcattcctaggcagttttactcacttatgatttcacttcccatcagtgatgatgcctctcagatgtaaacttccaactgagacctttcttctgagctcgaaccttcatgctcaactgcttactcactcttggccccttgggtatattctaggccactcaaactcatgctgaaatcaaattcctgatcttccttatccaccctatccccctaataaaaaataagacaacaaactggctgtgtctcacagtctgcttagttgggtattagaccttggctcattctgaggcctgttttccttgccacatatccattcggtcatcatattttgttgattttatttaaacccctgcatttctcttcattagtacagcttctaccaccctagactaacttactggtgtcactcacctgggctactatatttgcatccaaactggtctccactcatccatttttatcatccctagtctatcttctcatgcagtcagaatggtcttttaaaagtccaaatctgattgtgtcatttctctgcttaaaacccttcagtgtcttcctatat

SEQ ID NO: 134844 - DNA, 1601 bp, Homo sapiens
gcaacagagcgagactctgtctcaaaaaaaaaaaaaaaaaaaaaaggccaggtgcggtggcccaagcctgtaatcccagcattttgggaggccgaggcaggtggatcacctgaggtcaggagttcgagaccagcctggccaacatggtgaaacctcgtctctaaaaatacaaaaattatcccagcatggtggcaggcccctgtaatcccagctactcgggaggctgaggcaggagaattgcttgaacctgggaggtggaggttgcagtgagccaagatcaggccattgcactccagcctgggcgacagagcaaaactccacctcaaaaaaaaaaaaaaaaaaaaaaaagaagactagagtgcatatcttattcttctctgttgccccagcacaggcaatgcgcataataggtacttagcaaatgtttagtaggtgagtgaaagctgctgtttcaaaaagaagtctgtgtggaggagacgctgacgcaagcttcagctattattaggttgttacttcctacctgggcaggatatgaactaataagatttatgatgtctccttcagggaaaagactactttgtgtgtatccattctggagagattgctccaagctatggaaccggttcacgtggcccggaacctcagggttgacctgcagaggggactaattcaccctgatgattctgtaaaaatcctcactctttcccaggtatgaaattctactaggaaccgacattgaccacctgctctgggccaggttctgcactgggacagaaagatgaagaaagcacagtatttctctctctccttccctcttccttctccccctctcctctgctccctctttccccctaggaaatgtgtggtctattccaatgtgcatagctaactataacctgggagatacaagctaaagaaagaagttccattaagtaccatctaaatcattcattaatcagatactgactgagttccttttacatgccaggcatggtgccatatgctgttagagttaccaagataaacaaaactgattactttccttcaaggagctcctagtgtaaagaaaaagattcctatgtgttcaaatagctctctgccattttagattctttacactggatgaaccaaatgctattgtaaaggtcactaaaccaacaattaagacagtaactcttatcatcctggtaaccaaagcatccttgctatttgagtgaagagctgctgctaaggattatcttgttgaaatgttaggagctaaacagttactcagtagatactgaactactgtttttccttttctgtgtttattcagcaaaaaagggcgctgggcacagtggctcacgcctgtaatcccagcactttgggaagccaaggcaggcggatcacctgaggtcaggagttcaagaccagcctggccaacatggtgaaaccctgtctctacacaaatacagaaattagctgggcatgatggcaggtgcctgtaatcccagctactcaggagcctgaggtgggagaatcgtttgaacccaggaggcagaggttgtagtgagctgagatcgcgccactgcactccagcctgggcgaaagagtgagactcc

SEQ ID NO: 134845 - DNA, 1852 bp, Homo sapiens
tgaaaagattatgaaccactgaatcaacagtggatgatttcagagcgctttcttggctctgaccttctaagattccttccttttctgtaagtgttctccattcatgatgtctatcagttaacattatttgggtctgcctatgaaatgtctcttatttgtctcctctttaattcaagccctcattttttccctattgctaggtctgtagtgttagtctgacttctccttacctctgaaattccttttctagcaaattccttttctagcaaattccttcccaccttgtaaccccagtgagcatacatctcgagtcagctggtgctaatcttttccgtggtttcccattgcctgtagtgagtttttagaatgccatttgggccctttacagtatatttccatcctacttttccaacctcacttttttcctccactccacttcttttcatctgctccagctaccatgtggcacccttatttttccttaagcctgacttgcactttcctaactttactcataccagcctttctaactgaaatactttgctgtctgtccatattctgtccatccttttaggcccactaaagagccatctcctccaaaatatttttctcaattattccagttgcaaatgactgctccttagatctgctaaaggacattattgttatttctgttaatgataattgacactattacctatgttatagttctctgtgtgtctatttccagtttgtaaattctttgaaggcagtgaccgcattttgttcatgtctgcatccctcttagggcccagcacataatgcagtatacgcccaattaaatttgagactcacagagtttagagtggccaccttgtccaacctctcctattagagatgaagagacttccagaggtcataccgcaagttgacagcagagatgcagtaggaactgaagtgaggcagaatttgaggattcaggtccatggggaagatagtttgctgaatgaaggagcagtgctttagggaacaattttaatggaatttaaagacagaataattcagaactggatacatagtagataccaactgcaccttgtgggaataattctctggatagtatctggcagtcttcagatactttgctgttatcctggctaaaccacataagttgttgtgtgttggttcacaatctgatcttgcagatgtaagttagaatcttgacagttttttttgagagagtttaagtcctaagattactgctttagaacatgaaaatcaaacaagactaattttaagcattaactctttggctcgttggcaaagaagggtcacataggatctgaaatttgtgcactgtgcagtttaacgtaccactacttttttttaaacagctttcaaaggtataatttatatacaatgaactgcacttaataaaacgtacaagttggcaagttttgacatatgtatatacccatgaaaccatcgccacaattaagatagtgaatgtatctttcactcccagaggctccctcataccccttgctaatctctccctgtttcaaccagtcaaccactgatctgctttctctcactgtagatgaacttgccctttattttggccagacatggggggaagggatcatacaaatggagtcatacattatgtattcttttgtttggtttccttcacatagcatagttattttgagatttatctatgtggcatgaataaatagttcattcctttttattgttgagtgtaagtccattgtatgaatgtactacagttttttatccattcccctgttggtgaacatttgagatttgaattgttttctgtttggagatattacaaatgacagtgccgtga

SEQ ID NO: 134846 - DNA, 1414 bp, Homo sapiens
aaaccttcccgagatgtggctggttgggatgacagaaaaagaagcactgaatgccaaggcgatcagtccaaaagcgtttagggggaaacctgcagagggctgcagaaattgtcaagacggacaccgggagaaaggtgttcctgggtatgtccgcagtgagggggtcagggtatggagttcagatgagagtttaaaggaatttggctcagggttgaggccagtttcttccagtgttttgggcaacaacctaggtacctttatcaggcctgtgaatgttcaaggcccctggtttatggtcaagcctgctagggaaacctgccgctggctaggtcagagagcaatcaaggcactctgattttccatcaggacagagaaagaaagggggcgactggaggaccctacaacattatatgcaagaatataacatatcgtgtgtggcaccagaacactagaaacaatctaaatatccgttaacagaggattccaaattatgcgctattactctgtaacactgtgcagttatttaagttattgaggtagatgtatatatatgtatgtggacatggaaagatctctgtgttttgttttgttttgttttgtttgtttgtttgttttcagacgagtctcgctctgtctcccaggttggagtgcagtggcgcgatctcggctcactgcaacctccgcctccctgattcacgccattctcctgcctcagcctgccgagtacctgggactacaggcgcccgccaccacgcccggctaattttttgtatttttagtagagacggggtttcaccatgttagccaggatggtctcgatctacggacctcgtgatccgcccgcctcggcctcccaaagtgctgggattacaggcgtgagccactgcgcccggccaatctctgtgttgttgaatgaaaaagaaaatcgcagggtatatcaatctataattttaacctgtaatttttaaaaaggattacaatcttcccaacccccacaggcatgtaaaacttgtataacattgcaaatatctgcaaaggtacaccagaaactattaatagggaagtgggtctgaaaatagtaggacaacttttatttttgattttttacacatccgtagtgtttgattaaaaacactttgtaggcccggtgcagtggctcacgcctgtattcccaacactttgggaggctgaggcgggcagatcaccaggtcaagagatcgagaccatcctggccaacatggtgaaactccgtctctactaaaaatacaaaagttaggccaggcacggtggctcacgcctgtaatcccagcactttgggaggccgaggcgggtggatcacaaggtcaagagttcgagaccaacccggccaacatagtgaaaccctgtctctactaaaaatacaaaaattagccgg

SEQ ID NO: 134847 - DNA, 1930 bp, Homo sapiens
gggcctccactgggatgaaggatgcatgttaggggaacctgcgggccaggttggcaggaacttgctgggccgggccaccagcaggctcacggtcttgcccctctcagtgccagctcaggccagaccttcttctcagatgtcgactccaccgacgctgccagcacctctggctctgcctccaccagcctctcctatgactccaggtgagcttcctagaggtctggccttcacattttgcaaggaccatcattcctctcagcccctccacctcccacttctgtaatgtgtggctcattctatgtgtctcagtctctggcggggagtacctggccttctgcaattgtgagtctggctctcggaccctctggttctgagtcacggggctttagatgggacctaagtataggcattcagcctcccgtggttccatccctttggaatgcttcacctgctgcagaagcttgtacacacctctcactggacgattccagttctggggttgttggaccagagtttctttcacttttggcctccacgtgccatgagcttgggtgtctctctgcctcttggactacagagttccctgaccttgattcttggctgtctgaatatggtgcctgtcttccggggtctctaagggaaagagccgtttatttagaagcctgacagaagatggcatcctgcagggtggaagatttaggagtggggacagaaatccctgggggcctatctccagtacaactggtctggcaacagctggtcctcagcagtacggggagtggtcgagcacagggctttcctctgcactcaagctgcactgtattttaagatacttgaggcccttgcaaaagtagaattaaaagtataatgcctggccaggcacggtggctcatgcctgtcatcctagcactttgggaggccaaggtgggcagattacctgaggtcagtagttcaagagcagcctggccaacatggtgaaaccccgcctctactaaaaatacaaaaaaaattagctgggtgacagagtaggactccatctcaaaaaaaaaaaaaaaaaaaaaggacaatggtataatgcctgtagaggtctgtcttggagtctgtgtctcttgacatctgtctaggtgtcctctgctgttgcctgttttttctttcttcctgtttgttggttggtttgagacagtctcactctgttgcccaaattagagtgcagtggcatgatctcagctcactgcaacctccgcctgccaggctcaagtgattctcatgcctcagcctccggagtagctgggactacaggcgtgcaccaccatgcctggcctatttcttcctgtttctttggtttcaccagcacttcaggtcttggtttctgtctctaagcatctgaatctgtgccttgtcctgtgtgtctgtgtgtccatttctctaacacccgtgtgtgtgtgtgtgtgtgtgtgtgtgtgtgtgtgtgtgtgtgtgtgatgtctgtcagtctctccatccaggctctagggtacagggtccttcagtccctaacccccagccctatgtgacctatcttgttccaccagtctggtgagaggcaaggtgggataagcagggcctctgcactgcatggcctcaggaggctcagagaatggtgctcttgtgcttttgcagtgccgggatcctagctctaagagcatatgctttggagttggacgttcttacgtttgaatcctggctctgccactccctacctggttttctcctctggaccctcagtttccctcctcgcagggctcttgtgaggatctggtgagataatctatgcccaaggcatagattatctcagggactacataacaggcacctttgagagagcatgggagaagatggataagagaatgctgttcagcgcttttctcttccactttcctggtactgaggg

SEQ ID NO: 134848 - DNA, 1035 bp, Homo sapiens
cggcatcctagcgcgctggctgcaaaagaggcgggaaacgcctccgcgtcccttccaacagtaccggagagggagaggggcgtggctgagactagccccgaccacgcgcgcgcggcccctcggcaaccggcacaacacaacaaaatggctgccgcgccgctgggcccctgaggaaagagcccgaacttctcccgctctacctcagcctgcgggactgctcggctcggcttctaggcggtgagcgtcagacctggccgagcccgttccccggcatccggcccgagcagtgggggccggcggcaaaggcgggaaggcccggaccgggcgtggtgtgggccggcttgggatggattcggggcgggggcgcgtgtctgggaattgggattggacgggaaagaggggagggcccggaacgggcgtggggcggtggatgaaggagggaggtttggatgggaagaggtggggacggcgggggcgattggggatgaagaaccagagtgtggggaggtgtggaagttagggtgcggcgcccagaaggttgtgggtcctgccacctgagctgaggggagagctgggatgtgccagctgtctgtggggagtgagcgggagaaaggacagtttgggcgtcctgacgggttgtcacggtatcggacggagtacagtgcgtggagaaagatgacaggatatggggacgaaatgctaaaagaaggggaagaacaaacacttccgttatattcgttaagggactagagaattttgaagccagacaaacttgggttgaagcctcaattctgccaccttgtgtaacttaaccaggtctgtgaccctggatatgtgtctgagccttcctgatcatgtttcctcatttgtccaaataattgcgaatcatttttgggtgttcactatttgtcagatccagttttaagcactttgcacgtattaacctcatttagaatttaaaataacttgtatgaggttatcatccccatttaaaaagtgatagcactgaggaccagagaggttaagtaatttgcc

SEQ ID NO: 134849 - DNA, 1099 bp, Homo sapiens
ccatcagcttggagtagtatgggtcctagcatttatggcctctgagtttataactttatagacctgaaggttctagaaagaatagttttgataactcttaaaaattaatcttgttgaatatactgaaaactcttacaggttttgatgaacacctggctttattcttgcaatgaagaaaggttctcaacaaaaaatattctccaaagcaaagataccatcatcatctcactctcctatcccatcatctatgtccaatatgagatctaggtcactttcacctttgattggatcagagactctaccttttcattctggaggacagtggtgtgagcaagttgagattgcagatgaaaacaatatgcttttggactatcaagaccataaaggtatcactttttaatctaagaattggtctgaccacatacttcaagtagagatggaaaattttcggcttgcatttttggtccaactgtaacattctggtactaatttgatctattgtttttattaacagaaattaaggactgtaaggacagttggaggattgaggtttctgggtgagggtaaagatgtcagtggattcaaagagggagttttcagaaagaggaagctttgtttcctgtggtaggagagtgtcttaaaactcatcccaaaacttgccatcctctttggttaaggggagggaagatctgttcacttcagagtggagcgccttaattcagtaaaaaaacgttatacatacttggcctatgccagtcttcttattagcaaactgcttatctgtgaatggactgatttccacatatgggacatgtatgtatgttccactagtgttttagttttttcttaaaatcatctgttagtctaggaatctgttctcaaaagtgcattgttgggggtatagcttagtggtagagcatttaacttcaaaagtaagttattctttggtaagtcatgaaataatagccattaaactctaatcaggttttattagcattaacaacactgagtttatactatatctttgctgcaagttggcatattgttatttctaatttgattaatattttagaatgttatcaaatttagaatattaatc

SEQ ID NO: 134850 - DNA, 1027 bp, Homo sapiens
agcaaatgattttttttagtaagtgatgatattaataatttctatctcaaaggtttgttgtataaattaaattttaaaaatgtaaaccacttagcccaaagcttggcacacaccaaatatttatagtgtgtataaccattatcatctttgtatcattatagttactacattacaatacgttatagtattacaatacattaattgtaatatacaatacattatagttattacattataatacattatagtattacaatcattacatcattatttcattataattatgaaatgctatgaagtaaaatattattaaaacattatgattagaaatagccagcttttttggtatattcatggcttaatttttgtttttgttacataacatcaaaacaacttgttctttgtgatattcatgtctttcctctactgatgatgatctgtttctataatttcaggagctgattcacatgcaggagttagatatattacagaggccctcattaaaaaacttactaaacaggataatttggctttgataaaatctctgaacctttcactttctaaagacggtggcaagaaatttaaggtaggttaccaacaatttctgagcatagatactgtttttaacttttctgtgctttaatactgcgaaaaaaaattatcctaatgtcacctaatttgtggcagaccttttattgtttccagtgaatgttctaaatcagaagtatatgacatttccaaattaataagtttctattactcaatattcttacaacattgactctgtagagaaggggttggcaaagtacagcttacaggccagatcaggccagctatctatttttgtaagtaaagttttattggaacacagtcacccttatttgtttacatattgtctgtggttgtttttgcactacagtagcagagcttagtagttgccacagactatatggcccgcaaagccaaaaacatttactatttggcctttgtattcgttcattttcatgctgctgataaagacataccc

SEQ ID NO: 134851 - DNA, 2661 bp, Homo sapiens
ctcccaagataatggcattaattcattcctgagggcagaaccctcataacctaatcaccacatgaaggtctcgcctctcagaactgtcacaatggcagttaaattcaacatgagctttggaggggacactaaaaccatagcactatcttttggaagaaaggaggggaatgagagggagaggtatggcaaaagtgaggtagagggaatgacagtgagggaaatcttgttggatagtcttgagcttcttagtatatagacaatgttgttgtcaactgaagggcaaagagagtttggtagcttgagtagagttattactcctagtcaaggagagctgcatcaagggattctccaggagagcagtaagggtatattattttctgatgactgatcaaacagaccctgatgcacataagtaaatgttgtactttatgtcaagtcatctgttgtgtaaagtattcattcatttgtttccaattagtatattgagaatttggaaaaatgtgttaaacttgaagtactgaatctcagctataatctaatagggaagattgaaaagttggacaagctgttaaaattacgtgaactcaacttatcatataacaaaatcaggtgagttatataacaaaatctttaggcagcattgcagatagctttgttagagaggtagattaatgttatccacattactgaaagaatgatttgacagaaacagaagatatttttatctttattcatcaatcaaatgaatgtctgtctcttcacatatggtaggtaactgtctttatgttttggcattactgaagtacagaataacatctagcattatcaaagagatatatttttgagcaccaaattgtatcttaatttcatttctgacaggaagttttcccagatattgtctgtgatttattaccttattacattaagaatgttgacatgaagcagaatgttttaaccctgccattttgacccccaagatgttctaatctgttttgattctgatgttctttgcttattgctacaagaaatatgctctcaatcctgtttccaattcataatatatattactgtgagaaataaacatactaaaactgacactggctaaaacttcatatagaaaacttgttatagacaaaatgatacaagaatcaaatcttgaaattcttaatatctgcatgcttttcccccaagttagacttggtaaatatgatggccaagaaaatgactagcaatggcagaagttctgatatgacaaaactgaaatgaaaaaaaatgattaatgaaccaaacccttattataaaatttgtataaaaagttgactctgatgaaaatattttcagcaaaataaaattgaaagtagagaagcttagaaatatttacccagtgtagatagaggctttgaagtatttgtgcagtatagaaaattgaccaaagaattaaattgacaaataaattagaagtgacttgggaaaaaccttcatcaatcagaattcattaatatgtgtgataaatgctttatttaaaagttctggttaaattacttatattcctaaatacagtatcatctatgggctcccatatcctgctggcatagctaatctttttatgataacttaagacaataattaggaacatcttttggacaggaatgtagcagataggacagggtgctattgagtttcccaggtctccactggctgtttgctagtactgttcacagtagtcggtgagaatgccatggtcacatttttcttttctatgttatggagttgcaaagtctaataataagattgataggattcctgggcatagtaataaaaagttggcagtttagctgttctggtaaatttggctttagccacttttctttgttctcatttatgaaaagagttgataaattatcattatgaaaagtaatctaacatggagctaaagctgtttattctaaaaatacaatggagagactctataattgtactcactaaattttattttatcctttgctttccagcaaaattgaaggcatagaaaatatgtgtaatctgcaaaagcttaaccttgcaggaaatgaaattgagcatattccagtatggttagggaagaagttaaaatctttgcgagtcctcaatttgaaaggcaacaagatatcatcggtaagttattcaaaatagcaggaatttttagacttgttaaaaaataaaagattaaaaatatctaagttttttaaaaatgggatttcttcttttaaagattttgctcctttgactaaacactagattcagacatagcccatgattttctagattaattaaatacaagcagtcctcattttgcatgggttcctaggtcaacctagggttgacctcttagcatttttacatttatcatttcatgtaagcctcataacattcttgttaagaaggcagtacaaggattatttttgtaacactatgagttaggtagtagcaagtaaggtctaggacaggttaagtcccttatctagagtcacattttgtgccaggatccagatcactgaatgcctagaagaaagttctgggtttttttttttttgacagtattaacttccaatttcaaatttaccagtttattttgattataatgttaggtgttataggaggttgatcactagcttttcataa

SEQ ID NO: 134852 - DNA, 1057 bp, Homo sapiens
gagtatgcttgaagatgaggcagaagagggaggttgagtccaaattatgaagaactttatcagcttttcgcaagccttttggatcttatcctaagagtaacaggaagctgttgaaggattttaagataatacagaattttgcaaacatgtttgcagcatccttttaaatgtaattactaatgtctgataaaatattgcatgtttttcaaaggtcacctagaaaagaactcatttatcagcacactaattggattaaatacttggaagtaaagtattatcttttaaaaatatcattgaaatgatgccttcttgcctcaatttcaagatcaggatagtctttttttccaaaaccatggtggctaattttaaaagtagaattgtatttacaatatttttagacttttttcactattgtttgagaaatattcttacctttttaaaaataggaaatataatgataaataaactattaaattttcattggcagaagaggtagaaagactggaaagagacctagaaaaaaagatgatagaaactgaagagcttaagagcaaacaaacaaggttccttgaggaaattaaaaatcaagataaattgaataaatcattaaaagaggaggccatgttacagaaacagagctgtgaggaactcaagagtgacttaaacacaaaaaatgaattggtaagttcatattttacattgctttggctgtattctcataagacagataattctttgcccttgggtctaaaaatacaacttcctgaccatataatggggaagatgtggtttaacagaaatatgtggaaaggcttatgaattgtagttgactgtgtgctagatgatatggcttcccaaaagactaatgctgtcttgagctgcattatgtactcctagatatttgtattttttaaaaacaacattgtaggtgaggctgttcattggcaaaaacatttagaaggcgatctggcaaaattatccaaaattttgtgagttataggtctttttggacatggaatccatcttttattactaagataaaatataatatctttat

SEQ ID NO: 134853 - DNA, 1742 bp, Homo sapiens
tgcttcagtttagttatatttaaaatgaggattatttacctgtcctgctagcctcacagaattgtgaggatttaatgagctaataatgaaaataatttgaaatgaatcaagctaagtaatggaaggtagtaaatctataactcagaatgacaataaaatacatccatgtaagaataatgccaatactaaaagccatgtcttcctatggtaagttgtcagtaaagagcaacttgtattattacagtttaactctccaagtgacggtatctgtttgcttcttcttttagcccttgtcttggtttcttgcaggcccttttctgctgattctttattcttccttaaaggtagttcttccaggcctgaactgtgtttttcagggtttgcatgataacttgcattaatatgcttgcttacattttaagttttgaaactggcttgtcttcttgggaaatgtggttgtgtgcgtatgtattatttttttttaatggatgtttatataggagagcaaatttgaatgtgggggaaagaattatttttctgattggtaaatatgttaccttcagtcaactcttgattatccaaagctaatactgtgactagcctactttccagttcatttgacatctattttgcttttattcatgcatttcttcaacagatatttattgagtgcttacaatatgctaagcctggggcttataaaagtcacaaaagtactttgaaatgcacagcctatttattattatttgcctgcagagaccagttcatgtattctctgtgattccagtcacatttgcctgttgtttgccactattgccaatgagttttgaggagagaacccaagattagttgacagtgttgattgtgagttgctttcttgagactcggagacttatgatcattcagtgaaaatatcaatgtgggtaatgtgctggacaccctgcagcagtacatcgaaggcagcatggaagaataggcagtattggatttgaaatcaggagacttggaattgaattctgcctcttccactaccagctgtgaaattgggcaagttatttaacttctctgtgcagcttttatcatcttattgggtggttgtgaagatttagtgcaataacatatgtaaaatgcttagcacaatgtctggcacacattgagtatttggctcaatgttacccattatctaggctattacttccattttgatggataatcaggaggtgactgtgagctaaatcatgcacgactttgatttcctgggccttgtaaaatgtttgtgtttgtttatgttttattctcttcagcttgcacttttatattaatgaaatttttctgcatgttttttctttgatatctaccatcagatactggccaaaaaaagacaaaaatcacttagtggatctttgaaataaactcaaagtttggtttagtagaaaggagctagtactagtagttagttaataaaatatttagtttctgacactgatctaatatgtaactttagacaagtcagttcatcaatctgagacttaatttctgtatttataaattcagagaattagattggatcatttgtcttctccaagctccaaaaatttctaagaataaaaagttatagtagaattactttattaaaattgaatattacatatttggatctggttgagcttattcacatcccttattctttattacaaagaataatattctgaacacttaatactacagcaacaacagtatga

SEQ ID NO: 134854 - DNA, 1857 bp, Homo sapiens
gtgggcgcctatagtcccagctactcgggaggctgaggcaggagaatggcgtgaacccgggatgcagagcttgcggtgagccgagatcgcgccactgcactccaccctgggcgacagagcaagactccgtctcaaaaaaaaaaaaaagtatataaagagtttagaacagtgcatggcccatagtaagtgctatataaagttggctattattaatactatgtttattattaataatttacaagttgcctatactattatagaatgacagcttatttgtgcttgctattattagttttcataaacttttataaagtatgattttctacatataagcataaaaatataaaatatgcatggagtgcttagataactcccacatttcacttttatttttaaaaaactgatagaatatagaatacttattaaaattatagacattgtcttaataaatcagtgttgttcttctctgttaattatatattggggtttggggagattagatttcagaagcagggaaagaccttctttacaagcagttgagtggtagactacaacttgtaaataaattacgccaggaagctctggatctagaactgcagatggaaaagcaaaagcaggaaattgccggaaagcagaaggagattaaggacctgcaaatagccatagatagcctggattccaaagacccaaaacatgtgagtaaattaagaaattttgacttgttctgtctacatattacatgtctcatcattgttagcatcagagtccagagtcctttctgaaagtctgttttagtttgatgtacaaatttaagtgatatatacatacagtcagccctccatatccatgggttctgcatctgtggatttaaccaactgcagatcacatatattaggaaaaaaaaggatggttgtgtctgtactgaacatgtacagactttttttcatttgtcattattccctaaacaagacagtataacaactattcacatagcatttatactgtattaggtattataagtaatctagagatgattttaatatataagaggatgtccataggttaaatacaaatattatgctattttatagaagggacttgagcatcagtggatcttggtatctgcagggaatcctgggatgaatcccccatggatactgaaggaaaactgtacatatatgtgtgtatatataatgtatgtatgtgtatatatatgtgtattatacataaatatatgtgtgtgtgtgtgtgtgtgtgtgtgtatacacacacatatatggaatgtgtatgtctaaaacaaaacaacctagggcttgaagaaggtagctttcagtaaatgatggccgcatggtatatttatttttttttaagtggttgaatttcattgtattgcagagcaagggagatttgctccttacctttctctctccttgcctttttttcatctttctttctctctctctctctcttttttttttttttgctctgtcgccaggctggagtgcagtggcgcaatctccgctcactgcaacctccgcctcccaggttcaagcgattctcctgcctcagcctcccgagtagctgggactacaggcacccaccaccacgcctggctgatttttgtatttttagtagagacaaggtctcaccatgttggcgaggatggtcttgatctcctgaccttgtgatccacccacctcaacctcccaaagtgctgggattacaggcgtgagccaccatgccctgccgaagcgattctcctgcctcagcctcctgagtagctgggattacaggcgcgcaccaccacacccagctaatttttgtatttttggtagagatggggtttctccatgttgc

SEQ ID NO: 134855 - DNA, 1005 bp, Homo sapiens
tcgtgcctctgcactctagcctgggtgatggagtcagactccatctcaaaataaataaataaataaataaaaaagagagagagagacaatttaatgcaacgcaaataacactgacctacctagctgtgcccttggaaaaaccacttaacctctttgatcctcagttttctcacctgtaaagtggaaatgatttccgtatcaagttatcctgaaatttaaatgaaaactacccatgtgaaaacaatatagggcctgacacaaatagatgcaaattattatatttattttctattcttcctttaaaaatgttgttaagggttattacttttaaaggagtttaaggaacttggagttttgttgatttttttttttaattcagtcccatatgaaggctcaaaagagcggtaaagaacaacagcttgacattatgaacaagcagtaccaacaacttgaaagtcgtttggatgagatactttctagaattgctaaggaaacggaagagattaaggaccttgaagaacagcttactgaaggtaagactttcagtatgatttaaggtaaatcagtgttattgctggtaaaagaaacattataaagacaagcattaatccagatagtagctaaatacagttcacctattagtactagtatttgatagggaaatatttacaggatacccaaaagtagttaatgcaattttaagagttttgtttttgttttgttttgtggcattgatgcctagtgagtcaggtcattccagtcagtaggccagaagtcaatacgtgatcatgataagctctggcatgtgattgtctatgacataaaatccattcaggagcaaagcacccattggcatcagggaattcagtgtctggttataagaagaaagagttttaggatctagttttgcaatgctgatttaaactgcgacatatccataatagtggaaaaggaagacaataggccatagtggtttttacacatagggctcagtgtaaaaagatc

SEQ ID NO: 134856 - DNA, 1031 bp, Homo sapiens
gaatgtatgtcaatatttttatagctgttctcacagtaatctgctgaacaaactgcaggaaaaacaggtggataggatttttcagataattaaactctcgaagaagacagatgtctgaacaaacaagtacctgaatcatcactcagttctccaaatctgtgaggttgcgggcctcttggctggctgagatggtagctgttatcaccagaaataaaagggcagagtttatgtggcttggaggaagggttccaaaaaaaactacgtagggggatttgagagaaataagactaaactcacccaaatgttctcttcttctaacacttcaaatatttgttccttgaagtttaaagaaatctaataacctggaatttaatttttactgctctcagttccacttctgaagcaaatatcataaaagatatacatgttttccattactatgtgaggtgtgtgtgtatgttgggtcttacttgagttatcattttccatttttagtatagaaatttgcatataacacaaaaacagaatagcttatgacccttatttacccattgcccaacctaaacagttgtcaacattcattgtttcattttgtccacctcttttgttgctggaatattttaaagaaaaatttcatacatctttctttcacctgcaaatacttaagtgtacatctcttgcagaaaaggactaatataatattcttcagggggcttctccaaagtagaaagtgaagtcaactttctagaatgctgacacgtgttgtgggactaccttagttagaactagattctttgattacttggccaactaacctcctgagtacaagttaaacccactctacatgtctttgtcagaaatcatttagttgcaatgaaccaaaacctactcacactagctcaagaaaggagacagcttgctaggaaccagagctgctctgcctttcatgttgatataggggctctctcatttctctttttccatctctccgagcattgtatgtggcccagcatagaccccagccctgattt

SEQ ID NO: 134857 - DNA, 1021 bp, Homo sapiens
aaactcaaccctgaatgtggttataatgtcaaagtcaggcttgtttgtgacattgtgttttccttgatttagaagcaaaggcaagttattttataacaggcaggtaaataatgccacattcctagagtatggtgtgttgccagaatctggtattttttgatgtgatgattttaatgaagaggcaaacattccaatgactcctagagatcgttcaagataaaaccattcctgacaactcattagtaaaaaattaagttacagcctgttgtaaaatgggtgataattctataaaaagtttttattttgcttaaaacatattttgcctaaaaatcattcttgaaattgtatttcttcacagatgaattttgataagaggcaacatgaagcaagaatccagcaaatggagaatgaaattcactatttgcaagaaaatctaaaaagtatggaggaaatccaaggccttacagatctccaacttcaggaagctgatgaagagaaggagagaattctggcccaactccgagagttagagaaaaaggtaggggagacttagaaaatgagacacataagtacctgctgccagtgtcctgcccactggcaactaggtcagctgagatgggtgtgatctgtagtcacctctggctgcattgctggcacagtgctgaacctgacctaggtgggacctggatgcatgtcattgaatcaagaagctaagaccatgtgttgtggtagatggaaacgagaattgagaatgtaaggagtgactttcaagttaattaggtggtacttaacaaatgatattgggaggagtttgactcctttgaaacctcttgtccagttggatacatccatgggaaattacttttaaactcctcatcatcctttctaatacccctgcctctctttaatggcttttctccattccacctcaaccatctactcccattgtcacattctggactttgtcaagtttaaaaattgcacccacctctgaaatcacaaactgaagtgtcttgctctg

SEQ ID NO: 134858 - DNA, 1139 bp, Homo sapiens
aattaattggctctcttagaatctcttttatattttgagaaaggaagtaagtgatttcatatcaatttcatagaatgacttttctttacagacaacaaaggaggctttgaaaatgttttagaagaaattgctgaacttcgacgtgaagtttcttatcagaatgattacataagcagcatggcagatcctttcaaaagacgaggctattggtactttatgccaccaccaccatcatcaaaagtaggaattctgtggtgttgggaatgtatactgaattttcttgaagaaagtgtgacattgtccccttccccaaatttatgaacaggtaccaaaaacaacatttctatgctaagccgtgcattgaggttctgtagcgtttttaatatttgagatgaaaatagggccttcttggggaaggtgacagttgactgttcatactcgggcggtatgtgttagggtccttgaatgtggatgctctaaggagaaaaggtgatttgagcccagagagcctgctgaaatggacatagaattgtgcagagcctccgacagaaaaaaaggcacctggatttcatgtccttttaacgaacattcattcagtgtttactgaagcctaggccaagtgctaggtagtggtggggcatcacaatgaatggtaaagcccctgctctcaaagagttcattggccatgccagcataattgcaaaatggtgacatacctatgacaacagacctgacctgtattctctagttgcagagaggtattaaggattcatctgatgggaagttcaggaaggaatgcttcacaagcagggatgtgaagtcagcacttagcaagcagtgagcgttgggcttttaggagggaggaaacagctcgtatggaagaggagagttattggcttagcaaagacaaatagctttgtggggctagagggtttataggaacagtgtcagatgaagctgaaaagtagattggggtcatgcttttgtttttctttttgttttttgagacggagtcttgctgtgtcccccaggctggagtgcagtggtgtgatcttggctccttgcaactgctgcctccggggttcaagcgattctccggtttctgcctcctgagtagctgggattataggcatgcgcca

SEQ ID NO: 134859 - DNA, 1026 bp, Homo sapiens
acaaaaaaccactaggaaaaatgactacagagagaacagaggctgacacccgggagtctcatcactatggagaacttattttcatttctctcttggggagttgctgcataaaattaacccagtcaaacagctagataacatgctttttccattttggtatggccaaggacttgtgagttctagaaaattgtaccaaaagagaggataggagatggatgttttaaaatggcttttgaaaggataaatagacattaatttgtttgctttcaccacactttgagcccttcactttcacagaccagtctgatgtgaccccagccattacccacatagccctcctttctgcatggcttccctgaccctgccatgtcgatcaagtccagagggatgttaataagctgaattgtgtatggaactgcagtttatgtgaccatgtaatcacctcacttctgtgaaaaataaggataatgaaaagaagccaagttctttctcaaccttgctacatctcaactttgctgtagactttgacgtttcttaaaatcagcctttccatttataatagatagtgtgctctgctgtcatttgttttaggtttccagccatagttcccaggccaccaaggactctggtgttggccttaagtactcagcctcaactcctgttagaaaaccacgccctgggcagcaggatgggaaggaaggcagtcaacctccccctgcctcaggatactgggtttattctcccatcaggagtgggttacataaactgtttccaagtagaggtaagtcaaatcacataggaaagttgcatttctcttgcccgtttaataaccttttactgattctctgaaacccctaagacacaatccagactccttagctagctccatgaggtcttctgtgatctggtcttggccagcgacctcttgtcgttgttttaaaccctgtctggaatgtccttcctccttcccttcccatggtgatgcctactcatccttcagtgagacctaggtcctcaaacaatgct

SEQ ID NO: 134860 - DNA, 1119 bp, Homo sapiens
acttcttcagcctaggtctttccccttccgttcgttcttcaaaacccaggcaaaacacctcttcctctgagcagccttctcagaacttttctcccatgtggccagaggaaggagagacttctgtctatctcttctgctagaccccgaactctttggaggcagaggttatccacaagaggcttggcaaatgtttctcagtcatagttggactgtttgaaaaattaaaggttctatttgtctgtcagtttcatccgtgacatttaactttttataccaaagtcttagaatctaccatcattttttgggccattgataccactttaaccacagttaatttcagcttttggcaggaaagagaggaaacatcctgtgatgtttcagcactgcatttttttccccatctcattcaggagaatgaagtttctagattagaagacataatgcagcatttaaaatcaaagaagcgggaagaaaggtggatgagagcatccaagcggcagtcggagaaagaaatggaagaactgcatcataatattgatgatcttttgcaagagaagaaaagcttagagtgtgaagtagaagaattacatagaactgtccagaaacgtcaacagcaaaagtaattaatatattttttataattcagacaaatacgatattagttcattaatgctgtcgaacagaactttctataatcttggaatgttcttgatcttctgtccaaaacagtaaccactagctcagtgtggctgttgagcacttgaaatgtggctgatggagctgaggaacagaatttaatttcaattaatttaatagccacatattgagtaccatattgagcaatacaggtctgagttcttttggccaataatacaaatcagctcttattgtagtccctcttggagagtggtataaccatttcccctctccagttaccctagctaaaaatacagcaggggttctcaactctttcttttccattactctcctgtgcttccagttggtctctaaatcctgctgactgcatccagagagctctcaaactggtccctttctgtcatctccccttctctagcttttaattagtctcatcctagcgattgtaatagtttccacact

SEQ ID NO: 134861 - DNA, 1024 bp, Homo sapiens
atgttagccttaagatattgaattgtgtgtcacagtttttgatgtgtcaaatgttgtcaccagagttttacttcagccgaatggaataaatcacaaaatcaggtagtcttcaagggcagcctatgaactgcccttgaaggatagttttgagggaatggatgaatattgtggtagtggtttgctttatttttatacctcaaaagaatagaagtatcaacattttcttggtcaagtgctgacaacacaataatctttgttgttatatttaaaagggcaaacaattccatgtcatgcattttacatattatgcatttattgccaataggaattccatgtttaataagatggtaaacctagaccttgaacaaaatcaaatgtagcagtctttcttacctattctcatataaaattagaaaatcattgtagatctttttagtagttaggctacaagtatctgtattgtctacatttaacattttttaatgggtgtatatattattttttagggacttcattgatggaaatgttgagagtcttatgactgaactagaaatagaaaaatcactcaaacatcatgaagatattgtagatgaaattgagtgcattgagaagactcttctgaaacgtcgctcagagctcagggaagctgaccgactcctggcagaggctgagagtgaactttcatgcactaaagaaaaggtttgtcttcttgtggtttggggtgtgagctcagtgtgggtgagtcagcttactgtccacctgaaggattagaaagagaatgtgtgtgataagaggacagttgtccaagtcagacagccaggttccaggctggactctgctagttaagaagatgtgagaatttatgcaagtcatataagtcccctggctttgcttttcttatctataaattcaggctaagaatacgtaggcttttcggcatggattaaataaaacagcgtatttaaaattcctgaagttacttagttcctagcacaccccacgtccttatcctgtgtgtatcttt

SEQ ID NO: 134862 - DNA, 1070 bp, Homo sapiens
ttttttgtttgagatggtgtctcgctctgtcacccaggctggagtggagtggcgcaatcttggctcactgcaacctccgcctcccgggttcaagcgattctcctgcctcagcctcctgagtagagacggggtttcaccatgttggtcaggctggttttgaactcctaaccttgtgatcctgcctcagcttcccaaagttctgggattacaggcgtgagccactgcgcctggcccgataatattctttagaccacaacacagagggaagttggggagaaaaaggagttaccttttattgagccactgctgtggctacacatggccattttgtaaatgtttcatttaaccttcctggcagccctgtgtagatgatgttagcttggtttactgatgtagctcagagaggctcattactggcccagagtcacatagccaagggctcttttagttagatgagaattccaggatgaaaagagttccttacccacatgaaacacctcaggaactattatttgtattttgctatttcaacatgaatctatttaaattaaaagcagtctattacctaggaactaaattatttattaaagaaattctgtgagtaattaagaatggaaaaagtccttttcagatgagctgttccttctgttgtcatatgttggattactgtgagagaaaatagatgtgagcagaactagaggaaaaaaaatcactggtataataatatataataagatattttgataatatatcaaaatatcactggtatattttgattataaattttggtatattttggttatatattaatatatataggtatagatatataaaatcatcaaaagaaaattgatggcagtggtagtaggcagaggtagtaagtcaaccaaggctggtaagttctttcaccttcatcctcccaaaatgactcagggaggcagcttggtaagaaggaggaggagagagaaagtagtggtgttttggaaggagtgtgccagacatgttaaaacctgacatagaaggagacaaaaaactatttggtggcttttctggaatgcatagccagtttt

SEQ ID NO: 134863 - DNA, 1054 bp, Homo sapiens
catgaaggcctagccttttgtgatcatgtttatcttccctgccttaccactcaacaaggtactaagcccctccagagcaggagccatgtctcagtcaggcttttctctctatagacgttgccttgcttacagtaatgttgcaaatatatttagatgaagagaatatgttactttcttctattatatagaaataggtttctgtaaaatataatgctgttcttgacataaaaggcaaaaatgagcttgtttccaaattagaatttctatgatataaaacaataaataacagaacttattttgaagtaattttcatttacagtcacaggagggaataactttttttttttcaaacacaggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccggtaagtttaaaggaaaacaatcatacaaagtttgaggttggaaatgtctgtattacaagtcacagaaaaaataacaaatggccaaaaaaactttaaagtttaaccttactgctaataagcaaagcaagcaggttataaaaggaatatgatattttctgccattttaattgataaactttatttaaaagcaaaataatcatgctcattgctgatcagagtgtgctgaaagaagagcactcacagtctatcaattgaggtataaactggaacaatctcccagtgtttcaaggctcttaaaattcacacctgttgaactagtcagcccatttctactcctccagaaagggcaagtatgtacatcgcagcaatatttataatgacaaaatttggaaacaggctgggtgtggtggttcatgcctataatcccagctctttgggaggctgaggcaagaggattgcttgagcccaggagttcaaaactacctgggcaatgtatgagaccccatctctacaaaaatattcaaaaattagcgatgca

SEQ ID NO: 134864 - DNA, 1015 bp, Homo sapiens
tgtggaaggaagtagtactggtgtgtctccctttatgaaaatcaatgtttataaaaaacatttcagctgttccacacacttcaggattggtgctgggtttcctctcactggtctcaaagacttgaaagagaagatagtagctatctgtcactctgggatcaggccctccaggaaccaattacttcaaaaggcacccttatctgggttttttctgggcctttggtgtgggtcagggtaggcttgtacgactttgtaatggaggaaagcacctgcatgggtagcatatcaccattatgcatctgccacaagggaaggggagctctgcccacagctggctcggggtctttggctaaacctactgaaaatgctcatttcagaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgtgagtacctgctgccgtggcagtttgtgaggaaatgataaatttaaaattttaaactgcaacaccacttcaacacagagaaaataaattacccatcaacccagtcctgaacccagctgttgttattgatgtatttatgcatcatttgtccttgaagttgatggtaagttttacctgggacgggtgcagcctcaatggagctctggctggctggggagactgttggtgtgaacagccattatcagcacaaagtagacagcatgttctgccagcaagcctcagtttacacctccactggcagggaggagggggtgttgaagaagccttctctagacggttgttttttaagatggcatcttgctttgtctcccatgctagattgagtggcgcaatctcagctcactgcagcctctgcttcctgggttcaagcga

SEQ ID NO: 134865 - DNA, 1508 bp, Homo sapiens
tttatttttatttttattttcaagacagagtcttgctctgtcgcccagtctggagtgcagtggcatgatctcagttcactgcaacctccacctcccaggttcaagcaattctcctgtctcagcctcctgagtatctggaattacaggcgtgtgccaccatgcctggataatttttgtatttttagtagagacggggttcaccatgttggccaggctggtcttgcactcctgaccttgtgatccacacgacttggcctcccaaagtgctgggattacaggcataagccaccgcgcctagccagttttattacactgctgtagtcagtgcctacaaatttttctcatcctgccctttttggccaacattagctttaatcattatcctaaaaccaggaagctcaatctaccatgctttcatccttgaaataaatttgggaagtgacactcaggtcagaataatttatggtggatggagacaggtgagcagcaatggaactgtcaagggggaggatttttccactaccctctggaggggttagtggagccctgttgtatgaaaggaacttttaaaccatgtgtgtctctcaaaggggatacgctgataactagtgataggcagatcgtcataaagatggaatatagatgtctaaaatttaatcctaccagtaaccctgtgatgatgggtattattattctcattttacagacaattaatgaagactcagaaagggatagtagcttattatcaaaggtaatgctaacagactctgacgtgtatatacgcccagctgtatttgatctgcccatgaaaggccgatagaattatccccatttgacagctagagaagctgaggcccagaaggggaatgaagttatagagctagtgagtgtgtaagccagcaaaccacacctccatgtgttagatcgcagagttattttcttcctcctgtgctaggagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacaggtgtgtgcccagaaagcccagctggccagcctggggagagaggactcactgggctcaggcagattgtattgtttttaatatcccttctatagtagtatagaaaagctgattataagaatgttctttaagtcaaatctggttttttagccttaaaatttagaaacacaccttgactattaaaaatataaatttctcttaaatttgacaagctcttaaaatgttagtttttcaaggaaaaaaggtaattcttgagcatcatatttcatgtcccaaagaactatgttgaaatgctagattttatgccataaacaagtctataggagccaaaacctcccctaccccttgagcaagaaaagatggtccgggggaaacctttgatatcacataatgtagccaggcagagagtattaaa

SEQ ID NO: 134866 - DNA, 1058 bp, Homo sapiens
actagttaaaagttagggggctggcttctgagcgtaacattttatttccctttttttctggtaagaacagatactacacttgatcttagtcaaaaggctgagagctccttccagcaagttctgcaaggtccatcagaaccactagacagttactgacactgatgccatccctgctcacaggatagatgttacagatttttttttaaactagaacttttaattggaggatcttgaattttagcagttttaagaataaccgtttaattttttctctcagaattttgtacactggttcatcttaaaacatttttccaaagaggtactcaaatatgtcatttacctataagccatcatgccatcacttagttaagactgtttttactgtttcaagaatttgatttatccttccttttgtcttactgtaggaaaagaatgcctcagccagatgaggaatactgtcttgtgtaaatatattcaaggaaaacacctccactacctcactgacttcataattggaatgtcacatggtttttttaatcaagatgcagtgaactgagattctgaaactccactgtagtttactttgcctgtaccattaatgccaatgtttttataaatcacttgtacatagtacatatgggaatagttgcatatgggaatttaaaccaacatgtggctgagcctttttttttttaatcttcgtaacatgtttaaaaaaaaacagtgattttaactgcatatttgaacctacaaactggtaaatcttattaacaaaaagaatgtacttaaggccctctttatttatagtgtcgagttatttttgaattttgcttaaaatctatttttcatatgaaaataaaagataacaatcaacttgggtctgtcctctgactttacacttcacaggtcattctatggaaaagccgtcaaatttttaccttattccaagtaagtaatctttcaggtggttttcttttacctggaggctgaagtacattatacttatcaatgaagatttcatcatttggaaatacatcaattataaaactattatgctt

SEQ ID NO: 134867 - DNA, 1503 bp, Homo sapiens
aagaaaaaaggctgggtttactattgcacattttaagcttttatacctttatcttcttggaatggtcagattctgaactggacagtcagaaccacaggtctgctgttaagggattttaaattgtgcatttttaaccctacagtgaaataacttaagatatccctgtgttcacagtgtgaggggctgttttatgtcatgttggcataaattgttttgtaaaagggaaagtgtttctaaaggtgtttcagcgcttgtgctgatacaaagtaagttattactttgcaccaggtggtttggccactgaattaatactgtatagcaagagaaacaatcttatttttttggacaacatgttttattaagttcttcatttctgttgattttttttattgcatttatgattcagtggctgggaattgagaatttatttgaaatagaataggtaacacctcagcgtactatagaaaatgcactcagctcaactgctgtgtttaaaatacacattttaaatccctctttacagacactaacataaaagtacatctttctgggttgtaaacatgtggtagtaccagagtattgtatagtcaatgttaaataaaagccaaaactggaatgtgcagaaagtaggctttggttaatttgtggattcatttttatttttgtctttgtttaactttttaaaaaataagatttctggagtagattggtatattctgttaaagacttacagtgatccattttgcttacactgttgcatcacaagggactcacccagggaccatgacctgctggtgtgtgtgtatatttacaaaaacaaaacaaacaaaccacccattgggatataaggtagcaatcacaaactaaagactgcggcttgttgaggtgcaataccctgactcccaaagttagttacagtgggttttattgtttttgtgactgaaggatttattcagactgctgtactcttcatttgatgtaacaaaatgctattaatctaaatatttgtaaataaagtacctgtatctagattaaattaaaattggttgcattattttctgaactataatagggtttttcttcaggtgaacaatttgacgtgtcatcagtttttattgcagcactgtccatattcattgtataaagagaggtctacgtatgtagcatataaaaccacatcactaagtaatagacccacagctttattcttgtgtttacattacccttgaaatgttttcagtcaacccttttcagtgtaagatcagcacatttggtggctgatgctgttctcctttgactgtaccgggagccagattctatcatatgcatgtgtaatcccctgtaatacactcaggtgctcacaaatagagcagattgtcatattgtaacatgcgtgtgccagacaccgggcagtacactttggaaagaatgtgaaatccttttaatttttaatccatagcttactgcttgtgcagtcacctgcctcttgaggttgctcattgc

SEQ ID NO: 134868 - DNA, 2163 bp, Homo sapiens
agcttggtcaatctgttcttcctgtaatacttctgatcacattaaaaagcatgatttaagggaatagtgtctactcagaagcatagtgaacattttctaattgttcttccatgtctgctattgaactgtggtacacccatcattgttcttcatttattaggccaaaaatttcttgtggtgaggagaggctaacctgttttcgtttagtctcagctgtgctattagtccaaagaaaactgaatggaggtgttaacgtggctaagcatgattatgtcaccattacccgattaaaaacagctcagttcatgcttggctgagcagaccatattattcttggaatttttttcagcatgttcagagagatttcatttctgtttggagtatcctctctgttatcacagaaatgacctatctgaattgtcatggtgtgtattaacatacagtattttaatgattgcatataacacatgtagttgtccaaatagggtttgtagaaagggctttcagtacacgtatgtatgtatgctttccatagaaagtagttttccggccgggtgtggtggctcatacctgtaatcccagcactttgggaagccaaggcaggcggatcacgaggtcaggagatcgagaccaccctggccaacatggtgaaaccctgtctttactaaaaatacaaaaattagctgggcgtggtggtgtgctcctgtagtcccagctactcgggaggctgaagcaggagaatcgcttgaacttgggaggtggaggttgcagtgagctgagatcgggccactgcactccagcctggtgacagagtgagtctctgtctcaaaaaaaaaaaaaaaaaaaaaaggaaaatagttttccatgttctcttagctcagtgttctggtaatctcttattagatgacagtggttaagttggagacatcatggcagttaactaaagattagcaaaaggtcagtgtcttgtcttttgtagaaaactgtggttctccaataaagttatcaattgcctcttaggggagagaatgtagaagatgccttccttgaggctgccaagaaaatctatcagaacattcaggatggaagcttggatctgaatgctgctgagtctggtgtacaacacaaaccttcagccccgcagggaggccggctaaccagtgaaccccaaccccagagagaaggctgtggctgctagtgacctctttgctgtggcccctcatttgacctttcacctctgtctgttggaagcagtactttttactgcctcattgtcttctgtacatcttactgggtttaattaaaaaaaaagaaaaaactctgttgtaaaaacagtttaacacaatactaaactgctaaacaactagatgtaatcaggttatcaaaggcaagtagagtaataaatctctcctgcatggtaaatctagactttttttcccccttgtcctcgtgataagtatgtcaccaatatatgatttaaaccgagcactgatgctggacttcatgatttttaccctccctttggcaaggctttgtctcactgtacggtttaatttggtgatatcttaagcctttcttcccatccttaactgttcaagtatgtctgttgtaaccaataagtttattgctgtgaaattacttctgatggtagagaaggggttctataactgcttttgttttgttttggataaatttcctgttgtgtgggtggcatttttcttaacgagatttgcttctgtcttagcctcacacagggaaaatatccatttatcttctctctcgtgcttaattaatagctttatctttttttataccattttatccttttctctttaacagaaagtaaatatgtataaaatttgaaggaatcgaactaacaatacattctgtgtatattattttaatgaagaaaataaattgattactggcattggaacagtataaaataccagtttgtacagtatgacctatatgtgaccatgttactcccttccatttcacacaaagaaatagacacaactgcagttcacaagtagtactggctccaccccttggtgctggcagtgtttggggacattatgctggaaagagctcctagcatcagaggattaacactagcagattctgttccatctttgcactgttgcttacctgctgattttc

SEQ ID NO: 134869 - DNA, 1113 bp, Homo sapiens
tggatattgagttgtttatttaaaaatattaggtttggctagatttttgaaaagtatgcagttgtatttcacaactactgttctgagtaactggtcaaagcaaaattattattttaggatatgttgattaaatatgtattttaaatatttaagttttttttctataattatatggcagtcacaaatttaaacttttatttttgcagaagaagtacatataaccacttaagcagctggttgacagatgcaaggaatctcaccaatccaaatactgtaagttaaatggcatcttattacacagaaaatttaagaactaagctaacccaaaaagggaagccatttactggtgagatttttgtcttcaggtactaagaatgagagaatttttattgtattcttcaattagttgaagaaaacctaacagttatttttcagttcttattaaaccaggttttgcattttattatacctaggttttttgttcatgtttgtcattactattatgaatgtagtggtgatctcatgtgaagactatgaaatctgaaattatgattttaaaagggatctgcattaatttcataaaactttagcattggaggatactgggcaaaacgtagaagagatctttctgtactgttttttacaactgcatgtgaatctgcgttacctcaataaaaatttcaactacaggaggagaattaaggataaaaatttcagtcaaaaataaaaaggattctatatgtgttaaaacattagcttcttaaccagactgagatgatatttattgagattttaaaggctagccaccatgctagactctgcagtatacaaagataaacatggatccttggtcccaaagagcttatagtctagcagggagagaaccagcagatatgcagataactgtgctgcaaagtagattgaagcacgaattagaaatagagggactggcacagtgctggagagcctaggatgatcagtgccgtctggagagaaagcagctttacagaggagtggtgtttgagctggtccttgaggggtgagtgaagtttcagtagatattgttgagggtatgccaggaacaatgtgaggaaagacacactgagctgtgac

SEQ ID NO: 134870 - DNA, 1053 bp, Homo sapiens
ttattggtaagtttatttaacttacactcttgttcccaaaagaaggttaacatacaaaatatttatatgttaatacttaaacagtaccacttcaggactgagtgattttcttactgtaaaactaaaactccttttataagatttatttttgcattagcaatgcagcttttgcattgtggccatggatatttctgtggtacagtgctggtgggtaccttgtgaagtgatgttcattgttcttgagggctgcttgaaagctttttgatgctaggaagtatcagtgtttcaaggagtgcagaaacattcctaaaatactgtgaaagctctcagattcccctgggtttctgttataaggaaaaattggtagagaatattgtttgattccaaatcaattgtgtaatatatataaaatatagtatttttcttaattggtgtttttttccttaagtttcaagaaggttttgctcaaattaagtcttaatgctatttatccaaacataaaactacatttgaaagtacacgtttttcaatgaattgttcacattagaacagtttgctttcatgttgaacttaatgtgtcctttctaatgtttccttcatcaagggttaacattgctatagtacagtcagagatgacatcttttctcctggggttttcatgtaatgcaaattcttttctttcatagaataatacaagaagtataagacagggacctagtgaatcaagcttccagaactcagtttgttatttctgcttgttacatgctaccccatttgtcagtttttgaaatttgttgcttttatgcatgagtttaaggaaaaaaacaaaagaaaacaaaaacataaaattttgaaacagctcaaagtaaaaaaaattccattaaaaaaataagcacttcccagctggtggctatttattaacagtaataatttacagccaaattctgtcactgctaaagattgggaataatattccatttgtgtctcacagtgaaaacttttgaatcattataaagtaggaaaataaaaatttgttaagtgtcccagaaactt

SEQ ID NO: 134871 - DNA, 1057 bp, Homo sapiens
ggattgtaatgttaagtgggctcatgttttcagagtttgaaccagaccagcatttcctgtccttttttttagactcaagagttctctaagtaaagcaaaagtactgttaaataataggggaagaattttttcccttccaaagttaggtaaaaatatattcctcaccttaacaatagtatgtttcatgttcaagaaatgagactgagaaatcttttgttaaagcaacattaagcctatttagtattgaatataattctactgcaaatacttttgactgaaatgtattaatatcagtcaactatgggaatatatttaaatctagacagtatcttcttagaataagaaagggaagacctgttgtgagtgttggtggctacagtgttaaatgttttctgcctttgtttactgaaattagtaagtttgagtagttttcctttaattctgcttttatggtttttatttgtaatttttaaagaaacgagcaagaaaaatgtgtggtgtggtgagacagagccctggtattaaatccgaaatagtgatcatttcttttatttggaaatagtttctactatatgaatgtttgtaattttaagatacattttcaaaattagttatctcacatttaatgaatgtatgataattagcaggtacacaaattagtacaactaaaattgggtcacaattttatgatagtctttaaagcatttgaagtagaaatttgggattgttagaagtcatagctttaacataaaatagaaggagcaaagtatgtacagctacaacctttagttagaagagggaaagaaattaggaaaatcaagggagaagagcacagaagagacagtaatttgaaggtgactaagtgattacttttacccaggtttgaatggggaaagaatttagaagaattaaaaattgattagaagagtcggaagaattcaagttaagaagttaataatctttaaatatttttaatgtaagagattacttttcccccttgtgtttggcatctggttcagagatcaggtaaataatccagaccagttttagtctcagg

SEQ ID NO: 134872 - DNA, 1213 bp, Homo sapiens
cctgggcgggggcggaggtgtcccctgcgcggctccggcctgagcctcctgccctccccaaccggcggggcgctccgaggcgtgcagggaagggtgtgttccggcctcgccttccccgccttctcggcgcggctgggcaggaccgcatctcccgcgggcccccctctcgccgctgttccccgcggccgcagcccgcccccgcagggtgtacccacgcgtgccgcgccgccctgcagcccgcaagccccagacgtggcggtcccgtcccgtaggccgcgtctggctctgagtacaaaggcagctcttcgcagccctcttggcgtctcggggcagctccggtgtccttgtcgatgtggggagcccggccctgcagccgggccgggccggggccggggtctgggtctgtgcgcctgtgcttgcgatgtcctggttttggtgcgttcctgtgaggcccgtggacagcctctacggccctgaacctacagagcatctagaaataagagaaagttgtggcatttctagaatctaagagaagacgacagagctggagtgttttaagcgttttaactgtgggccaggtacatatttatgtatttttgtacctatttatcttgccccgcgtagccctcggagataagttgtctccacttcataagtgaggaaactgaggcctaaagttgtgatgtgtgtctggctgttgatggtacattacaaactggcttcggctcacactgtggctggtggtttctgtactacattcaaaaattaggctagggttacagacatgaccatttataatgtagttacaactttattccttttttactgtgttcgcattggatgacagctgattacccttttatgacctaaagtccataaagtcaaccactacactggcaaatcctcatgcttacaaaccccaaaggagagatgccaggatttcagtttcatatatgaagaagaaacgggttccaagaggacaggtgccttcctggtgaccccacagcaagtgtcagagcccagatttgaactcttgcaaagtttactgctcatttcgttactatcccaactgcctttaaaaaattcttttatttttctaaggtaaatattgtagaggaacaactgccttttatttagatttgattgttgaagacaaacttgaccttgcagtaatccagctcctacccctttattcccccaagcctttccaaat

SEQ ID NO: 134873 - DNA, 1898 bp, Homo sapiens
cagactggacaacagtgcgagactctgtctcaaaaaaaaaaaaaaaaaaagaaaaaaagaaagaaagaaaagaaaggagcagggaggtagagccctctgtaccctccatcaccagaaaaagctgaagaggggctgagtaggagggacagatgctggccagggcacaggttttgaagcataaaactcttgccctgtttgctgactcgttgagacagggtgcccagaaggggatagacttccctggggcgtggggagagcaggaggctcaagtgagatgctcttggtgctagaaaccgccctccctcatgcctggggtctctccctgccaggaccctgccccgcttaggctctgccctgtctcatcccagcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggtgaggctggccctgcccagcccctgccccagcccccattctgaacagtgcagacctttggggcatggtccccagggagggaactgattattgagcacctagtatgtgctgggcccttgactggtggttcatgccctgagacgctagagccagcctggccaagttcacacccccactctgcccctaacccatgttctgtcctttggcaagtcacttagtgtccctgtggagtggacatgatgatagctctgcactacctcacaggaatgttgtgagcgttaaacaccttactgtgacactcagaactgtgggtgaattggagaccctggacctctccacaacttccctggcccagctccaggcactccccagtttgcccttgagtcaggagcccggagtccctgccacacctctgccgtgggatgctataagttctgcccccttgctgagcctcagtttcctaatctgtgaattgatctgatgctcccagtcctgagtttacgctcaggagggctgagaatgaacataagggaatgtgacagagctgggaggacgcttagagaaaaatgaggtccatcgtcctgttatacagatggattaactgaggctcacagaaggcaagggctttctcagcttctacagctaggtcagggcagtgctggggttcctcctccacctcctcttcctcaggggtctgggatacttctggaaagccaggctcatattgctctgatgtcccgtaggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaaggtgggttgggccccaccttgcttgagcggtagggacagatgcaccagtaacagggctcactcaggcccatctatcttttggccttgtgatgcagtgggcagaccgatcagaggtcaggctttggagtcaaccaacattgtgtttaaatcctggcctctttctagccatgtgagcttggacaaatcacactgcctttctgagcctctggttccttatcttaaaatggggagaagaaaattccccataagttcatagtgttgtcttcctagccccaacagtgaggagtgggccagaggtgaaaatccagttcttcttgcaggccctggggggctttggcctagtcctgttctggtaccccttaattcttaaggccttgccaacagagggccccgtgttaagtatttaatagggcattgttagtcacatc

SEQ ID NO: 134874 - DNA, 2081 bp, Homo sapiens
ctatcaactgaaccaaaaataacttgtcataggcagagataaagccagaaacactctacacatgccagatgacatctggagaaaagggtgctaagggaagcgtttggcagcaagatatgattgtaaggggttgtcccttgagttcaatgtctgcctatttctgatgggtctaaagcaacatggagttactgtgcagcagaactctcagtaaagacaccatttgccttggcaatcctcaaaaagcttcaatagcagattgcttcagaccatctgtagtccgtccttttctcatctggatgttgtttggcttctgtgcgaaagattggtggagtgtcccagtagatatcatggtggtgtgtgatcagagtcccaaggaacctgaatgagccaaggtgcccagcatgaagtcaaaacaaagccttgacatgagtttgccatgaaatagcgaagagagagtggaagagaggagccaatcactgtggggcagtgccaccctgagggcacttagggtatggggttggtgcttaaatacatcacagatccaggtactgaatgggaggaagtgtgggtgatttccaatctcattgaccctatgttcagggacttgaacggaagatgtttcttgtgttgcctaagtggtattcagtctaccagactctgcaacttgcatcttcaaatccttggtaaagagatgtggatggtgtcagagaaggcaaaggcctgcagtggattgaagaggcttgcaagcagttctgtttctaggatgtgggcttcatcagaagacactcggtcaccacttagctagtctaaacctcagggttcctcagcccatcataccccaacttggaggactgacatcaaggagtagactggagaaacagccctcccatcaagtaacctcttgttctctcctgctccatctgcactatagaagtgtaataattagacatacttggcaaaatggctaattgatttggtaacagaagcatgagccataacaatggaagatctagttatcatgactgaacagcttaacattcaattcccttctctaagagaagctgtgaaatcctacatattatttaaagttaaccaaatcaatgtaaagggagttaggagacagtgtgtacctatgcacgtatatttatgttttgcttgtgttccagtctcggtcatttgtttccattttcaagcaatttatttgaagagccattgcactagcctgatgtatactgcaatgagcttctttgataaaatgaaacttagatttttctcgaccatttcaccgtgcctcctacttcattttttgccagaaaatctcacatccaacaaaacaaaacaaaaaccctgaattagtgggctttgaaaaggaaaaagcagggctttgaaaaagtagatcacacatcagttaagactcctgcttctctattagtcaggttgtcttggattcagtctggagtaggcagagcttaagggtttttaagtcctgacccaaagaaatgatctagcctgaaagtttagagcaaaggactaatgtttacttttaaaggaatttcttgatttttttaaaaaacttcattaaagtttaaatccccaatggacaaattcataatcttgttaatcgttattactaaactttttaaaaaatgtcccaatttacaattaaataaattactttctcagtatattctggtctggtcatggattgtgcatttcctcccaaagatattcaaaattgtcaattagagaattttaggttttcagactcagaaaagtcctcacgcccttctgaaaatgtgtccactattacagaaatagaacagacttgggattcccaaatttttgtttgtttttgagacagagtctcactctgtcacccatgctggagttcagtggtgtgatcatggttcactgcagccccgacctcctgggctcaagtgatcctctcacctcagcctcctgaatagctgggactacaggcaccaccacgccccactaattaagaaaaaaacgtttttatagaaatgtggtctcactatgttgcctaggctggtctcaaactcctgggcttaagtgatcct

SEQ ID NO: 134875 - DNA, 1050 bp, Homo sapiens
gaatagatcctgtactaagcttcctgtaaaacccagagcagttgagaacacatgctctcttggactggctggctcctaagagccagaggagaggaaggatagggtagtgcatgtctagttctagttgctcttccaaaattggcagtgagataagtcattccagctccccacggactgagtgactgaatggtggagagtagccggggtattacactaacatgaaaacacacctggggtaggagaaatcattctcctactaaccataaaatatagacaagatgattttacatcacgtggtttctttcaggaatcccagcatgtggtttctttcaggaaacccacatgtgggttttttcagcttgtggtttctttcaggaatcccagaggataaatgttttgcttttcttctttgtttcagatataatgatcattacttggaggagttcataacatctgctaataggtacttcatggttggccacaaagtcatattttacatcatggtggatgatgtctccaagctgccgtttatagagctgggtcctctgcattccttcaaaatgtttgaggtcaagccagagaagaggtggcaagacatcagcatgatgcgtatgaagatcactggggagcacatcttggcccacatccaacacgaggtcgacttcctcttctgcatggatgtggaccaggtcttccaagaccattttggggtggagaccctaggccagtcagtggctcagctacaggctggcggtacaaggcagatccctatgactttacctaggagaggtggaaagagtcagcaggatacattccatttggccaggggatttttattaccatgcagccatttctggaggaacacccattcaggttctcaacatcacccaggagtgctttaagggaatcctcctggacaagaaaaatgacatagaagccaagtggcatgatgaaagccacctaaacaagtatttccttctcaataaaccctctaaaatcttatccctaaaatactgctgggattatcatataggcctgccttcagatatt

SEQ ID NO: 134876 - DNA, 2067 bp, Homo sapiens
acactcggctaatttttgtatttttagtagagacagggtttcaccacgttggccaggctggtctctaactcctgacaggtgatctgcccaccttggcctcccaaattgctgagattataggcgtgatccaccatgcctggcctgggctaaagtttagattgcaggaaagacaatcataaactaaaatgttcttagaagaattgtcttatcaagtttccctcaccccccctgaaataacctgagggttgctgggtcattaaattgttaactgtggtgacttggaagggtaatgagttgagtactgcatcttttcatcaaaaatatgtctttatgaataaacgcttagtgcctagagcctttttctggtcagttcacttagtgcatgcataatctgccttggaacacatttccacaagatattcaccagttctctgaccaccgcaatcaccttccctgccttacctggtttactttccctttgtacttaggatccacaattatcaacaaggggaagaagacatagacaaagaaaaaggaagagaggagaccaaaggaaggaaaatgacacaacagagcttcggctatgggactggtttaatccaaagtaagaaaagcggcgtcactccctgtgcagcaaatccatggccctgcagggggtggtgtggcagtggaggcaacagtgccattgagaacattcctgatttaggagaaagagccttagcatattagacctttaacagtagacatatgtatatgtgcatctatttgattgtgatgtaaagtatatttctcactgtgagttatggtcaaaaacactgtgctaggcattgtgttagggagaggagacaggagaaatcaatcaacatggttgtatttgagaagttcatggtctcacaggggtcgttactgtgaaactattatttgcctagattggtaggaggcaggatcaactggaaggatgtggttctgggagtgaggagatgggagctgtccagggtgactttgagacctgagagactggtgggtgatggtgccattggccagaaaggggactggaggaggagacacaggcctcagagctgggggaggtggggacctccattaggaatgcatgtggatgcaggtgcttatgggacatctggacagagtcacagggtgctcctgagcttagcagatggtatgtgctggagatgtgcaatgaggtatcatcagagtaatcaggagagaatggaatccttttttttcatttgatttttaatttttattcattttgagacaggatcttgctctgtcacccaggctggagcgcagtggtgcaatcgtggctcactgcagccttgacctcccaggcttagcctcctgagtaaggaggcttggtgtgcgccaccacggccagctaatttttaattcttttgtagagacagggtcttactatgttgtccaggttgctcttgaactcctgggcttaagtgatcctcccaccttggcctcccaaagtgctgggattacaggtgtgagccaccatgcccagcctgaaaatagcatctatcccattgtgaaggagcttgggctctggaaagactgaatatgttctggcaacttctcttattgtttggggataagggatccatgccagtgtgaagggatgggaattttggcttcccatatgtcatttgatgatctgcacaacagggtaggcatctctgaaatgctaaaccactcatagaaatgtgagaagatggaagcattgttgctttgataaagccccttagatggggcaatgagactccgccagggacaggctagatgggccagagatggtccccaaagtcccttctaaggagaatggggcaattttactgtggtacttgttctttgctgagcaggacttgggaggtggggctggggctgaatgactgggggcagagaggagggacagaccatagtcaccagctttcaccctcttcactcttccccttgcatggcttcatctccaaatgagtagggagcagatatttatttttaatttatcttatcttatcctttatttatttatttatttattta

SEQ ID NO: 134877 - DNA, 1044 bp, Homo sapiens
gatggagagcaagtaagctactgcctcttcctcttcttgtaaggacactaattccttcatgggggtcctactcccacgacctcatctaaacctaattacgtcccaaaagccccacctccaaatatcatcgcactgagggcagggcctccacatacgaattttgaagagatacaacattcacttcgtaacagtcatcatcatcatgatctgctccagagggcagaacaagaaagattttggtaaatagaagagctctagcagttggaagagtccaacagaagaacaagtaccctttggggttcctgcctggagtcggaatgtctgcttggataaccttcaagctctgagtttgaacacttgatcagataactttggtgtttggaattgtagccagagttgtatgtgcataactgagccaaaggctgaaacgtgcatgtatataccagcctctctgggcacactctctctgcatggtagccagagcaggttctggctgctcttcaggctaatcgtctggcacctggactctggccacaacatcctctgatgtgcagaatccacttgaacatctgcaaaaaacttcaaggggaggagttgttttttgtttttttttttttgtttgttttgtttttttgccactttacgaattggccacatgataggttgaggtgagccgaggacacaaaccttacacaggtaggcagcactaagctaaaatggattaaaaataactaactcaagcatgtcaaccaattagtaaatagaagaattgtcagtaaagcgtattgaaagaatatcatctaggatagcatttgatttcaggctggatgaaaaaataatcttcgaattttagagaattagaggaagccttcaaaattatgatgaaatattcatgatagtggtgatcatgatgggaactacaagttattgagggcatgtgccaggacccttgctatgcattacctccgattctttttgttttgttttgttttgtttttgtttttgtttttgttttgagatggagtctcagtactttggaaggct

SEQ ID NO: 134878 - DNA, 1087 bp, Homo sapiens
caaagactgacaaacattccaaatataacaaaatccagaaaacaacgacataagaaaatgatgtaaaactaatacaaaaatgattagtattacttaactgtctgatacacctgtcatgtttgggctacatactctttgactgccacattatctgacaacagttttctagaatcatttccaataaaagagaaaagacagataaatcagttttgcctgtggcatggttaatcaatgggtgctttttattactgagagtttagagcaatttattttagcttcccaatttgttattggcgatgccacttctctaagtcatttgacagtttctcaggtggctccagccagatcatgagaaaactcagccctggatccttgctaggcacagtgaggcagacgaacctgggtggagcacgaggtggctgtgagacctggatcatagtgacccctgagcagggagcagagagagtagtgtgtagttcatctccttcttcttgaggccaaaggaggaggggcccaggtgctcaacaaggtccacctgggaccggttgtttctgggacctaggtgggtgtgcaggtaatgggtcagcaccccagctcagcctgcagcccctggacaggcactgaggctagagagtgactctcccaggcaaggcaacactctacctctgggaagcatttggggctttctcatgctcaccctaatgggaaatcaggcccagtcttgcaaaggggcttgtgcacatgaggaccctgacacctaagcgtcattagctcctggtaagtcagcctctgcattcagcgcatattggttggtggttcctatgcatgatctgagccaaaaggctgagaagtgatagttgatgaatcctatcatttgatcatcacaccaaggggcccgtgtaggtcactgcagcagggtgagctctatgtggctaaaagaactgccctcaaaaaatgaggtttacatccctgaggctgatttctcatgcacatcctgggttcatcagagaagaactggggattactggggaatcttagctccaaaggacttgtttctgggccaaggagtctgaggccagagaaactc

SEQ ID NO: 134879 - DNA, 1064 bp, Homo sapiens
gtgccgcggagggtggcaggcccgctggccgaggcactgccgaggccgtccgagatgggagctggcggtgcctccttccgcgccctcgcctgggcctccctgcccctgctggggcctccagcctgcgcgctctgcgaggacacgctctgctgcggaggtaaggccgtgcgcctccaggcgcgccctcgccctacgcgggcacttgcccggggcctgtttctcctccttggccccagatccgcgactggcggcaaggtgaggacgaacacaggcatccgcgtagggctgggaaaaggaggcaggagctctcagcaaacccacctttagctggaaaacgtcgctgtcccgccaccacggtccgaaaagcgttcgccccgctctggcctcagtgtgcctatctgggaaatgggtcaataagatagtcacgctttaatattcagtcacgcttgctgaagcgggtcgcagacgttcgcgggacgttccctccagccagctggagtcctcgggagtttctgttggtgggagtgctggggtgccttccctgtgacaccccgcactgtccccttcccaagctctagttccccccattagtccccggctcctgaggttggagatccacgcagggcgcacataaaagtttaaggggtcagcggatgcgggaagattctagcgggaaggggagctgtagggtggaagagggataagtaaagcaaagtcgcggcccactcctcggtcccgtaccctcatagcgccgaaacggaagcagaggttatctctggactcctggaggcctggggactccgggaggggagggggcgtgtggtcccgccggcatctcgggccggcaccaggctggggagcgtgtgctcggagcggagggcctcggctctgcccagtccggcctgggcggggcggtggtggggaggtcgattgaccaaacaggtgcgcccccgcccctctgctccccgcccgcgctgggtcccgggcctggcgggcggagctgtgggcggctgggcctgcgattggcagggctgggcaggccgggtggccgcgggagcccggga

SEQ ID NO: 134880 - DNA, 1035 bp, Homo sapiens
tgtatgtttattaactctttgctccttccctagctaggccaaggcccctggtgggcaggacaggagctaagcaagatgtaagctggacagaccattggaaatcttctggtgcgatctatccattttagaattagggggatagaggcctgggtttgcctaaaacttcatgacaagttcctggcagagctgggattcaaacctggatctccagggctatcttggtccttggctgcaacatcacccacttctcagagccaccctgcttctcagctccaagagccaagaattcccagctctgcaagaatcccagttttgcagccttggctcctcctggggctgggagccagcaacgccaagcctgcaggttcccagagagggctcctggcgtcggtgtggcttagtcacagggatgagatcactactcacctctggataggggaggatgccaaggtttgggaactttcactctgagctacttgattttgtgtatgtgtgtgtgtgtgtgtgtgtgtataagaaaaacaaaccttttggttgggactttgtacttggctcatgaactgtgggcttggggaagctgctgagccatgataagcacttgtactgtgccatctcacagcttcccaggatagtggctctgtgttaggaaggagcttggaccagagccagaacctggtgttagcatttgctctgcctcacattggctgtgtgaccctgagtacggtgcatggcctctctgggctgtaatgataatacctagcagctcacactttctgagtacttcccatggaccagccactcggctcatcagcccatttagttctcacaatagacctgtgagatcctgttttcacctctgttttgcagatgaggaaactgagtcccagagaggaggagtgacttgcctaaggtcacccagctgggaagggcagagccagggttggaatgcaggtcttcccaactccaaagcctctcgtgtcaggcactctgctgccctgccctctagctgcagggctacctcctaagggattgtgg

SEQ ID NO: 134881 - DNA, 1054 bp, Homo sapiens
cctcccaggttcaagcgattctcctgcctcagccttctgagtagctgggactataggggtgcaccaccgcgttcggctactttttgtatttttagtagagacagggtttcgtcctgttggccaggctggtcttgaactcctgacctcaggtgatccacgagcctcggcctcccaaagtgctggtattacaggtgtgagccaccgtgctgggcctcttttcctttcagaagttatctcaagcactgtgccctccatgaaatttcctatggcccctcaaccttaactgccttagtgtatccttgttacgccttatgtctgcaatagttgtcggcccaagtatgttccatggaatggtaacctggtaagatgctttgtagaaaagaaggttaagaaaaggctgctgaatactttatgtacctgttttgtatagtaccaatccatatgaacaattttaaaggttctgagaaatcctgcagtaaagaaacctgctgagatttgtttactccagaactttccaaacctctgactgtagaacactttcttcttggaatgcctattgataagctttgcgacactcctggagaggtggcgttgtagacatctatataacagtttgatgctatctcctcttataatgaaggaaaccaaagcccagagaactcagtgactagcctcaggtaaatcccagtgtctaccactccatcacctcttgggtcaattggcaggtcctttataatgagtgtccaaggctgggtggcaaggaagggctggacatggtagccaaggacctgctttcaaataactttctttctttttttttttttttgagacagtctcactttgttgcccaggccagagtgcagtggcacaatctcagctcactgcaaccttggcctccctggttcaagcgattctcctgcctcagcctcccgagtagctgggattacaggtgcgcaccaccatgcccggctaattttatatttttagtagagacagggcctcaccatattgaccaggctggtctcgaactcctggtctcaagtgatccacctcc

SEQ ID NO: 134882 - DNA, 1082 bp, Homo sapiens
tccagacacactggaccctcattcctgttgtggtgctcagtagccctgtgaccttgggctggtgactgcaccctgagcctcagcttctgctctggtcattggtagcttggctgagtatagcagatgggacacaggttatgggtgacagcctcccagagggaggtggcatgtgctgtcacagaggacaggagggtgctccaggtgggtggtgcgaaggggtgagagatgaaggcagacaggaaagcatgggaagaattttcctagcaaaacctccagaaagagtggttatcccctgactgtgactagagagattgtggaggaggaggtccaaggaaagttctaagcaggaagcaccgtgcgggaacagcaagggccttaagagacggcgccaggctgaggatgagccatgtgggaagggagcttttctggaagaggcgcctggggctggatggtctggacctggtgtcaatgcctgccccaggcctgcctggaggtcagcgggcctgaaccagtctcaggacagctttgcctgcttggccatgagccaaggctcaggatgaagcctgtgcttctgtggactcctgtccatgtgactgtgtggagggaatggcctggaaagcacacagtgccccagcatcctgttctgccttctggaaagcctgctccttgtgtgaaccccatgtcatctgtcctgtgtgtgtgtgcgcacgtcccctgctcagtaggtacctggggtgggtctgggagtgtacacattggagtatctgcatgaatataaacatgcacatgtgtttgtctgggcattaccgtctcactccacacccctgtgtgttcacacctaccagggaaacctctgccctgtccttcttctcccttgcgagtcaacaggtctttcccaggcaccccccacgcaccaggctccatgcagggtgctggggaggtggagatgcaaccagcttaggcgtaggtgttaggagttctgcagacgcacacacacacacacactcacacacacacgcacacacactgcaaatgagagcgttgataggagactcaggtctagttattgctgtaggagccaa

SEQ ID NO: 134883 - DNA, 1079 bp, Homo sapiens
tcagtagccactgagcctctccgagccttgtgttcttgacagtaaaatctggaatgacagactttgcttggactgtggacttggtgaatgtggtcgcccaagtctgacccatggtaggtgcttcatggatgaaatccatcattaacatccaaatcgggtttccatttttggctgtaaaacatcagtaaagatctaggagggttggagtacaggcagaggacaaggtgtttgggggaaggtcagtggtgagcctggcctgggccttggggacagtccctcacacagaccctgtgcagggccagaagcaccctcctccctcccctagcccgtagcacacacttgctcacttacaggctcccaaaagctatgtcctcacgtgctcagctgacttttgctctgtgtagaccctcgagggaacccaggaaacatggttttgcctcggggaggcaggggagatgccacaggatgtactggaataactgccaccttcactgccatttcaaacccagatggcaggctgtcagcatctcttacaggggtgctccgcagggagaatcaatgagtcacggtgtaaggtctacaaggctcagcctgtccaccttctccatggaaactgaggcctgggaagggcttgtcagaggtcaccacccagctgacagcagttcaggagcctgggttgtttacaccatcacatgccacccctcctcattttgtgagtcagccgaggacctgcagccactctgtagggcattgaaggctcagtgctagtcctgcccctgcctcttgtagactgtatgaccctgggagagcctcagtttccccttttgtgaaatgtgggggatggactttgtaaggcagcgtacagttcaggcataaataggtgcttaaatgttctggtgcagtagctaagagaatgggctctagagagttccccgacccaggtttcaggccctgcacagcctcataccagctttgtggcttgctcaggagtggaacttttctgcctatctgggacaactccctccctcctatagggagagttggggggtaggggagtggctctccaggaccacacagtg

SEQ ID NO: 134884 - DNA, 1229 bp, Homo sapiens
ggctaagtttcttccatgcgtgatctcattgaatcttcacaactacctcgtccccattttacagaagaggacacaggcatagaaggttaagtcatgagcccaaggccccagagccattaagtggtggaatcccctgctcccaccttcttccggaggaaggatgaaaattatttacattttacctggggattcctagagattgaattacccttaggacctaaagaggtgtgtcaaacagtggaatttcagctgtactgatgggcaggagaaatgtttagggcaggaagcttcagctcttgccagggaacagaactccaaaagtcacaggttctgggagctgtaagctgtaaaaacgagctttgagtgtgagagaagcaaacaaattgtccaaagtgaagccctgcgagaaaagcagggggagttatcttggaagccgttaagagctgttttcttgccttggtcctgagatctgggctcctaactctggagcttcctgggccacttgcccttcctgtcctggttgtgaatgtgagcacgtgagggccagcgtgtttagcttgtgtgtctgcacaattctgctggtgcctgatgatagctgagtacatgtgtatatttattggcttatttcagtgtatttgtatgttagcttgtatgtttcatggctgtgtatgtgtgtattcgtgtgtgtgctgatcaatgtgtatgtgtttgtgtgtgtctgtatgtgtggtggcactggggtacttgtatgcttacacatacatttctttgtgggatgcctttcctgtgtgcatttgtatgcatgcctgtccttgaacttgtgtatgtttctggccctgtatatttctctatgagaacatgtttaagtgtgtctttccaggcagtattttaactcaacagtgaccctagagtgtcagggtccagcctcttcctggggcttccctgaaggctctcaaggcctatgaattggttttctttgtttgacttaagtagtctggctaccttctccaggcggaatatgtggcgatctcactggtatgagattgtagaggattctgtgggcatagggtggcctgtgagtaggtggccaccaggaagtcaccaacttaatcccagcttaaggtgcctcccctctttcgcctgtcacagtgtctgacattccattagtgagtcattctccagctgggactctctttgatggtgcatacccttgaggggaggaggccaga

SEQ ID NO: 134885 - DNA, 2655 bp, Homo sapiens
atctcgcttcccatctttgttattgtctgggcggcaggccacccggtttgctgccttcctccctccaccgggcccctgccttcggctgtcttccccaggaacatgcccttctccgcgctttccttggcgggggtcaggaccctctgcacccgcatgcgggggcttgtgtacgtaccccgttttgtgtgcatgtggtggttgtccggggagcaggagagacaacaggcagtccggcttctgagtgtgtctgctctcccgggagcaggcggcatgcatgtcatgtttacctccttacagcgggaagcctgtacctagaagccggcaagtgctggctggccaccctagccagaggtcggggcatggccaagacgacctcgtgcgggtcctgccccacttggcctcaggtcagccttgccacatgctgaaggggcgcagagtgggggttgggagtgaaactacaagcctgtttctggaaacagtaggaaacggtagcggttggagcagaatgtcactggcagcggtgtggaattgtcttattaattttctataaacaaaatatggcttggtggcctctctggcacaggaagggagcctagatttcccatggacaggcagaaagactgggtttgaaatctctctacccagccttggagctgaaataggctttcccaggactggggtctcctgatttgctgctttgcttaggaacagattcgtcggctgctgctgggatggatgggcagaaatttctctggggctgtccctggagtcatcctatttggagttcagtgagtaaaaacaactatggtgaccccgcccgccccccagctcatggccaaacctggatgagtggagcagtgcctctccctgctctgatgtggtgtggttgtgatgttgaaggctgggagggcaggatgggctgtctttggcttggtttagcagcaaggaagggttgtgtcctggctccatgggacccccactggctgccatgcctctggctggggagagggtaagtgccaagacgctagcctcagtgagtgggtgggacacgagtgggaaggacggtgggggcttctagggtgtcgagcgggagtcctggtccccatggccttcccgtgtagatgagcggcacagggcactctggggcggccacttgagttctgactttggatgaatctatctggtttatatggctgctgaagaggctttgttgaatgctgtctgcgtgctccgcaagctgctgtgttggggaggtggtttttttgcgctggaattctctcatctggaggttggaaaccagttggttctgtgctgggatttttttggctccctggaaaaggagtcggtttcaggggtggggatgccgaacctggctggttgggattgagggttgctatctggttgtgaggctggggtcaggccaggcagtgcttggttggcacagctgggctctgggggctgggggctgtaggacaggcttgagccttcggacttattcttctgaaacggcctcaggggaggttgccagctggtctccacagtctctgggtccctcagacactcatttcttcttcagaagctttggcagtaagcaccaaggacaggtgatcatttctcctgggtaacaaacacatgctgcttggagcgctttccaggtgaaaggtgtgccggcaaaagcattttcattttgcacactggaaatgctgctgcttcatttacagggctgttttaatgttggtaaaagtgatatagaggatgtggttctgtcagcccagaggataatttccaagtcattcatttatttattaatgttactgaggagctaggagggtcagttggcaatattatgctttcctcattccttctctctcctgatgctgtttctgggtgactctagccctccacacctgctgggaatatgcttcctttggcatgctacctgtctaaacttaccacagtagttactctaaagtgtctgtacccccatcaagctcttcccagtcatcctggtgcggagcttagctcataaatgcaggcagctctggggcaggtaggcaaggctgctatgtgtggagttagggatcgattcccccttccagagtatgtgtgtgctggctggcgttcccacacctgaaagttactaatggtggaattccaagtgataagggactagggaaggagatacagtacttggatgttggggatggcagcttccagggaccctcacctggacctgggtaggcaggaatcaattctgccccttgtggtgagacagtccctggaggagggagagtgaggaaggttgatgaggaacaggggaaatggaagttagggtctattttcctgctttagttgctgacagtaagtgcaggcaggactgggcacccaagtctggtgtttcttgcccttgttccctcccctactatagacagggagggcctggtcctttttttggggactagtctgtctagtgtggtgatgtcaagatgatagtgcagtttagacaattgccaggagtcatgggatgtatgtgatctttggatttgaagccaagcattcctggggcaagtcacgtaaccttttgcagcctcagtttgctcatctgcagaatgggcatcatgataatcatgttgttgaagacattaacattaatac

SEQ ID NO: 134886 - DNA, 1010 bp, Homo sapiens
taatcagaacgttgtattgcagctgcagattgttagcaggtgaaggatgtgtgagcctcaacaattactgtttctggcttgggaggagattgattaatagattgttcccagccccaccccctctgcttcttactcccgtttgtgctttctttccctctttccaacttcaccacatttcgtcaggaaactaagtggctatgactaaatccctactcttgtactagaaacccagggcagaggaggacctgtatgaggaggaattgcctaggacacctgataaaatgcagattcttggactccaccccagaccttctgaattataccctctgggtggggtggtcttgcttccccaaagtttgctccttttgcagaggggcaggcattgtgccccagctgtgtgctagtgacttgcctaagcacttcctgtgctgtattcttactgatttctcatagcaagagggctttttgtttcccatttcacaggtgtagaaactgaaacccgatgtgtgagtggcccaaagtcacacactggaggaaacccagtaaccaggcaagtccattccctggttgatgtcaagatcccaccagtagcatgtcatgtcctttctcattaaggctgtgatgccttttgaaataaaccctctccctcctcagagaagtagcagtagcccccttctgtgcttgcactaggctcccattgtgaaaagctcctgcacaccagtgccctgggtctcctgagggtgcttggaacagtcagggcattcatgactgatctgcattttgcagctgtggtgggtgacgctcagagaggtgaaggggcagaggcaaggggagctggaacttgtctcctaactccaggtccagtgctcagcccacctgtgccaccaaggcctgctcttctcactgacttcctggttgcaggtggggaaactgaggttcagggaagtgtacccatttacttaggattgagcgagcagcagtaatgcaattcaaggtccgccaagtcaaat

SEQ ID NO: 134887 - DNA, 1515 bp, Homo sapiens
cttccatagcacttcccttcctccaaggtcagaagaacatagaggtgacttccatcactacccaggagggtgaaggcaaacagggtgatgatgatggtggccagggactcccccaccagcctctgctcaggatctgtgggaagatgggtgaagctggcgctgaaatccccagccaccccaggcagtactacagcagactcaccaagggagttgcctattgtgctgcaggccacactgccctggtgtcaccaccttctgtggactggatgtgacgtagggaagtggtagtgccagggccagatgttctgcccggagcccatccagcctgcctgaggtggtcttgctcagttgccctaggatcataaagtccacgaatttgatggttgtttatgaggatagtgaaaacctattccagagagtttcagaattaaggaaaaatggagctggcagagaacttagtcttagagtctgtacaagccaggggtgcacttgaaaggccttgttgtctttcgtacctctgctgcttattgttcagagcacccataggagtgttttcccgaactgggttccatggaacacattcttaaagatgttaatgggcgtttgcgatgagagaattccatagtccaaacaggactggggagcagtctgtccagagtttctcaaactcagtgtcagaggttcttggaggtgagacttgatgttttactccagtggggtgattgtgtgctcaaatacattttacatcctcaaattttgcttcctcattcttgggaaatcatttgtgacccaggagatgaaaggccctgagaggtcctgcaatgaagaagtcagttttgctttgtttaatccagggtttcctgtcccccaaccccaggagcagctgttaacatctgtggagcagttgtattttgcagaacattatttggtaaacattcttttgaggtgttatgtctcctcagaagcatgttttggaggaaactctggaagtgttccctgcccttagtacctgcaggagtaagccttgaatgatggcattgctggctcagcaacaggtagtgggtcatatgtatttgaaaaaagtcatcctaggtcctcaatatcattcctcaaagcagctaccagctctcctgtgtgtgggatggggcctggctctggtcagagagccctctgtggggaggtggtttgtctgggaccagcctaggcctagggtgtaggggtttattcccctttttgcaggctgggtggcgtccatgtacctggcagcttgggctctgggcctccccatccccctctagactccctctgcagaaggcagtggtcaggcagaggctgcccacagatttgcataattgcaccgtctcctgaataattaataaagctctgtccttgctgggagcaaagtctgcaccgttatggatgggtttgccatggataggtttgccggagctcttccaggggagccgatggttcctggactcctctgcttttcctggcatggagcccccagagaga

SEQ ID NO: 134888 - DNA, 2089 bp, Homo sapiens
ggggagctctttccacctggagcggcccctgcccttggaggacagtgccaactcttgtaaacttccccctttgtggagcttccccaggcagcatttatgtggcaccttgtcattccccacatggccctcacaccagctaggaaggtggcagggcagggattattccattttatagataaggtaactgaggcccagagcgggtaattgtctcacccaggggcacatagagttgatatttaaacccacgtctgccagctgggccttcagctctttcctcttggccaccaagaaaccatttgctccctggatagatgtcagtatgttggctggggtggggccttaggacctgttgctctgacagtgcccttcccagcttgcttggagtgtctagagggtggaggcaggagtgagtgaaagccttccttcagggtttccaagctgtggggcctggctttggagccatttgtagacaggggcctaaaaccgccagatgcctgcttatcacaccattcccgactctcacccttttccttctcctgccctcttgttgtagggtgggaatgtttgaggtgccccagaaactgggtatgcactcaactttggccagtagtggtggtgcaggggtgaaggagcagggcagggggttccagctggcttgtctttctccaggccttcctgagagttactggacaagcttggtggatggccaggggagcctggggtgaatttgttcacagcagctgggcttagaggctgcaccggggctgagatgtgacttcaggactcaggccaactgttttatatctcaaaaatcttgggttataccatacaccatgaaaggtactgcattgccacacctgacacttccattctggtcccaaagcaagccacacgggggctctctgatgaacagaatcctgctctgctgacacatggacccagatccagatccgacgccctgacttcctccatgatctgggacaagtcacctaatctctgaacctctgtctcctcatttttaaatgggcaccatgattgtggtgcctacctcccagggttttgaggtctacatgggatcatgttacatggtaatttgatcatattctgtcatcacacacatgtactcacattctcacacaccatgcttttgcttttttgtttgagatcccacaacctgccagcacatccaacccagtcttcccagggtccacctcatcatatatatagcaagagatggcccaagacacatgaagtgatgtttgtgctgacatttctcccacttagaaaatcaatattctgtggtctgcctaattgctctgttgctgctaaatgagtcattatggagggaaaatagcaaatgcattgtgagattaatgggagaaaatggttggcaaatgactttggtttgcttcggaaactctgagaaggtgttactacgtgaaatctgcagagccatgcaaggccgagtcctgagcagcagggagacaggcaggcagctattggcgctgtgagcctcccttttagggcggggcaccgattcaaatattatagaggctggactcaggagttactgagtgatgaagtcaggagccaacaatgggacaggtgctctgacaacctggtctcaaagaagaggatactcttcagttagagccagttacatgccaggcatggtgctaagctgagggatgtaatggtgagcaaaaccagccccagctcctcccctagtggaggacacaggctgaagtgcaattgtcctacaggtgactgtgtaattgcaattaaggcatgtgtcctgaaggcagtgagagcccagatctgaagggtttcatctggtgggggtggtggggagggcctccccgatgacaaaaggagtaagctgagctctcagggaagaaccttctgggcagtgggagaactcgtgcagtcctgttgggtcttataggaggggctgccacgggacttgtatggccttaaccctccagccatcctaagaagtggatatttctcgtttcacaagcgaggaaaccaggactgaaggtggttaagagacttgccagaggtcatagaacccttaaatggcagagtc

SEQ ID NO: 134889 - DNA, 1032 bp, Homo sapiens
tgtatttttagtacagacagggtttcactgtgttagccaggatggtgtcgatctcctgacctcgtgatctgcctgcctcggcctcccaaagtgctgggattacaggcctgagccactgcacccggccatgacttgggtagttttctgatgatcaaaatgccaggtcaactagtgactcctctttcaaaaggctctgtaaataacacacttctctccccatgaaatgggttggtttattccctgcctctaatcccagctggactgtcatcaggtagggcctatcagttgtctgcagaggtgggtggaggtatggtcacctgaaggtgcttctaaggaaggtgcttgtgagttcttgtaaacttcccaaggtttcaggagtggcagcagcagataaggagagtccaggcatttcctgtgggcattatgaaggagcaccagaggcatcccactttgtcttggtgcctggttgtagctgagcatcatagtgccatgagaacctggtaaaaagattctggagccccaccctgggagggtcagggtcacaggtctaaggggggctctggaatctgtattcctgacaagccccaggtgattctgagacccactcaagtgttgagatccccagttagcagctctggattcttccgtctctgagagggtcacaggcctccaagggatggtggtagtggagtatacttttatcttcctgggctggatgtaacactgcctgctgccagctcaggaagccaggccacactgtgcccatagggccacatgtaaggcagagcctggtgctcagctgaaccccaggtgaggcaggaacttggcctgggatgctttgctactgctattgtccggaaactgagtttcatcccaaacttaggtctgactggctgtgccctgtcccttgcgaaatataaactgcagcccttcctggcgagaggctaagtgtttatgtgggctggttgcagagcccagctctttgtcctgctcaggttccatttccaaaataattctgcttagttcttcaca

SEQ ID NO: 134890 - DNA, 1060 bp, Homo sapiens
tttaacagaagtcctggggatcactgtccatgggctggggaggaatccggccaccttttttagaaggcaggaaggtgccaggatcactgctcttactttggttgggctctaggtggcacagcttctgatgtaaagatcaaataacaatagggagatctggatgcagcctgaaggctcaccccagtgtcttgctgcaggtgtgcccagctgtgggaccaggaccccaggaaggaagggcattgttctgtccctgctgtgggagtctctcagggaagcagcatagcactcaggaaatcctgggcaccgtgaagggctgtgtatttattccttattccacaaacaataagcaagtccctgctgtgtgccaggcactgagtgggatcctgggagaaggattgatgtgttgtgggtcctgccatgtcctgcctgttgtgacagtccaccactgtagtggcatctgtgtccatctggagagtacatgttctgctaaggggggcagcagcccctgcaccatggcactgggcatttggtggcaggcctttggatttataagagaagccaaaaatctagaggtttttttgtgacattttaaaatttcacatctttaaatgttggcatttgattcaaaacttaaaaatgtcaacactgtgtgggctaaacaaaacatgaatgttgaccaaatacagctcatactctttagttaaagacctttatcttaaaggttggataaaacccagatgggcagagggcaataggcaaggtcttcctggggagggggcacctggacagaggggtggtggtgggaatctgcctgagcattttcagggcagctgggaactgggaagtgaggggcggaactgatggggccccgcccagtcatggaatccttgcatgccctggacgtgcagatgtgctgcaggcctgacccaggctgccctgagagcctccagctgtgtccatccctccagtcagcagcgtttacccaacaccgtcacataaatgaggctttggccaggcaggagctcaaggaagaagggtcatgagtatttaagagaaacct

SEQ ID NO: 134891 - DNA, 2208 bp, Homo sapiens
gctcccagtcaggtgggagaggtgcctgccacccctgatgaaactgtctctacctcaggttctccctgctgctcagaacaagggacagccaggaaccaggtccagggaggagtgtggtctgggctcaggggagccctggaggaagtggattgtaagctaagattgggaggaactctccccaccctggtttcacctgatgggtcttgcagcacctcctgctcagtaagcaaagaactggatgggaaagaactgacatctgtgcaatgcagacacttggagctgttgtttcatttagagtacagtgttttcccctagaggccctgtgtggatgaagacacagagctggttgaggattgggcccagggggtagggcggagaggagggtgcatggtgaagatttgtctacttaggctggtgagcccactcggggtggagcactggcttaaggcaccttggccctgcccactgctgctgggggaccttgatcaaggtacttcatcatcagtcaaatggggcagagagccctgcccacctcccagggcttctctgagagtctgcctgacagtctttctgccttgggagcagcagagcctgggcccatgttggggatgatgaggatgttgatggtaacgaggatagtgacagggacaacatgggggattgtttactgaggattccctcatgctggcgcttgaggtgacacaccctcactgtgtgctgtgtgccctgccgtcatggctccccactggaccctgcaccgagccctagacttgctcccctttcagtcagttctctgcccaggactcacttgttatgactcaggttccttcctgtggaccctgaatggggagcacctgactacctttccagttgcacttcccccacccctccccgttccctgccccacgagtgctccagcatacatctttgtccttgttccctcttcttctcttcctggaacattctttgttcagatacctgtgtggcttgctgccccacttcattcaagtgtgaatccaaccacccggtcaaacacagccccctcccatcctctagccaggacctggctctgcatttgtctctagctgttgagttcacctgatgttgttacatacttcgtgtacttttcccacactctagactgtacgccacatgcaagtagaacatttatgtcttgtaccctgatgtgtctctggcacctagaatcgggcctgacagaaagttggtgaatgaacaaacaaacatttaattgtaccccataatgtggacacattgctgtctacattttacagatggggaaactagactcaaagaagaggtggattgactagcccaatgtcatacagctgcagcgggacagaaccaggattttagcccagtgtctgtggcctctgagccctgtctcagccagtagacactcccacctccccagaatctaggatggacaggaatgggagggggcccaaaaaggtgggtaggattttaccctggggattgaggggtgaggccaaggagggggtgaaccatgagggtctgagagggccaggggcaggtcggggacttcagtgagggtcaggacagggaacccttgcaagacagtctctgaggagagcacccccggcaccagccactcccaaagaccagccgcctccaggcttcttgtgctggctttggttcctggcacgatttctgtttcccagaggagctcaggcctggcccggcttcccagggtggagaaacacatggtgagtgagtgtgtgtgcgcgcgtgtgtatgtgtgtgtgtgtccagccttgctgtttgcgttgtcgtcacgtcttcttaatcagcctatttctgggagcgatgacttcatctcctgtgattctcgacacagccattgtcaggcgtccatggaaagattgggcctggcagtgtccatattcccctaacgagccaggttgggagagccaattggcgggccctggtctgacctggctcgggggcttatggtcaggtctatctccaagagactccactgcccagggtcacccttagatttggcctctttgaccctggggtacccagtgcagcaaattccagccattgtttcctgtgtgcttcctctgtgtacgctctgctgtgggcagggggtaggggacagtcacgccaatctctgccctcaagggctcctgctgtctgacaatgcagatgagtcaacagacctca

SEQ ID NO: 134892 - DNA, 1068 bp, Homo sapiens
cccattttaccgaagaggaagctgagaccctaggagagaatttggggctgggcaggaggtgagcccaggtccccttaactttatgacaaaaccagccccagcatacccacctgccttcctgcagtaagggatggagggcagcagctcctccatgttctcctctgaagtcttgaaggagtccagccttgaggaggagggtgctccttacctctgctatcaagcggggtaggcctggcctctccatcaaagaaattataagtaaacaggtgggaggactctagcacaccattaattgctttacataggttgtcattaaatcagagatagtatatggatggctggtggccagatgtagcccacaaacaggtctcatttggcccgatggggtggaaagtttttgttttgtttgtttgtttaaaatcattcaccaacactagaacatttaccttaaacattcacctgaaaatctaggtttctggcttctattttaagacagatgtggcttcagtgggcctatattcctatagggcaaataattggtttcttcagttcacctcagactccttttctccctggaaggctcctcccagcaaccttgggaggtgtgtgggtgtgtgtggggttatagtgttcccattctgcagataaggagcctggggcccagaggggaccagctgggccactccacaaagctgttggtaaggtcaggacttgaacctccatcctcatctccacgctttgtggttctcactccacctcgctgcctcccagccatgtccaacccccactggccgccaaggaaagaaagaaacttttcacaggcctaatgactcaaaaataagcaacagtaagcctgaagaactgttcctatctccctcctctccctttccacccttcccgaggccagaagggacatgggaaacctattcatttaaactcaattattttctcgaagacagaacagaactgaattgggtcaacggctatatttgctgtgctcagctgttttcctgcaacagcatcacccgccgggtctgttgctgggccctgcactgccaggctcaccaa

SEQ ID NO: 134893 - DNA, 1041 bp, Homo sapiens
cacctccagggacctaggcttcaggtattagacatttaatgtccaacacctatctgtaggggaggtgcatctgcagcagagtttctgcagatgaggaaactaaggcttagagaaatgaagtgcttgtgggagaagcagaccttagagtcaggcacagctggcactttctagctgtgtgactgggagcaaagaacctgactgccttgctcctctgatcccacctgtaaaggaggcataatttgacatacctcacagggctgggctgtcctgttgtagatgggttgcagtgtacatgccagcagcctgcccagggttaaccctcctggcaatgagaagtgtgcaccatgtgccaggcacagaagttggtgggggcacagaagttgttggggacacagatctctgaagaaggatatgcttggacatcgttctctccagatacctttcctgattccctgctcccaaactggaaatgctcctgcagtctctctaggtcccctgttggtccaggccctgccctggacacttttcaccacatcttctgggcctacagcctgttatatatatttttttgtttggtcctaatatttgtgtaccttcccctctctactaaactgccagtttcctgaggacagaccgggtgtcttgttcacctgtttggctcctggtgtcacttccttcccagctgggtggccttggactggttgtttaacccggtgcacctgttttcacatctgtaaaatgggaacagtgatctctctccctctggcacatgtcacggcaaggaggttaatatcacacatggcagcactgtgccagatggctgacggaatggagtctagagaaacattgggaggaaaccaaagcagaggctgcccctctgccctccttgaagtagggagtatctaaggaggcgaggcatagtggttataaatgctgtcttgttatagaattgctgtctggttacatggggaagtgggaacagagtggtggccagtgggcctttccttgtctcctccagcttcttgctgcagagtgctgggc

SEQ ID NO: 134894 - DNA, 1353 bp, Homo sapiens
cgggttacagtacctggcattagatctcttcttttggggtctgggtgtagagcaggatctccctgcactaccccacgatattattgctgatctcagggttggggagtgtttagggaggcttgagttccctgacctttcaggaagcatgcatgtgaacttaggcctcggacctcgtgtagacatggtgtggtgatggctgggccctactctggtggggtggacgcaggacttggggactaagcagcaagtgacctagccacagacacagaaatggctctggtgggagcccagagtggcactggactctctggggggccagggctgaggggactgcccaggttgatcccggcgtcttgtacaatagaaccagcagtcacaggctcataaactgtaaccgtcctctttccgttgcctcttggtagcattcagcccctggcacactatgctgggtgttgcctagtacttggcactgtgacaaccaagaaagaaaaatgctgaccatgtctcactgcttgttcgagtaaatttactctatattttttagagatgtcgcatgggtgggaatttactcccactaaatgttttgatggaaacattacatttttggagtgaacatgtgtcaacatcactgtggagaaaaggttccaggattctctgccagccaaagtcatcaccataagacactggttgggggcctggcaggcggaggtgatgcgaccaggctggtagtggggcagaggtagccagatgggtaggagtctgcctggctggtctggagggagaaggggatctgagctgggggaactgaataggtggtgaggaggaagggagtagggaggctgtgggctgatgacatacattaaccacccacacagctcaaaactaggtgagtggggagcttgaggggcaggaacagcgagcagaggctctgaagtgttgaacactggcagctcagacccgagggacaggctggggccagattgttgagggtcctagaatcccagctcccaccagtaactagcgatgtgagcttgggcaacttttccaacctttctgtgcttctgcttcatttttagtaaaatgtagcatggatagccacagcttatggctctttggagaattaaaggagataatgtctgtaaaatacctagcgctgggcctggcacatagcaggtgccaggacacatttgctgtttgttggtgatgataaagccacacaagtatagatgtactcacataaattaacagctggtgcactgaaactacttcctgagttggccctcaatctaataccaagtttgttttctcaccttcagctaagtacaactggtctcttcagaagcccttgtggtc

SEQ ID NO: 134895 - DNA, 1150 bp, Homo sapiens
aagatattataacagtggggatgactcaacaaggggatgcttcttgcctgagggaaatctaggaaggcttccaggaggaaggactattcagattgaggagggaaatgagggggctagtaaaaggtgcaaaaacagttgtctaggggtgaggcacactttcagatgtagttgggtcaacttgagcaaatgacttagctattccagacttgatttcatctataaagtggtcacagtatctgccttgcctgtttgttgccatgatcatgaaatcagtgggagcagacctggcttggagcctgcaccctggagggaggtggtgctcagaggatgcactctgctttcgccttccttgttggtttggctgctctggagccaaagggggcttctctggccccaggacctctctgagactctatcttcacctctcccctgctaggaaattttattaagacattggataaacagatgacagctctgagggaaaacttctcagaaggaaggggacaggacactaagtgctcttctggctgggagccttttaggcagtagggggagctgggtagctcttggggctttggtggtgtggactgatgcaaatgtgggcagacggggtggtgttggatcgcctggcctgtgtgcacggcagagctgagcctggagcctagggcccagcaggggatggaatgagtcagggactttccaggttgggggctgctgctggggacacagtaaaacctcttcaccagtcctgcaataaccccagacagtatcctgcctgcctgtacacagtaggtgcctgacacagtctgcagcttagtaggagctcagtagttgtttgctaaaacagtggcgcaggctgcaactgccaaggactgacctggggtctgtgatgccttagggtggaggatgcgaggagctgggcaggacctaggtgggactccagggtgtggctcttgttctcccactggcttctgttcatatttacatcgggaggctgtgcagcctcgggttcctggcctcagctggattagcacctcttgctggtggctgtaagggaaggaggtgtgacggtatgataccctgcatgtggtagagactcagtaagtggataccattgcggtggcttctctggtgggatgggaaaaagggt

SEQ ID NO: 134896 - DNA, 1010 bp, Homo sapiens
agtgcccttctcagcttaggctgtctagacccaagtcggggtggggagtcgggttaggggatcatggtagacaaacccctggccttgtctggacctcagttgtgttcacttgttaaaatgttggaatggaaatgtggggaagggagagcgtttgccttggttgggtctctgggctgcgctggtctaagcccgacgaacccggggtggggccagcgggccaaactggaatgcgccgcgagagccgggccgcgggcaagtgaggggctggcggggccggtggggacccagactcgcacgaaggtggggaaggagttgcaaggcagagacccccgaacccctgctccagggcctgcgcgtcccgcccgcccggcgtgccgaagcgcagcggcgggtcgctagcgggaagtggctgcagctggaggcagctggccgcggaatgtcacccgctgccgggcctgggaagggctgggcctactgctgtggggtggggggcgggtgggagggcccggagggctggggctggggcgggccgcttccgggctggagagggtttggggcgtggcgcagcccgacgttagtccggaatgctctgggagcagcgctcgggggaggttaccttggcgcgcccccaaatcttttggttcccccgctcctgccttccactgctctggctgacctggctcagaccagcttgaaaaatgcattcattcattcagtacatctgtcgagtgtctactctgtgccaggctctggttcgaggtgtgctgggcttaccggggcgtgcaggtccctgttctcgtggaccggacattttcatgataggtaaaagacagaaacaaacaagatgacttcagggtagttctgtggagaaaatgaagcagggtgataacttgggaggtgggagttgcccctttagctagagagatcagggaaggcctcttcctgggacgggactttgggtctgagaccggaatgaggaggaaccagccttgcccacggaatggcaaata

SEQ ID NO: 134897 - DNA, 1066 bp, Homo sapiens
tggaggtggggaggtgggctggggggaagctttagggcacagctcagagaaggccaagcaggcaaggttgtggggcacctggaaggtgggtgtccagcggcctggctgctgacctaggctcagggaaccagcatttggtgggtgagctgtgaggaacgggccttgaccctaggctgcagggctaatgagggcctttagccagaggctcccagcacaggtgagggggaaactgccggtgcccctgtgccctcgcgctctcccagccctgcctctctgagacagatttaataatccatgtctgtctctctctctctcagttagtattgcaggagggaagctttacttctaaaacttttattgatccagacactaataaaagtaaagggtttttttttcttctttcctgctagagcaaagaacatcagacatcagagccctaaaacacaaatgtgttttcctcctccctagatctgggagggagttgtgggttggccttgttcagatctagcctcttcaagaagcctccctaacttctcaggcctgcagtcatccacctgttccagagcagttaaacgaaactgccacatgtgcctctgtctgaccccagaaggctgggctgtcacagaagctttccttcccacctgaggtccccagggttagggagagacgccatgggaggcattcaagacctggctcttgatttcttgtgtctctcagggtttggggtttggttctttggctgctctggtctttgtttttgcatcttgatttcatcaggacttactgagctcttatactgtgtcagaccctctcttaagacacagaaatacaacacgtagagcttggccacacacagcttaccttgtgatgggagaggcagataagaaataagcagagaaacaaagtgattctgctttgggaaacatagtgaagttcccctactgaaatgtgagtcagggaatttctgtctgctttgttcagcacctgtgttcccagtgcctaaatagtgcttggcacatagtttgcacttaaatatttgctagctgcatgagcaagatgctatgaa

SEQ ID NO: 134898 - DNA, 1091 bp, Homo sapiens
tctcatctggaagatgaaggaaaagatagacccgaccccacagggttctgaggctcaaactgaaagcctggtggtggggcacctgtgacaggtgagactcctcatcttgcccccttctttcttcatcatgaagaagagacactggaggatgtggagcagttggggcctgtggtccaggtgggatggagcagtcagggcctcgtggagggagcaggtgggaggaatactctggctgggatggacctcacggggtgtggcccagctttgcagctgacttgcatgaagtcctggcgagctggggagcccttgcaccctcagcttcctcatctgaaagatggggcaatggtaatgcctgtctgtggagtggtgaggaacaaatgagactgggccacaaagtacccagtgctgtgcccagcacatagtgcccaaagagggctgctatctcatctcttattcctgagatttagcttccttgttttgtttttgagctctttgggaccttcgtggactttgaatttttactattgttcattgtgtctaaaatcttcctcagaagccgagggcctctaacctgatcatgaattttggagtttcgttttttgttttttttttctttcctgtttcctgtataggaaaaagggacctgtacctttaagaccccagcaggcccaagtaggacactggccctttaaaagcacattacagagagttggaacatagcctttgttgaactagccatgattagtcccagcggacagggctggagtggcatgtctgggatcagggcggggctaggctggccggggccagccaggagcagcggacagcaggaaggctcgcccggccactcggcttcccgagcctggtggctatgctgagggatggtgagtggcctgagcggagcttagaataagagaggctgggaaagccaggagggaggcagccccagagcccagggagacctgaatgagctgggcggcagcagacaccctcagtgagtgactgtcacaggagctggtcccaggagggactccggagcaccctgcccctctacgcagacatccactgccggcccagaatgtagaaacggt

SEQ ID NO: 134899 - DNA, 1072 bp, Homo sapiens
cgggcttaggtagcgtagtgtgagctgtctgtctggagagaccagggaccactttgtggtggtgacattgggctggcccttgaaaactgaggaaggactttgtttggcaaagaagtggagggagaggcagaatggacaggctcaggagactgcttggacatggacccctggaggataagagtttgcagctttgtcaggaagtagctggggaggagagtccaggtcacttgtgcgaggggcctttcaggagggctcggacaccagcttgaggcatctgggacttgattatcttacaggccatgaggcgagagaggagggacaggagtgaggccatgccaggcggagtggcttgttcagtggagggtgctgctttggtctagacaggagaaggccagtggaactcccattcccctctgccctcccatgccctggccaagctcctctgtagcagcggagtccagggcaggtcaccctagccatggccttggctgtcccgtgtgtgacctggatgtcatggtgccacctccttcctgggagcagtaaggattccatgccatggaggacaggtaaagggtctctagtccctggagcgctgtcatggggctagtgatctgccatgtttagaagggtctcggctggggccgtggggagcagtgtgcagccacagagggtaggatgagcctcctaaccttgagagggatgggggaagcggcccatacttggacagagcaagggcaggggcatttcccggagactctggaatgaacattggaatgctgctcttgggacttggccttgaacaggcagctgccctgacgacccaccctcaggccttcttcgtccctcctccaagggaacaaccacgtcaccagggtttgcaggctgagggagggctatccctatccccactgacctcccgttccctctgagcttagctgaccttggctgctggtgtgttggggttttggtccaggaactctaaggctctggaccttggagccagccagacccaactttacccacaaggagccccctgcctgacaaggagccagttctgtgacagaccttccca

SEQ ID NO: 134900 - DNA, 1094 bp, Homo sapiens
cctgaatacaggggcatcagcccccagataccacaccacatagggtagctgtgggcatggctcctggactgacctggttcccatcccagcagggggccttgggcggctcaagtaactgctcctccctgagcctgtcatacctttctgtaaaatgggtagatgaatactcctggcagggctgtgtgctgttgaaatatgaaaaaagggatgtgcaagtgaccagctgggcgctcaccttgtgctgactagaggtgggtgcctacaggcatcccttcctgggagtggaatgggagtgaggtagagaccagtgcctgcttccctcctttcacctgagcgtcccgggtagggaagctgagcctatccctgcccctttggagcctgggcagtctttggtacccatcttctgccctgcctctaatgcgctgcttccctaggctggcaaggcagaggctggaggtgaaaaaggaagtggcccaacaatgccagcatgggatgaagccagggtaggggagaagcctgccttgggtgactgatggagcaagcagtccctgctgtgaagtggccagggactgctgcaagcacaggacagggctggcttcccagagaggtggttcttgggccttgaattggtcctgctgggttcaggaagtgaccaaatgaccatttttccttccttagccccctcatcttatcagctaccaccatgggcacaccctggcagggtcacagcagaccagctccctctgggcccagatgagggagggaccgaggacactgtgtttcagggcctgtagactccaggctggtcaggaaggaaacgcataggaacgtgagtgagagagtacgggtccactggccctgcctccaccacccacccgcttgctgtactatccaggaaggagtagcctgggagagcttgcgggaaccacttggggcctccctgggcctgccctgcccctattcctcttcctcccagagagcttgggctgcagggatggatgcagcctctgctttacatcccaccccgtggagaagctcccagggaagcggggagggtcatggctgcccaggtaggccgggccagtccaaggtgt

SEQ ID NO: 134901 - DNA, 1043 bp, Homo sapiens
gggaccatttctggttcaggactcctggccaagccaggcttgatctgggttctgacttccttgccagggatagggtgaagatggccctgtctgctggttcacagcagggggttctgtggagggtgcaggccctcgaatgccgtgtgaggagtgtgcttcccctgcagagacccgggtctgctgctggggacagtggaaacacacagcaggaattgcccggactggctcccttacctggcaggagatgtctaagctggaccagaggttgagtgagagtcagacagagagggaaggagaagggtcagggactggggaccctagggcctggcacatccagacagtccgagtctcatttctccagtctggcataaaaaatatcaggcttatattaccattgttgtcactgctgcttgacggaagagaaccctcagagttgtcagctgaggactgaggggattctggtacctacctttagttgtctccttggttcttgtggttccgcctttagggaaagtacgctcgggttaagcattgccctctgacctgggcaaggtcttcgttcattccctcttcccatctcagggagagggaggttagagttaggaagatgctttcctattggacagagggcactgagggacgagtgaggagcctgctcgtgcaggatggggccactctccggctgctgacttgccctgggacagtggctctcaagtgtaccacctgcaaaacatgaagtagaggcgtcatatgagccttgtcctggctccttcctgaagctgtgatgcagacctgatggccagagtcccctgagcctccaaggtcttcttccatcactgcctgcccttgctgtggtcccttccctcataacactgtcttgcctgctccccacaggtgacgacgtcatcaggaagcaagtgcttttcctgccggtctgcagctgagcgggataagtggatggagaacctccggcgagcggtgcatcccaacaaggtaagcctgcgcccctctcaccaaagcatgggggattgaaggtaggctca

SEQ ID NO: 134902 - DNA, 1023 bp, Homo sapiens
acttgagggcttgaccaagtcctggtcaccatagccatctcttaagttacagtacagaccagcatattaaggaagagttaataatggcatagcctgtgacgtgtcaggcgttgtgctggcctctctcagtctcgccctctatgagatgggggttttaccttagtgccgtttcatagacaagcaacccaaggctccagttaagttgcttgcccaaggtgagtgagcttctgtgaggtcgaccagagatccagcccttgtccatcatgccctgcctcatcctgacttagggcctaggcgcccgctgccgcctccaccttcagagctcctcctgggtctgaggactctctcaggctctgggctggttgggggttgcacgtggcacccccagctgaccaccctggacccccgtgcacatacaggacaacagccggcgtgtggagcacatcctgaagctgtgggtgatcgaggccaaggacctgccagccaagaagaagtacctgtgcgagctgtgcctggacgatgtgctctatgcccgcaccacgggcaagctcaagacggacaatgttttctggggcgagcacttcgagttccacaacttgccgcctctgcgcacggtcactgtccacctgtaccgggagaccgacaagaagaagaagaaggagcgcaacagttacctgggcctggtgagcctacctgctgcctcggtggccgggcggcagttcgtggagaagtggtacccggtggtgacgcccaaccccaagggcggcaagggccctggacccatgatccgcatcaaggcgcgctaccaaaccatcaccatcctgcccatggagatgtacaaagagttcgctgagcacatcaccaaccactacctggggctgtgtgcagccctcgagcccatcctcagtgccaagaccaaggaggagatggcatctgccctggtgcacatcctgcagagcacgggcaaggtgaaggtgcgtgcaggcccctcggctcctgacacaggctgggcggcagcactgg

SEQ ID NO: 134903 - DNA, 1054 bp, Homo sapiens
ctgcacagaaggcatctgtgtctggtgtgggagcccccaccagagtcataggtggatactgatggccattcttaccatgagacagggcagcctcatttgtcctctttggcactgatggtgcggggagaggcgagtcctgctgtggtcaccaggccaggcctgatcagggctgtacatggaaatgagtccattctctgtggtggtgggggcttgtggctccacgtggcatgctctcattcaggctgcctccatccatagacccggctctactgtcaccagttctaggctcctaccctggctgggggcccctgccctgcccacactccccagcagcccccaaaggtgggcacactgttcctctccgggacccccgcagcttggtgatggaacagcctcaaaatgccaggacttctctggctaggtctggaatcctagggccctccatgccaggccagctcaggtcctgctctctccacctcctgcctccccaggacttcctgacagacctgatgatgtcagaggtggaccgctgcggggacaacgagcacctcatcttccgggagaacacactggccaccaaggccattgaggagtacctcaagctagtgggccagaagtacctgcaggacgccctaggtagggagtgggccagcagcagggcagagggtggggcagggcccgccaggtcctcactccccactccctgcccacttgtccataggtgagttcatcaaagcgctgtatgagtcagatgagaactgcgaagtggatcccagcaagtgctcggccgctgacctcccagagcaccagggcaacctcaagatgtgctgcgagctggccttctgcaagatcatcaactcctactggtcagtgcggtgcccaggtctccccaccctgtcgccttccccatcctgtccttcagtgtctggcacccgcagtgtgcctgatgctgcctggcccctgagttgtactgacttgccagtcccctggcctagtcccttttgagctctcaggtggggcagcgttcagcatgttgctgtggttttgtgatgga

SEQ ID NO: 134904 - DNA, 1700 bp, Homo sapiens
gaggtggggagggcccagaccagaagctggagaggtggttcagcactggcccttggcagttaattccggttaggacggagagccagctcctcatgcctcctcccatcccacctgcccggcccttcactgagaacccactgcccgatgggagcctgggtctccctgctcctcctcctgcctgggcacttgctccagccaccctgtattgactgctctccccagatggctgtgtcctcagagctcagacagcggggctgacctcacgcagctggcggggtagagccaaggttggaatgcaggttcctgctctgtgcactcctgtcctgggcccctgcctgacagccaagcccacctttgtctgtccctacacagtgtcttcccacgggagttgaaagaggtgtttgcctcgtggaggcaggagtgcagcagtcgcggccgcccggacatcagtgagcggctcatcagcgcctccctcttcctgcgcttcctctgcccagccatcatgtcgccctcactcttcaacctgctgcaggagtaccctgatgaccgcactgcccgcaccctcaccctcatcgccaaggtcacccagaacctggccaactttgccaagtgagtgcctcctccctcaccaggcagagttgggcagggctggtgtccacagggcaggccctgggggtgtttctgcccccaagctgagcagagaccataaacaggccctggttttgtccctgtcatcctcagtccttctccttcccgctttttaaaaaataaaatctccacaccctgtccttctactcaaggtatatgtcattttggtatgtttcttaatttttaaaggtgacgacatgagacatttttttccttctgcttttttgaattaatgtattattataaggattctcacatatcccttaacattcattaagccctgttttgaaataaatgactaatattcctccaagggggactggcccatatttccttaatccattccctgtgcttgggcacttgggttgggcaccaccatcctggtgtcaggctatcaggatgtctttgctgataaagcactattggtgtttttggctgcatccttagagcaagtgggcagaagtagaagggctgggtcgtctcactgttgttcattctcaaaacatagattgagccccatcctggggccatctgtgtgctgggctctgacggcaccaagatgaatcagtcctggtggcgctcagcacttcagccagggagacgtgtggaatgagcaggagagcagtgatagacacacacgagcctcttaggagggctctcagcttgttgggagaggagacaggaaagcctccagggtgacatgatcccccaactgcatgtcagggtgaggcgttcattgtctcaagaggagcagaggctgggcatcccagggagggccatgcactgtgccaggtcaggagaagcgggcgatgagacctaagaggacagcagggacctgaaggccagacagggctgtgggagccaccagagggttttaaacaagggagaggatggccttcctctgttctggatcctgaaaagctcaccctgacagcagtgggcagatgggttggagggagcaggatggtagccaggagacgtgaaaggagagcatagctgtggttccagcaacaatagcagaaaattcgcagggaggggagcgggtacaggag

SEQ ID NO: 134905 - DNA, 1008 bp, Homo sapiens
ttcgaggaggcccctggtcggggagcctcctcaaaggataagctgaatgtggagagaggagggaagagagtgtctgggcagtgggagcagcgtgagcacaggcctggaggcaggaggtggcctggagggtgggcagcccatgcagaatacaaagctggggatgaggctggaccaatgacagctggctcccgacgggcctgagcctctacaaggagccataccatcttagtaagcactctcaggggcgctgagaagctggattggggggtgccaggaaagacagggaggaccccaatacagggtaagaaaagtgggaatgagtctcagttacgtatagtagatgaaggtggaagacacagcgtagcccccagattcctaccaagagtgtctgggtgtgggcgtatcagggtaccagttactgagctgggaactgttaagaggagtggtttgagtggggagggagagggggatggtgccagtctgatatcctgagttttaaggggcctgggttatctgggaaagggcttcagaggaacagcgggttttaatgctgactctcatctttttgaaggcttatgtcaggccccatgttggtgcctccatctctgtctctggctctgcctatgggtagggcatccctaccttggtgtcaggcagggagtacaatcaaccccagggtcccagtcgtggagtttacttccttctcagtaataccaggcacgggaggagagacagtgtgtcttgtttgaattggcctggtctaagaccccatcagctggacagaccaagcaggtgtgcaagagccaggaaggcctctgctccatgttttgtctatgacataagcccttcccagattcctcctatttagaccacctgtttctctgttcctgactgttgtttgctccatttacttgtagtttggttcattatgaaatagttaacatgagtgaaaccagggtggctagaaacctgctgttcacttgttctccagctctgctcttggctcac

SEQ ID NO: 134906 - DNA, 1028 bp, Homo sapiens
actcgtgcctcctgccttgtgaactccttgagggaaaggactagagttcattcatcttggcacctcgcgtacaactttgtgaagatggcgggggcagggtggaaaaagttctagagcctttcagggccttcgtctttccaccacctgcctagctctaggggtttgaagatctaatgcccatttccacccatcttggctcctggaagaacatcgggaaaggggcagcccgggggcctctggggctttaggagcagcgagtgtgggatgtggaggtgaggaaggaggcccagcagtgtcagttgctgggagtcggctggagggcctctgccccaggcaagtatgggaggcaagtctctgacccaaggaggggctctcctagtgtgtccctgctgtgtgcgggggtgatgggcttgttctcacaccctccccacctctgctgcctccagggccagtctgactgtctctgtctctggctataggttgatgtccgtggaggaagaactgaagaaggaccacgcagagatgcaagcggctgtggactccaaacagaagatcattgatgcccaggtgggggctccggccctttggtcagccacaagagttaaagggcctgggattaggaggggtgactagcctctccatcctcagtcatacctcactgcagacactgaggggaataagaaaccagaatctgccctgagaagtcagacctgtggtcttagtgggccacaagctcactaggacaggctgtgaaaggagagaggcagctcctcccctgccagggctcttggcgggcattgtctttcaccaggactgctgaccaaagagtggaagccaccaggagggcagtgggggtaggagtgaaggcaggctggtcagagggagcagtggggctctcgttcacaactatggcatccgggctgcattgaggggagacgtgaaaggctctgtggccccagcctcctttactcagggctgcaccgctttcctttcactcacccaggagtaggctgggccttgctcaggct

SEQ ID NO: 134907 - DNA, 1273 bp, Homo sapiens
agcaattgttaacctgcctgaggagggaggaagctacccaaggagagggggactatggtggccaagggcagggtctcggcctggggaggcacccacggttgcagccccagcgcgggtgtcaggaggccgagcctcccctccctgccgctgtccaggaggcggccgcagagggagccaccagagactgaagcagcgtgaggcgaggtcaccagccgctccctgtggggtgcgggcagaagagactgcacgctggggagtggggacagcctgatggggcagggggcctgccaaaaatatgtctgttggttcctgaatgtggtgtgtccttgtcctcctggatctggccgagtgcatgtgtccccccacacctgtgccagggagggggcttcctggaggggggattcaagggctaggggcctacacctgtggcttcccctcgcctccttggggggcccgggactccctggcagccaggccctgtcatgtgggacctggcacttggcagatcagttggcaggcaggaagataggaggacacagagcaggaggtcagtgtcccctgcctgtctccatccgaagcacctgccactgcatgcagcctgttgggaccttcctggctgtgaggaactgaggattcctacccacccaccccctctgaacctgtccccagagcaccacctgctaccttcttccctgccttagttgtattgccagatagacccagtgagggccatggctttttcttgtgagctcttgtccctgtggggaggacccacagcttcccacacctcccacacaggcccaggctgatgctctagggctcccagaagccagagatctgggcggatctggccagatggctctgagcactgtatctgccttctcctggggcccagcacacccagggcacagtggtcctgtagggagtgccacctggtgctcaccctgaaagaaaaggtgatccttcctctgagtgatggtttaaaaaaagattctaacgcctgcaggccctgagaaggtggataactgtgattttttttcctttcacagtatgcattagaaacaaaagcccgcttgctcgcttgctggaacacaggggccttttaagttgagcgtgcgcactgcatgggaaatagcggccctggaggatgttagacttgctccctctccaagacagcagcagcctgcacctgccccgtgtgtgtggccggcctcctcctcacccttcccggcccccggccaaggacccaggcgctgcatacaggggaggggcg

SEQ ID NO: 134908 - DNA, 1019 bp, Homo sapiens
taacctacaattcagttaggctagagacagatgctggtggaggaagggctgggccaccagggatcacagaccacaggaagatgggaggtggaagcagaggccctgcccccaccccttcctgtctcactcttctgtcttgtccccacccatgcgccttcgtgcctgagaccagggtggccacacaggcagggcctggctccagtctcatcctcccattgcccagtgagccctgctcttctctccccagccccctcccaccgctgcctcgtagagtgacctcggacagagcccccctagcaatacagggaggctcccggggcctggacaggcgggctcggaggctacccgctgtggccggtgccagctgcccttgcagggtgggtgagctctcaggccgagagccttatttacctagtgcaaaaactgtaaaagtgtacagactcttcacagatttttatcttaattgcaagtctgccgattttgtaaatgttcttggtgtttgactgtaatgtaactatctcacctaatggttgtacatatcctttggtcctggtgctgccgagggctggccgggactgctgctctcccaagggttttattttatttctgaatctagagaacagtattgggcaggaggaaaaggcttggtgtctgcggggggtgtcttccctgcctgtggcatttgtgtgttggctttgcagctgctgtctgagtagtggccactggggtgccttcactgggccagtcaacggggggctcctgcccaggccacagagaacctgagttcccgggagctgggccctgcctgcagccagggctggggttgccagaggccctggagggaaggacagtccctgctggggaagaacagccccggggccccctggtcaccgagactcagcctctgctggagaaagccacgccctccctgctagcacagaggcctgactgacttttttgcttaacttccatgttctgggtgatggaaactgccaaacctcctgtcagtgaggactctt

SEQ ID NO: 134909 - DNA, 1024 bp, Homo sapiens
ttcacaccattctcctgcctcagcctcccaagtagctgggactacaggcgcccaccaccacacccggctaattttttgtatttttagtagagacggggttttaccatgttagcgaggatggtctcgatctcctgacctcatgatttgcccacctcggcctcccaaagtgatgggattacaggcgtgagccaccacgcccagccagaaatatttctatttttaaaaattcctttctggattgtgtataatcactgcctaattaatatgtttggtaaatctggtaagttcttacatcatatctgtatttacagagaccctttgctgaccacctcctgcctttatcccacccctgaatcagaaagtgagacctccagcagaagcctttttacctttgacagttctcccaggtcaggccgcacccagcccagtttgtccagcacacactcgtcaaactttgcctgctgtttgcgacagtgacgaaataactgctggccagtataatcaatgcaagtccaatattctgtaaaaggctctgcacagtgacgttttatctgcctggaaaagaaagctgggttaggggcatctctttgcaaaacaatgaaaaacagaaaagtgagaaaaaaataggtacagatctcaaatacatagccttgctttttgaaaggtatgtgagtacatattcttatctcacttacaagacaacttcaggatcctcaagttgagaacaagttagtaaacaaaaaagatttctgaggtagaaaacctaatttctttatatagtaagaagaaaagagtgtagcctaatgcacgcctattttactcagagaggaactccttacttggggcctatttattcttttctttagatccaattcctctaagggtatcagcttagcaaatttagaagaggaggaggcataattaaataatggacatgctgatagaagtcaaacgtgacagacaatggcaaaggaagagacagaattataaaaagcaaatacacaaactaacaagcagaagatcc

SEQ ID NO: 134910 - DNA, 1048 bp, Homo sapiens
tgattacctttgcgtatagatcattttcatcagttaataattccttggcataaatttcctaacagtgagtttactctataaagggctttgaacatcattatggctcttgaactgtattgctttttttttttttttttttttttttttgtgatggggtgtcactctgtcgcccaggctggagtgcagtagcacgatcttggcttactgcaagctccgcctcccgggttcgcgccattctcctgcctcagcctcccgagtagctaggactatagggcacccagtaccacgcccagctaattttttgtatttttagtagagacggggtttcaccatggtctcaatctcctgatctcgtgatccacctgccttggcctcccaaagtgctgggattacaagcgtgagccaccgtgcccagcaaatgcttttgttttttaaatgttggatcaatttatgctgtcctcagcgctggattctggtatgcatagtatttaaatatttgggaggtgcaaatatttttggatgtttcaatttgcattgatttgattgccagcgagattgagtctgtgtgtgtgtttatttaaacaatttttcttttttttttgagacagagtctcactctgtcacccaggctgtagtgctgtggcgtgatctttgttcgctgcaacctctgcctcctgggttcaagcgattctcgtgcctcagccacctgagtagctgggattacgggtgtgtgccacctgcctggctaatttttgtatgtttagtagagatggggtttcgccatgttggccaggctggtcttgaactcctggcctcaagtgatccgcctaccttggcctcccaaggtgctgggattacaggcatgagccacagcatccagcctaaacaatttttattttctaagagaacttttgcaaagcattttttccatggtccagtggtagtacattttaagcggggaatgtttggatttcacaaattcccaaggtgaatccatagaggaatttctcactgctgaagttgctggttgtaggcattagtagataat

SEQ ID NO: 134911 - DNA, 1065 bp, Homo sapiens
atgtttaaaactggcagatagcacacacacacagtcaatgcacacacacatataagtatatatggaatgaatgcatcttagctttgctgcttattagatatggtccttgaaaaaattactcgggcaagtttgtgaaagtgcctggcacaaggtgtttcgcagaagcaaaaagccgtctttttccagtcacagctattcaaggtatagtaagtgaatcaaatgagccccttacctcccatctacatattccccgatatatttgctccctgtgtactccatggcgcctgtttttagcttccagctgttaggatccggagtctcagtggatacggcatcactatgacaacctggaggggtgggcggagccgaatcgaagccccaccccgctggaggctgaaaagttcttggtattgcgcacgctccctcgctcgtggttgggcagggcaatacgcctgcgtgttgccggatgcgcatgcgcaggcgccgtgtggcactcggcggtcgaaaggggagttcaaggagacgggggcgacgcggctgagggcttctcgtcggggtcggggctgcagccgtcatgccggggatagtggagctgcccactctagaggagctgaaagtagatgaggtgaggctatccggaggacaggcaagggagacatggggctgcggcttctcgggcctgggcctagccccccttgggctccgcggatcctgggacccgggcccccctccccagtcctccaacgcatatacaggtcgacccccggaggtcccctccgcagctttgggagtcgcctcccctctctaccccaccctgtcgcatcttgcagtggctctagaatcctccccctttcgccctccacagcgacctatttctccttccgtgaataatagtgatacattttattaagcaccaaccagtcattttacttagcttatgtcgcttaatcctcaaacttgcatgcgaggtgagtatacaaccctaggggctcacagtcgagggagacggtcatctaccttaaagtggtatcaccggtgcagagtgcatagagtggggtgacgaag

SEQ ID NO: 134912 - DNA, 1109 bp, Homo sapiens
tgagcctcagtttcctctggggaggctgcctgggagtccctgctgcggctgggaaatccaggggtggggaaagcagcgatgatgtgtcagcacacaaggagttaagcgctggtggagcccacttttgccacactgtgagcagcctggttgataattacagttctgaagtctccaggctattcgaatcagtgcagctgcaacctcttcagcagtaacccctgaaaccagacaaactgggtgtattgtgctgaaccagtcctcaggcccctccctgatcgttaaaaattgacagcaatggacttaacagccctcttcactacccctttcactctctacctggctgtacagccaccaatttgaatcacagatgcctcccctcccagcagctgctcaccaacccctccctccgcctcccctgcgcctctctgcggctcccctggccctgccacgccagggtgaggttgccgaagcacatttcatcaatatttaaaatggaattaaacctgcagctttgattaatgcctcccagatcctgggagttgtgattactattttgcaaattgcgattgttggaatatgttaatatgattgtctgagaatatcttcaccttctcagataatttctccccttttttggtaggagggggagagggaaaggagggagaaaaaagatgggggaaaaacaccccacaaactctttaatcaattgtaaattattacccttggcacaactgccagtggtgcagagagaaggaagatttctggtttggtgcatttatcttaaaaatttttggtccctgttggcccggtaattccactctgggacactattcttaaagggataatctatttgtctcggaactatttagaatcaggaaaaaggaaaatgtacatttctaaaaatgagggaatgattattttgttgtatatgcattcatttaacaaataattatgtgccaggcattgtgctagattcggggaggtggatactataagacacttgaggggatatttagcagctactgaaaataattgttaggaagtttgtatagcaacatgggggaaatgtttttgatgtgataataagcaaaagaaaaaaggcaagaaga

SEQ ID NO: 134913 - DNA, 1179 bp, Homo sapiens
tctagaacagcatggaaatctcgaagatgatggttgtgaattactgtagcagcaaaagcaaattggtctccacacctaaaatcgtctgcctgtgtactttgtagatgtgaatggtactattcaacggagcacaatcacatgttagcatttggtaacataatgtttttggatgttcttatggatgtttcttccctaaactatgtatggaattgagcatcatccagaataaatagcgttgtatcccaaattgtgatttgaaccctgggatgctctaattggctggttggtttggatttgtaactccagaaacattctatagtgtgccagagcaaaaggcaaatacacaaaatattatttaaatcaggaaactaaaaatattaacatctattaaaaaattgagcatttttctacgctcgtgtgtcttttacaacataaagaaaaagtaaaaggcagggagggaagtgagagacagattttaaatcatgttcagaactgttgttccagaatttactacggcaatccctccaactggactgaaaaagagaaagttcttggcaaaaaggagctgattctttgaacaaatgttgtagtaatctgtttaagaattatgcttattgtttcaaaatcccaactaggaaaacatggtgtatatcttaaaattgtttgtgttgacaaaactagaatcaaatttaacattttataccacaacacaagttctatttggaaattgaacttttattctatagcaaccatttttttcaaatctaaataaccatgccttctataataacaaatgttgctattatcatgggacttttaaaattacatttattgcatgggattgtttttatagcatgagaatgttctgtttggaattatatcatggtcagtctaaatagaaaaagcaaaatttctttgaaaacctaaacattgctatattggtcactatcaaacatacaattttctaataattgtgtagcggtctaagtggaagagattgcattatcttgtgcaggacgaggagaggacatgcagtgggcacagaaagtcaatggaacagatgccactgtggcaccaagactgtaatgactctgtgtggtaggtagttttaaaggactgcatgccttggaaatgattcttcacttggagaacatacttgcctctagatatgtttgtcac

SEQ ID NO: 134914 - DNA, 1079 bp, Homo sapiens
tgcgtttatgactgtctagcactctaatattactcgtcttgtttgtttatgttcactctgtggttgtaatattgaccattggctgggcgcggtggggttcaacgcctgtaatcccagcactttgggaggcagaggcgggcggatcacgaggtcaggagatcgagaccatcccggctaacacagtgaaaccctgtctcaactaaaaaagaaatacaaaaaattagctgggcatggtggtgggtgcctgtagtcccagctactcaggaggctgaggcaggagaatggcgtgaacccgggaggcggatggtgcctgtagtcccagctactcgggaggctgaggcaggagaatggcatgaacctgggaggcggagcttgcagtgagccgagatcgcgccgctgcactccagcctgggcgacagagcaagacgctgtctcaacaacagcaaaaaaatactgaccattttagggctatgttagatgccagaaatatttatatgactaaatacatcttggagattaggatttgagggagtgatgatgcattcttgtttatggaattagcagattccaaacttatgttctttccactatattctgattcctgtcaactatattatatgtaataatttcttacctatagaataagaatgttcagctaaatgatctgagcattacttctagctctagactgcatgagtctgtcttacataaccccttaaaactttgtgagggaagtggaacagatattattttccctattatataggaaatgaagagtgaagtgagttggcttagtatactgaagtaatgataatttccaccacctaatttagtgtttttttgcacaaatattctaatttttgaacagtcacaaccaaaagtatcctattttaaatcttaaaatgtaaggttttctttttcttggttgtgagacccaatctaactgtaagcataaacaatacctctgaatatcattataagtgccatccacaaagaagctgaaaaacttaatgacctcagacattatctattttctacactgtggttttctttctaaaagggataataccgactttctt

SEQ ID NO: 134915 - DNA, 1063 bp, Homo sapiens
tctccggtcaagcctaaaattctttgaaaatgtcagaggctttgttttcatgagttccacattgtcatgccaatgaaaggatctctaggattgcatacaaggtatagttataatgttgcttgagtgtgaggtgaggcactttgggaaatgggtgtgccagtgtgccagctggcacattagtgagcaaactgtcagagaaacccctgaaggatgttgggcaggttagcagtacatcagctacatgaagacatcaactccaccttgtttgagagttttatgcattcttacctttatataataaatgtatataatatgttcatataactgcccttgcctgagtattactatgtcccaggcacagagcaagatgcatcgctcatgttatttcactacctctctgaggtttagggaccacatggtctcagatgatgaaatataggttcagagaggtcaagcatatgcccagggtcacatggttaccagagctgggatgtgaactgagatctttctgactccaaagcccatgctttaagctagtataccacactacctttgcgggagcatataccagcagagattcattgctcattccaaaatatgagtgagtttggtgtgagtgcagatgcgaatgagttaaatttatttactcattccaaatcggcactggtatattttgagtgtaaaatgtcaactggatttttttacgtatgaaatctttcatctgtctttacaccaatctttgcagagaccagcccccctcccttgaggatttattgtggttttgatctgtgttgcctcaaaccattgaaatcttttcaaagaggcagagctgttttctttttattttttcttctttctttttttcctcctgcagtacagtggtaccaggagtggacatagtttgctattcagcttgatcaaagcactctacaccaatgtaacttcctgatcttactggtaacagaactaaatgtttccatgttctgccaagatgggttgccagttatcgacagagggcttgcatctggtaataattatttactaattctgtttaccttttgat

SEQ ID NO: 134916 - DNA, 1049 bp, Homo sapiens
attaattaattggaaagaagtcaggaagtgatagtaaaagttatagtaacaagaaatagcaaataaccagtttaaaatgtgcatgcatattaatttgatagatgaggaaactgaaagtcaaagtggggaaatgacctacacatttttaacccactaatttcacccagaacccatgttatcaaattgttaccctaagtattaccctaagtactctccctcctcccagtccccatccctgtccccaaactaccctcaaagccatttttccagaggaggcttttagccatcattcctggctgtcccaggctgccagcctgcaggtgttggagtactgctgggcaccatgccacaccccatgcaaggcagccacagggggcaaaagcatctcaaggctttgtggctagctgagtgaggagggaccaagctgtcattctgagtccagccactcttgcagtgtgtctggcagcccccaggtgttttgcttttctagctgaaaaaatgcacagctgttgctatggtgagagcctggccacctccctgcctgggaccaattgcactaaatcctttttagtttctaccctttttagtgcatttagttctcaattcctagccaaggcctgtggtctgcaaataaagatgtccaacagccgctatgctgctgagcatgcagatccttggcaccatgctgcagcccttaaagcctcctgcctaaggcttcctgctttcagtctcttttcgacataggaaggagactgtggcagctactaaactgtattgtgttttttcattcttggagtacatgtttatggcagaaaatttggaaaatatagaaaagcacaaaaaactttaataattattcacttagtgtgtttttcctgagaacttgatatgtgttaggtcctaggctggatgtgacagagatggacataaacaatacattgcctgtcttcccatcagtaaaatataaccactattaatattttgacaagtttccttccagtttttaaaaatacacaattttttgtttacatattttagagatcatttct

SEQ ID NO: 134917 - DNA, 1085 bp, Homo sapiens
cacagccggggaatcttctcctgccgccgtttggtggcaatagggagggagggggcgcttcccctgggggcctgatgtgggctaggctggagttccagagcagggcctggaaatgtcaggatgggtggtttatgttcacagaggtgggaacaggggtccccttgggggaaccctgaagccctggcacccagtgattcaggacggagctgcgacttaagtccatgcctctggcccctcattcccccatcaggggctagatgggggtcaggaggccaccctagcatggtctctgacctccatttctcacccacagtgaatccctgttgttactatccatgccagcaccagggcatctgtgtccgcttcggccttgaccgctaccagtgtgactgcacccgcacgggctattccggccccaactgcaccatccgtgagctgggccttcagccctcactccttccgtcttgagcccttctgctccccgggccctttctcctagaccctaacttcctaccctcctctctgaccatggccctgttctccttccttgcctggttctgcccctctccctgacctggcttcagcatgagctctcgctcttggtccaccctcactccctgcttctgagttccatggtgagtcttcaccacatgccctggcccctgtcctcacgcccggttctgtctctgtcatgtgtcattgctcccaaggttccatccttacccacttccccataggtgctactctgttccaccctggcccttgtcctcagtgccccatcttccaccctggctacttctggttctggtaggagggaccaactgagtgactgccattgcccctgcagctggcctgtggacctggctccggaattcactgcggcccagcccctctttcacccacttcctgctcactcacgggcgctggttctgggagtttgtcaatgccaccttcatccgagagatgctcatgcgcctggtactcacaggtgggtgtggggcagggccccctgacctgggggagcaagcaagcctgctagtccttttggattcttggcatctgataagggtagtgggtggggagag

SEQ ID NO: 134918 - DNA, 1500 bp, Homo sapiens
gccagttcctgtaacaggtgtggggacacagcagtgagtaatcaatacagacaaggttctgcccttatggagctcacactccagtggcagacaaacagaccataaataaggaaacgatgaaataagatatatacaaggtgagtgtgacttcccttctaaccccctctgctctgtcctcccctattgcgctctcaagaccagagacccaacagcagtgatctcagggcagacagccctccactccagctctgagacccttttctcaggacctctgtaggcagcagagagagaggacagaggggtaagatgaggggttgagggaaggttcttcatgatccacactttgggcttagtatttctcaggaagagctatggcccagaaacaacaggggaaactagagttcggtctgacagtccttggggttaagtctcctgtcttatggtccagaaactcctgtttctccttagttggctggaaactgctcccatcattccttctggcctctgctgaatgcagggaatgcaatccttccctgctcttgcagttgctctgacgtagaaagatccttcgggtgctggaagtctccatgaagagcttgtgtcctgtcctttcttgcagattctatttcccctcttctgctaatacctcttactttgcttgagaatcctctcctttcttattaatttcagtcttggtggttctatcaggggtgcattctggccaaggggtgggcctgtgaatcaatcctgggcaatcagacaccctctccttaaaaactggcccgtggagactgagatcactgactctgactcatccccacagctggctctgacaagatggtccatttgttcctgcttccgagatccccagggcagcctggatccctgcccttctcaagactttagcttttccttccatccggtggcctattccaggaattcctcttttgcttaaatcagttggagtttgtgtctgttgcttgtaatcaagcctttatggctgctgggctgagtgacacaagcactttaatggcctggagggacttttaatcagtgaagatgcaatcagacaagtgttttggaaagagcaccctcgagaagggtggatgacagggcagagcaggaaggacaggaagctggcagaacggaggaggctgcagccgtggtccaaccaggagctgatggcagctggggctaggggaagggctttgagggtggaaggatgggatgggttccagaggtattcctctcttaaatgcaagtgcctagattaggtagactttgcttagtattgacaactgcacatgaaagttttgcaaagggaaacaggctaaatgcaccaagaaagcttcttcagagtgaagaatcttaatgcttgtaatttaaacatttgttcctggagttttgatttggtggatgtgatggttggttttatttgtcagtttggttgggctatagcacacagttatttaatcaaacagtaatctaggtgtggctgtg

SEQ ID NO: 134919 - DNA, 1019 bp, Homo sapiens
ctgttctatagtatggtcagctaataatatatcagacctttttttatattattaaatattctacaactttttaaaaatgtctattaatattccatcgtatagatgtgatataatttgcttgatggttgtctcttaaaaagaaagatagcaaatactttttttaaattacaaaagtgatagatgttcattgtagaaaatgtaataaacactgttaagacttaaaagccatataattccaccaaccaaaattaatcccttttgtcatatttctagtcatttttatagcctttttttctatgtatttataataattatcatttgcgtttttttcctttttttaactttaaaaatgtatattctagggtcaggggaaatgtaatctggaattaaatattagccttaaaattcacaattttgattttcctggcttttcaggaattgactaactgtaaaagagtcttgaaagtatttagtcaacaaacagagtgcattttttttttttttgactaagaaagctcgttgtagtagaaagggtggaatgtattgaaaattattagaagcagggaagtattgttagtctagcttatttcctttcagtcttttttcaatatttttataaacattgagtacttactgaatttagttctgtgctcttccttatttagtgttgtatcataaatactttgatgtttcaaacattctaaataaataattttcagtggcttcataatatttcatcatttggatatataataatttatttaaccagtctctttatttttatttatttattttgtttgttttctttgagatggagtctcgctctgtcacccaggctggagtacaatagcgtgatctcggctcactgcaacctccacctcctgggttcaagcagttctcctgcctcagcctcctgagtagctgggactacaggcacatgccatcacgcctggctaatttttgtatttttactagagacggggtttcaccatgttggccagactggtctcaagctcctg

SEQ ID NO: 134920 - DNA, 1122 bp, Homo sapiens
tcaccaggaatgcccttcctgccctgctgatctataaggggggtgaattgatcggcaattttgttcgtgttactgaccagctgggggatgatttctttgctgtggaccttgaagcttttctccaggaatttggattactcccagaaaaggaagtcttggtgctgacatctgtgcgtaactctgccacgtgtcacagtgaggatagcgacctggaaatagattgaactgatagtctagttgcatagatttctcattgtttgggttggaatacacgtcattgtttatttttgttcctttgtcttctggcttttcagctgttctttgtagtcccttttattatgcataaaataaagaaattcttagattaaatcagaatgctgaataaccttgtagctagcaataaggtgacttacagttgtataaacaggaagccaggcttttgaactgtttacttaagattctgtggtgtgacatctctgttattgtttccagtcaatatttacaaagcatcctaaagacagggtcttggaaattgtcttcagatgatcttagaggtctctgccaagtctgagagtataattctgtaggtattgtgttatttgcaacgtaaatagtgcattttcttaatcaaatgattgtaaattatatttacttgtaatcagttccatagctttagacggtggttagattttttttttccccaccagggtcttgtttaaaggggtgagccaccgcacccagtcctgaggggtggcctctgctgctggatttcatgtcttcctccagcatgactaagtctggaacagcaggaagggttgatgcttactgacctggtgatgttagaagacaagtagtttatggatttaaacattagagctggagtggggctggaaatctttgtaaaggaagttctttcagtaagatgcccctgcttgtctttgtctcttttttgtttaacaaggtaactttttgtttaacaaggtaactttttgtttaacctagattttttttaaaactttttttttttttcatattggaaaagtaattcatattcagtagaggaaaactgaccaaaacagaagcaaaaataagaaaattaaaataatctctaatcctactacc

SEQ ID NO: 134921 - DNA, 5832 bp, Homo sapiens
atgccactgcactccagcctgggcgacggagggagactctgtctcaaaaataggaaaacaggacttttctagttacttctgatacttctagtgataaagacatgtctttgctagagactcctaaagtttgctgtagctttcattaaatatgtatagtcacccttaacagtttgcacttaaagctaatttgtttttaatgtcatttcttttttctcagggaggagcaaaaaacaattctgccggtaacttcttgctttagccagccactcccagtgtctattagcaatgcaagttgcctccccatcaccacatctgtcagtgctggcaacctcattctgaaaactcatgttatgtctgaagataaaaacgactttttaaaacctgttgcaaatgggaagatggttaacagctgaaaggaggttcatctttcaaatttgtgaccacaccatggaagcatttacactagctttttatatatataatatatattatataatgtatattttttttaaaaaaaagatattactgggggcatccatttcctgtggactctttgatacttcaagccctcttgcattagcattatgaaaaaaaaaaagaaaatttactttactagggtaacatgttcactttccagaaatgattggaatttggacaacatttaacttaagcttcaagcagctttttatgagtttgtagcaatccggtgcagtaactgagccatttcctattttaaatggcttctatagaaaattaacaactcagttattaaactagcaggatcctacaatgatacatctagtgaaagtagacttagttaacttatttatttctattttatgtttcactgagagaagtttccatctcattccagctgctttatttatctttttcatggaactttgcatggatttctttttctttttttaattttgaagagtggagttagatgttcttaccatagaattttacagggttatatactagcattctttactgcattatatgtaggagtgtggtgcagtgcttttatctgtagcatataatttttttttaattttccatttttcaagagtagtttctgctttgttaatatttatacacaggctacttgttgaagtaattaattaaaaatataaccaagtgcctaagtctttcagctgatgtactagatattaaattctcctaagttatgcagaatcgtttttacaattttgataaattatgcactaatgtaatggcagttttttaaaatgcagatttaagcctgtacattattgaatctgatgacttggcaaaagaatcaggtgctttcagctttcttgagaaaaccctgtatgtagcgtttgcactgactaacaagatggtattgctgggtttttaatttaaactaattaatttggttgttcattgcattatcttggttaaatattgtttattgttacttcatgttggggtttagtttttcttgttttttgactgttaggttgataagactatgaactgtgtaatagtagaacagtggctaacatttattcatacttaagaacatgaataatttctgccttgctaaaatgtgactgaaatggttttgacttggcatctgaaagtatacaatgtgttcaacaagtcatgcatcagatttgtgggaggtattgtactgaaacctaaatttcagtcaacatttgaaaagaagagctgggcattccttcctggtgatctttacctatagtttatctatctgtttttcttctgtttctttaagattagtttgacttttattattatttttttaattaacttctgtgaagttgtttactctgaaaattgtactggaatattttaagccaagctgatctttcaccaggtgtactgtatgtaagggcttttcctgctagcaagatgcttaaacaggatcatgttattggtcgtctgagctatttagttgttttacaaaaccacagcattgtatcagataagattttgataaaaagttttgtgcacatttccaggggcgggagggttgacatttccctgaaatttcttgattagaatgagtaaatactggtgtttgatacctgtcttaatgaacatgctcataaggtgactgataagttgtaaatatacctgagaaacaaaggggtagttttgatattctggtgtcagtatggaagatcttacacatttatttaatactcaaatgtatgaagatgtttgtttgtagcataacaacagcacagtagccttgacttagtttcctttggttagtactgtaccttttttgccatggccagtgctccccatccctatgaagacattttatttatttcactctgtaacctgaaatgaataggaacaagggttttaaaccatgttacattaacttttctgacattataaattagcctagaatattacaggaacatgattgttatataatttatatcagaacctttctataaatatgtgcttattacatttgaaatgcttccaatgtactttatttgctgtttgtaattccaaaaaggatatgcaaaccagtctgtctatttcatggatatttaatagtgagatcttccatgttgaaggtaatgtatttttttttaagattttaaaattgctattttgttacaaaatagagacctattaacagtttgagagctccttatgtgccctcagggaaagaaccctctgtgcaacagaactacacaaaacatcttcagcacgttctgagggtgaatatatactacataaattgatcttgtgtatttaaccttatctttttaattttaaaattgaaattttgaaacttggttgtgctctgctggagggggttgggataaactgcttagatgtttgcctacttgtccagtgaaattacatttgcatcagtatatgtatatacctgccaaccttattggtatgtctcagaacatttatattaaaataatgcttgtcttgcagcaggtgatcccataaaacaataactccctgttcttaaaaacttactctctttttcactaacaacataggaattgtttctgtgttgagattattctgtgttgcatccattctctatgtagtggtcaccttctgtctgtcatggtgggcttaatgtgaagtaaagccattggttctctgccactttcgaagaaagggcagttcatctgatccttcttcagaatggtacctactgatatcatcgaggaaaatgttacaaatcagacctaggatatgactttttaaaattgaggcatttcccgtcatttggcctttttaccaacaagatgtgatgtacaaatttggaatcaaaggatacaaagcaacaagagaggaaatgtgtaatgtgggtaaccaaactgcatatgttacctattgtctaatcagaaaaaatagtctgaggtctggaaagcaggaaagtggtggttattttctttcattttttgtgtttttgttttttaatttctaagttccattctgaaatccatgtgccgcattcagttactgtggttgtagcatcagtttttttgtggtttcatttcattttatgaattcagaggaagttacatatatattttttctagttggtacctgaacaaagcagattcccttgcctttgctgccacgtcttattttcaatgccatgtgataaaccagtgtcatacatgaaagttgtgcattgtaattttcaaaaaaaagggagttcattaggccagtggcactgatttttccttcccatcatagctatttattctagtaagaggataataaaagaaatttcctatacaagaactgaaattttccatttgtatggatctagtcactttcagatttcaatttgaggttaagtatataaagcacatcccaattttatatgctgccttgagaaaattacaggatgcacggcaatttgtaggaatttcaaatgggatcatttaaacatttgaaaaattattttaaaaaccatctagtttgcttttggattttagacattaaagcctatgttgtcttgttaacaggggtggaatgtataaccatcagattcagcatgtgatttcacctttgaatctgagtatttcttccctatcttctttgagtcatttttggagcagactgtcaccagtattgataactaagcattaaagggaaaagttgcattgcaactatgcattggtttcctggaagaacttttcttttgttttagtgaatgaagaggcttgatgggatcacttactgtaactccttctacataaggaccccttctgcaagcagaacacaaaagaacatgctcaaggagtatcccattttctggataaattgaagaagtttgctagtaatgtctttatactagcgtcttccttgtatccctttgctggcaagggaatacaaggcgtcaagaccacagatcaaaacaccccacatttgagtggagtcttatttttactccaagagcagttattcccttctagtctaaaattggcagttttttcttttttttaataaaatttttaaaatattcccaaaccagtggaacacagacactggctgcacttagtactgccaaaagccaaggtcatttgcacatattccatcaacctgtcgagaattaggcctcactttataacccaaggcatggaagtgcatgcattctcttagctgggcaaacaattatactgtagttgtgatacaacacatgtggcttttatttgtactgcacatatccactgtacagccacttgggagtatcgtggttagcttgcagcaactgctgtctgcatttatactgtttattgcatattcttttccctggaagtgaaagagaaatgtttttcttgttgcattgattacattttataaatttgcttagctggaaagtttgggaaaagaggcctgtttgtcaattgtacaaccgattgtgaagctctagtgtgaatatttttacgtctgtattagacattttctttgcaaatctattgttcgattgaaatgtaaatgaaattaaagatggtgtacacccatcatgtaaaaagcaggcaccatctctaagatggatttaatgctcatttttaaggcatatactcagcttctatttaaaactataatttaaaataattctgtacaatgaaatggggaatatatatgggaataaattctattccatttatttcaatttgaatttccaaattgtaatgtttccctttgtgctataggaataggattaaatgggggaagactaggatttataaggcctgtatatggggggagggcagagatggaacaatgagggttgtgatgatagtgaatagcaaagagtgaattctgtgtgtttttgctgtagcactgaagtgaagagatattagctttggctgttcacaaaatagagcatcatgattttcagtgtttgagagaaaattgatggaaaaagtttgcagtacttgacatgtatttgcatgcacaaaataaaattatttgtccaccttaaaagttgtttgtttaatgtcaatattaagtttatggtatgttttagttatctagattttcttggcatagtttttggcttaacagagctaccaggtcactccttgagatttaaatgattgcatgcctcatctatatatcataaggaaggatttgaaagaaatgaatagacccaaggaggttgagatataccttaattctgtcaagtcacttccttcattcaacacagcactttctgggtgggagatgaggatgtagatagtactgagtttactgtctagtggagaaagtaggacagatgcataactaatacaaagcaatgtatcatagaagtttgaagacaattctgtggac

SEQ ID NO: 134922 - DNA, 1004 bp, Homo sapiens
agcacactatgttgaaaggtaacgttcttcttaattctatatgattctccattctcagacttgtatgtatcttaagggtacacattctacccccagttcatgaaatgtgctttgcttgttgtctgagctatataacaaatttctgaaaaatatttgcatttaaatttggaacgatgagtgaagttttcagggttgatctgtcacataaaacatatggttattactgcttttgttgcttcattcacttcacttttattacaataaacatatttctctttaaagggacagattcattgttactgatttatctggtcatagaaagcattccagtactggggaccttttgagccttgaacttcagcaggtaggctctgtaactcagctataaatttttgagaaatagaatgacagttgaaagctatagttggaagctaacttttctttttttccctcctcatataggccaagagcaactcattacttcttcagagagaggccaatgctttggccatgcaacagaagtggaattccctggatgaaggccgtcaccttaccttaaaccttttaagcaaggaaattgaactaagaaatggagaggtaaagaaactgaacctttcggcttcatgcttaatgtatttgttttctgctgctgcatcttggttataccattactgagtgcattttggtgtgcctatctctgatggatgattgattgcttttaaaacttataacagaaataaaattgtaatcccagatttcttaaataattctttaactagatcatcgggatttttgtttttttgagatggaatcttgctctatcgcctggagtgcaatggcacgatcttggctcactgcagcctctggctctcaggttcaagcgattctcctgcctcagcttcccgagtagctgggattacaggcacccaccaccatgcccagctaatttttgtgtttttagtagagacagggtttcaccatgttggctaagctggtcttgaact

SEQ ID NO: 134923 - DNA, 1073 bp, Homo sapiens
tttatttttttttaaccagttctcagagagtgtgagtggtacaaaatttgaagaagatcatctttcccattattctccctggtcttgtggcaccataggctcctgtataaatgccattgattcagagcccaaagatgtcattgctaattcaaatgctgtgttaatggtatgattttgctggggttgcaggggttggaggtgagagatgatgcatgttcactcatgttgtagaatgaatgttttctattcattcattcatattgttgccttataactcagtagcagcagggttatatttaggtaagtctgaaataaattatatttaatatttaagttatttgaacattggtggtttactggtagtttgttggattatcgttgagtctagagctagttttaaattaaccaaaaaacctaattacatgtcttttgatagcatatatttactagctgaagtaattgccaacagtccttttattgattttctttggtttacataggacctggacagtggtgatgttaagagaagagtacatttatttgaaacccagagaaggacaaaagaagaagatccaataattccctttagtgatggacccatcatctcaaaatggggtgcgatttccagatcttcccgtacaggttaccataccacagatcctgtccaggccactgcttcccaaggaagtgcgactaagcccatcagtgtatcaggtaatccatttagataatacctagcctgatatgttctaagcactatgccttttttttttttttttttaattgagacagagtctcactctgttgcccagactggaatgcagtggtgtgatcttggctcactgcaacctccatcctgggttcaagcgattctcctgcctcagcctcccaagtagctgggattatagacatgcaccaccatgcctggctaatttttgtatttttagtagagagtattttgtattttagtttcgccatgttggccaggctggtctggaactcctggcctcatgtgatccacccgcctcagcctcgcaaagtgctgggattacatatgtgagccactgtgcctg

SEQ ID NO: 134924 - DNA, 2564 bp, Homo sapiens
aagctttataaagcagggtaaggtaaggttcaaagcttattatattttcctacattaagggctgccttagatttaagccattataaaatgttggattgtactaagattacattaaatattcctctttccaattttcaaggatactatccaccacctccaacggtaccagctggtgtggctccctgtgttcctcgctttgtgaggtccaataacgttccagagtcctccctcccacctgcttccatgccatatgccgatcattacagtacattttcccctcgagatcgaatgaattcttctccttaccagcctcctcctccgcagccgtatggaccagttcctccagtaccttctggaatgtatgctcctgtgtacgacagcaggcgcatctggcgcccacctatgtaccaacgagatgacattattagaagcaattctttacctccaatggatgtgatgcactcatctgtctatcagacatctttgcgggaaagatataactcattagatggatattattcggtggcttgtcagccaccaagtgagccaaggacaactgtgcctttaccaagggtaagtgaagatgctactataatgtagtcattaacagcccagtgtctggagtcaaaccacccaggtatatatcctggctcctccacttactaattgtgtgacttaaggaagttacttgacctccctatgcctcagttctttcattcctttgatggaaataatagtagtacctacctcataaggctgttgtgagaattaaatcagaaaatcaaacctcttagaactgggcctcatacatgttaatgctcaataaatgttatatttggataggaaattgttgggaaagtagaaagaaatcttaaaaatacaaggttaggaccttttttcagtatcaccacatacatacaaatgacttccctaagcaagaaaagtgagtgctcagattctgcgtttaacatcagttgaataaatattaacctttttattttaagtgtatggagaatagactagggtgactttccctgctgtatttttttatcccaacaatatcataaactgtttacatcattttcacacagttaaatttattcaccactccctagatgattaagattgtttcttttatcccccattaggaaccttgtggtcatttgaagaccagttgcgaggagcagataagaagaaagccagatcagtgggcacagtaccacactcagaaagcacctcttgtctcttcaactcttcctgtggcaacacagtcaccaacaccaccttctcctctgttcagtgtagactttcgtgcggatgtaagaaaggttttaattacttaatgttgcagggataggtcaaacagctgacttcaaattactcattcaaaccaggaatagctatgttggatatttgcagtggtttggtgtgcaattgagtttagttcaataaacactgaatataaatgcactacggctaggtgttatgagactctgaagaccgttaaggcatagtcctttactaagaattcaaaatctttcctatagtataattattttatggttgttttattaatagtgtgatttatatctatcatttattgagcacctactcatgccagcactgtattagtacatttgcataaagctattttatttaattctcacaaaaaccttagggggcaggtattttccatattttacagggtaggaatcttacagaagttaagtaatttgcccaagatctttcagctgtaaatagctgggatatgaatcctgggctgtctgaggtatttcttccctacttaacaagaagtgcagaaatacctacagtattatttatgctctttacatcactgctaattattgttcttggcattaccaaacaagtttgtgtaccaggatgattttaatttaatctggtgttttcagtactgttatatttggagaaaaccattaatttcttttttaagtttcttctggtttattccccatccccagaagttctgatattaaaatttttaaaatcttttcattataaaaaatttcaaacatatacaagtatagagagaataatatgataaactccatgtacccaacacccaggttccacggttatcaactcagtcagtactgtcttatttataccccctcttccccctggattgttttgaagtaatcctaggcattatattttttaacccataaatatttcaataaagcattgaatttttaaactagatccaaataggtcttgtcaaacttagacttcttcaaagcaggtaaatatcttgacaacagagtgacagagctgccacttgcttgctagatgccacttgcttgctagatgccacttgtattttcttttttgatatacaattatgcttcaggaaatgagtatttccctgagactccgatctgctgagttcgacttgagaaaagttttttaacttttttgcccttgagtttttttatctgaataattagtaaactagatttaatgattcttataactttagtattctggtcctataagtattccttattcacagtccctttaaaatt

SEQ ID NO: 134925 - DNA, 1685 bp, Homo sapiens
ccttttacagtttggtaacaacagaaaatggcttcagctcttgcataccttttctctttactctgtgttctcaaccaaatttgttgccagttcctgtcatttttacataacatcccttatattctagttatacaaaattttcaaatggtctctttccactccctcaaaaggtttttttgaatacattcttggacaaagtggcatgaggggaaaaaaaaatacatataaactcggcttgctatattaattacatgtatattatatgtgaatggcatatatattttcatgtggcatctgttgcagtagaatttgatatagactgtatttgattatttagctgaagaaactttttgtcaaaactgtttcctcctttttcaatctattcccattgcccattgccattttttgtcttgagtaagatttagtgaaatattcaccaatctgttgattgtttttgaaacaggtatcgattaaggaacaaaaagatcaatgccactgtaagaacgtttcctcttctaaataaagttggtgtaaacaacactgtcacaaccacagccggaaatgtcatttctgtcataggaagtactgaaacaacagggaaaattgttccaagtacaaacggaatttcaaatgcagaaaacagtgtttcccagctaatctcacgtagtactgacagtaccttaagagctctggagaccgtgaagaaagtgggaaaggttggcgctaatggtcagaatgctgctgggccctctgcagattctgtaactgaaaagtaggtattaggtaaaaatgattactggaaattctttttcctttttagaaatgcctgagtgtttttatttctgctgatgaataccggttaatcagaatttttatgcagaatattttgtgatgtagaagaaacactaaatactaaaaaatttgagttctagtttggttctgcaactgaatagccctgtgaacttggaaagtgggaaagtgactttaactctgagttttgttttcctcaactctcccaaagagactggaccagaattgtttttttttcacaccttattttcttgaactgtagtgttgattccatagaggtgccagaaaagaactaaatagaaacctaagcaggtaaaatgctgagcctctagctctgtttcagtcagagcgctttcactttatactctgtaatgaggtgtagcacttggccgggtgcagtggttcacacctgtaatcccagcacttttggaggctgaggcatgcagatcatgaggtctggagatcgagaccatcctggctgacatggtgaaaccccatctctactaaaaatacaaaaaaaaaattagccgggcatggtggcgggcatatgtagtcccagctactcaggaggctgaggtaggagaatggcatgaacccaggaggcggagcttgcagtgaacccagatcgtgctactgcaatccagcctgggcaacagagtgagacactgtctcaaaaaaaaaaaaaggaggggactctttggagccacactctctgggctttcaagttctggctcatggtttcccagctgtttgatcttaggccagttacttaatctgtctaccttagtttactccttcataaaactagaattataatggtgtcaacttcatatgttggttgcgaggattaagtgaattaatactccagtatgcct

SEQ ID NO: 134926 - DNA, 1776 bp, Homo sapiens
tgttttcatcctaggctcataagaataagaatgtcttagattttgatgcaaattgtagaagtaatagtgaaattttaatattctgcctcattgtatgaactcaaatagtttaagcctgagagttgcaccctcaagctgacaagtgaattggtaatttttcacttctaggtggaattgtattctaccttttctgagaaagtttaagtagacaaagcttttggtttttttttaatgctttttaaaattgtttgattttggtagcagaattttaagacagcaataaattgatgaaaaaatattttctttttctgggcattctgttaactaatgaataaatggacataacatttgaaccagtttcgaataatcttcagaaggaatatctgaagtgccaattcagggttatgtcacataactcacaacaggaaacaatggaatattagttgtttcagcacaagaattacttgtctaatgtgaaaaagaattaaaggtgtaattataaagttctgaacttcctagagtgaataacaaatggaatcttcaccttgccactcattgaatgtgttcccatttttgtagcctcagccaaacagcaaatacaagactagcatgtgccgagatttgcgacagcaagggggttgtccacgaggaacaaattgtacatttgcccattctcaggaagagcttgaaaagtaagtgttgagaattctgtttcatatgggtttaatttttgatttttatgggaatgttatatacagtcctgaagtttgtgatgactttcaaaaatgcaagttaagggctgggcaccatagctcatgcctgtagtcccagcagtttgcggggctgaggcaggaggattgcttgtgctcaggagtttgagaccagcctgggcaagataaggagacccccgtctctacaaaaaatttaaaaattagctgtgtggcccacagttgtggtcccagctgctcaaaagactgaagtggaaggattgcttgaaccccataggtcaaggctgcagtgagtgtgttcacaccactgcactccagcctgagggacacagcaagactctgcctcacaacaaaacatataagatctgggtacaagatttacataagtgatttagaactttactcagtggtcatattttgagaccattttatagctggaatccatatttatactgagcacctgtgcagaatgaaaatacttgcagtcttatttgctcagattcagttaaacctagcagcaaagtctcaggcaaaatggtaaagcagatatatatcctttttacggcttttggtctttttaacattctttttccctgtgtattctttctcttctcctatggttaacccctttttctatgtccctttacccgagacctaaaagttaatgtatgtaaggtttaatactattatccaatttttgttgttttgttttttaactaagactttcatttttgagacctcaccaaaaaattgatcccagcttttctactttctgctggccagtgtatcaactttttttttttttttgaggtggagtcttgctctgtcgcccagggtggagtgcagtggcatgatcttggctcactgcaacctctgcctcccctgttcaaacgatactcctgcctcagcctcccgagtagctggaaccacaggcgcccaccaccatgcctggccaatttttgtatttttagtagagacagggtttcaccatgttcaccaggcgggtctcaaactcctgacctcaagcgatctgcctgccttggcctcc

SEQ ID NO: 134927 - DNA, 1064 bp, Homo sapiens
aaagagatgaagactcttccctaatgcagctgaaggaggaatttcggagttatgaagcattacgcagagaacatgatgcccaaattgttcatattgccatggaagcaggactccgtatttcacctgaacagtggtcctctcttttgtatggtgatttggctcataaatcacacatgcagtctatcattgataaggtttgtgaaattagagatgctgatgttctatcattgctgttacattgaagagtattagaatattctaaagagtctatacacaaacagttggagattcctatgtttttaaatgtcagactcttataaattatccttattttctttttatttttctacttgcaaaataaagggatgcaacagggaaacaaatacatgatactagcataaaagcagtgaggcttacaaagtctcaaatttatctatattctgacctcagagagttaatacagcttataagttttctaagtgtctaatgatgaatttcatagggcagattctgaggtgaaaatttaattcatcactgatactcctactgtggaatctgaagacacttgaaaacgtattaaatatgttgataaattgaaagtatttgagtataaatgtgtcataagaaccaaagtaaaaagcattctcatttctgtttgttagctacagtctccagagtcatttgcaaagagtgtccaggaattgacaattgttttgcaacgaacaggtgacccagctaacttaaatagactgaggcctcatttagagcttcttgcaaacatagaccctaatccaggtatgtgggaatatgctcagttgcttatatttttttctacttttgaggtgaataacacaagagaattactgctaacattcttcccccccaacccccatgcccttggtggcttattttagacgctgtttcaccaacttgggagcagctggaaaatgcaatggtagctgttaaaacagtagttcatggccttgtggacttcatacaaaattatagtagaaaaggccatgagacccctcaggtaagtacatttattacatttctgactgctg

SEQ ID NO: 134928 - DNA, 1071 bp, Homo sapiens
tgaagatgtcagtaacggaaagaacataaggaaatcatttggtaaacttgactcttatcaagtaaaagtggactgcagaagcctcatttctttacatttagtgtcttgaaatcagactatattggaaacttcataaggagtatgtaaactttgtaacccattattatgtttgttatctcattctctgtagtgattagattaacacctttaatctgaaaatggcctacatgttatctcagatacaaccaggaaatggaaagttgaggagattggcccactctgcttttagatgttgttttttgtttagtggaaagggtagagaagaaccccaagatattttaaaatgtagtttcattgtctaatagtctagcgggtagtgacagatactgaaagcaagctgaatccttaaagtgtttttatgatccaagagtgtaggttgctggctgggtcttgagaaaggctcatgtacttggaaatagaaaggcctattggcttctatgaaagtaaaacatttaaatttgaaaccaaagcttatttaggttattttgttggttttatagcccccaagagtgaaaatagtacagacagaaaaatgtttctttggcagaacacttagtttgagataacaggtagttgataatagaaatgtgttgaagtgaattcatttaactccactaatgaggcttggacactagctgcctcatagtcatagtgtttagtttcatgctcttagggcaacaattgaaattaatctctggttccacacacaacctcactaggccctgtaaaactctgtatcttttgaatgtgtagttttttttactacttaagtagaaattaaagctatgtaaataccctgatgataatttctctggtagcagaacatttcttcttttcattttttttttaaagcaacagacttttgctctgttgcttaggctggagtgcagtggtgccatcatagttcactgcagccttgaactcctgggcgtaggccatcctcctgcctcagcctccctagaaaatttcttaattatcatgtggtagtggtaatatatgcctacctattag

SEQ ID NO: 134929 - DNA, 1111 bp, Homo sapiens
aatatttgtattttagatggatgaaataacagcatacttgttcttattctgtaatgatggaaatgttcaagtaaagagggaaaatttgataatgtgggagaggggagaattgctggagcaatattcttacataggtacataggagtagaatctaagagcttaccattaagcagtattctaaatgtcttatatacaattaaaaaatagagtcatttttacttttaggttaaactgctaaagtagctaaaaattaggcttcttattactatagaataataacaaacagagacagaatactgttagaaaaatgaaagcacattacaagggactcattaggaattgtggcttaatcgttaaatgcagataatgaaaattgacttttattttttattgaaaaaactttagctccctttgtttcccttttcctaaaggtgtagctagcttgaaccagagtgcactgagccgtccaatgcaaaggaaactggtgacacttgtaaactgtcaactggtggaggaagaaggtcgtgtaagagccatgcgagcagctcgttcccttggagaaagaactgtaacagaactgatattacagcaccagaaccctcagcagttgtctgccaatctatgggccgctgtcagggctcgaggatgccagtttttagggccaggtaagataggttactatcttaccttttttattagctattggggcttgaggatgccaatttctggagctcggtgaatcctgagactcaacccgtctttatatgtacaaatcttgatataattaaagataaatttgtttttgttgttgttgttattgctgttttgttttgtttgagacagggtctcactctgtcacccaggctggagtgcagtggcgcagtcttggctcactgcagcctcgacatccatgctcaagcaattctcctgactcagccccctaagtagctgggactacaggcacacgccatcatacccggctaatttttctattttttgtacagacagggttccaccatgttggccagactggtctggaactcctgacctcaggtgatctgcctgccccagcctcccaaagttctaggattacaggcgtgagccactgcac

SEQ ID NO: 134930 - DNA, 1843 bp, Homo sapiens
agtcttgctctgtcgcccaggctggagtgcagtggcgcgatctcggctcactgcaagctctgcctcccaggttcacggcattctcctgcctcagcctctggagtaactgggactacaggtgcccgccaccacgcccggctaattttttgtatttttagtagatacagggtttcaccgtgttagccaggatggtctcgatctcctgacctcgtgatccgcctgcctcggcctcccaaagtgcgggattccaagtgtgagccaccgcacctggcctgtattgaacttttatagcggcactacaaaatacagattttcatcttcattttgcagatatggaaattatgacttggagcagttaagtaatttactcaaggtcattcatagaagtagcagagctgcaatttttacccaagttttgacctttgaatgagaacactctgtcttaataatgcttatcttaagtaaataatatagtaaaaaggtgataagtgctttggggaaaaaaaaacaactgtgtctttttttctccactctttaattttgaaattctttcagacttacaaaaaagttgcaaaaaatactattcagagaacttgtataactttccacagcttaacctaatgttaacatccaacaccaagaaattagcatcgatacaatactgttaactttctgcttcttttcttccttcattaatccacacagctcctgctgttaagtatgttattttttgctgttgctgttattgttgttattttgagatggagtctcactctgtcacccagactggagtgcactggtgcgatctcagctcactgcaacctcagcctcccgggttcaagagattctcctgcctcagcctcctgagtagctagaatcacaggcatccaccaccacacctggctaatttttgtagtttttagtagagatggagtttcaccatgttggccaggctggtctcaaactcctaacttaagttaatctgctggcttggcctcccaaagtgctgggattacgggcatgagccaccatgcccggccttatttttggtttgtggaaagcagtttggctaggtgtttgactttaattttacttaaatggctttcatgtattatctatgcatgataattttatactcaccaagattattatcaagtacataaataatagttgcatgagctggatgaatgtatttctgcaatattcctttttttttttttttaaggtaccagatcatcagtcaattaagttaagtaatctaggtgagaataaacactatgaggttgcaaagaaatgcgttgaggatttggcactctacttaaaaccactaagtggaggtaaaggtaagttcataaaatgcatttttactgataagtaggacttggtagtacatttactttgaatgacttgatgtggataccctattaagttatggaaaaggagtttgcttgagaaatgccttgaaaaatgtatagactgagaaaattatgttgtcctattttctgaaaataaccaatattgttattaagaattcaagctagagccgggcgcggtggctcacccctgtaatcccagcactttgggaggccagcgcgggcggatcacaagatcagaagatcgagactatcctggctaacacggtgaaaccccgtctctactaaaaatacaaaaaattagccgggcgtcttggcaggcacctgtagttccagctattccggaggctgaggcaggagaatggcgtgaacccgggaggcagagcttgcagtgagccgagatggtgccactgcactccagcctggggcgacagagcaagactgtctcaaaaaaaaaagaattcaagctg

SEQ ID NO: 134931 - DNA, 1047 bp, Homo sapiens
taaagttttttttttttttttttaactcatcagctattgttagtgttagtgtatcttatgtgtggcccaagacaattcttccagtatggcccacggaagccaaaagacacctctgagctatgtgatgctttagttgaacattaggggggaaaaaaaaaagaacatgtgctatagaattcatgtttgtaattattttattgaatcaaagcaagactctagatttgaaataacatatttaatgagggtctactttgcattaggtttgacagaaagtattcagcatttattattactaattcttaccataggttttcaggtagttattatccccattttacaagttaggaagagatgaaattctgtacatcatgtgctacatattaaagccagaaaggaattatttttctgatttaatagaaaatccaataaaccaaaatacttcattcattcctttagtatcttgatatttgaagtcctccttgtaaagcacaaaatctcttttcagtgtttataatcaagttacacactatgaaatcaaggtgcatctacaattgatagtgtatcttaatttaattgccagtatatttttgttaatggagtataaaatgttgcctcttgcaaacaacattttagatttgataaaatatcatagactttttgtaagaatactagctaccaccagacacagtggcttacacctgtaatctcagcactttgggaggctgaagtgggcaggctgcttgaggccaggagttcgagactagcctggacaacatggcgaaaccccatctctacaaaaaataaaaaaattagtcaggcatggtggtgtgtgactgtagtcccacctacttgggaggctgagatggtgagatgggaggttcacttgagcccaggaggtcgaggctgcagagagccaagatcgtgccactgcactccagcctgggtgatgggagtgagaccctgtctcaaaaaaaaaaaaaaaacctagctaccatttatttagcatctgctataggtcaacaggtattgtgttaatatcatttgtaa

SEQ ID NO: 134932 - DNA, 1038 bp, Homo sapiens
tatccaagggaaacacttttttaaacaacaaaacaaaaaaaccgcccagcagtccaaagtaatttgtgttcctaaaaatggaatatggaaagttaatttgcttgtttgatgtggtcgttgagaaaaatacataaaagctttgatgtttattatgtgagcaaccaatataaatacagtttagttgaaaggaacactattaaggtattgtttccaggcagaatttcagaaatgtaattaattcagcaaataggttttttaaaaaagacatccaaaggttataaaattatttagaagtattttaggtctgaagctgtaatagttgacttaagcaattaactcttcaaaggtgaatgatgaatatgtggttaattcatacttttgtccatttctagcttacaaaacactacacagcaaaataatgatctgctagactgctaacccgagcatccagcttccacaatgcctgtgcaggcagctcaatggacagaatttctgtcctgtccaatctgctataatgaatttgatgagaatgtgcacaaacccatcagtttaggttgttcacacactgtttgcaagacctgcttgaataaacttcatcgaaaagcttgtccttttgaccagactgccatcaacacagatattgatgtacttcctgtcaacttcgcacttctccagttagttggagcccaggtaagcattcaagattttactataggttggtgcaaaaataatcactatttttgccattattttaacggcttgtccagcctgcaggctacatgtggcccaggacatctttgaatgcggcccaacacaaattcataaacttccttaaaacattgtgagattttttttgtgatttatgtttatgtttttagctcatcagctatcgttagtgttagtgtatcttatgtggccttttttttttttttttttttttttttagacagagtctcactctgtcacccaggctggtgtgcagtggcgtgatctgggctcactgcaacctccacctcctgggttcaagcgattctcctg

SEQ ID NO: 134933 - DNA, 1059 bp, Homo sapiens
tattgtaacataaaactatactaaggactattgtaacataaaactattaagtgtgctctggtatagtttgaaacagtttaaaactgtgtagtaggtgacaatatgaaagatagcatttttctgtatggttgaaactcccccaccccaagccccacacttatgtgctttaatataaagcatttcagaaaggctttggaaaactaaggaaaaggtatttgctcttattttgtactaccaggtggcctgtgataccctaacccacagaattaacatttccaaacaggtggccattatgaaaaactacacgcagtgtcctgttttcataaatatttaatcagttcaagttattaactatattagggctttcagtagatttaagatgaaattcattcttcctcaaaggccttttcttgtataactctgcaaaccagaaaactggatgttaaaaatgttcagtagttttagggagtgatatattcatctgctcagtgcttatctctaaagttggaaggaaactaattggtttttagattgatggcattaatagatgtggtaatttgaggatgaaagttgtaaaattataacttggaagatttggttactttaaagataacgatattagataatttgcattagagctgtttgagaaagtttgtataggggtgctttttacatagcaagccctgtaattcatttttaccaagattttttttaatctctgtttttgtgaatataaaagcgcagggccgggcgcggtggctcacgcctgcaatcccagcactttgggaggctgaggtgggcagatcacctgaggtcaggagttcaagaccagcctggccaacatggagaaaccctgtctctacaaaaattagccaggcatgatggtgggtgccgtcccagttacttgggaggccaaggcgggagaatcacttgaacctgggaggcagaggttgcagtgagccaagatcacaccattgcactccagtctgggcgacagagggagactctgtctctgaaaaaaaaaaaaaaaaaaaaaaaaaaaacacaataaaggctaat

SEQ ID NO: 134934 - DNA, 1191 bp, Homo sapiens
gtcttttaaattgcaattcaattcctttttctccagtactgagtttctagcttacaggttgtttccattgctgttttggtttttacttgtcttttagctagagatccaaattgtgcttatgctttaaatatcattttttaagaacaaaactaattatttttaagttttctaaacggggaagtactgtgacagtccatttcagtagcttatattcctcacataggttaacaagaatgaaaacaatggttttaattagaagaactaagccctaaggtttacatttttattaagagaattgtaaaatgatgtatacatatatgacagttaaagaagcataaactttattctggcattttaaaatcagatgccgtagacctgaactggctgcataatatggtggactaataagagaaaatgaaagtatttagctggctcttaataaagcagtttgtaatttgaatcatataagagatgcctattgtgcttcctgttttatgtgtcagcactcatagcaaggaacttacagtctggaaaattatttgagcgaaaaattgtttatggtcccacctttaatttagcatttctcactcctatgctttatcttattatcctttttcaatttttgtaactggtaactaaaattagttaatacaaataattagaatgtttttcttaaggaatcactttaggtatcttgagttgtaggccttttagtccattttatctcagtttgaaatgttttgattatttgagaagaatacttcagtagtaactataaatattcatagcaatttagacttacatagactcaaataagttgcataaaatgtattagtataggtctagaagttttgcaaattaatatgtagtcttagtgctccatggttcatttatatgctctttaaattataaaaactataggatatttaccatttttggtagttacaaaaatattttctaggtaaatgtttacaaagtgcctgttttgaaggaatgaagtttcttctatgttttaggtaaaattttatattgatttatcttaattaaggaatctaggatttactgataatattactgaagaaaaacatatttggaaaatcaaagcgtttcttacatctgatcgtataagggaagtttagttgataatttactgtcagaaagctagactctgacacagagaagaaaatttgg

SEQ ID NO: 134935 - DNA, 1145 bp, Homo sapiens
tcaatttttgaagaaatagaggtcgttacatcctgttaaagactgcttttcaatattgacattttcgttgatttggagattaatgttttcaaaattttagagtttggaaaattgctaggaggacagaatgtgaaacatattctagttacgtttagaaaaagcagatgttataattcaaacaggcacttgttctatgaggatttaattacactcgtgttcattagtggatcctttgagttacccctgatctgttatttctgttgtggtaacctgacatgtaagaagacttacgtcctttgttcatatatttttgttaaatcatactctgcttttgtaatttgctgtcttccactttgaaaaaaccaaaaatttgcattttggcaaagcattcttctttacactcaggattttatattcaaaagttgaacttctacattgtttgcaatagctaagaacgctaaaaaaaacttcataacaaggttttagtaactacttactgtttagtttgtaccgtgttgaagtttcactttttagtgatggaaaaaggaagcatgggtaaaataaagctagctgaaaattaaaaataagttcatgttttgcatccagtctcatgaatgttatgatcagcgtctctaattttactaaagctttaagtgtaagtgtgagttttacctcaatttcctgataaaagttctaagtattactttataatttaaatattctagagttgcactgtccagtactagccagtggccacatgtgacagttgaagatttgaaatgtggcttctgtgaattgagatgtgctttaggtgtaaaataccagatttcaaagacttagtaccaagattttttttaatatctcagtaattttaatattgacaacatgttgaaatgatattttgtataaactgggataaataaaatatattactaaaaataattttagctattttaacttttttttttttttttttgagacagtctctctctatcacccatgctggagtgcagtggcaccattcgggttcactgcaacctctgcttccaggttcaagcaattctcatgcctcagactcctgagtagttgggattacaggaaggcaccactacaccaggctaatttttgtatttttagtagagatg

SEQ ID NO: 134936 - DNA, 2506 bp, Homo sapiens
ggtgtaatttttaacagcctttgaaacctgttatagtggcttcccctttcaaggaagatttcatttggatacatacaaaacagatatgacaacacagatttgtttttggaaggtagatccagctttcttaattgtctgagtttccttaaattcaacctttttacatttctgttctttaggtctgccaaaatgtctgaaagatcagatctccttcacttcaagtttgaaaattatggagattcaatgttacaaaaaatgaacaaattaagagaagagaataaattttgtgatgttacagttctcatagatgatattgaggtacagggacataaaattgtgtttgctgcaggttcccccttcttaagagaccaatttttactgaatgattccagagaggtgaaaatctccatattacagagttccgaagtggggagacaattgctcttatcctgttatagtggtgtgctggaattccctgagatggaactggtaaattacttgactgctgcaagttttcttcagatgagccacattgtagaacggtgcacacaggccctgtggaagtttataaagccaaaacaaccaatggatagtaaagagggatgtgaaccacagagtgcttctccccagtcaaaagaacagcagggagatgccagaggctccccaaagcaggactcaccttgtattcatccatctgaagacagtatggatatggaggacagtgatattcagattgttaaggtagaatctattggggatgtatcagaggttagaagtaaaaaagatcagaaccagtttatttcttctgaacccactgctttacattcatcagagccccagcactccctgataaattcaactgtggaaaacagagtaagtgaaatagaacaaaaccatctccacaattatgccctttcttatacaggcagtgataacatcatcatggcctcaaaagatgtctttggccctaatattcgaggtgtagacaaaggcctacagtggcatcaccagtgcccaaagtgtaccagggtgtttcgtcacctggagaactacgccaaccatttaaaaatgcacaaactctttatgtgtctactctgcggcaagactttcactcagaaaggcaaccttcatcgacacatgcgtgtgcatgccggaattaaacctttccagtgtaaaatctgtgggaaaaccttttctcagaagtgttccttacaggatcatcttaaccttcacagtggagataagccccataaatgtaactattgtgatatggtttttgcacataaaccagttttgaggaaacaccttaaacagctgcatggcaaaaacagctttgataatgccaatgagagaaatgtacaagacctcacagtggattttgattcttttgcatgtacaacagtcacagactctaaagggtgtcagccacaacccgatgcaacacaggtcctggatgcaggtaaactggcccaagctgtcctgaacttaagaaatgatagtacttgtgtgaattgagtaggggcttcatgctcacaactcgaactgactgacaatgtggcaatagtcttagtctttttaggagtgattttgctagtttgacttctccaaagcctctgtgtaggtggtagggagtgagtcaaagcactaatagaccaggcaacttaccacttggagtggatttgccttacttttgccctctcccattttctgttttgagttatttatcttgtaaagtctgttttcctttcccaaggaataattccttttgtctacctaacattgacttatgtcttagactgacactgttttaggcttttcactaggcacattccgaaggtaccaacaagttaataacgtcacctactctccactaatagatgctatgctaagagaagtgaataatctttctttggtagaaaataggctgagatataaggtgatattgctattgacctgaaaatgtgatagaacttctggttgcctattgattattcctccatgtctgataaatgaatctgcttcctaccatttgtacttgtcttggagctggctataaagaagtatgctggtttgttatgtactcttttcaacagtatcatagcccaacttcatctcattgaattgttcacatataccagagtactctctcttgaggaacacctgcaggcagatagttagggatgaccatgaggagcataatcaacagggatagaagtacacttatacaacagcacttacatgggcggtttctctggtagcatgtcccataagaggccatatgcttataattaatgtgtaacttgttgatgcttttgagatcaggactgctccaggcacgctaaaaatgtgctaaagtatagtgggctctctaaaaagaggctatttgggagtctctgaattttgtttcagagtttagccatcagaaaggtgagtttggccatcagagttttgtcctgtgcaccataaaagtctctgaattttcgtttcctcatgtaccttaatttct

SEQ ID NO: 134937 - DNA, 1047 bp, Homo sapiens
agttttcgggattaagtttgggagccagatctgaacaaataagtactcctatgtgtatatatatgtatgtatgtatcagtcacatatgtgttaattgctcaaggggccgttgctgagaaggctttagaaagaaagtgatgtctgaattgtacttggagagagtaaagtgttgaagagtttttcagggaagacagttgcaatactgtggagaaatgactgagcataacttgtgtgggaagaggaggaaatggggggactcctatgcacagaatggatatgagactgggaaagtcgaccgaggtccagatggtgaatggtgtaatcctaaaggagatgggtagttttttgaagagttcggaacagaatattgatatggtcagatttgcactgcaggaaatcattttgttctgtagaaagcccatagagaagggactttctattaactgcatttagacatttagctaaaagttaggaacgcttatcggagattcttttgaaggggtaatgggatcagcctagtgagaggcaaaaaattcctgaaataagttataatggtgtcattggtaaggagacaaatatactggagatgattatgtcaagactccataattaactgaatgctgaagaagtgtgagggaccaaatctaattcttaggttttagacctctgagctgaaggatggtaatgccattatcagaaataaagccataagcttagtgtagattatgaattcattttttggacatgttgaattaaaggtctaatgagacagacacatagagctgtccagcatggagttggaaatgcaaatctttagctcagcctaaacattgtagctagaggtaaaagtttgagttatcagcatagaagtggaaaccatggcaatagctggcatcaggaagagaattttgaaaaataaggaaatttggggggggagggtaatgcttgcatttatgaagcagaaagaggaattggagctagtagtagtcagcagtaggcaataaagtgtaggagtgcagggttacagcaagcaagaagacccagaaa

SEQ ID NO: 134938 - DNA, 2152 bp, Homo sapiens
ttctcactgttttttctctggttgatcgggatgcattatccaccagaaaacactgtagacgactcactcaccaggaaaagagcatatgccagttggaataaataaaggggaagagtaaggaagaggctgtagaattattttataaattatcaagtcttatgagccaggtgcagtggtgcatgcctatgtacagtcccagctactcaggaggctgaggtggtaggatagcttgagcccaggagttcgagggtggagtgtgatatgatcgtctgtgaatagccacagcactgcatcctggacaagatagggtctctttaaaaataagacttaactagcactttaataatcattgtttttgttcccaactgcattgtacattcattgaggacagggactttaaacttcattatattgctgttgctgtgtttcacctttgaatgatttttaaataaaaatctcatctttgagtcacaatctgatgtaaccttgtccatttctgtcctcttgtgtgccttaaatgcctttaggcagctgtgttgtaccagtggttttaggacttggcagtcggaagttttgacttctagactggattctgtaactaaagctaaattactttataaaaggagaaaaatggtaccattctgacgggtttgtggtgaagctgaaatgagatagccacataaagaaccatcacaatccctgacacaccgtgcgccctcagtaaatgccaggtgaattttattacactgtgaagtactgattttcaaacaggacttgcacatgaaaggtgagcagggggattccttgctcaagcaccagtactctggggttgtaccctttgttaggctcaacaggtactacccagtccgcttccatcgtccccagtcccggctgcagtcacgtagttggctgtccaactccaaatacacaagacagcccaggtccagctcacagccagtgcacttcgcgcaggcgcacagtcctgaggcgggctgaaagcccaggtggggctcggagaagaggaagctccgcctcgcttcccggtattgggccaatagggtcgctcgtcatggtcgcagacctatgagacggggcagggggcggggcggagggcggaagaagtcgctctcacgtgagtaaaggggtgggggggcggggacagggcggtttgggaggcccaggcggcggagcctccgggacggcgagcggcgggcggcggaggaggagacggcaggtcgggtagggccgtgtttcccctcctcctcctcccaccctcctacctaccaaccccaggggtattttccgacggcccctgcggggagccaagctgtcttctcatcccgcggggtcgggccagtggagctgctctcagctccctcgacgggccgagttctgaggggagccgtgattggggggagggggaactgcgacggaggggagagggcgcatgcgcaggctgggccgctctgggagcccctgcccaaaccggttccccctgtctgtgtgggtgccggtcttctgagtcttgcgtttttggccctccctctggtcccccagcaaagccggtttgtgtcttgactttaatgttttatgcttggtcctatttgggaatccagccgctcccccccgcctcagtttctccccattgctcactaggcctgtatctgtgacttaagctagcctgggcctcaggctgtcctgggctgcgcctaaatttcaaagacttgctagttttcactgtcgctttgccatctcaggttggtctttcagtctcatttccccgtctgcaattaaagcgttcttggcatcccagtcttctcatctccttgaagcagctaccccagtacctcatcgctgtgtcttttgattatccgcacccttagggttttacgtgttgagccaaaggataacctcaagacttccaggagttcgctgtccattgcctggtagtactttggtctctgctcttctgcatccagactgtttatcatctgctcctgcgtttcacgcatctgcatacctttggttactcgagaattcttttttggaaacaaatgtcctaggagaccgtgttaagtgatcatgctgctagtgttcccgctactagtgctccgttagttttaaatcatgttccaacttgaatttgaggtct

SEQ ID NO: 134939 - DNA, 1026 bp, Homo sapiens
ccattggcaagatttttttcaggtgtcagcattatcacactcataattaacagagttaaatgaactctgttttatgcacatttcatccctacttgttacctcttgtacctttcattagaagtatgaagtatcaagatatagtggggagagtatgaactttggggtgagaaagacatggatatcccaagtctctgagaaggagtgattaagtagcttatcctcagaaactccatttttaaacatggagctacttacatctacctcatggaactgtaatggaaaacacctgatatcccccctaaagaccctataaagttataattattttgaaacttacttttattgaaggataaatgtggcatacatacattgaaatattattcagccttagggaaattgtgacacatgctacaatatgaataaaccttgaagacttatactaaatgaaataaaccagttatgaaatgataaatattgtgtaattccactgcttatatgatacacctagagtagtcaatttcttagagatggaaagtagaatagtggtttttggaggaggaagagaatagggaattagtgttaatgggcacagagttaagaaaggaaatgttccaaggatagatgatggtgatggttgcatgacaatgtaaatgtatttaatgacacaaaattgtacacttccgtggctaagatggtaatgtttgtgttattacttaatcacaatgcaaaaagattacaacttataaaaaagatgttttaaagttttattttgttttacaatttcctgtatttgtttaattccgatatcttttttagttaatgtagaattgaactaaaagtgatttaatagtttaaagaagtaaattgtcacagttacggtaggctcaaatttgcctaagcgtgagttttagataagctagtttttcttgcctttaagtgcaggtaggcccaagatgattgttttgattcttttggttttggttttggttttttaacgtaacctgaaattaatcagaaagcttaaat

SEQ ID NO: 134940 - DNA, 1019 bp, Homo sapiens
gagggatagtgaagaaggaatatatttgggatatgttttagaactaaaatccattattccaagggagggtgagaaaaggaggagtcaagatttgttttggtttggtgtcttttttttctttttctttttctttcttttttttttttttttttttttgatgttgttttgaatctgtggctgttaaccaggatagagaatctagaaagaagaatctgctgacgcgtggggattaaatggtttagttttgcaaggaattggttttgagatgaccataggacgcatatagtagagccctgctgtgtattctcataacaccctttacacacctctgttataacaagcactatattataattacctgtttactggtctgttttctctaccactgtaagcctgtcaaaggtaaggagtgtcttttattcctcaccataattctatacctggtgtctggcacatatcagactctttgatactgaatagaagaaaaagaaaatataacacaaatacccatgtggaattcaagagaaaagacagtgctagtgttatcagcatacaatagaaagctgtaaccatgttagctaatgagatagccagtgaaaagaaggacgatgatgtgattttaaaaatagaagaaaaggaacctaaatcagaactaagaaaagatagtggtaggaaatggatgcaaaaggataagagtttcagaataagaaaatggccagcattttcatttacttcagcaggtggaagtaagaaataattctttgggttgtgaaattttgtagtattgatggtttttaaggggttcagtgaaagtgagaagtaacggggtggtatttttgagagggactgtttagaacagtggggagttccattgaagtggtagaggtggaggcattaatactactctttcaagaagaaaatctcaagaaaaccaaagaaataaaggttaaccaagctttggatgaggcactagcacattttgtctcaagcatgtcaggttcaattattagtatcaccca

SEQ ID NO: 134941 - DNA, 1249 bp, Homo sapiens
tcttttgtttatcatagcttactctttgtacattatctactcaataagtattcaatgaatggattaagtgaatcatttttctttgaatttttcaaaagtacaatttgaaatgtttttgaatgccatactatgtatttagatttggtcttatgaaatgcagatgtgtaatagctgttaagcaggggaattagtttaaataaaaggcagcagagagtccaggcttctagccttagctgtgccattaactggttaaatgaccttacttctcttggggttgccatttctttatctaacagtattgatttgtaagttttttttttcctactttttactctgccatcaacttgattttagatttctaagttttcttccaactataatactcagggattgtgtagtttctcctgccagatgtttatatgtgggccttttaggggaaaattgtgtttgacacatggtgtatgctccataaatatatagtcaatgattaaaaatccaaagcataaatcaggacttctcagtcagagaaattaaacagatttttagaaccttacatctttgaggtactagatgaacatggagccatagctacttttgttaatgagtataacgttatatcgttttgttgatgttgtgacaaccaaatgaaacattgccacaaagtttgcagaactaggttttaaaatgatggtgagtttaagtttcattccaagactcaataaataattgaatgaattttcataagtgacacatatttatactttttgctgggaatttttggtatgaaacccttatttgggtaatgttcatattgagctgagttctaagaaactgtggtgtgggaagatgcagtttttaatgaacttctcctttcttgctttgtaaggtatttcccagctctagagtttatgctaaagtttaactgccttgaatttttcctgttgggtgttaatgtgaaatttggcctgttaaaaccatgttaatattttaaatttaagtatcaataatgctaggaaaaccttattgtgccctcacaataactaagtgctttccatttcatttacatgtacaactttaaaaattagacggtaggccgagaccggcggatcacgaggtcaggagatcaagaccatcctggctaacacggtgaaaccccgtctctacgaaaaatacaaaaaattagccgggcgtggtggcaggcacctgtagtcctagctactcaggaggctgaggcaggagaatggcgtga

SEQ ID NO: 134942 - DNA, 1053 bp, Homo sapiens
aacagaaggctaatacttatatatttttggaggctaagacttgaattgcaacttagcccaaagaaatcactgtaagtagttagggttatcctgaagggaatatgttttatttatttttttgaagtctgaaatatcttggccttgaatagcatgaaattcccttattatctggaataaaaaaaaaccctaagctataagtagtgaaagtcttaggaaaatatttttgaagcatttaaaaaaaaattctgaatatgttgtgtaagaagtacagtgtaattgaatatctggcagacattctatatgagtatctttatggtttttgtttttcaggcattaaaaaatatttaatcattcatgtgttgagactcattcttgagttatggatgacaaggcttctgttggaaaaatcagtgtctcttcagactcagtatctactcttaatagtgaagattttgtcttggtttccaggcaaggagatgagacaccatctacaaataatggaagtgatgatgagaaaacaggactcaaggtaaaactccctaacctaagattgttttgcttagcttttctaagcccattgcaaaacttggccttaacagaaaacagatatgggaggaaagtgagaacatggaagtaatatacttctttttctttaaagaattttatttgcacttagtgagaagtttgtatttgattaaagattttcactctgattagcttttcctaaatttttcaatacccctaagtgtcaaaactagtggttatagtataaacatttgtcattttagtattgttttcacttttccattgaattacaagtacttgttttgtttggtcctggtttacataatgtaagggcactggcaggtcaaagatgctatttatgaaaatgtgttttaggattattgaaacaactttaaatacctggccatttttttttttataatttctcagccactattacttattttccaatgccctattattgttctactctttattgatataaataaaaacagattatctgttaaagttgtcatttaaaatataagt

SEQ ID NO: 134943 - DNA, 1044 bp, Homo sapiens
tcgtaagcatatacatataacttcaggacagttgcataaataattgtcacattttttaccataaatgtaatcattcacatacacttatcctcttccatattcttatatttttgcagcttctggtttttaaaggcagcaagatgggggttaactgttgttcactcactgtggcattcgggtttatttttactctttttttctaggaatctatgggcaaaagttcagatggaaagtcgtatgttattacggggagctggaatccaaaatccccacattttcaagttgtaaatgaagaaactcctaaaggtgatacagattgttgacatcatgaacagaaattttagtctcaagaagagatgcaaaactaaggaccccttctttgaccaatatccagtgtttacctaattttgatgaaaccgaagaatttgaatagttcttcactttattattaaatttgacctataagcaaagtatcactttttcccacttttccatcctttttttcattttttccttcccctctttcttttctttctttctatttatatgcttatttacttacagacttataagttttatttttgtacagaggtaatccatgcacataaatggttaaaaatttcaaaggatttatagggggaagtgagtctaccacagtccccagggctctgtcccaaaggaatcactgttagcagtttcttgtgtagctcttcaaatactctatgcataaagtatctggaagatatttcatatgctctttgaatggcatttaatagctgcatattatcccattctgaaaatgtaatttgcttaataaatgcctcttattgagcatttttccccccttcagttttttgttattaatagcactatagataaatagttaaaggatgtaaacagaccattcaaataccattgttaaccaaatttaaaaattgagaagtttcagtgttgatgagggtgacataaagaagtcatatgccacttgtgcagaacaatctgacagtacagtggtgtttttgttttattttttttattttattt

SEQ ID NO: 134944 - DNA, 1044 bp, Homo sapiens
tttgaagcagaactagagtactgcttagtaaatgcccaattttcctaagaattttaagatctaaacatatgcttttctgttttaaaaagttacttctaatgtagatactcaaaaaaacatcatttattttcacatcctgtatgaaatcagaagtgattgcagtgagccgagatcactgcaattaaaaacattaaaaacactgcaattaattaaaaacataaagaactttactgcttaataaataatattttttcatcttcaagataaagcaaagggagagaaagaataatactgacactttatatgaagttgtatgcttggaaagtgaatcagaaagagagaggaggaaaactacagccagtccttcagttcgcctgccacagtctggatcgcaaagttcagtgataccttctcctccagaagatgatgaagaggaaggtaaactgtagggatagcttaatttatttttgggggtggaagaccatgcaaactattaaaatcgtatcaggggattgataatgtgatacggcatttataattcatttaatgaattccttatgagagtttactatatgtaagtagctgtgggagatttaaaaatgattaacattgagttttctttaagatacttgtaacccagttggaaaaatgagatttataattagctccttttaaacaatcagtgtagtgctagcttggtatattagcacatttttttttagaacaagtttgacacagcttacacctaaagaaatgttcctatctcaacacattcattttgcaggaacaaattcactgtgccaaaatgtggcttgcacacatgaccctttttaccaaatatatttataaatatatacgtttatatattactatgttttacactgataaacgttaagaatccactggttctttgtttcttttttttttttctggctaaatctattgaattaatctgtcattctctattaaaagatataattaccttttaatgaggcatgaaggaagggagccacaggaaacatgaatgagagtcgttttctaatt

SEQ ID NO: 134945 - DNA, 1118 bp, Homo sapiens
aaataaaacaaaacaaacacaaaaattgagaaagacactattatgaaaccagagaatgctcaaatcttcataccatagattttgaggaatatctgctggttacaaagaaatctgggcccgactaaaggttcctcaggactggcatcaagttttaatttatagcagacataccttttttaaaaataaaattttagggggttcagaaggcctctactgatagttcttaactagggagagataaggactaatggcagtgtgtaccccttgggggaaatcatggaacactagaacataagctctgtgaaggaaaagagtgtctgcttttgcctcatgttgttccctagcgtataccacaacatctgatatgtagttggtgctcagtaaatattggcagtatgggtaaccccctagaattcatttttatagtgaagagttaataacaggagaactgggactaaagaaaactgtgtagccatgctatcttttaattctccctaacgcagtgtacaaaccagagaaaccattcctgctgtgattgtttgcttccagggaagaaatgattacatttctctcgagaggcttcttacccataagacatttggcagaaacccagaaattataaaggggacatgtttagaagcatcattctgaaactgagatgcttgtcctaccccaccttaggcagatgggttcttaacacagattttaaactactactacccagatttattgaaagtatccaaaatgtgaaagagaattttgtaagaaaagtttttctaatatttttgaagaaattaccatcccttctaaattttagtacatttttcatagccacctttccccaaagagttgtatttggtatattggtgttttaataaatagaaaattacttgagagattagaaagtagggccagtcttgcaaggtagtgaagctggggacatttaccttagtgcccttgagcctttctttttttttttgagatggagtctcgctgtgtcacccagacaggagtacaatggcacaatttcggctcactgcaccctccgcctcctgggttcaagtgattctcctgcctcagcctcctgagtagctgggattacaggtgcccacaccaca

SEQ ID NO: 134946 - DNA, 4646 bp, Homo sapiens
tggagttctgtggtgcgatcttggctcactgcaaaatttataaagaaaagaggcttaattaattcacagttctgcagggctggggagacctcaggaaacttagaatcatggcagaaggggaagcaaacatgtccttcttcacatggcagcaggaaagagaagaatgagtgccagcaggggaaatgccagatgcttataaaaccatcagatctcatgagaactcactgtcatgagaacagcatgggggaaaccgcccccatgattcagttacctcccttcgggtccttcccatgacacgtgggattatgggaactacaattcaagatgagatttgggtggggacacagagccaaaccatatcattattatataaacataaatgtcaacatgcaattgcattatatacatatattataatttcttcaaccattctctactcctattgttggacagttaggtagtttgaaattttttaagtgttttaaataagacatatattttcatgcataaagctgtttgctttggaaaatgagagaaaataccatattttgaatcctatagttttataattaaatagctcctttttttttttttttttttgcaattgacataattatggacctatgtggaaaacaaaagagaattaaagaggttacagcattttacctagaactatttttattttctttgtacctatccataaatactaaaagagagaaattatgactttatgctcccagtaaagtctttcaaatttgactcttaacattccagtgttcttctggctagcatagccatctctgttaccgtttttgtgtgttttgtttattatagataatgatgaacctctcctgagtggatctggtgatgtatccaaagaatgtgcagaaaaaattcttgaaacatggggagaactgttgtcaaaatggtaagttatgatagaatagttttttttatctgcaattttcattttatgggtagagaatcttacctaactataatcaattttggaaccagtagtagaaacctaagcgcaatgtttgcattctgtgatctattttagggatttatatgagtaaaagtagagaattgaaatcaattttcagaatatcaggaacctaataaattctcattgctggagaaaatatttatccaaatgtggaattcatgtacagaataaataagaaaagtatcttttatgttgaagaggttaggaaccactgagtggttcagataatacacaacagtcagtttagagggtgttcacacaatgcatagagccatggtagagaccccaggtaggatttttcccttatctgtgataagtatctagaatgacagagcaaagtgtcataagcatggtatatattacctgctctatcgattactatctcttataaaattcctactaacacttacaaattttaggaatttctcatcagctcaagagatggtttgacagcagtgttaagaagcactatcctataggctatctaaaaagaatacattgccttcaggatgggtgtagtggttcatgcctgtaatctcagcattttgggaggtcaaggcaggaggattgcttgagcccaggaattcaagaccagcctggacaacttggtgaaaccccatctctacaaaaattgaaaaagttaactgggcgtggtgacgcacacctgtggttccagctactctggaggctgaggcaggaggatcgcttgagcataggagtttgaggctgcagtgagccttgattgcaccactgcactccagcctgggtgacagagttgagaccctttctccaaaaaacaaaaaagaaaaaataccaaacaaaaagaatacattgcctttaggtatttaacatgaccacagatattctggtaagtcaggttggtgagacatttatgcagtttccttttctccttgaataggatgccagtatatgctgaaaaaagctgagcttggaagtgatctgaacacttctctatttctgacattctggttactagggttgtcaaataaactccctattggcctgttactttggggtttgatttttctcagacattttaactgttgaagtatttcactgcattgttagaataaagctgtgtctcagaattttaaagcattgtgtcatgcccttaagggataggactacaaatgggcattatctgcttttatattactctcacaatgctttacacttttgacaaaacactctccacactggaaaatgtcaaatgtgtacaggagaaaaaagcaaaccaaagcacgatttgtctttacacaagttgttttaataaatgaactctgcaaaaaaaccagagtaatagttttcttatatttttggtatttctttacatcaggagacaaaacttctggtgctcttgtcacaataatattttcagttcattgagtttggagtgtttgggatgctgctggcaggaattttatctgtataaaaaggtttctgctctaaaacagaaacataattgagttttgacatggttacataatatatttaaaatcatgtagatatagcattaagactctagttagattttattacacgaacccatcagcatcttatacaacttggaattcgttttgttatcaagctttgttattcatttaattaacatgtcttcctattccctcaaatgtatttattgagtttccatctgtgtctgccatctttcagggtatttaaactatttttgcttgctttagtcatgtcttcagatataatagtgtctcttctttagttcattacatcattattttttctcattattatttgtgttctatggatatgtgttctatgggtaagaagcattgtaataatggaattttaaagcctggtagacctggtttcaaattctacctctcctacttttaagctgtgtggtcttagacaagtcacttaactcttttgagtctgtttcttcatttagaaaatagaagtctataaaattaccatttgtaattattatagattaaaaataatggatgccatggttgtagttatagtaacatagaactaatgaatttaccatattttaggcactgtgctgttatgtgctctgtgtcaactctaacaaccttataaagtatttgttttttacagatgagactggtgcataggttaaggcattctagttagtaaatgtcacaaccagaatttttaacacagtcacggctgatcccaaggctggtttatttaactctatattagattttagtggtagtattaatagtatctttgagctctaattctccaagttcattttttttgtttgttttttgagacggagtctcgctgtcgcccaggctggagtgcagtggcgcgatctcggctcactgcaggctctgccccccggggttcatgccattctcctgcctcagcctcctgagtagctgggactacaggtgcccgccacctcgtccggctaattttttgtatttttagtagagacagggtttcaccgtgttagccaggatggtcctgatctcctgacctcgtgacaagttcattttaatatgactgttaatggataagagaactaatgtcagtataaaataggttgctaagttggataaagttaatattatcaatgagatgaaattattctgaaagtaattttatcaatgtaaattaagctagtaaggttagcaggctttgtctgtaaagagccaaataataaatattttaggttttgcaggctaatagtctgtcacagctactcagttctactattgtaatgcagaagctatcatacacaatacttagacaaataagcatgactgtgtttcagtaaaagtttatttatgagaacaggtgatagttaggcccagtgtggcccacaggctatagcataccagggattgggttagcagcagaactatgtctgttctttctgctcataacttttcaacttttacataatgtttttatctaaacaaggagaaaactattgaactgtccatagcacttgcattagggcaccagtgtcacagaataaatcacttttaaatgtgctgtgcagaattcttataggattctgtgaacattttgagaaaaatcacaggcctttttataatttgatagtggttattttgtatcagtaacttctgcttacgtctgatagccacagcatcttcttaatgtcaggatcctgttttattgactcagtaatggtggctctcaagtcacaaaccagctgctctataacagagcattcattagtcttaagaatttgaggactacctcagtcatttaattgacttccctgaaattttttctgcatctgtaaaactagaggtactaccatctacctcagatggttgttctgaaggtcaaataagatactgtatgcagaagcacattgtacatttataccaacatttcaaggctagtttaattttccccattttataggtgacataaatgaagtccaaagatttcgataacttgtagtgatatagtagttcagtggaaatgttattagccaccataaacattcagaaaagttatttgaaggaaagcatcataaaaactgttggaaacatacttgagatattttattttaacttagaacatataaatatacaatattcttgtcaattttttttttctagacaaagtc

SEQ ID NO: 134947 - DNA, 1039 bp, Homo sapiens
tgcagtggcatgatctaggctcaccgcaacctctgcctcccggctttaagcaattgttgtgcctccatctcccaagaagctgggattacaggtgcgcaccaccatgcctaatttttgtaattttagtagagagtagggtttctccattttggccagactggtcttgaattcctggcctcaagcaatccaactgtcttggcctcccaaagtgctggaattacaggtgtgagctgcctcacctggcctggaaaaacagcattcaaacatgagataggaccttcaccagaaaatgacttttatgtcttcagaatattaatgttctttcccatcatcctatatccagacagattttttttgtttcaataagtattctgattccttccattaagttgatataattgtttagctagtatttatcgttgagtaactgttacaaccacagtgttggagctgggaggttaaacacaaaagcaagtagctgtcttatgatagaatgtgtctgaaaaagcacagtgggagccatcaaaagaagttaacagttctatctgggagaacagaggagtctttatcaggaatataacatttgagatgaattccaggtatagaaagatgggtacagcattgtactcatagtatgaacagagccactgaagaataaggttatataacatgtatatctagcagagatacacctagtttttattttcttttgttggcaaatcatattttggatttgtaacactacttattttttttgaagtcctttgaaatgtttggtcaaaaatgattcttaagagcttattgctttaaacgaaatattttggtaagactattcataagacatgaagtgtctgtaactgaatggattctgtttttctggttccttgaaagtggtgacgtctgttgatagaaaaggaacctggtagttatatgatatgtaaaagaaagactattaacaaaatatgaaacatttgattgatttgtatatactggtgatgtgtactttatatttcacattaaacttacaattttgtttttc

SEQ ID NO: 134948 - DNA, 1001 bp, Homo sapiens
tgtcatcatttatgacattaccaggaaaaccacaatataatatgatacagtttgcattgttttaaataggcagaagcaagattgtatattctaagatacaaaggcttatttgtaccatgaaacttcctgtaatatccatgcctgagtagaagaaggtacatttacttttctatcttctgtttgtattcttgtttactgctcagcaaattagaagcaagaaatgcatctcaaaattatagcgtagtgtcaaatatgggaacagtgtaatttatctgtgctatttgtgtagtattcagaatgggagatactttatttttctcttgaaaaagtgatcttaaagtttcttggccaatattcagtgaatcatgagagacaaaattaatggtgaatagccttctagctagaacttcttgtgcagctgaattatgattctcagttgccatacgccatacacttaaaggaagttaacatacttcctttctttaatattgctctttgttctttgggaaaatgccgtgagaaaatagaaattacccctctggtagtgtgtttcagtctaattcctgacaccctgttctgttactaccccttctccttgctagcaccctgaattctgcttatctactaaaagggggattccagacagacgaggaaacagccttcaaatggtgcactgcaggcatagcaagccattcccacactgtgcagtctggaaatcggggcacctctctgacgatgaattccaattagttgctaaagatgccagagtgtgtgcacgtacaggctttttctttcccctccccctttcttccttttcccaagccccctcttctccctgtttcccctcctactcctttatctcctccctccgtgtcttagttctgcagtacgcgggttgaagcacattcctgctttgcaaggctttctgctaaggatgtattgtggcttttgtttggattgcagcatgcagaattacaggtaacattctgaaattgaactaa

SEQ ID NO: 134949 - DNA, 2162 bp, Homo sapiens
tcagttgtgtggggtgctattgagggtagccgtgaatagtggtgccagtaggggtggagcgggagggatgatgccagcctgagctagccaggttctttgattagggcattggatgtgaaatgtaaaatgctctctccttttcttctatcagctgttcagaggagactcattacaactcctgctgaagctcctaatcttcttcccttctcttctaccctttccccctaccctcacttggcctgaagacgttctccccagagtttaccttgctcccctggtgctatgtgtatggtgaacctggcactatggccgcgtctgggactggccagacaactgctgctggctctccttattccaggaaggatttaaaggggaattgcactgcaggcaatgcaccagagcagcagcatcaggagcttggggagtaaggctcctctggcattattacacacatgcaaagctgaccgcaatgacagcagctgcttctttgaactgttggcagcagccaagcggcagcatgaagtgacagatcactcctgagctcaagatgaactccaccttggatggtaatcagagcagccaccctttttgcctcttggcatttggctatttggaaactgtcaatttttgccttttggaagtattgattattgtctttctaactgtattgattatttctggcaacatcattgtgatttttgtatttcactgtgcacctttgttgaaccatcacactacaagttattttatccagactatggcatatgctgacctttttgttggggtgagctgcgtggtcccttctttatcactcctccatcacccccttccagtagaggagtccttgacttgccagatatttggttttgtagtatcagttctgaagagcgtctccatggcttctctggcctgtatcagcattgatagatacattgccattactaaacctttaacctataatactctggttacaccctggagactacgcctgtgtattttcctgatttggctatactcgaccctggtcttcctgccttcctttttccactggggcaaacctggatatcatggagatgtgtttcagtggtgtgcggagtcctggcacaccgactcctacttcaccctgttcatcgtgatgatgttatatgccccagcagcccttattgtctgcttcacctatttcaacatcttccgcatctgccaacagcacacaaaggatatcagcgaaaggcaagcccgcttcagcagccagagtggggagactggggaagtgcaggcctgtcctgataagcgctatgccatggtcctgtttcgaatcactagtgtattttacatcctctggttgccatatatcatctacttcttgttggaaagctccactggccacagcaaccgcttcgcatccttcttgaccacctggcttgctattagtaacagtttctgcaactgtgtaatttatagtctctccaacagtgtattccaaagaggactaaagcgcctctcaggggctatgtgtacttcttgtgcaagtcagactacagccaacgacccttacacagttagaagcaaaggccctcttaatggatgtcatatctgaagtggctcagttacggggttcccgtgtgtgtgtgtgtgtgtgtgtgtgtgtgtgtgtgtgtgtgtgtattttatctctaagtattcctaattcactaggaaatctgggacagaatactttgactctaaacaatagcatacaaattattcgtatggataccttctaagtttgtagaaatggttttcaaaagtgcttgtgaattagaagactcaagatcatgaagacaaattgctcttgctctcaatttttgaaatgtcttggaaatgactacagttctcagatttaaaatgaataaagccatatctaacacctctttccagctggcatgactgaacctgagtgtgaaaagcgtcagcattttaaaaagtcatcactttcttgtcactttctgggctctttccagctatttgggcttcatatgcaattgatttcttctaacggaatagtaaaatataaatgaaaaggttttagaaattactttttatgtatgccaaagcataactacactgcaagtttcaacactgtcatttagaaagccaaatgttctgtgttttattctcttgag

SEQ ID NO: 134950 - DNA, 1078 bp, Homo sapiens
tgtttttttaaaatacaaggtagttgagacattttctttgtggttaaatggaatcaactagttatttttgaaaagtattctttcagttagtgctaaggaatccacatttgaagaggagaagggaaaacacttaagtctcttattgctattttctctctggaaaaaaaatcctttggcatacagttcttaatggtcttttttttttttcctgccaaagtactagaaaaacctataggattttataattcttctatagaattattattgagagttatgtgtgtttgtatgtagtagtgatgtttgttcttaaaagtgattatctttagagcaagaggtttatttttctaaaaggagagaaggaattccggcagctccaggcacgagagtatttcctctacttttctgctgttctggaaatgttctggaagtcttcaagggacttacttgatctctgcctttggctagaggttgtaatctgaatgcgacagtggtgttcagtgagatggaagatggaagaaacccaggggacatgggttaaagtggatttctgaatccaagaaaggacatggatatttataaagcaggcagataagctttggttttccatcatgatgccagtgttcttatgattttaggctttagacatcaacttgattttaacctcagttgtgttctatttaaacttttttattttaagtgactaagcattacataaacattcaaacttcagattctgggtttttcccaaaaccttgcttgctctttatgtttagtgttagcaaattttattctaagctgcttcaaaatttagaactcatactgaaattgcaagttatgttagaaatggcttggttaaattgccatttcaaatgggaaaccttttctgttagattctgaaaaatggttgtattgtatacattttccctttaagtggtacagatctaaaaaaccaaaatttaccttttttcatacatgttagagaatgtaacctgttcacatttgcagtttgcttatgaatttttagtttagaaaatatggcaattttaaacacttaatttttgttgaaaaattgatatta

SEQ ID NO: 134951 - DNA, 1032 bp, Homo sapiens
ttttgaggagaagtgatttccaacccacaattttatgcccaaactgtcattcaagtgtgagggtaaactaaactcattttgaggtctgcaaaatcacaaaatattcacctgccttaacgtactttctcgggaagttactgaaggatatgcttctccagaatgagggaggaaataaataaagagatacagaatccaggaaacagggtctctgacacaggaggatggtgaaaacaattcccacaggaaggaaagctctacgaaagcaactatgcaggagacctagagagcagccagtctaaataggagcaggaacaaagaaggcactaggaggtatgtctctaggaaaatatagttgggattttcaccatggtgagaagaatttagttttgtgagatttttaggggaagaattggtgatagatacatagaaaaccaaggaaaagaaaaagataggcaattaataacttcagaaaaaaatagaaaattgaagaaaggaaataagatcatgacatactctgattcagttatgtgttgctgtgtatagtttggtgtttagccaaaaatgatagcaacactgttgacagggtgaggggaagggaagtgtttggggggtgaggggaaggagggtgggtgtaacagagctacagtagcatcttccatagtgtaaactctgaaactgatgtctaaagtggaaaaacccagaaaatagcaacttaagcattttattcagaagtatgaattaaaaacaaacagctttaaaaaaaggagaggtgaaaatggttgcctctaaggaatagggtatgaagagtgaagggaatttcattgtaagctttgtactgtttgaccttttcacttacgtaggtgtattattttcttttttttttttttttttgagacggagtctcactcagtcacccaggctggagtgcaatggcgcgatctcggctcactgcaagctccgcctcccgggttcaggccattctcctgcctcagcctcccgagtagctgggactacaggcgcccaccaccatgc

SEQ ID NO: 134952 - DNA, 1191 bp, Homo sapiens
ttcctgtgggaaacttgagccctaaaaggaaatgaacatagctaaaaggctgcatatcacatgggacttagatttatttttagaatggcactataatgccatatttggattgaaacaatgtgatagcagtaaaatatttcattaaataaagagccatcttttctgaggaagtcatctgcttttctatttcaacgtgtggtatagattgaacataatacttatataatcattcagctaatataattctaaagtatatgttaaaggagcttatttggcaaacatttctagagccagcttattgagtctggtgtagtaaaggttctgtgacagttcaatgattacagcatatggtgttttttgttgttgttgttgttgttgttttgtgtgtttggagtaagttgtttggaggggaaaagagtaaagggagtagagtcatttggaatgtttatattatttttcttgaaatggatgaactccttactaaattagacaacgataatagagaaacctagatggatttttgcttctgagaaatgattttggaagaaaaaagataatcagcaaaggtatttaatattgagctctacagtgttttcattagtatggttcataggctaaaaaacaaaatactcttattgtatcacttatgtttcaagtatcagtttttctgccacctgatttctttataatttcatttggtttaaatgtgatgttcataacattcaggagatttctgaactgtatactgtctaattgcagatccccgacagggcactaagtcccaaacaggaaaacttgccaaatacagattttgtcccttggcttctctcccaaggtgggaaatatgccagcatcataaatctcaagtctgttgagaaagagctaccgctgatataccaggccttaagccaccagctttccatgcagtatttcatttgcttctcataaactgtgaggcagggaccattgcatagattttatagataggtttgttaaggttcagattagttaaatgacttgcccaaggtcacacaaattagtaagtgggagaggcagtacccagagacagaacagcctggccctagactttgtgttctgttggttgcattgtgatctaagtagagcacctaaagtccatcgtctgcattctttgtcaaaagtccaactccagtctccacacaattatgacca

SEQ ID NO: 134953 - DNA, 1091 bp, Homo sapiens
aatttggcgacatccttgaaggtataaatagtttactgtttaagaaggagcataggctttaaagttagttcagatcccacaactataaaatattcatggccttcggaacatgattacccaaaaggctagagaaattattggacaagagaagaacatcacttgcatttttcatcttaaaacagaggtatcatgttctttggtagtatactgattatgatgtattcttaccaaggggaatcaactctattgtcttagctatgaagacactgcattgttaaagtagaaggtcatatttctgtgttccagttctttactgtgtcagcaaatgaaatttaacaaggggagaatattagaaataactgggtgcttggtgtattttacaaaggtttgttgacattattgacatttgttccgttttagttaactcattatagaagaggaaacagtttttgtccattggaaaaagcaaaggatattttcccatagcctgtttgaatcccttggcatttggtggtcttgttcatactgagtagattgctttgtgcattcttatgccatttgcctctaggacaaatcccaattaagtaactactcttttccatttgaaaactggcatatgggcttcattccaaagcatcaattaaagcagcagtttttctactgggagcactttacctcctccttttgcgattagtttgagtattttcctataggaaatccattcttaatagcacattttccatcttacaatagaagggtcaccagctgcagttctttgcagtaaggatggagtataatatggaagtgtatagagtgaaatgggttgcttttcttccatcttttttccccctttacatttgcttttgcttgagtggttggtccctgaagaggcagtaactatgggcatacatatgtgtatgtatgtccctgcaacatttaaagtgtgtaaatgagaagaccttgcctaaacctgaataagagtttacatgattaacctaactaaaccctctctttccttatgtttccacaggagtctccccaggacagtgctatcacccgggatattaaccgaacattcccagcccatgact

SEQ ID NO: 134954 - DNA, 1142 bp, Homo sapiens
ggtctaaatttccagcagacaattagtctccatgtaaaagtctgtcaattgtatcaaacagaatgggtttaaaaatacagttcattttaaaacatggtttattatgaaaaatttcaaacgtaaacattaattagtataatgattagtctaactgataagtatagttaatatcccccacactaattatttatcaatgtattgtcacagttgcttcatcttttttttccttttttctaaagtactttaaaacaaatcttagacatcatgatcctaattttttaatactacatctctaaaaaataagtttatccatctttaccaattaattagtagctactccacattcaaatatccttaatacggctagttagaatcaagagccaataagacccacattacattaagttgttgtctctttttaaattaaacatagtcctccttttctcccataccattgtcctgctgcagacagtcatttctgttggttttcagtcctgtctttgtctaggttgagttagatatgactgatgtctctcttagcttcattctctctcttcactgccctggtacaggccagtatcttacattgctggcagttttacaaaagctgctctgcctttgggttctggcctgttgattctttgctccttgcctaacgcagaattagatcatttcagtggcctccacagaaacctttataactgctactttataacccatggaattaaatgaaaagtcctagttcatttccctggattccttagcttagtgttgaagatattttgtattatatcctgacttagcccttattgctgcttctccaaatattgtatgcattaactacattgaacttctcactgtgctctggttgattcacttgtctaacttccccactgaaccgtgatgtcttcaagggcagggatcatttcttagatatggtagcatctgtagcacttggcacagtgcttggtctatagtaggtgttcattaagtgttgatgaattagtgaaatgtcttttcttcccccagatttcgttacagccaacatgaaacttatactccaaacattttccaaatgtatcatataatttcacacgtatatgattcctttatcgtccatcagcctgaaaaatatgctcccc

SEQ ID NO: 134955 - DNA, 4216 bp, Homo sapiens
ggcttggtggctcacgcctgtaatcctagcagtttgtgaggctgaggcagtaggatcacttgagcttaggagtttgagaccagcctgggcaacatagtgagaccctgtctctattaaaaaaaaaaaaaatgcagtgtgggccaggcacactggctcacacctgtaatcccagtactttgggagtccaaggtaggaggatagtctgagcctaggggttagagaccagcctgggcaacgtagttgagatcccatctctataaaaaatttttaaaaattaggcaggcatggtggtgcaagcctgtggtccaggctactcaggaggctgatggagcaggatcccttgagcccaggaggttgacgctgcagtgagccatgattgtaccactgcactccagcctgagcaacagagcaagaccctgtctctaaaaataaaataaaatgcaatgtggtaataatataataataaccatgcatgtatagcaggtgccatagaggcagagaagagaggaattcattctgggggaattgaaataagtttggtgcctgaaggaagagtgcatgtttgaggcagagagggaaaggacatcccaaggagagggaacatcatgaacaacaacaaggaaatacgaagttttttttagcgcagaagtggtttttccttaatcttccctactccttcgccacaggaaatgcagtggtgatagctgtattcattgtaaagaaaaagttaagattggagagaagtattggcaccacttactgtctgtcaaaatgctgtcccagtgtgggtagcatcctccagggttctgtattcaaggtcctatagtgccaccatggcccacaagtggctacattcatttacatttcctctgtgtgttttattttccaggcttattctgtgtatgatgaagagattggttattgccagggccagtcatttcttgctgctgtgctccttctccatgtgagtaattaggtctctgttatgacttaacacatggcctccctcagcttatactaaccttaggcttgagcatggttttatattgggtttggacagactcttaaggcatgaattttaacacctatagctggaaactttttccttaaattaacttaatgtcattgtggaggagatatatgatgagaataaacggcaatgttgaaaactggtacaggggtagacttcctttttattaataggatgattggagagactttaatgttggttgaactcttggggacgttttatcttctctaaagtagccgctgtcattaatacttgttttgagatttaggtattggggtaggaggaaggcggaaaagttggttttcttttagtaccattttattcattcattggcttagcaaacacctttgccctccaccttttttattttctttcaaatccacagaaaactctaaacagtgttaaggtgaacagtctttatctagtttaccaattaatattttccacactgctttttctgtttgtctccctctgcatctctttttttctcttttctgcataaacacacattttcttttttacttaaattgttttttgaaattattcttgaaagtaaataacaaacatcaagacttctaaatacttgatcatatatatgccttctgggagcacagaattctgtatcataatcataataccatgatcacatccaagaaattccacattgattcagtaatgtctgatacacaatacacattcaattttctcccaattgtctactccatagaatctagctttttttctaatcaagatctaatgaagattcaaatattgaattgtcatttctctttattcttttaatctaaattactcctttgcctttttttgtgtttcatgccattgatagttttgaaaaattcagacaaattgtcatataaaatgtcccacagtcttgatttgtctcattttctcatgattcagtttaaaatgcttggcaagaataccacacaggtgatgtcagcaaagagttttgagtacctgttatgatctgtactgtgctgaagatcagaggtaaataagagacatggtctcaatcctcctggatacagagcttgtgaatccaactagctttaagcacataatcacacaagtatatcatttattactttcagtggtgctattaaggtataataaaaagtttggtgtaagattgtaacaagggagtcttacttagattaaaggcttctcaggggaagtgacctgtaaggagcagcctggaaaatgataagggatatcattttcttttgctcttttctgtgttaacttttcaaaatgttgttatgaaaataatagatctatttgaaaagggagtagagaatagagtgttaatgggaaagtgaatggtacagtatacagaagtcctaaactggggaaacacttggtgtatgggaggaactgaaaggaggacagtgtgactggagtatcctgagtgactgggagttgaggagagagctagggagagctttgaagcccagataaggagtctgaatcttgcttttctaagcaacaggtattcaagggtattaagccattttgtgtagattgcaatacaagtttgagtatcccttatttgaaatgcttgggaccggaagtgttgtggattttggattttggattttggaatatttgcattataccggttgagcatcccaaatccaaaaatccaaagtgttccaatgagcatttccttttagcatcatgtcagtgtttaaaaagtttcagattttggagcattttgtattttcagatatgggttgctcaacctgtacaagtaaaacaaaaaccactttggtttttcttaactgaacccagcttgttgctattggtagtcatgtaaaaatatgataaagctatgacatgaataaagaggttgactttttattttgttttgttgttttaatgagactttatatctcaaagtcccacaagcctgggtgatttatcttcgttctcaccttcagttcaaggacatttatccccttgaaaatgggttttccaatcagaccctccatgtcttgttttgaactcttgctgcttgccagagtgttataagtgcttgtttagagtgaggggagatgggctacttagcatcagaatcaccactgtgggttaggccacatctccttgcatgtggcaaagtgaagttgccttccatgacaaagacttcaaagatctgggcttttgccccagatactcttaacttaccagtaatgatctgctatgcttttctcacttattacttaatctgatttgctctttagttctgctttcttctcagtgatttctgtgctcagcccgcctccatcatcttgttccatagaagcctgcccaccttcttgacttttttgaaggcttgctacattcacaccaatccttaaataacatttccagtgcttcttttttctcttttgaaaatatcttgccaagttctcagggaaataattatccataaaactatggaaaatgtaggtattattataaatgtaaatagaagtgaaggaggcttttgtagtacttcaagcattactgcaagccttagaatatgtaaggttcttctaaaacaagctatatttttaacagtgaggaagaaaaacaattttgctagaatgaaatagcagctaagggaggaaaaatggttaaacagaggtcccaggatttgggaaagatgacacctacactgtatatcagcctatttctgctcagctcaaattctgtcctttctacaaagtctgtttctgactgccttaggcagatacaggccttcctgttcttgtattatcactgatgtctaattcctattacagttattttaatactggctgtgtgagagactccttgaggacaggaaccatactgacaaagagtagtcattgttaactattccttgtttgagtgaataaatgttttaaacacaaccttaggcctgagtttctgcatagcactaaattttctggtaaggcaataatataaagctggatttaatatcctgagaaaacttctgtatgttttgtgattccccaccgccatcctccctacccaacaacttgcctatctgttacagatgcctgaagaacaggcattcagtgttctggtcaagatcatgtttgactatgggctcagggaacttttcaagcaaaacttcgaagatttgcattgcaaattttaccagttggagcgcctcatgca

SEQ ID NO: 134956 - DNA, 1072 bp, Homo sapiens
cctgggacctctgtttaaccatttttcctcccttagctgctatttcattctagcaaaattgtttttcttcctcactgttaaaaatatagcttgttttagaagaaccttacatattctaaggcttgcagtaatgcttgaagtactacaaaagcctccttcacttctatttacatttataataatacctacattttccatagttttatggataattatttccctgagaacttggcaagatattttcaaaagagaaaaaagaagcactggaaatgttatttaaggattggtgtgaatgtagcaagccttcaaaaaagtcaagaaggtgggcaggcttctatggaacaagatgatggaggcgggctgagcacagaaatcactgagaagaaagcagaactaaagagcaaatcagattaagtaataagtgagaaaagcatagcagatcattactggtaagttaagagtatctggggcaaaagcccagatctttgaagtctttgtcatggaaggcaacttcactttgccacatgcaaggagatgtggcctaacccacagtggtgattctgatgctaagtagcccatctcccctcactctaaacaagcacttataacactctggcaagcagcaagagttcaaaacaagacatggagggtctgattggaaaacccattttcaaggggataaatgtccttgaactgaaggtgagaacgaagataaatcacccaggcttgtgggactttgagatataaagtctcattaaaacaacaaaacaaaataaaaagtcaacctctttattcatgtcatagctttatcatatttttacatgactaccaatagcaacaagctgggttcagttaagaaaaaccaaagtggtttttgttttacttgtacaggttgagcaacccatatctgaaaatacaaaatgctccaaaatctgaaactttttaaacactgacatgatgctaaaaggaaatgctcattggaacactttggatttttggatttgggatgctcaaccggtataatgcaaatattccaaaatccaaaatccaaaatccacaacacttccggtcc

SEQ ID NO: 134957 - DNA, 1030 bp, Homo sapiens
tggatatgattttgggcctttaggaggcagctgaaaaagtgaggcctttgcataaagttaagacctctgaatggctcccctatctgttaaaggaggaatacaaaaactacctattagcctgagaaacagtagaaatcataatataaaatgaatagtggattagaaaaaaaaaaggaaatagaacttctggtaattaaaataatcatcagagtttacattctatttaaaatgttacatacttcataggtattacggctaacagttaatgatagtttaccatgtgcttggtactatggttaagtgcttttatatgtggggattagcgacgatatcgtatgtacagtgtttaacatagtgcctggtagttagtaagggtccaagaaatgatggctacgactataattatttcctccctgatcgttaagtagataacaaacattttacagtaatattttcaaagaaaataggtttgcacaaagcatagatagaaccaagtgagttctgagattctttgagtcactcttcccacctcagcctggttcagcacacaagaggatgctgcctcttttttgttcatgatttctttgcctccaaaatcccctttctcagtgtccccatctcaattaggggtacctggttgctcaggccaaaaaccttgctgtcctcttgactcctctctttctcacactccacatctatgctcgtcgtcagaatatatcctgactctgatcaccgccaccttcattattaacatcctaatctaaccatcatcatcctttcctgtttccacagtggctccctccctggctcttctctatcgcatgtctcctttgctgaaaactcacgtttccaccatccagaggcatcctgcattcaattttgctccttttctttccaaatgttttttatgcattcttaaataattgagttcatacagtcagtatcatttttcttcctgtttcatgcaattatacggattttcctcactgagatattgtgtgtaaataatcagttgtaaatggttatataa

SEQ ID NO: 134958 - DNA, 1195 bp, Homo sapiens
actctgattctttctcctactacgtttcccccttctccttccaattcagacacgctggcctccttgctgttctcagacctttgcactggtcagtctctctgcttgtaatgttctcctgaatgtctgcatggcttcactgtcccctcatccagtcttcggctcatatatccacagcttctcaaattgcagtatctaaagtagcagctcccccaacctttatgccattacgtccttatcctatcttatttttccctactggaatggaggctgtgcagcagaagagacaatctctttggcttactgctgaatccacagtaccaggaacaggatctcgcttataaatatcgattgaataagtgaatgaataaatacactgttgagtgtctaccatgtgttttacaaagaagagttaacatggatttgggcaaagcttaatagtttccagccagaagttttaccttttggattcccattagcttgaaacactttaataatatatggatcctttatttccatatatggaaaggtggggaaagtccagataggaggtatctaatgtctttttttttcttgcctatgccttcaatgagttaagtctgacaaggctgccttcagtgtgtctgcacagcacatatattttgtgcttagatatataattccttctagacctggagaactttgcatgtttggggtacactttggatgtttccccctatttgcacatgatttcaggtgagatagtagtttttcttgaaatcggctcatagcctgaaaagagtacagattcaccagaacataagagaatgggatttttctgccagaaggtgagctatggtatgtacagtttagttagtgatgatttgttgtcttctggcagctatacttaataccaaaaaattttaagagagatacacacaatagttgaacctgttatgggcaaagtgataattcagtggtaacttgccagttcaaaattaggaagtcattggcaagtgcatcctgagccctgcattctgtggcttgcgtgaggtatgagtacacatgaggatctgtggtttgagtccattagacctcgaaagggcggttcatgatatgtggttccaaaagcttgtttggaaacaagcttttgaactttttcatgtggaatttacaaaggtaacttttgctctgcaactcactgaaatctctttccatt

SEQ ID NO: 134959 - DNA, 1355 bp, Homo sapiens
cctctttctccttaaagtgaacttattatggaactgaaatgttttacttatttcttgaggagtttagatcccctgctcctaaactaaaatttaacagtgtaccttagaactcatttagctatccattgaacttctcccgctttatgggtcagtgacctgagatagaaaaattgttccacttctgatagaggatctaaaaggaattccattctaaatagattattctagaagatcatttatggacctgggagccccacagccctttcatacaactgcaccttgcatagtctttagaggggaatattgaaaggtcttttagatttttgattcaagaaatatgcaagggaagctctttcttcatgtctgtataggcatttttgagaacaagtgagacatatgaggctagtttagaagacccaagaatcatgctctaagagatggcccagtgagtttcctagatcagacctgaggacttggccattttgccatagaatcctgcttaaggtgaaatggaattgctgaaccattgcttcattagaacgtgtcattttaaacacaacgtgatgtgccagacttcaaactacttgtaagaaaagatactagtacaaaaaccaaatagcagtgtctccaaattaatataattcttaaccatttgctatttggagaaacagaaaactcttcagcattttcccttgggggatatttttattccagagcttaaaaacaacactagtttgaacttcattctctgttcaaattgtttgtgtagttagtatgtattagatttaagctctctgagggcagcgacttcatccgtcttgtttgttgatggattcgcagaatcatacacagtgctctcatacagtgaaataatcctcacagtgaccatatgagggccttttagggatgtgcatactgagacatagagaattgatgtaaactctcaaaggatataaagttagtaactaatggagttgggattagatcccaagagtttcagactctgaagtcaattcttatgggcattctgctttactgtaaatgatggattgaatgaatgggacaggagccatttgtgtgttatccctttttagtgatgttagtaatgtaatctcaatctctgtgtcagagttgaaacttattctctatacactacacaaagttcagctttctttataactagaccagactgtagttttatttctttgcttgttcctaccttttagaatcagattttatgaggaaacttctgaatggatgctctctctgtaatgaaccctaaattttgccagttgttgcaagggtagcagtgggcactgccttcttttaataagctggtctcccttagtccttat

SEQ ID NO: 134960 - DNA, 1731 bp, Homo sapiens
gccttctgataggaatcagtgaacagcgggtatgattcagagctctgagtctaaatccatagcttcccttgcttcccgaattcaattaaaagttaaaagtaagagaaaaaaatgagtcttggacttctaagtctctgttcattaagtgttttcattcttattgtgtgaaacgcgttaggaatttcacaatgaataggacttcctgccctcatggagtttgtacgttggcacctatatatatctttgtattgctaatgccactgcacatagtagtgcttaactattggttaaataaatgtccctgctgcatctttattaaggtaaaaaggaagcctttggctttgatttgtttaacatcctatttttatgagtcccaactactttccaagcattgagcactggagatacaatagtaagcataacagatatggcctgtctcctggtgggaagacagacaattaagtagaaacctaagtaatcgtgagcttggattggtgccatggatgaattgacttgatgctatgagaatagttacataactgaaagaactggcctgacaggacgagagtatgagggaagggtttgctaaagaaggggtgttggaactgcaatcccagaggtgaataggagtgagccaggtatgaggttgtccaggcagaaggagcatgcttgcattgcatgtccactttggttgccatttccattcagaagaaaagtcaatgcaaggaaaagagagtcctttctcagtaattcagcaagcatttctgggtactcgctatacatgaacaggggacaacaatgagtgagagacagttctggcctggagaagacattcataatgtcataggcaggctgggaggtgctggcctctcccagatatggcctcaaaaggaggcttaaaatgcccctgctgctgctggcaccttctggttccccattcgggtttcaggcatcagcctttatcttggaattggtgcctcagaggcagcctaaactagttgggtttggtatgcagccacccatgctgcaaaagtcagcatcagccgtgaacccatgagaagctatggtgtttttattgattttgtgtttgtggtgagtgtttaagggagaaagggagggtgggagggagaaagagagagactgagaagaggtgagggtgaagactgggaaaagactgagctggtgaagaagtcaggactctggaccagcaaagtctgtgaagacagcagagctttgtgtacacccgttcctgagaggtgacccctgaggactgattcggaagtaaatgaagaccatcagctagagaaacaagcagagctcttagagaaaccctgtataattatgaaaatgatacttaaacagcattctgtttttcctaattataaaaataattcatactcaatgcagaatacttggaagacatgggaaaaatgaaaagaaacacccatatcctatcatgagaatgtaagaagcaaatgagatgttggtccgtgtaaaagttctattatttaccaggtacttatcacacaccaactcttgttatatatgatactgagggagaatcaaccctattactatgagggtgaggcagctataataagggttaatgaaatatagaagacattgttttgtaattagcctattacaacatatatctatggggaaaaatgttaattcttccttaccccagcaaaagaatgaaaagttgaagaaacttgaagatttgtgaaa

SEQ ID NO: 134961 - DNA, 1042 bp, Homo sapiens
ggcagaaggatcacttgaggccaggagtttgaaaccagcctgggcaacacagcaagactctctctacaaaaaaatataaaaattggccaggtatggtggcatgtgcctgtagtcccagctactctggaggctgaggtgggaggatcccttgagccaaggaggttgagaatggagtgagccaagccaagactgcaccactgtgtcccaatctgggtgacaagagagagaccccatctaaataattaaaaaaaaaaaaagaatatgaaactaatggtaatcccttcctgaaacttcagtaatcagcactaaagtgctgacgtggaaatctgcctgttagtccccaggtccaggtaactaggactctcagatctactccactctaactttcttattttacagatgaagaaataagacctagaaagggaacaggataggcccacatttgctgcgtgttggtgtcagtgtctccagacgctctcagtgggagagtgtgttcctctcccattgactgtggacacctcccctagtcaggctgtttgcaggtctgcctcaatcagagctctattcctggagtctggctgctgcccaaggttagacagccaggaagacagcattctgctccagctgacctctacagaaagatgctcactcaacacctggggtgaggccacaaactggagcaggacatctttaagctgagatcttctgcagtttaggcccaatgctagggtaaacttttattgtgtacctaagtgactcacaaagaaagcacctaagtaaaatgtctatgcaatcagtaagtgtatagacaatcctaacagatcaatagtagtggaacagaaaataaatgcggctgcgaacagcaaacacttcatcccagtgcttttgcattctgaataaatgagaggaagggcagtggttatgaggctcccatggcactttattaaaaaaaaacaaattgacaccaaatcctgtaaaacattttcacaaatcttcaagtttcttcaacttttcattcttttgctggggtaaggaagaatta

SEQ ID NO: 134962 - DNA, 1056 bp, Homo sapiens
agatgatatgattgtatatgtggaaaatctgaaaaaatatatttaaaaagctgccagactaacaaatgagtttttacaaggtcacaggatacaaggtcacaacacaaagaccaactgcatctctagagactagcaatacacaactggaagatgaaatttaaaaaacaataccactttacaaaaatagattaaaacatgcacgtcttgtaaattgaacactaaaaaacattgctactgagagaaactgaaaaagatcttaataaaggaaaattttaacatgttctggattgaatgcttcaactgttgttcagatgtcagttctccccaaattgatctacagattccatgaacctcactcaaaagccagaggcttttatttctagatattcataagctgattctaacactgatacagaaatgcaaagaacaacaaagtcagagaactcacatgaactgattttaagatttattataaagctacagtaagcaagacagtgtggtattggcttaaggatagacacagaaacagacggagcagacagaatcaagaagtgaacccgccaatttagggtcaattgatttttaataaaggggccaagctaactcaatggggcaagttcagcaatctgcaaaatgtcacagaactaataaggagctgaggcagagtttacatcctgctggacagcagttgggctcaccagcaagtttccttcactctcatgtctgtctcaacacagaggagtgaccctgctagaggggactcggacatggtcctatcagctctgcagggaccttccatagcttcccctcatccttttaacaccagtgtcaggtctagtcattactcccatttcatacagaaagcttgattggggtcaccgaggaattaagtggctggcatggaatttctccacagctgttgtgtgaagaacagcaaaagtgacaggtgatgaataacaaaagtgatgtataatcaaccgaaaatacaagagggccctggaaattttaaagcctcacaccagagcttttctctgagatgcaggaaggaaagagctc

SEQ ID NO: 134963 - DNA, 1065 bp, Homo sapiens
tgtgacattttgcagattgctgaacttgccccattgagttagcttggcccctttattaaaaatcaattgaccctaaattggcgggttcacttcttgattctgtctgctccgtctgtttctgtgtctatccttaagccaataccacactgtcttgcttactgtagctttataataaatcttaaaatcagttcatgtgagttctctgactttgttgttctttgcatttctgtatcagtgttagaatcagcttatgaatatctagaaataaaagcctctggcttttgagtgaggttcatggaatctgtagatcaatttggggagaactgacatctgaacaacagttgaagcattcaatccagaacatgttaaaattttcctttattaagatctttttcagtttctctcagtagcaatgttttttagtgttcaatttacaagacgtgcatgttttaatctatttttgtaaagtggtattgttttttaaatttcatcttccagttgtgtattgctagtctctagagatgcagttggtctttgtgttgtgaccttgtatcctgtgaccttgtaaaaactcatttgttagtctggcagctttttaaatatattttttcagattttccacatatacaatcatatcatctctgaatacagtttttcttcctttcatatttatctgcctctctttttcttgtctcactgcactgactagcatcttcagaatgatgctgaatggttagagtggacatcattgcctggttctggacattagctgtaggtttttcgtagagtaggttgaggaaataaattctcctctgttcctgtttgctgagagtttttgtcatgaatgggtgttgaattttgtcaaatgcttttcctgtgtctgttgagataatcatttggtatttctccttaattttgttaatatagtgaaataaattcacttttcaatgtaaaccaaccttgcattcctaggataaactccagttggggtttctattttttattaaagattttaattcttattaaatatttatatgttcataaggaatatttgtctggagtttt

SEQ ID NO: 134964 - DNA, 1153 bp, Homo sapiens
agcttttagttaagatctaatttcttgcctggtctatttattaaaacagtcttctacttgctatgtctccctcttctgtccacctaatgcacaccaggcagacaggtaatgctctatttctggtgacatcatttcattttggcaaaaatctttaaactccctagcatggcatttgaaatgcttcgcaatctggatccacacactctcttccagccttagcaccacctccatcccctactgcaaggaaagaactcctgagggtccttcctgggcagccactctcctccttgtgctgctgaacatgccactccctctgcctggaattgccactgttctctctctcctgtagctacaagccctgtgcattctttgatcacagcacagctactgctgccttggtgatgcctttcctgattattccgggtagtcacactaccaggccttagctttgcagtcccagacctataacagggcctgccaaagagcagatgcccagtgaatgtgtgccatgagggagaatcagccctaaagcttttatcctgaacttgttccctccataaacagtgcttagggtttagtggtgctggtggacctagcaatgtgtattaagatgaccaaaacaagccctaacttctttatcaggaaaggaggctcagataggtagtatattaacagtcacaaagctagttaagtggtgggaactggaagaacaaaagcttgcatttataaagcccccgacattctgccaagccatttgtgcacactatcttacttagtcctcaaaccaacctatcagatagggactctcatcatttccatttgtagataaggaacctgagatgtagggaggttactaacccaaggtcaaacagttcagtggtagagctgtgtttctaaagcactgtcttctcatcccatcaaaagattccaagcttttgtgtattattctcaatatgacagcggaaatcctcaagacaggccaaatactgatgagacatccactggccagtaacaagtcctatatttcttctcatgacaactgtgaccaaagtttaaaaggtgtggaaaaaccccaaaccataaagataatttctggggtctctagtgcacatcaggaaacccagcccgcaggcacatgtctgagctctgctgc

SEQ ID NO: 134965 - DNA, 1100 bp, Homo sapiens
gttactggccagtggatgtctcatcagtatttggcctgtcttgaggatttccgctgtcatattgagaataatacacaaaagcttggaatcttttgatgggatgagaagacagtgctttagaaacacagctctaccactgaactgtttgaccttgggttagtaacctccctacatctcaggttccttatctacaaatggaaatgatgagagtccctatctgataggttggtttgaggactaagtaagatagtgtgcacaaatggcttggcagaatgtcgggggctttataaatgcaagcttttgttcttccagttcccaccacttaactagctttgtgactgttaatatactacctatctgagcctcctttcctgataaagaagttagggcttgttttggtcatcttaatacacattgctaggtccaccagcaccactaaaccctaagcactgtttatggagggaacaagttcaggataaaagctttagggctgattctccctcatggcacacattcactgggcatctgctctttggcaggccctgttataggtctgggactgcaaagctaaggcctggtagtgtgactacccggaataatcaggaaaggcatcaccaaggcagcagtagctgtgctgtgatcaaagaatgcacagggcttgtagctacaggagagagagaacagtggcaattccaggcagagggagtggcatgttcagcagcacaaggaggagagtggctgcccaggaaggaccctcaggagttctttccttgcagtaggggatggaggtggtgctaaggctggaagagagtgtgtggatccagattgcgaagcatttcaaatgccatgctagggagtttaaagatttttgccaaaatgaaatgatgtcaccagaaatagagcattacctgtctgcctggtgtgcattaggtggacagaagagggagacatagcaagtagaagactgttttaataaatagaccaggcaagaaattagatcttaactaaaagctcccaaatctttaggcatttcaggcatttctatgccagttggagactgggggaattccccgaggcctctccagagtaaatagactgca

SEQ ID NO: 134966 - DNA, 1041 bp, Homo sapiens
taaaataaaaccaacaaaagaaacagtaatacaattttactggtttatatttcaattcataaagttgacacactgaaactaccttagcacaatgtccacacacctagcattagataggcttacagctattttggtaactgaacaagaaagacacagaaagcagcaaaggggatggttggtggggagggggttgccacttgttacctcccttattacagataacctcagcaagcgttagtacagccaataagaaaaagagctacaaaacaacccgagtgtctttatatacaaaaccagtgcctcttgtaagcagccgcctcaacactgaacgcagaaaagaggacaaaaccatctgcgtgtcagcctgtcagcatatcactatataaattaaaagtcaaagttttttttttttttaaaggtgctaaaatccattccatagctttgaagtgagaacttacagcccatctgaacagtgaggtttgtacccaggcatactctgaggagggcccaaaggcccagcccatctgggagggacaggcccggaggatggagacctcgcagcatgtgcaccctgcgcagacatttacagacacgcaactcagtctttctcacttggacaacctgttgtgcaaaaacactaggaatcttgaagtgagggagctctgtccacagctcccgtaatggcagggaggagagcagagcccaatgaaccttgagtgaaattaagtgctcgaataaccacataattaaattgtgcagatcagcagtcctagtctggaatttaaacactgtcaacggggcatattgggaaagatatttatatatatatatacatacacacacacacacacacacacacacacacacaaacacattaagcaaaataagatttgtccatgttataatccagtctcacagtcaagtcacccaccccagccttttgaagtcatttggcagctaatgctaaaaagtaacaggaactatgagagttgcatagaattgatcagaaacatgaataatgccaaacccaaaacctgcacc

SEQ ID NO: 134967 - DNA, 1413 bp, Homo sapiens
cttattttgcttaatgtgtttgtgtgtgtgtgtgtgtgtgtgtgtgtgtgtgtatgtatatatatatataaatatctttcccaatatgccccgttgacagtgtttaaattccagactaggactgctgatctgcacaatttaattatgtggttattcgagcacttaatttcactcaaggttcattgggctctgctctcctccctgccattacgggagctgtggacagagctccctcacttcaagattcctagtgtttttgcacaacaggttgtccaagtgagaaagactgagttgcgtgtctgtaaatgtctgcgcagggtgcacatgctgcgaggtctccatcctccgggcctgtccctcccagatgggctgggcctttgggccctcctcagagtatgcctgggtacaaacctcactgttcagatgggctgtaagttctcacttcaaagctatggaatggattttagcacctttaaaaaaaaaaaaaactttgacttttaatttatatagtgatatgctgacaggctgacacgcagatggttttgtcctcttttctgcgttcagtgttgaggcggctgcttacaagaggcactggttttgtatataaagacactcgggttgttttgtagctctttttcttattggctgtactaacgcttgctgaggttatctgtaataagggaggtaacaagtggcaaccccctccccaccaaccatcccctttgctgctttctgtgtctttcttgttcagttaccaaaatagctgtaagcctatctaatgctaggtgtgtggacattgtgctaaggtagtttcagtgtgtcaactttatgaattgaaatataaaccagtaaaattgtattactgtttcttttgttggttttattttaacagcatattgattaaatattttggtacaaacaaacagcattgctttgtaaaaaccagttttgtcatcacctactcctgtcgcctccccttcttccctcatcccctgcgcacagaagcagtcagagaagaccactgtgtgtgctgtaagagaggcatgtgtgagcgcgaggcagcccctcacccacctgttgagacgtatggagtggtagggtgtggcaggccacatggggcaagatgacgacgttgatgcctctgtgtttgtttatgatgaacattgcccctctgagaaataacatgctgtagtagcagggatgagggacacttggtgtttttgaggcttaaggaagccttacaggaggtaagggtcaaattagaccttcaaaggcaaaagcatctcaccaggcagagatggaagagggaattccagggccaaagtgtgcatgtgcaggggaaacagctgaagagtagaaaggcaggctgagcacctgggggccggctgtggtctgctaaaagctttaaaagca

SEQ ID NO: 134968 - DNA, 1059 bp, Homo sapiens
ggcctgctcagccttagcccttcgtcaggcccaagggtgggggaggcaggaggaggctgagcgtagtcgtggatagaaacctttccctaccgcacggttacacacatggcatgggactcctggctgtagctcactcgggtctactgaagaccaagttggtttttagaaatctatttaaaatatctatcatgtatctatttactgtgtttttctgaatacgcaagtgtaaatagtataatttgcagtgcaaaatccttggcaataactttgtgtattatgtttaaaaacactggaaaccgtgaccaccatggactgcccttcccctctgaggcaattattacatgtaggactctgaactttaaaccttcagcgtgactgaagcagcagcctgcacatgtggatggtcatcagtgcctcgcccagagatacctggccttcatccaaagggaccctgctgccacaagtcctccaggcagcacccgcactgtggctccttcgcactgagtatgttggactctgccatagactgaccctcttgtctggctgctgcagtttgtctgtaatgccctgacatgttgcattctccccatttggataaataaaaacaaacaaatgcttctgtcacacacagtaatggattgttctgtgcaagacccactgataaaatgaaggatacagctttggtgaaaggttcaagtgcaggctcccttttcctggcccttaaggctctagttcagtacatgttacaggttcttcccttcatgcaaagggatggaggggccgaggatgtttgaaggggggtggatggctcctgataatggacagtgatttgggtggggccagggcctaattcatgatcccgttatggtccttaaaaccctgcctctctgtggtgtgaagtttcctcaacatgaaacatgaacctggcaccctggcacagtgagtggtaagtgatgtcatgttgagtgagtgctgacctcttaatcgtcacacctgttcgcggggtcagtaatacccagacagacaatacagatcggaaaccgaggctcagggttaaag

SEQ ID NO: 134969 - DNA, 1027 bp, Homo sapiens
ggaagaaagaggtgcagaggatttgaacagaatgagagtcctcctctgtgcagggagaaaggcttcagtgggtctccccctccctgctagggatcctccttgccagccctgggctgggcgctggcaggcccgttcccaggtctcccgccgagggcaggagaggagccaggcctcaggagagaagtgcttactgagtaatttaccaagagcgataggcttcccactgagccagacgggatccccaggaggggagtcagaggcgggcctggcatgcatgcacagagagagtgtgcccacttggggagtgtgaagggccttgctgtgggacccgagaggatgagcagagtcaagtggcaggtgggacacacagtctgcagtcacttcttaaaaggccctgggtggtgtgtccttcaatgatgaccattgtccacaatagtgagttccagagggtcgattgggacagttggatagccaaggaccagagtcaggaggcaaggctgatgagcaagaggctgttgccattggccaggcgaggcgtgagggaggctgatggagcgcagcagcagagggatggagaggcaggaatggcatctcctcacaggccaggctcctctgccggattgggtagggacgggaagatgatggcccccaaccctgggccaaggaacaatagcacccatccgggggcgggggacctgctggagtacttctcctggaccactgctcagtgggcaatagagggaacaatggtgtttctgaccaggacgggggaaggcaggggaatggaggaagatactgacagggtacagaggaggtagaatggagcgagggccatctccaccgggctaggaaatggggctttggtgggccacactccattgtgctggagcactctggcatctccattggcagtggggaggggcttgtgacctatcagcatcttcaccctttctgagtttccgccgggctgggctctccagccaggagtcacaggtaccgggtggttgttcatgctgaggccttttgc

SEQ ID NO: 134970 - DNA, 1597 bp, Homo sapiens
ttaccagctcctgggctaatgaatgacagctgggtctctgctcaggcgtgggtgggtgcggggatggctgcgggatccttttcaggacaaagtattcctcatccaccccaagtcatcctctttctgggcacttggcaatgtttctgtgcaccctgctgtaatcctggaggggagcaggaaaaaggaacctttgaatcccaggctgtcgtgttctagagcatgactgtgtcagggagaatgagcgcctggcattcatagaacacagtcctctctcaggccctttcccgtttgccatttcatgacttgctgtactggtggcccttggagaagcagcagtgcatagatcgttgttcccaccttgcagacagggagagtagagcccagagatctctccaaaccacactgcttatttgtggcaaagcattgtggcccctaatgagtttttaaccaccagaagaaataacatttcttaagactgtttttagaggtaacagcagccctttctgaggaattagttttgaatttcaccacaactggaattagaaattttctccttttacagatgaggaaatagatgcttagataaggtgacttgccccaaattatagtgcggtgagtggcggcgctcaccccgtctgaggctatgctgtgtgcaggtggtttgcgtcgctagtaggcaccaatgtccgttctgtcttccaagcccacttggcagcagtggcttctctctctgtgatgtgttcggctcacctttcctgtaggcttctgggctatcccctgtgcgccttgaaaccaagcaaaaaccaacccacatctccctgatccttccttagcctcctaaaatccagactttctgggctcgttctttttctgttcctttgttagtgtgctactgggcaaggtgaccaactggtcagccctgggccaggcagcctgtttttttgttttgttttcttttttgccagctacacagttggggttaatttctacagaccatcattttatactgtaactgaaccctataataaagtgcaaattcagtaattgctacttggagagctcctcaggggtgggaaggaggacaggggatgtgctgttggaagtatgtgttttatgttccgcctcatccacactttggtttttggccacatcctccgttcctggctcggccttcaaacatgtgctctaacccatgggatcaccgtcacagtaacacattttccagagcaatctggtgttgggatccccttggattcttccatcatgagacttctcggaagtctcagctttctaaaaatccctcattcctgcagaggctacgttaaaggaatatggtagccatcatctgggaggtaaaaaacctatggaaattggcacctggggaactcaggaaagctgaaagcaccttgaaatgagatggaaggaccagaaggttaaggctggtgaagaggagacctggagagaacgtgggcactcctgccaggtatttttaagggattatatttatttgttgtatgtggttccaaagggtgaaagacaattatgggaagccagtggggcaatttgagctaaaatacacctcccgcgatgacagacg

SEQ ID NO: 134971 - DNA, 1394 bp, Homo sapiens
aaattaggttatgtaagctttacagcacagctagaaatagagactagaaaccatgcgggaatctgggccaaagaatttctctccttccagcacattcccatggggctcaggaattagatgagttaatacacataatatgttttgaacagtacctggtgcagagtacgtactcagtgaatgttgagtgttcttaccatggttggccgaggtgaggatgaacgtgaggagggcaaggctctgccaacaggtgttggagaggcaggtgcatggcctgctcagggtggagctgtgtcggttccttggtgctgataggcgtcagctgctgccaggctttgggagaagactcctggtatctaggggttagacaagaaacacaccccaaagacctggtgagagctagtgtggtggcgttgctgcagatccaagcttaaggaagttgctcatgtgtctgttacagtagttaaattaccagccagtctgctgccaagggtttgtaaatacttgttttttggcggggggcggggggtgggatttaagggtgcttagaacttcataagggctgatcttagaatatctacctgctgagtccaagtgtccaaccagtgcattaataattttttaaaaaggtgtttggttacaactgcctccggaatctaaccttcagggcttaccagtgtttagtaggtagaaagcaagttcctttaaagcacagaaaggaaaggaggaaactgattggtgtgcttaaaaggctgttgactaggatgcttcagtgaaaagcactcctatagcttgtctcttctagtttgctttgatacttttggggggaaaaatctgcactcaacaccatatgaggcctcccttctgcctattagtcttagagaaaacatatctgcccatctattcgtctttctttttgtctatccatttactgtctggacacagttggaaagttgctttttttcgataagaggaaaatgggtacatgatgaaattgatgcttttggattaaatagagggtgcacgtcttatcttccattcctttgtgtgtctacaaagacttcaggagcctctgcagaaaggtggtcagatgcatccttggctgttggtaagaggtgagctaagtggggaacatagattggagccctcagatgctccaagtttataaaaactgcgttacgtagacaaggactgagtgttacctttaaggaggcaaataagatttggcttgtagtcaggaggtttttcttaaatctaagaaatacttgtttagctaatgtcctgcaaaagttagtacattccccccaggggaggctgtttggtggagtctttgccttgttcagccagcattgagggaggacttttttgccttgactgatcagttgtcaacattctaa

SEQ ID NO: 134972 - DNA, 4980 bp, Homo sapiens
gcctggttcctgatgcagtcactgattcttagttgattgatatgtatttgccccagggcactttaatttgggctgtagttattttttttaatacaatagagacttttcatttaactttaactttgtaaatattgaagtgtgtaataaagccaataaaatatgggtttgaatattgttttagcttattatttttgatatgttttggtatcaaattacaaggaattgaaaactaataacttagccctagaagcccattcacttgtaagcaaagtgctaaaacaaagcaaaggtgattgttagtttgagccagtctactcactttgtaagccctttgtactcctgttgtacaagggccatccccatgataaaggttccattctgttatttgagcattgcttattaaaatgatggcactacccagagatggggaaggagaatgtgattatcctagtttatgaatttccaagtttttaaaaataataaattaatcaatcaatcaccctctcttgttcttgtggccttcttcactctgtaagatattgtgttcactccctggcttttttcatgcagatagaagattagtgattttgctgggattcattgaagggtctcctttcctcttcaattacatcagaatctaaagcagcaacagggtccccataaaaacttgctcttcgattgtcccagttcttgttgagtgctgctgtgaaaagtgacaggtttcagccatgggtcagcatttctttttaagacacctgatgatgctggtggaaatggatcagtgggtaacattgtgctgttctgtaaagggtgcagacctaagtcctccacttgcattctcaccttgtttggaaagccaatgatgttactaggtcaatggtttcattaaggtactcacccccatgaaggagcagcagtgtggtcccctgtcaatatttataaggcaccatgtcttaaaaatgtctgtttttagtatgaattagctttcattttccctattcagttctgcttttgggaacttgacagggcccatccatgagaatgggcttcacaaaatatggcaaatgtatgtaccaaattccttcgggaccactaaataaaggtgaaatgggcaatgtacaacaaatgttagtgtcacttctcagatatatattacacaatgattagtttgtttcttctccttggtcttttgtctttattagtggtgggtgatactttaataaaacctcatcacttgctggaaatagctgtaacttatcattctcatcctgtgcattagtggctagacataaacaagagggcccatttcagctgggagttttcatgtttcattgatgcgttttgctgacctatggatgaaacagagccatcactgagaagaaaaagcatggctgatagtgtccagtttttattaattaaatctttacagtagtcctcattgtctttggaatactattaattggcagctgcggctgtattgttatttgaaattggtcatcaaatttggattccacgttggaatctctagatatttctcgttagaaaattcttttgaagtagctgactctgcttcataactcacgcgctctgtaatggtgaaaagggagctgtgctgttttccaacatgatggcagtcatttcaaatggtttctaccaagtcttttttttttttttttaattttgttgtttgttggaagttactaaccatgttgtaaacctgcccagttgctgcaaacttttacatttctctgctttacttaaaataatcgagctgtcagtcctttgttagaagtggtaaccatgcaagttcaactgtttaaattctgtaatgaattaagtgtccccccacctgttgcccttcccacccttccattttgtaatgaaaattccacttacagctgaaagagcagagaaatataaatgaagctcttggcttcaccaaattgcctgagattaacatgaagttttgcttctctgctcttttctccactgtaggtggttttttcattgacagcccctattgccagcctctgagcgtcgcaccatttattattcacttgggccctcaagatttcttctctgacttctagaaccatcaggttgtctggcttgaaatggcaatttctatgtcttggtcttaagagcaatgtgacaccctgaggctatccagctttcagacactccactctgacaccctctttttgaaagcaatgactgatcattttaaagaagagcaatactttgttcaaagccacggtgtctgttttaaaacttttcctttggaaacctagcaatatctgtacttaacccctttttagcatagtttcttgtcagggagtttacaggtcagtgtagagcttaaaattagcgtgtgagctgtgctatgttctgacagttttttacactttttagcacataaatagttacattcctgactgcgtcagttagcgttactataatttctcagagataggggtcctccttgaagccatatcctctgcacggggactggcccctagccagggatgtggcttgcagcttgtgtttcttcaggctgcaggagtaccccatctcttgtgcaaggtaattggtccagtagatttccaacatacctcatgctgactagatgaagtgcatgggtggtgaagtaaggagttgagtttatatagttctgaagtcgtttgtagtctctctcaaattgttagcctggggaacaaaccactgagagattttgctggtattggccttttctttttttttttttttttaattttgggtgaatgtttgaaaatcatgaatcagccaccattattaattgaagagctgggaatacctcgttaatgtatttttaaaactggtgttggaccctctgtgtatttcaggttaatacttttaagcagttttcagcacgtttatctcactttattctcgttctcctcggaccttcgtagccatatcacttgtataaaataggctgagatatagtgactgtaagctgtgatctcagtatacaaaggtaagctcttttattttctgattaaagagaaaaatagtcaattaagacaacatgcatatatgacaatcatatatgatgtatttgatctcttaggtcatatgtcatcgcattacctttaaaaattgtatggtctaaatgtaaaatagttatttttcaacatttgttttaatacccttgtaactgctttttactcaagacagacatttcacttacactaagtgtgtgtgtgtgtgtgtgtgtgtgtagaaacttaggatataacacgtatgtaaattacacacacatacctgtttaaatgtaagaattcagtgataggaacagttcatctaagaagattttaatgacagggcactcttttggccaaagcagtggaatttcctaagcagcaaggttggtaatagtgctggtaggatctgtatgtgtaagctgttacacaagctgaggatcaaagtgccaatttctcaaggagaaaaacttctccgagaaatgaaagtctctgatctgtgttgtatgccctaatacaacaacagcaagaagccatagaaaaaagcaatagaaaatgaaaaaaaaaaaaaacaaaaacaaaatattatggtaactatggaaaagtatataattgactgagctaagttaattatttgcagaaccaacttcagcaagactcgggtggtgaatatcgagtctgcagagaccaaatagacttaaagcaatccatctgtcttttccaggttaggtagctagattatttatttcccaccttattcaaccatcatggagttcatgtaaagatgtgagggttaggcagacattttaataaagatttgcttcatttaggtgtgtcccataaatgcatttaattgtgttagatgttgtgtgctaaggctgtatttgatatatgtagattaaaatgaatttcatgtttcatatttgtttctaagtagcagtttcttttgatgactcactttaaagttgctggaacaactcttgtttttttccatgcagaatctgtatgtacatttaatgtggctttggcatctataaaaggttgtatgaggtatagctgactagtactgagtgcgatccagtcctgctgaaacagcccagtgcctattaggtaccaggtcctcttctgggtacaagtgaacagaggctgtgaccagtggaagcattttaattctgacagtctccttgttgttggaattgggcctattacaaatatcctactttgggaaccagatacttagttaactgtggcaaaaagaatattagctcagttattagtttaattataaactatttaataatgtaggccctctgacatcaccaaaataggcgtcacttggaaattcactcatttaaaatatttccctggcagttttgagagcctgaaacctactctggtttatgttcatggacctctgtccaataagtgaacgtaatgaaatgaattcataacaaatactccggtcctttccaagtagtttttatagtagaacaaaggacaaagtggttaatttaaacacggagcacattttttttaatgacagatgagaaagtttcacccttataatcagtcattcaccataatttccctgtttcctagatttcattaataactggagggaaatcttcagcagtgagttagagaggaaagaactaaggagatcccccctgctttccccgcccctgcccccccccccccacccccccgcccgcaattagatttcaagcaatccagagccctatacaccagggtcattaagagcagttaaagctgaaaacaacctgctctgtgaatggtcttcccctaattcccattcatctgatgccagtgcctcctgagagagggtgggggctatctctgaatcatccagaatgagaaaggttctgtgtattcaaactcatactctatacagtctgacgccatgctgtgcagtgaccacaggtttctcggtgttattagg

SEQ ID NO: 134973 - DNA, 2473 bp, Homo sapiens
cattggccctagagaggaagtgatagtgggtttcaccagcagtcttacttaagtgctcgctgcaggaagtctgtagtacatgctagaatatcataggtgtttctcttctcccctctaaaataaaaaataaaagcaaatgcataaatgaactccagtggccctttggataacttttgaatgaggtttatgtggcaatggaggcaataggtttggagtcagtgatatgctcttagacacttttttctactcaggtgctacatgttatagaatcagccatctgcagggtgttgtcagagaagagagcatgagagtgtgtgtgtgcaagagtgtgtgtgtcagcatgccccaggctgggtgtgcatccacacagaagggaaaggcccttcctgtattgccagttttggcattagtcctctacatgagcctcagaccttcgcattgtgcattttctcttcatgcatctgctttgccatttttgtttggatgaaaattgtgttcctaaaacactgctgaactgaaccttcatctgatttcgtaactgtggacataagtagaaagtgaatagtttgaccactttgcccattaaaatagtttatatcctagaaagatgtgaagctacaagggtcacactttcggagcaaattttcttttaggcaaagtgcagagcctggagctacatcctttatatcctctggcacactcgggtgtggtcaaggcttccccatattttgaactgagccgtatgggtaactaggaattggagactaatgcaataataagcttacgcaggtttccttctaaattcaaactctctagttcctttgggtttgggtttggccatttgcttttaactattcagctggcttctgggtctcctgaccatctcatcctctctgtgacttaggtctggtccatttatccaagtacattttggctcactagactcactgtactatgtcttgtataagtgccaaaacatctgccgcttggggcagatatttaaatctgtgtctttcttttagacatacagtaagtttcagattcttcagtaaaggtttgctagagctcgatttttcctttgaaaatactttaatatctagattctaagttacattcatgtttttccttggtctttttttctctcttgttcctccctttcctcctttaacattatactttcaccctgtgccctctgagcccccacatcagaaagctcctctcttccacgtgccatataactgacttccaaagctggtgaaatttgatgcccccatttttcacataaaagatttggtttttaaatgttactgtgatgcaaacctactaaaacgatgctttattttggctgtaaggtaaatatgtcttttggcctttgtaaagctgttgcatgtggggtaatttccctctgatcatctggtgctcttgaatacctgctgttgctgctttgtgatttctccataggttaaatattagcataggaagaggagcagatttcaaatcatgctcgactatgcagaagtctgtgaggccacaagaacgtattaattacaaattcagaaagtaattaatctttccagatttgccatgccaatattggccatagccattaagaagttaagtaaacgcctggccatggctccagctggagctgaggtctgcatggaaagctatgctttgaaccttgacaacccgtttctcctggaatatgtgatatgccacattgagaaccaatatggatttctacagtcgattagaacatgattcaatagcattgcttttgattttcagaattcatggtagctcactcaatgaaattgcttcctagatgtagccatcctgattttgagagtggaaaatattatttatcaaaatattaagagcaatttcaaaatagatctgtgagcgatttatgggcctcttgcaaaatggtatacatgttgactgactgatctggaaaaggttaatgataattactgtcagatatttttttacctgaaatttttattggagtattaaaacttatttggagtcctctccgtttcttttctctgtaggtttacccaagagaatggttctgttacccgttatgaaatttccaacatatcctgttccccactactcattcttttagcaaatgacagaagctaattcctattgaacaacaatacagtacaacacagaatgttagagaaaaagcctttttatcctgctttctttgaacacatacttgatcaaaattatttgtaaagaacatctttcctactttttgattttaacaaatgcaaatttagttctctaaaacttgaaaaaaaaaaaagaaaccagttctgtgaaaacggtacctcatttctggaaaataacttataccagcccttctgttctagggaaataaaagtctagcagttcaaagtttaagttttaagagacgtatcagattatgtaaaattaaatttgtgaaggatgtatagagtct

SEQ ID NO: 134974 - DNA, 2066 bp, Homo sapiens
ctagaagataatcctagtaggtaaattgctcaaggagtgtgcctgctttggcacacagcagacatggattttgttctcatgcagcttacagtctgaagggtgagacgtagattaatcaagtaataacaacgagaaactgagatgagtatgatgaaaaagaaggacatgctgctgtgagagcatgtaacagagaaacctggtctagtttagtgggtccctggaggcttcccagaagaagggacatttgaattgggctttgaagaatgaataggagttaactcaaagaagactgggatgggagagtgttgcatacagaaggaacagcatgtgcagagaccttgtgttgctgttggggaatttggctcaattgaagaagcagaagtccagaatgtgtggaatgtggtgagcactgagtggcagaagtggagagactggggaatgatgtgaattaaagctggatgactcagtcccagacctggaggccgttgtttggattttggtcttagaaccctaagcacagtgttaagtcttgatgggttcttaggagaatagtgacaagatcagactttatttgtgaaggttagtctttctatagtgtgaagaacaggaggtagggataggtgtgagcattgacaagatcagttagaaggcatatagtttacagtaatgtattgtacatttcaaactggctagaagagttcaaatggttctagcataaagaaaggacaaatatttaagatgatgggtatcctaagttcactgatttgatctttataaattacatgggtatattaaattatcacacgaaccccggaactatgtacatctattatgcctcagttaaaaaagggctactgaagactactaacccaggcaagagacattgatagtattgctactggaggcagggaagaagaaagggggagaccagaagagaacagatgggaggaatataaaggaagcaaaattggtgtattgaatatatagaaagaagagtgatgtttcaaggatatctcagctcctagggtttttagctggagcattgggggaaaaggaaaaggttatgaatttcttatggtgtgacatagtttatgagtctaaaattaagacagtcttctgtgtgtctcactatttctactgatatttaataattttagccttattcagtgtattattgaaagggcaaagctttcattcacaataataggcgggttatagagatgaactatctttcttgtctttgatgatgtgttctattggggcttaatctggtcacgtctcttgttgccgcggaccatttaccacctgctagagtggtaaatggctatggtccagtggcagtaatcatgaaaggaaccgtttatggccactcgttgccaggctttactctatagtgactcctctcttgtgtcattgcattgacctccctgaaaggcctgtgtcccgaagcttttaaaaatgaagttattttatggccgagacaagattcagattaggtccctttagattatgaataggttatataccatttgcacagtatattctgtgcagcagggactgttgtcagtatatttacatgtattatttaattaaattcccctggcaactcagttactgtacatagaacactgaagctcagagaggttaaataacaggtgccattcacagataccttgctaggaaaaggtgaagttagaatcaggactccagtgtcctgatgaatgacctagttagtacttgtggtctcatttcttcttaaggaggttttggtataatccttagaactgcagccttagccaaacagcttctgttttctggaataaatttgatagctaaccttttttaagcattaatttcttttttggcctctgatctgtctcctcttcctactgcttatttcagctacatgtgtcctcttgaatatgatttagtgagcactcagactgagttatatgacttaactatagactaaaaagtaaaaattgttcatccctcagaactgtttcagttggtccctaaaagcagtttacttcttcagcatacatttgaatgcgttgtctcaaaca

SEQ ID NO: 134975 - DNA, 1019 bp, Homo sapiens
agcctgggtgacagagcgagactccgtctcaaaaaaaaaaaccaaaaaaagataattagtagtggatacatacatacacaaacagcagaggaatcgggctccaagaaatcatattaccttcctgaggtcacagttacttagagcaggaactggcatcctcatctttggtcctcctgtcttagtcctttatgttttccccccactagccccactcagattcgcagttaattctatgtaattagttgctcagatattttctgcctgttggcagataatttactggatttggaacctaggtaccaagtgtgtatgattactttagtaaggcctaaaatgactttggatataaattgattactgaaatttggtgtagaaaatgaactctttctggataaccctcaagcaaaaagaagttatttgcatattctcttaacatctctgtaaggtaggtatcatttttgtttttcagatgataaattgaaggttcaagatcacagacagctcatggtctcacccacgtgctcacagtttctcatagttgttgtgcgttgaagagatgatagaagaaataaaatggttcttatttctttcagtaatgaaaatgtgttattttaacaggcaaagggcgttgtgaatacagctgtgtctgcagcagtccaagctgttcggggcagaggaagaggaactctaacaaggggagcttttgttggggcgacagctgctcctggctacatagctccaggtatagtacaaactgcaagagattggccccctttactgggccgaaattcaaagaatagcatctcctgcattttctaaggttgtacagggtttgtggaaatataacacaggcatgaatgtacacagaaatttaaaagtagagaattggcagaatgtcataggtgttctcctggaatctgctgagtgaggagaggctacctggagggagatgacagatgagcaaattgcatttggttgtgggactgtattttgacaaggaattaaaggatattccatag

SEQ ID NO: 134976 - DNA, 1203 bp, Homo sapiens
ctccgcctcccaggttcaagcaattctccagccttaacatcccaagtagctggaattacaggcatgcaccgccacacccagctaatttttgtatctttagtagagactggtcttaccatgttggccaggctggtctcgaactcctgacctcaaatgatccacccgccttggcttcccaaagtgctgggattacaggcatgagccaccgcgtctggccgagactgaatcttttaagttttgattgtggtctatgttggaagcaaagtagaaagttttagatgttattttgtaattgacaggcaagttggttcaaagataaaaaatttcttgattgcctttctgggccaatttctcctaatggattgagtcatataacttagaggtcaaccagtatagtcttcctgttttgtagattggaaaattgagggccagaggagaaatacaggattagactctcagattttttcctttctagaccagggtactttttatagtatgctacttctgtccttatcctattggtttgaacctagctatcctgtttgttttctctacctctcacctccaaattaaatgaactaggaatagcatcaggtttatatttgtcatcctgtatttaaactcaattatcctgaggaggttttccccatttttccatggtgctaccctggtaggtataccatatttaaccaaggacttacagatttagtaccatcttgctcttcctgcaaggtgttttatggttcaaacactatggatttgaaacttttgttctcaatattttgtctattctctggtttctcgtgtctgaataaaactgcattttaatgtaatttgtacaggtattgcaggcaatgggatatccaacaggctttgatgcagatattgaatgtatgagttccgatgaaaaatcagataatgaaagtaaaaatgaaacagtgtcttcaaactcaagcaataatactggaaattctacaactgaaacctccagtaccttagaggtatacttatttttttctcagaaaaaaaataacatatatgtgcattgtaggaaatttgagagatgtggaaaagtataaataaaatcaaaagcatatgcaaacctgtacataaattacagagacagacataattattattttggtttatttccatccagtttttttcatgaatctctgtgaaggcagtcatcttttcatgcag

SEQ ID NO: 134977 - DNA, 1088 bp, Homo sapiens
caggattttgccaagttgcccaggctagtcttgaactcctgagttcaagcaattcaccccccttggcctctccaagtgctgggattacagatatgagcgactgtgcctggccaaaaagtgaagaatttgattgatttgaattagagttttgagactagatcttaactgagcaattgataattggataacttttttgtttccaagcttttttgcttaggatgcatttatattgacaagcgaaaattaatgtgtagttaaataatgcatacaatttttatagtgatattagcataataattttagaattacttatgaggttaatctgtgtgttttgaaatcctcatttaaaaaaattttggtgaatttacagtagttactaggaaccccaaaaacgcataaagcaaaattactttctagttaatttctgacctcattcctctttctttaacagttctggatagtaaagcaatagaccttatgaatgcactaatgaggctaaatcagatcaggcctgggcttcagtataagctcctatctcagtctggccccgttcatgccccagtcttcacaatgtctgtagatgtggatggcacaacatatgaagcctcaggaccatccaagaaaacagcaaaacttcacgtagcggtgaaggtacagtatttgttttactttgcaatgctttcttattttatgttccaaataatatgcttattttcctataataaattatcatttttaaaaacattttaatagcaataatattatatatagacttttgttacttctggataacaaagttgtttttgttgttgtaaaataatatgtggtagtcttacaaaatttggaaaatacggaaagaagtaaagaattaaaatatgtcaattgaacatttttgaagcaaagatcattcgtatttgtatctagtatgttggtttatttcccatcattttctattttgctgtttattttttaagtgagctcacagtatatatgtaattttatcttctgattttttttcatgtaatgtttcattagtgtttttcctcattatgaaaatcttcataaataatttttaatggcggtacgat

SEQ ID NO: 134978 - DNA, 1043 bp, Homo sapiens
tgtttatttttctctgcctgggactctttctccaaatggctgaatagttcactgttttactttctcaggtcttcatcaaaaggtctcctcattagtgatacctttctgctgagcacgacatataaattgtccttcattacactcactacccatagtatatgttgtaattagttttggccagtatatgtaagctctttgagaaaagggagattattttgttacttgctatgtgtctagcgcctaaaattgtcttgcacatagtaaatgtcaattaatatttcttgtttattgttgaatgaatatatgaatgaatttataatggggacagtaaaggtaatggcttcatgagggtgctcatgaggattaaataagttaatacctgtaagatgttaacagtgtcaggcatatggtaaatacgaaaatattatttttaaaaattgttgcctcagaaatgatcacttctcatcactagatattgtgaaggttgaataccacctgctttttgtaaagcaagaccctttttctccttaggttgctattatgattagccccacattttacagcccctttccaatggctgctatgatagaatgaagcttaatccatagaactctatgtagctggaggatttagagaagagatctctgcatttaagctagcttgtgatttccaggcaatcaagaagctgcttttaatgtaacttaatgagcagaagagtgattgaatagacatagttcctttttaacttttatctcttaaagactgcattctgggagactggcatactcatagttgtatgtaatgcaaatgaaatataatactcagccaacgttgccttctgttgaagagaacatcaagattgattaacctgagtggtaaatattgacccaagcaaatgctgaagtcagtgtttacctcaagggacaataaatcttgatcagaaaatacatagttaatctcattattattataggctttcactagaagaatctggaaatcttgtggcatgagtatcttgagcataattttccttaggaaaaaca

SEQ ID NO: 134979 - DNA, 1892 bp, Homo sapiens
tgtttgcttccccttctgccatgattgtaagtttcctgaggcctccccagttatatggcactgtgagtccattaaacctctttccttcataaattacccagtcactggtatgtctttattagtagcatgagaatgaactaatacaataaatagaatggaccaatacactgactttcttctcttctgttcttattaggtaacgtcagctaatgtaacataatcatgttttcttattagtgactaactcatttggctatgttggccagatgccattactgcatagactatactttcagaacccctggtctaaggagaagaaatcagcgataagctaggaggagacgttatcactatcactaatcagtttgattatctttctcaagcttggaaatgttatctaactgagaaagaaagaaaaatacagaggagaagaaaagcatattggaaaattcaggaccatcttccatttgtattagtctgttgaattcagagtttcagcagaaaaaatgtaggttttgggctcagtatgacctgggttccaatcatagctccaccacttcctagttttaggccttgagcagttagctcatctctctcactagggatattaccctctttcttatttttttgactcttgtccggttaaaatgcctgacttgttgcctagaatacagtggatactcaaatgtgaatccacttactgccttccttaggcctcaaaaatatttttttttccctccctttctcttcttttaaactagaaagtggaatatttaataccggatattcttcacctggaatgcagcctacctctaacaatggaaattactctacttttagatatcacaaaaatagtgcagttgcccagtctgtttatttagatgacagaattccagtgggtctgaagactttcagagagtctacaacatcaaagctgttgaatagtaataataatattaaggggtttttttttttttttggcctttttctctctttctttcctaagtgtatagttttccagaggctacatgtgacatgtgatgagatcgttgctctgatggctaatggaatgttttattttctatatccttgtgtttaaaattgttttgttttatttttaatatgctcaatattgacagatattacccacaaagcatagcacttcgggtgcttaataattttttaagagtgtaaagtactcctgagctaaaaagtttgagaatcagtgcctcacactgtaaactcctcaggagaaagaatcctccagattctaccctatgattattataaaccaatgcttaatattacttgaggaatgaaggccattttcttcctgcaggtgcttgcttagtggtgaagaaattattgaaagggatttacatacccatgtgacatcaagcattgtctgtgcattgaatgattgaataaaaatgttatatatatatttagattcttatgattagtatcagaaaattttatttcaatcaccaaattcacaaccactctttcggttttatattttccccttcactagatagtaaaagtatgtttactattatgtgacttagttttttttttttttaactttaaagatctttctcaaaagtttgggaactgctggtttgtcagttgatagcataaaatagaaccagactgccagtgttcctgttctagttctgtcaaagttatatggcctgggcaagtcactttaccattttgtgctttggctatacaatgatctctccaatactttcatgcttttagcacctagcttcctgacattcacgtttaaactttattcgtgttattctcggtgatttccttatgcatctcaggtgatttttttcaacactaatgtctcagttctgtgacttcttctctcacaaatattt

SEQ ID NO: 134980 - DNA, 1596 bp, Homo sapiens
tgttacagagcttgaaatattttttgctgacaaaaaggttttataccttttagaagtgagtgtcttcttacacttgactttgcactggtggttaatcacttagtgttcacctgctgcccacaaaagtctccttggctgacccacttctcttttggtgcccccttgcattaccatgaaaattacccaataggccggtataaggatcctatacctctgtagctttctctttgagtggagacatttacaaataagttcatgttagtaattaaagtcaggcaaacagtacacttaaccccatatggatatcatttatatatattgtaaaattgacttaacttggaaattatgcctgctccaatcaagacaacttaagaacattataaaacaatttaaataaagccgtgaaagatcattttataaatgaatgtagcaatgattactttgacaaaatatgagttcttagtttattgaacatggacatttggtcgtttgtttattctaatggtaatacttgagacaagctgtctgaaacgaagtcttattattatattgaaatatttgtggtttgtgtgcttcctaagtgggagattaagtgggctgggttttgtacactggctagttattagctattactaacttatatgaggacttgttaagtctttattaaatgaattagagaccatagtttctctagtgatcctttctgggtaaataaatgtaaagtttttgttacaaaaatgtcttctgaagatacgatcttaaaattgcttgatttaaaaactcttcccagggtaaaggttgataatcatggggaaaatgttaagtgggtcctaaatgttaaattgaatttcactctttggcctcccttgtagatagaaatgttagctcacatttaactggaatccttttaacacttggtgcatgtactaatttgtaatttaatatcttctagccactagaacttatatgtgaaaagtctataggtacttgtaatagacctttgggcgctggggaggccttgagacgagtaatggagtgtttggcatctggaatactacttcctggtaagggtttcaaactctggaagcagaacaatcagcaaatctcagtttagtttatttttctaaatatatgctaagtttgttctctacacaggaaaatgatgcataggagttcttttgcttggaattttgacaactagaatgcgtgttggaaaagtgctataaaactctttttcaataattataatttgtgttttatatgtactaacataaagggtactaataatatattgtgtctgctttgaatttgctttacctcgaactctgaatttgaaattgcagatgtttagttaaaatgtatgaagttcattctgtttgtagtctggttttaaatttggaaaaattaaatttggtcttattttccatatgtaatcccttttaagatttgggctgattcattgtgctgtttctaaattctcagagtaagactcagtttgggccttagatatacaagtgacttccagtataaaataaggacatacaagtgctaacatgttgaaaatgagagtgtgtcctttttactccacttaactga

SEQ ID NO: 134981 - DNA, 1728 bp, Homo sapiens
tgggctgtcttatatttaagagaatccttaaaaagaatggtaaatccgacttaattgtattaaacaaagaattattactcaagaagcatttgcatattgtgtgcatttatggaatgtaccaatcccaaaagtttaaaagcctacttttcagtagcttagaggagataaatttggctgtctaaacttgactttagtgtcatgtgacatcttctcaaatatggatatttgctgctttgggccatttaatccaactttaaattattaaggcaagctgaatagccataattaaatagtgttctttgttgctttttatttttaaaaggcatgtaaaacttgaaatgtagttcactgtattttatatttgtaattttaataattttggtttagaatagggaattccaaactgatacttgagttctcaatcatggggtggagtttctgttaatggttatcttgttgaattagtttatctagtgtaaaaaaattgtcatcctcagtttatttttagtatatctcattgatatgagacataattgatttccagttttccttaaagatggttagagattaaaatttcttctgttaaaaaaattgttaatgctattggtcccagatttcccttctttgcatcctgccaaaggaaaaagtgctctgtacttattttgtgccctgtaatgttatagatgcttaataagatcccagattttaagtagcagctgtcattgatttgtttactgaatgaatttttcatgtttcattgtatttgtgcacagaactactctgatgactgtttacttaaataataatcatagtgcacataatttttttaaaaagcaacacagccaaatgaggaaattttctgggagtcttattagttcactcaaatgctgttattctttttattttttattgtttgataatttgataggaatcgcttggtcaaattgtatttgtctctctttatcccattttactgttagaaaatgtttcgatgaaagatcctccggacttattggacaggcagaaatgcctgaacgccttggcgtctcttcgacatgccaaatggtttcaggttggctttttcttactatcttattgttattaaagtttgtccaagtttcatttggaacacctgccacttaattggtttctgtgtactacataaaatgaggggtgctttctagctcatagtgtggttgttggagtaattgagttaatttagatatgtgcctagtatagcttctatagttcatgatgttttattataattctttttggcttagtattctgaatttcagatggttgcttataaaatcaaacatgactgagaaaagctaaaggttaaattaggtagttgcctggagtggggttgccatgagactacgaaattaattttaatattatggtccttttatttttaaaatgtacctttttaagccttaattttactacttgtgattaattgatttttttgtttgcctgataactgatgaataatttgctacttagtattcacttgaaagaacttgcccaaaatgaagaatagatctcaatagggatatctggaatcattttgtttgttttaggcaagggcaaatggattaaaatcatgtgtaattgtcctccgcattctgcgtgatttgtgcaacagagtccccacatgggcaccattgaaaggatgggtaagtacttaaatatggctaaaagcaaatttggaagctgtagcag

SEQ ID NO: 134982 - DNA, 1074 bp, Homo sapiens
tgttctacttgaccctctagtataaaaccaaccatttctaagtagtgttgtaattataggtattattaaaaattatttgagtataaggagatgagaaaaagactgaagttgccaaaggctaagttaattacatgtttgcttgtatctgtcagcatccctttcattttttttttttgaaagtattaagggaacatcagtcatctttattccttggttttgtgtacttatatgagattttgtcatagctttcagtgatacctttaaacttagcctgttgcctttataactttaacttctgtttagagaagctgaaaacattcttagtatattgtactcttgctagaaactattatagaatagattttgtaataaagtaagagagtcatagtctctcttcaaggtgtttgagttactgaaggatccaaagacctctatgagctgaatctcatcagctgttatatgggatcaggtaaggtgaaggaatcagctttgatctaatgttttacacatcttacttccttttttttttttgaatggcagaaagatttgctttgctgttgtccttaacatcccagccctgttgactcacttgatatcttttataatttgctcgttttttctaacttgggctttgtcaaagacaatttttgatttttgttactggtttgtgtattcctgggcaacttggaggatctggtctataattacgcacttcagacctgggctgtacgattctgttttctcacactagacagctgctcatccccttgatgcagttcttttcagctgcatgggataaaagcacaagattcattcaggtcccaggaatttgtggggctgaaagttacccttttttctcctaatttatacttttttttttctcaaagttaaaaaaaaatccattgtaacttttttcttggagacattttcctgtagtatctcaactttccttcacctacccccacccaaacaaactgttcacaatacatacacacctcacatctttcttttttctgtcttaacttgccacatatttgggtaaaatctaaaaaaggaagaaaaaaaaaagagtgg

SEQ ID NO: 134983 - DNA, 1014 bp, Homo sapiens
tttgggaggccgaggtgtgtggattgcttgaggccaggagttcaagaccaacctggccaacttggcaaaaccccgtctctactgaaaatacaaaaaaatcagccaggcgtggtggtgggcgcctgtaatcccagctactcgggaggctgagacatgagaattgcttgaacccaggaagcggaggttgcagtgagctgagatcacaacactgcactccagcctgggtgacagagcaagactctgccaaaaaaaaaaaaaaaagaattatttgcatcatattgctcttgacttctaatagctgtataatctcataagatttgtacatgtctgtgtctagatttgttttatagtgtaagggatgtaaattgggggactgaatttttttaatggataatgtttagtaaatttttttttaggaggtttgtgaccctgttaacattttgaatatgatttatgtgagaatcatgctttaaactaactttcttctgaagttaagaagaattgctgtctggcagcgtcatcctcataaaagtagagaaatgtattcagttattggtagttttgagaagttcatgatggaattgtggtgggcttctttttctgatgtttttatcctgtcaagttagcttgtttctgcctctcattccctagaaacttgccaggtggtatttctcctgtgtcaaacctttgaccagctggctactctgtcatgacaatttagaggcattgcagcctatctgggccagtggggactccctgttgctatttttcatcaccagactttcaacaagtcccattgcttactcccttacctgaaataccagtgccgcagtaaatattggtcagtttcttagtttatttcaacttggtgataagggtagagaaaaaggtaccagtaaagttggagttttaatttttgagagacatgactcatagaatcacttaaagtaaaagtgatagactctttttaaaaaaatgctttttgggataactaaaatcatctatatcataact

SEQ ID NO: 134984 - DNA, 1058 bp, Homo sapiens
ttgtggcaacagggtgttactgtgttgcccaggttggtcttgaactactgggctcaaatgatcctcctgccttgacctcccaaagtgttgggattacaggcatgagccactgcacctggccagaaggaaatttaaaagaacaatttgaaaaaatatttaagagaatacagtatttttgagttttcttaagcaatataaatgtagtaaagaattacaagatctgtagtatgaaatacgttccccattgactccttgagggaagatagatactttataagcctcaaatctgaggcttaattttgtggatacttggatgtctggatttacatactcccttatcagtttgtaagagtattcaggaagccaagtgatgattaagttatagtttgggaaataggttgtgaaagtaatcatgcagacttttatttttagggatcaaggtggtcggacattgtgtggtgtaatgaggattggcctggttgcaaaaggcttgctgattaaagatgatatggacttggagctggttttaatgtgcaaagacaaacccacagagaccctgttaaatacagtcaaagataatcttcctattcagattcaggtgagtacagtttaactgcacctctaggcgaatttgtaaaaaggtgaaataggtagtgactttgaaaaaattattaaccagaattgctaatagctaataggatagacacagacaaaatgagtactgctactctgggtcaatgactaattcatcacagttaaagcaaacttctggtgatttgtactcaggatatatttaccaaattaagatggccattaaggtaccatcttaaacttttccgttgtatcttgctgagaatcttcattttttccaggctaggtctcaccattataaagttcttggaagggttggtatactgcagaaaagaattggaagattgaaaacagcctagatactttctagcgactaagagactttcttatcaacgagagactttcatagatagtaatttttaaaactgaagactcagttaatttgccacctctttgttctgttaatg

SEQ ID NO: 134985 - DNA, 1109 bp, Homo sapiens
gtgcatgccacgacacccagctaatttttttatttttagtagagacggggttttaccatgtcggccaggctggcctcaaactcctgacctcaagtgatctgcccacctcggtctcccaaagtgctgggattacaggcatgtgcccccgtgcctggccaggataacattatttataaataatgccaagagtgactgaagtgaaccttaccaaaacatgaatggaagagctcttgttttctggtgaggagttcagtagaatgggattttacttcccacgctggagcagttttttcttgtttcagtattaactgtttcacagtagacagtcagtgctatgggttggctaaagatatagttgtatatcatctttttcaggtgatgtttcttttgttgaagtaattgttttcgttctccttctaacagagatctattcgatcttttgctaatgatgatcgccatgttatggtgaaacattcaacaatctatccatctccggaggaacttgaagctgttcagaatatggtatctactgttgaatgtgctcttaaacatgtctcagattggttggatgaaacaaataaaggcacaaaaacagagggtgagacagaagtgaagaaagatgaggccggagaaaactattccaagtgagtgtggactgacctctgggacgctgtgctagagtgcacagcaaagctctaaggtctgctggattgagtgtgtgttatgctgttttttggattttgtcttatgcatatgtgagactataaccaaggaagtaaatgttacatggagattttctgagttaaatttgaaaggaaagcaagtaaagaataaagattagagccagagaaagaaaatggacctgcttaggatcccttttgagagaacaccaagtcctttaaaatcattatgtttcaaagttatgatctttttcctgtgttgattcagcctcctaaattttcaaataaatagtagtgtttttgatctctggggagatcataaaataccatttttgtaaggcatttaaaaatccttgtgtagaagaaagagtgtaggaaaatgtattttaaaggtatttttgactgtatctacctcactgattcccagga

SEQ ID NO: 134986 - DNA, 1050 bp, Homo sapiens
tttaatggcagtatccaatgtaaaagcatcatggaataatcattggtattgttgtattttcaggtgtctttactgaattttcagatgggtctgagtaatgccaatttctgattgaaaatctaatggttaactgcaacttgttgccatcagtggtagtattactctttcaggtggtgcttcttgactgaatctctttgcaaatgtatttatctcattgagtgctagtcagccagctgccacattgtagctacaggaggcttacttttctggccatatcacctaggctcctgggcccaggccttcaaaagatgtgttagctttttgtttgaactgagggaattttcctctattgagtttatttctttttaatcaggaacatgtttatgggttgcacactcatattggaagctaatagtaaataagcatttttgaagttgttttcctcttctcttgcaggtgtgttccagagaacaagccttcagacatttgctatattgacgctgagctgtcaggggactcaggcttatgaggaggtattgttacacaaaacagtgtctagtgaagacgacaagaaagaggggaaaggatcggaaaaagaagctaaaatactatagaaaaccatggtaggttattgtggatattttcataatttagttacaaaagactccagtaatttaaaattagaaatgttaacagtgagggcaaatgaaaaacagtggtgttaatttttggctttagtgtgtcatataaagatggcactctactattcaaagcgaatgaattcagatttactacaagctatgtaaaccacaaggtagggcctcatgagcctgtaggccatgaattattaaaacaaaggaggaaatgctcataaataatattttctaataaaactggcattagcaaactgatacaaatagctaggtttttaactttaagttcagttttttttcttgtggaaattaaaaattctgaaccagtcctttaattagtgatatgaatgatgtagaagtttataatatgtgtgaatgtttaactgaaaaagccacc

SEQ ID NO: 134987 - DNA, 1068 bp, Homo sapiens
tactaggtgctgtggagataatagtaaatcatatcattaaaactgagtaatagaaatataaaggaagctgaaaaagtgctggatggctcaaaggaggaagaaattatataaactgaagtattaggtaaggcttcatggaggggtagatttgagatgggcatttgatgaatagaacaatgacaaatcatgatggcgtagtggctgcagtccaggtaagggaatcgtttaactcaagcttagcggtagcacattgcaaggtgttctggcatagagtcattattcccgtgttgactggagctgtggtggtgagagaaatgacaagaatgacgataggaccttggatgccactgaatatttgagtttagtgccagttgcttaggtaattagtggttattgaaggttttgaagaggagtctgatgttctcaaggtaaaattttcctcaatgatgggctgaaatgggaatagtataggagaggataaatccccgtaaatggtaaaacatagtaaaacaactttacacagtggtatacaagacttccaaatatgtaagtatccttgaattattagatatctgtagtagtaaaacaaggattaaaacaagattcctgttcctatgcactatccccctttccctttttaaaaattgagatgggggtctctgtatgttggctaggctaggcatgaacttctgagctcaaatgaccctcccctgagctcaaatgatcctcctacttcagcctcccgacggactataggcctgtgtcactgcacccagccctttgtttgagtttaatttagacatcttgcctcctttgtaatttttcttttgttgactttccaaatagcacagtctcattttcctgccatctctcaggttattccttctttgagtatagttgttcttctccttttgctttttttgtattcattggtacacccactcccttggccattttgtggcttcacataccaaactactgaaaactcccaaatttatatcctaatccagacctctctgctgaacactaggtccatatccagctgccttcttagatgtctaataaata

SEQ ID NO: 134988 - DNA, 1046 bp, Homo sapiens
cagcctcccgagtagctgggactacaggcatccgccaccatgcctggctaatttttttttttctgtatttttagtagagacggggttttactgtgttagccaggatggtctcgatctcctgaccttgtgatccacccacttcggcctcccaaagtgctgggattacaggtgtgagccaccatgcacagcatatttgaattcttaactgtttcttggcacattacccctttttccttttagtcagaattgtcacaaaatcggtaaattctaaaaatagtctgatgacctctattactcccttttagttagaagaaaataaatagctacggagtcatgtactattctggtgctatttcatgtttgatcgtggtttaaaggaatagatgccatcttgagctttttaaagatcactgtgtgaaatcaaatatacacctgctctttgatttgtttgtggagacagtgatgtgaattggaaaagatgttggggaccccaattctagggttagttctgcagttacttcactgtgtgatcatagacaaatcatttaacatctttgtatatttgtgctttcacaatttaaaagattattaaaaaatttatctgttctttactgcttttcaggatcatgtgagcattgaatgtgatcctgtatgagaaaatattttgagaaattcgtttgtgtttctcttttgtgccagacattgttttaggtgtgcaatgcagagtaaacaaagacaccatctgccaatggtaaatcctatgcagaaaaataaaacagatgtgctttgggaggggctgctgtgagagaagttgcttttttgtttgtttgtttgttttgtttttttgtttttttgagacagagtcttgctctgttgcccaggctggagtgcagtggcgcgatcttggctcactgcaacctctgcctcctgggttcaagcagttctcctgcctcagactcccgagtagctaggactacaagcgcctgccaccatgcccggctaatttttgtaattttagtagagacagggtttcaccatattggtca

SEQ ID NO: 134989 - DNA, 1034 bp, Homo sapiens
tggatggcctgtcttagattcttcttttgtccgttatctccaaattactttttccagtggtttttcataaatatcagtagtactaatcttgtgatttacgtcaggttttaaaaggagtttgtgaaagggttgaattataatatcaacacctgagccaaagatattgaattgttctgaaaagctacttgtcttttctgacctagatacacagtttccaactgtggcagaggatgccagaaagagaagaatgaatagtagcaagagcctggaaattaaattactatattactgaaggatctaatgtacttattaatttttagcacttttaagtagtataagataattttcttgtatggacacaatattggtgaatctatgtatttctttttgtaggttaaaacctatttattttgctaagctgaatattattatttttgcttgtttcaaaattggtaatttgttaacattactgcttgcttataactggattgcagattctaagttcgttttgcaaacttacctcattaagagaaataatcgtgtccattctgtctccagatatgggttttgttttgttttgccatgctctgtggtacagaatggcaacagaaggtcttttgagaatcaaagacactgttttaagcttgtttaccaaggtattggtttacccttcagtgttaagtgtgcttcagcagacagaggaggacagagaatatttgaattctttttgtttttgagacagagttttgctcttgttgcccagctggagtgcagtggtgcaaactcggctcactgcaacctctgcctcctaggttcaaacaattctcttgcctcagcctctcaagtagctgggattacaggtgcccgccaccacacccagctaatttttgtatttttagtagagacggagttttgccatgttggccaggctggtcttgaactcctgacctcgggtgatctgcccacttcggcctcccaaagtgctgggattacaggcgtgtgagctaccgtgcctggccgaatatttgaattct

SEQ ID NO: 134990 - DNA, 1262 bp, Homo sapiens
gcttcctggagaaattgtcggctaaggtttttttgtttcttttttcttgagatggagtcttactctgtcacccaggctggagtgcagtggtgtgatttcggctcactgcaacctccgcctcctggttcaagcgattctcctgcgtcagcctcccaagtagctggaatttcaagcatgtaccaccaagcctggctaatttttgtatttttagtagagccgaggtttcaccatgttgaccaggctggtctcgaattcccgacctcaagtgatccacctgcctcagcctcccaaagtgctgtgattacaggtgtgagccactgcatccagctggctaagttgggttttgaaagatgaattcaagtacaacagtgggaaggaaggatattccttatagaagaacagtaggagaaagataggaaatggcatagtgtgtttaggtaactgtaaggagattggtacattcgcagtataagttttgaagtggggtaggttcattagagaccagagagagggagatccaggccagtttatgaagaactctatcttgttaagatatggggagtcagggaaggtgggtgacagatttatttccttaagagatcatttcatggaatgaactggaggcaagtggggcagagacagaaaatcttttgaggacttagactaagaaaatggcagtaaaaaagaggaggggagataatttggtagtaaaatctttagtacttgtgatttatttgatgtcaggagaaggggaggaatcttaagatgatgtccctggtctcctgacttgagtaactggattaattggtatactagccaagataagaaatatgggagactgtggtgctggcagtgttatatttcttgatttggctgataactatgagggtactgtttaaggattattaaattgcgcttatatgttttatgcatttttccatctgtaagttatatttcacaatctaaaagaccagaaaggaacaagagaaaataagtttgggaaagaagatactgactttaggattggacttttatatttggagtcaaccctccagatggagatgtgtggaaggcagttggaagtgcagtaaaattggaagtgcaatagaggagtataggctgctaataacaggtgaaaggattaggttaggtctgtagttctcaggcctcgttgtacattaaaatctctgtagagttaaaaaaaaaatactgataacctggatcccaccccagattaattaaattgacctctaggggtgtga

SEQ ID NO: 134991 - DNA, 1025 bp, Homo sapiens
taattctgttatagcttttctcttttgtgtgtaaaaataataaagctctgtttcatgctgtgagatttattgttagaaagacagggcaaatttctgaaatttccttgggtagtctcccttctcatctttagcttatttgaatcttaactatttatcaattcatttgcatacgtgggatgttaggatgactctttgttttgaaaaacagtgctgtcagagttcctgtacagtccgtgctgaaattagggtgccctagtacaatgtactgttctctcttagtcactataatggttttgtaagtagctaaaccctaggtcatgctgcttttatgcagctgtcttccttggttactgaaagttggatggcgcttagtttgcctttaagggaatctaggtttaattgtatatctcctagaacattttgcaccaccaagtaggttgtagagaatctttgttagcattctgctagccttattgatacgtgatcacctcactgaaattgtgcagtatcatgtattctttgattgtattttttagaaatgggagtcttgctatgttgcctaggctggtcttgaattcctggcgtcaagcgatcctccggtcttggtctcccaaagtgctgggattactggcgtgagctacctcatttggccaaattttaaataagaaatgctaacgtttactgttactgctgtgtgctatgcactttgctaagcagctttaaactgtggagttttcttttcatttaaacatcacaacaattaagtgaggtgagtcctgcttttattctcattttacagagacagaaaggttaagttccgatctcaaggttacacaggtggcaagtggtggagaagggatttgaacccaggcaatctgactttagggcctattctcttatctactatgctttaacactcccctgaggtaacacctttctgggaaactgtcctattgagaactttactttttatgtgttaccttgtgtgaaggcattaaaagcttgtgcctgtttgggattttata

SEQ ID NO: 134992 - DNA, 1141 bp, Homo sapiens
agcctaggaaggtttagccattgatgctcttgtatgtttgcgactaaagttatagaaagataaggatatagaaaaatgaattctatcaatgccttctctgaaacctgaattttgtgatatccattgattctatcaatcctgttgaaagataagaggagacaaataatagaaactactttttgtgagaaaattagctagtgatatttgcttttagtgaaatgctagtaaaatacgtctctgtgtttctctctctttttggcttgcctctttgaattcaaagacttgataacattaaagaaaatgcaggatctctagatttcggtgtggtgggcagacaataacatttttatacataataatataatggtttcatgaagaaagcatcatacagtatattaagtggttgagtaactactctgggtctagcataatgctaaattgaaggagaaaaaaggaatgttaaatatagaccttgctttcattgaattttgatgaaaagagaggtaaaaaagaataagctatggtagttgaaaaggatttcttggaggagttggaacttgaagaataagtaggacttaggtgggtagaggagaagagcaaatcccataatatagtaagatatggtggaaagaaaatgggcttatttttttggtcagaagacctggtttgagtgaggactcacttaatagtttgtgacattggatgaatcacttgacttctttgagcctgtattcccttaggggcatacctgtacttgcctcataggtctgctgtgaagataagactgtttatagcttcaacaataatagtaatgtagtacttctcgtgtcaggtggctagtttgcagatactcattttaggaacatttcataaattcagatgctacactgaataatttgtatttatcaaatattttataactatcctttaaaacttatgtgtatagttcctaggtcagtgccagacatttagtaaattgtaggtgatattgttactctgctcctgttataagaatagcataggaaaaagagatgacagtccttgtccttcaggagttcttgctttcagtaataagtcatattcataagaagctgggggaaaatgcaagacgttctgtgccctggtcctaagtttgtgatat

SEQ ID NO: 134993 - DNA, 1053 bp, Homo sapiens
tgttgcctgcttccgatttgccagtgagaaacagagtatccttcttatgctatttaatagtgatattacaaacagcagcaacatcaaaaaagaatgtgtcaggcacataatgaataataatgctgatagcaggcatgcgttgtgcatattattgttaatcttcacactagcctttcaaagtggttactgtatttctgatgagaaaatgaagccttgttcagtaactctagaatcacttagctgataagtggtcaatctgggattcaaatccatatctatttggcttgaaaagttgggtgttcttgtcactaaatttgggaatgagcaggcaaaaagaaacacatggaaggaatcatctcgtttgagggattcagtactctcttagcagtacagtgtgtaagggaaggggatttgagtttgttagtcctgttggtgtttgttagttgccactttatcctgtcccactatgatttgtatgcacaggaggaaaaacaaaataggaaataatctttggaactctttatggacattatcatgaacaattagaagaaatggcaatgtagcttctgacatttgttcttagaaattatctgtttctttttttcttctcttttaatgagtctttatatgattttattttaaattcataaattgatttgcttgagtggtttagtctgagcagtattggaacttgattgatttcccattttaagatccttttaaaaagtggtgattcaattccagtgaagcataactcaaattgtgtgtattgaagacttttgtaattacatttttgcccctattaaaaaactttattttagcttttttaaagtttgaaagaacttttggtaggccagttgtcagtcattcctttgaaagcccctagtaagtcacctcataaaccttgtcacttttctactgtgttttggcccgaatcatgttacttcccttcagtaataggccctggggtaatatgttaaaatatgctggctttgggtaaaaaggatggtatcatgtaaaatacagctctctggctactttggacaaagagat

SEQ ID NO: 134994 - DNA, 1087 bp, Homo sapiens
atactccttcctttttcaagttttagttatcaaataattacccatcatttggtatttccgtatgctttgacaggtaatgctctatttgagggggaatgatttttaaatgctttcttaatgttgtgtttggtttacaagttgtaaagagccttccaggtgttggtcatgattgacacagcaaaaatgtaaatagcaaattgccttttttttttttttttttttttgagacagggtcttgctctgtggcccaggctggagtgtggtggtgtgatcatagctcattgtaaccttgaactccagagctcaagtgatcctcccgccttagcatctcgagtagctgggactacaggcatgtgccaccacatctggctattttttttacttttagtagagaccaggtctcaaggtcttgctgtgttgcccaggctgatcttggacttctgggctcaagcgatcctcctgtctcagcataggttgctttattacacattaatttgccttgagcttggtgatacccagctccgatagtgatctttctttgctacgtgatctactctaatagtttactctcttaggtaacatgtttggacactgttacccattttactgcttttctgttttcatttgttttgcataggtccttttattggaagattggttgtttttcaaaattcgtttagctacagaaactgtttctgactagtaattctaagaggctagtgaatcgagtctaattttagaaaactttattgagagatgtaagtttaatgtatgtgtcagttaaaatagaagtaaagtaaataaggccagattaatggtgatgtagataattaggtgatttgagcctgaaagttgtgttaatctttaatatagcttttagttcttgcattgaatagtgaggtgaccaagtgacctgatttgtaattttcatgtctaatttgaattatttcttgtcctaagggtccattaagtgcatcctatttgagaagtatagtgcctgcctcacaacagactctccacatgtgcatgtggctgaatgaagcagtcctaaattttatttggtattcagattctcttaacttctgac

SEQ ID NO: 134995 - DNA, 3430 bp, Homo sapiens
ttaaaggatagcgggagaagtgcgtgaaatggagggtgtttatgcaggaagtatggaagaaggtgggatcagcaagagagggaattttgaggtaggacggagggtgaggggttcttggcaagtgttggaggacgttaggggcaggagctgggggagagggacaggtgtggggtggcgtggagtgtgtgaggtggagggcaaaagggggtggggaaagggaagtgttcttggagtggcaggtaaagtgtggggacaaatggaaggaaagatttctgaggcgggaagtgtggagcggttggggaggaggaaggtggaggggagggtgagaacgaaatcagtagagggggacaacgggatagactggaggggaaggtggacaggtctggagtacagtaggtggagggagggaagcacaggtttggggcactgaattttgtgctgtagggagaagggaggtagggagaaagaaggaaggtagacaggctattttggggtagaggatgtagaagaatgcttaatacctatagtggagtaagggaagggcaaggcagaggtgtatgtggacatgtctgtaactagaaaggcataggtgatggattggagtggtggtggtggtggtgggggaaataggatgcccaggtttagggcaggaaatgactgcttaagttggagagagctaggaacacaggttgcttaagagagtatggaagatccaaggagtggaagtatggggagagattggaacactttgagtttgagagatgaaaggggccaagatttttaggtcactgagagtctaaggaagatcaggcagagtgcagaagttggaaaaataactaaatggagaggattaaattccatactgagagaaactggagattgaggggtggggggacctggatcctggaatgatgttaatggaaagtggaggacattaaactcagtgtcatatctgaaagttcatactcctagggtcagagagatcgttgagcctgcttttaattccagaacccagtaaatgaggaagggggaaggggtaagggagagctgagtgcacatccccaaatttgggagaggtgtgtagtgggtatcatcctagcatattggtttgacgagtggacagaagggccacacagggtcacgaggagcgcaccaagagtgaatggaaatgggattgcagcaggtgcagggcagatgtctttgtgaaactggaagagaccaggcccagtggccagtagcattcaagggctatgcataagagaggaagaaagggataccttggtgcagtgtctcagataccctggtgctttctgggtaatgggtcagtattcaggcagcatggggtgatgtaatatctgagtcccatgctataggcagacagaagtaatgtacacctagctcctaaaagtggcagaattggagctttctgactcttaacactctttcaaggcgtgaataactgatctggattgttgactttttctcccaaatggttcaggtaaaatttagttggaggcttttggattctctggtattttgatttgagttgggaagtgtaatgttagctttattgaggaaagacacttatgggttgggcggacatatggccttcagcttgccaaacacatgggaagtaacctttaggggtttgaacacagacatttatttcagtgcaagtctcattcactgttctgtggcttgtgttagattcttaggggtttgaaaggattaagcaaactactttgagactgcttcagtaagcaaggtttcctagaatcttggaaaacgatttcccttttgacagttgaaaattaagtcttgtcagattttgctaagaaataaatttcatcatgttgcagaaataacttcaattatcactctgtgggcttcacgtaatgtgtagtgtggtacctagtatgatttcaaataaaaggttcgctttggtagcttgggagctttctgggttgattagttttcttcttttgtcgatttaggaagtatcttaatgcagccattgtatgttcgaataataagtttgagtggaagtgggaatcttgcctaaacataatgagggcggagcagaacaccaaattttaagtaatcggaatccgttaatataaatattaaaaaaaaaacctggaagcaaatgattcgtaaaatccaaatttgaagtgtgtcatggcagcaaaagaatgctctgaaggcattactgtaagattttatttttggagggaaagatttttagagtataatgtcccttcgattgaaactctgagtattttgagatttgatatatgtatacaatataatatagggagcatgtctgacctcatttgctttttggcagagaatttgagcagtaggatataagatgaatagagtgagctttgaaagttctctccaacatagccattgtttcctccttatatttcttaagtccattgtgttcattttattgacttggggtgcgcactactttcttgctcagaatactcaattctggtatagtgttcggattatatgtattgttcagtgaaattctatgaattgggacaatttgtaggcactttagatatcctaagtttacgaaccaaggaaagcaggttatttaggctttgtaggctgaataattgggttctggttttattttcgctggtgacttgctggacaagatatttaatccctttgtgctggtttcttctctagaaatctgactctatccatctcccatgagaatcaaggtggtttatataaaacaagtttaagtctttcgggaagactggagctacgtaaatacggggatagatgttacttagtttcttttttctcccctgtggtttttagactggtcaaatgttagtacttcgtaatttaccattaggtggattaatttgttgtgtgaaagttggatagagatgaaacttatgtgaaagagatgtctgcaaattgaagtttgttcattctttgctgtctgcttacctttccaatttctcagctaagtgttagtgctggtttgaattcttcagcctgagcagaagcttgtgagagacattgggttctagctatagcccaagattgtttctaagcaggaatttccagagacagaggccttctttggctcagtgaattcaattctttttttgggggtggggaatgcagtggcgctctgtcgccaggctggagtgcagtagcacaatctcggctcactgcaaactccgcctcccgggttcaagtgattctcctgccccagcctcccgagtagctaggactacaggtgcccgccaccacgcccagctaattttttgtatttttagtagaggcggggtttcaccatgttggccaggacggtctcgatctcttgaccttgtgatccacccgcctcggcctcccaaagtgctgggattacaggcgtgagccatcgcgcccagcc

SEQ ID NO: 134996 - DNA, 1035 bp, Homo sapiens
gcggcacagcaaggcggcggcgggcgctggccggcgctctcaggtgcggcaggacgcgcgtggagggggcgcgcggcgaacgagggggcgggctttccgttccccagcagccgcggggcccgccccctggcctggccaatgggcgcgctcgacggtgtcacgtgctcgctgccgccgctgccgccgccgaagcggagaccggagccgcgagcgccaccagggcagcagccgccgcagccgccgccgctgggcagaggagccggagacgcgagcgggcgaggtggcggcggcggcggagcgggagcgggtaccgggcgcgggcagagcgcggcggcgcgggtaggctccggcggcggggcgggcgcctgcgcggcgggccgtcccgggcgggcggcggttaaggcggcggttgaggcggttggcggagccggcccgggccccgcattgtttgttgtgcgtccttagcagcggcggcggcggtggcggccgaggcggagagcagggagcaatcccggccccgcggctccggcattgtggccgccgccgccgccgctgcggtgccccggccgcttcgggcaagggcagcgggcagccttcctcaccttcgcggggacggggtcccggccgatcaggggagggcgtgggcagggttgggggacgcggtgccgggaggtcttccgggacggagggctcggggctcggggcaggtgttggaggacattgggggcaggagctggggagaggcttcggggggcaggcggaaggtgtgggcagatttgggggtaaataggggtgcagagggatccggcccaatggaggaggagagccttcaggcaggtttggggggccccctgggccaggcgagtgcgagatggaggacattccgtccggtgggggggggcactatattgtggggttcaagagggaatgagggggcttttggggagggcagggacgagtggggtgggaatggagggagaagactggggactcgagcaggactggaaggagcgctgcgtgccaggggcagggagt

SEQ ID NO: 134997 - DNA, 1045 bp, Homo sapiens
ggaggctgaggcgggcggatcacgaggtcaggagttcaagaccagcctggccaacattgtgaaaccccatctctactaaaaatacaaaaattagccaagcatggtggcatgtacctgtagtcctagctactcaggaagctgaggcaggagaatcgcttgaacctgggaggtggaggtgagcagagatcatgccgctgcactccagcctgggcaacagagtgagattctatctcaaaaaaaaaaaaaaaaaattagtagtaagactagtaatagcagtaataggccactgctgctgaaggctgccgtggtcattcctgcggcccttagtgtgtccctccctcgccattcgtggcttattccgagctgcggtcccttgctggccctcgctagcctggtcatagtgaagaggtgctgcccggcaaccccgtgagacctgatgtccgcgtgtgtgtgcccccaggctacagcggcgagctgtgcgaggtggacgaggacgagtgtgcatcgagcccctgccagcatgggggccgatgcctgcagcgctctgacccggccctctacgggggtgtccaggccgccttccctggcgccttcagcttccgccatgctgcgggtttcctgtgccactgccctcctggctttgagggtgagcccctgctggggaagcggtcagcccatgtccagatgcccagggagggatcttgtgcccacccccccaccccccccacccccccaccccacaccccacacccgagtctgccctctctcttggactcagtctctctagctatagaatggaccctctcagcccctgcctggctctgagggtgcaggtgggacccacagctgggcctcttacaggagccgactgcggtgtggaggtggacgagtgtgcctcacggccatgcctcaacggaggccactgccaggacctgcccaatggcttccagtgtcactgcccagatggctacgcaggtgtctggggtggggtgggccctgggaccatcagaattggtggtcctcaggtgagaaggtcccttctgtc

SEQ ID NO: 134998 - DNA, 1266 bp, Homo sapiens
gtgggtatggtggcccaggtgaccgctgagggtggctgaactgggactcgctttggaggtgagactggggctcaggagtgtagtcctggcagctggggccatagtgggctgaggttgtctgggagaacgtgtggagggatggtcttcagggaagacggaggtggttcagccaggacagagaaggaaaggggggctattgcagagagttagggggcagcatctgtagaaggatgactctgacctttggggagctggggcctgtcaggcaggagttgggggttcagaagtctgcccctgccttgggtacacgcagatgcacagacacaggaccccggtgagcccagggagctccaccgccaacactgaacgtccctgccccctctggaatgcctgcgacacctccctcacacccgcccgcattcctgctggggcacactgcctcctccccctggcaggctcctgggcacaggctcctccaccaggggaaagagatggtggtcacctcttcccctctctcactcgcctgaagatggtgggactcagtgtcccccagccctggatggctgacactcctgggggtcccgaaggcccatccactgcctccatgggccgaggttccccaagtcctgctccaagagccatggcctcctgggtacctggcacacagtgggcccacacagcacgtctggcctctgggaagcatttgctctgcattttgttttttccttgccacagccccatgaggcaggggtttaaaaccccatcttacagctgagaggatgagggggtgtcatcccccaggttcaccactatcagcgggaacccggctcctctcccagttgagctcactgttgggtgacagggagggcagacctctgaggtcagagccagggaggggggaccccagctgcagggctgggctctttgcccatcctccctccctttaggccatgctgggcatgggggaggccagtgcctggcattcctgagcaggctccgaaggaggcagctgggccaggcagggagctctgcctcctccccacttccccagcctcagtgcccgcccaccactctcaacctgtctggagggcatggcaatggagccgggggctctgtggaccttcctgggccacctgtggctcctggcaggtatggaggaatgtgggccctgggcagggggaggttggtgggtggtggttcctaggaagaggctgtggtgtttgtgagctgatcgaggctgggcttcaaaccctggtgacttctctg

SEQ ID NO: 134999 - DNA, 1124 bp, Homo sapiens
ctcgtttgtgaggagatactgtgtctgtagtaggtgctcagcgaagaagcactgcaatgccagttatggtgggtgatgctcactgcagtcctgagccaacccctgccctgcctctcccacagcctgacccctgtttcaatggtgggacttgcctcgtcacctggaatgacttccactgtacctgccctgccaatttcacggggcctacgtgtgcccagcagctgtggtgtcccggccagccctgtctcccacctgccacgtgtgaggaggtccctgatggctttgtgtgtgagtgtgtgtcctgggcagctcccgtgctgggtgctggacacctaagctggttagatcccatctgcactctcagggcttgtaggatactggtggaccaggcatgccaagccctagggcagtgtggcggggccaccgcatgtagagggacagagtttctggagaaggtgagcctgtactgggcttcagggccagactctgagagccacagggggaaggatattttatggagtggcatagcatgtgccaagtccctgaggtctgcaaggacagtggaagtgcaagggggtgagcaggaatggggtgggaaagttggtaggggctttgaggacacccagctaggcggctctgactttatcccaaggacagtggggagcctctggagggttttaaacaggagaggggcatgaccagatctgcattttacaaagatgactggctgcagtgaagggcaagcctcggccatgaggtggggcagcttcacggagaagggaaggggccagattctgccaggagttgctgttgcctggcttgtgacctggagggtcgcctaggcatcacgccccaccccccagcactggccgggaactgctcctccatgggtaggaaatacattgggagtagaagtgagggtggtgggggcggctgcagtttccaggattagatgataggtgggtgcgtgtgccccaccccaagtaagtggctgtctgccactcgctgggggaagtggggaggtggcatttctggagaaggctccgtgggctattccctgaggctccttctctccgcaggtgtggcggaggccacgttccgcgagggtccccccgccgcgttca

SEQ ID NO: 135000 - DNA, 1045 bp, Homo sapiens
gaggtgggtctgggggcctgggaactgtgaggaggtccaatgaatgtggagggctgttcctccagccagggtggggcgggggtcctcgcccaccttctcacccctccctggtatcacagtcaccattgtcacttgagtttccttccatgactcgcaagaccatcctctgtgatacagactgctgctgggcagtggttgcctggtggcagttctggaaacccagcctcagcccgcctgtgggagaccataaaagtgcagattctgggccctgcagacagtggcgtcagcgtctggggcacctgccttcacacaggctcccgtcaccctaatgggatgagagtccttctcagtgacggctgctcaggtggtcacctggcagggcccagctgggcaggagcagcgcatggggacagtggatggataagctctgatgcttgctgaagtggggatgggcagcagagcagctgggagcacaagaggcagccatgggggaagccgctttctcagcccccctccctctccaggtgtcaggtccccactctcccctgtgaagccaacccctgcttgaatgggggcacctgccgggcagctggaggggtgtctgaatgtatctgcaatgccagattctccggccagttctgtgaagtggcggtgagtgttgtcaggggtgaggggccgtggacgtggcctgctgggcccttggcgagatgctgctggggagagagcgcagcaccatggggctgttcctgggccactctgtcatggggtggggcagtgagaggagcctcaggtcccttccacaccccccacacaagaggtatttccactgcagggagagctttgggggctgtcaccgtctattgacaagagcacaaagctcctagctgggtcagcggcttcctcagagtgcccagggcagtggcagtgaggacagatggtctctgccaatccaaccaggactcagggccatgttggtgttctgggatttaggttggtgaatccaggagactcatctccaggggtttctgagccagtgtcctgagta

SEQ ID NO: 135001 - DNA, 1066 bp, Homo sapiens
tagcagaagagcctgtgtgacagccgtgctcactggtgggcgatggatgctgtaaccaacccgtgcgtgtctgctgtgtgccgggcaccgcatttgctcatgtaaccaccaccaccacctgagcacctgaggctcagagagttaagtgacctgccaaaggtcccacagcaagaaatagcatgaccagaggtggaaccaaggttagcagggcaagcttaggcccagacagctcccctggagagcttccccagcccagttccccatgggctgttcacagaacctgactgtggctgtgcctaggccaccaaacaaacagcagagcagggcgggagcaagaggagcatgactgctggcctgtgagcccccttccagtcctgtctgttcctcacaccttgtctgaatggctcacaagcccagtagccagttttatgaaaggacctgtagtttggggggcactaaatgggtcccctgagtgcaagtgagagccaaagcgagttgccctggttcacagccccaggcccatcggcatgcccagcttgcaccctcgcagcctcccagactcctgccctcacggagaccccgggacactctcctgtcccgcaggcccctgcgtgcacccctcaagccctcaatgtgcttgggctggagtccgcttgctcctcccctgaaggcctgggtgggagagtgcagcctgctctgtccccgacaggccgcagccgtatcggacactcagggagtcagacagcgcggaaggcgacgaggcagagagtccagagcagcaagtgcggaagtccacaggccctgtcccagctccccctgaccgggctgccagcatcgaccttctggaagacgtcttcagcaacctggacatggaggccgcactgcagccactgggccaggccaagagcttagaggaccttcgtgcccccaaagacctgagggagcagccagggacctttgactatcaggtatggcatgggcaagggagggtatcggccgggggccggcactgtccgcacacgaggtgggatccccatgtgacagtggaagagactaagggagaaac

SEQ ID NO: 135002 - DNA, 1020 bp, Homo sapiens
tattataaacagcagtgatgacaatcttccagtgtgattctttgccaactttgagggttaaccaaatggaagtggaattactaggtcctatgtgatggatcatgagtttaaggctctggacacgtggcaaatttagtttcttttctatctggaacgagcttcctctcctgagagcccccaccccaggctggcacacagaggcagggccaggcgtggagcccagaggcctgcttcccgcctgcacgtgaagttctgagggcgcccctaactgcctgttctcttctcttttgtcttcctctgccccagcctggtaaagcccttgcgacactatgcggtcttcctctccgaagactcctctgatgatgaatgccagcgggaagagggcccgagctctggcttcaccgagagctttttcttctccgctccctttgaatggtctctccttccttcttccatttccctgagctcggcttggtgactctgcggggctgcatggcgaaagcggggggctggtgctgcttgcctttgtgtcggggggagggtgtctggagctgctgcctgccggtgccccagtgccaacatgcagggtggacaccacctctgcgtgccacctctcagggcatccgttttgccagctccacagaggctgtgacaatagagaggtgacagggtgatacgcgagcattggtccccttagagatgaaatgtgcttgattgctagtggaactggtgactacaattagcctggttgttgatctccaagtccttctttatctcagcacatcttggaaagccatggagatgggaatcagagtttaagttaaaaaagaaaacgttcctcatatgaaatgtgtatattaaatgccagcctatccaagtgttctgatctgcctgactttttaaagataatttaatcattattatttatagcctaagcctcataccaattacaagtagcgatttttaaaagtttcacccaccatccagccacccctaagattaagctgctgtcgccctcct

SEQ ID NO: 135003 - DNA, 1640 bp, Homo sapiens
aaccaaacatcatatgttctcactcataagtgggaactaagctttgaggatgcaaaggcgtaagaatgacataagggactctggggcctcggcagggaaagggtaggaagggggtgagggataaaagattacaaattgggttcagtgtacactgctcgggcgatgggtgcaccaaaatctcacaaatcacagctgaagaaattactcatgtatccgaataccacctgttccccaaaaacctatggaaatagaaaattaaacaagaaagttaggttcagggagatgaagtgacttttccaaggtagcctgactaggaaggggagggtagtggatggttagacagactggcacccaccggacaggcaggacctagcctcaccctgggggctgtccctgctcgtcagcacctgcccactggagccacgtgacagagggacacagcgtagccaagacatttacaaagcgaggatcctttgtgcctgagtgaagtgatcctttcaaaaatgatcaccagctccccttcaccacctccggagaccaagtcctggctgatttttccccgtctttatctcaagtacatttaaatgtcaattaaatttgaaatatctacatttgtcagcatttcattttgggccagcgtgacgtgctgctgatttgtccacgcgatgtgacacatgaaaaaaactcccgagatgcagatcttcctcattaaaaaataagccggtgcgatcccggcgcggcagagagcatggagcacgtccctgcttcctgacgccgtgtctctgacatggtatttaaaaaggaacagcctcgcctgtcaccactgtcacacgcgcgcgctaaccggcgacacgttaaaccaaacattagaaggggttcgggaagtcatctgcatgggaactccacgcggagacaaggtgggcagaggcgggagcagccgtgggggatgatggggtctgatccatgacggacggccagcctttcttctgcaccaagactctggcagccctcgctgggcagccaagtttgccgcaacctgccttttcacagacagctctttgtgtgtaataaaatccaggcaagtggtgggtggcagaccgcaggggagtagctgaattgggttaatgagggaaaaggtgctttttttttttttttttttcatattctgccttaagctaataaaaagtttaagcctggacgttttcgatggttcatcctttatctctgacaaatatctgactgtatgtttcatgggagaacatgggcagctgaatttaagtaagtttattttgaaacctcacctttcattaaaagtaaaagaggaaacaccctatctcttatttcgttgtttctgacccagaaaactgaagaggcaagatcccgtagtggttgaaagttggcaaatccacattcagttcctagctctacctttagctgctgtgtgaccctgggcaagtgactccccctctctgagccttggctactttgtctgcaaaatggggttgcagtaaagaattcatgagaaattgtatggacagcatttcgcccaaggcttgtaagtatcgccatccatgtggcctggactcgacaaagctctgatctgaccacatcagatgacaaacttctcacctggatgtacc

SEQ ID NO: 135004 - DNA, 1077 bp, Homo sapiens
tagttttgttggttggttggtttgttgtttgtttaatatgccctgttttctacttctgttggaaaatatttggggttgaaataaaccagtgggagcatgggagccagtttggtggttggcaaactaccagtgatagaaaacaaatgacaggttttctgtgagcgtacgtcacagtggctcgggcccacaaggagacagaggggtacgtttcaggacatcattccaagggtttctgttcacgtttgtttaacgaggaaggggaagttgttctcccataataccagtggtatttctagtgcaacccgggtgtttttctacgcctcttcccatgctgcttccccacccccccactgtgctccgccccttccaaatgccatgtcacaacagcacttggatgtgtttttctcaactgtcatcagctccagctggcaggaccaacttcttgaaacacaggaagcatccagcggaaaatattttaataaaacagactcctcataaaatattgttcgggggagggggaagaaaccggctccaccaatctgtcggcattgtattgggagatgtgagaagccaggctggcagcaggggcccgatcctaatgggcctttgtcaggtggtggttccgtgttgggcacacggacttggtgcctggccctttaatctggcctgggttttcttgaatcacagatcttcatctccactgggaatatcaaagtgcttgggaaacttagaagactggggcagcagaaggggatgcaggatctttgaagtggagaggagagattcattcctcctgacttcttgccccaactctcacttccaattgcacattaaataatcccagcactttgggaggccaaggcgagcggatcacctgaggtcaggggttcgagaccagcctgggcaacatggcgaaaccccgtctctactaaaaatacaaaaattagccgagtgtggtggcgcacccctgtaattccagctactcgggaggctgaggcatgagaatcacttgaacccaggaggcggaggctgccgtgagctgagatcacaccaccacactccagcctgtgcaacaga

SEQ ID NO: 135005 - DNA, 1890 bp, Homo sapiens
attttcagattagggatgctcaacctatataaaatgctgcgggaagaaaaaaaattcagtcaagaaaaaaatgaatcagtagcagctgaactgtctgtggaatctccagtgccatgttaggtctggcagagacacagaggagaagagaattaatattcattgagcaccttttatggtgcctaggactgtgctaggcacttgtgtaattattgtctcatttgtccagcccagagcaggcagatgccatctccctaatttgtagccaacaccacagggatgatgacaggcctgatgataagtcctgcctttgagcccagcttgcctctctccactgtctctctttgttttctaccaaacagcctccccttaagccaaagtcagcagcaggtagctctcagaattccccttcgaggcttgggatccaaggcgggcagggaatcttggaagccatgattcagggaaggatcattccccttggaaaaattcaagtattggagacagctacagtggactctgtgttgtctcactggtgtggggatctgtgcagattgcggggtgggctgccacatccattggcaactgaggactcgggagacagacgctgtgagagacacggagtagcagctgcctcaggcgctgagctaatgcaggaggtgactagcctggcgctagctttggctggacctcctgggttgatggcatgctgaagaggcaggatgcctaggagaaccagctctcctaggcttggaagtcagagaggcctgccctggtttgaattacagcttggccacttcctggctgtgcgaccttaggcaggatcctcacctctgagcattagtttcatcatctgtaaaatgggtttaacaataccacctggtaaaggtaatgaggttgtgtatgtatagcacctagcacagtccctggcatgtcccccgaacttacactgccaagcatcaccactaagaggccaatttgggagtcatagaagatttgtgctttctgggcccctaaggaccatttattctaaatgcatttatgcaagcatttccagtggacactgctacagactaggtgggaaccggggagactcggcatatggaacccacaagggcctcgaagagaacagcctaccaagctcccatgtcaggagccatcagcctccagtgtggctttgctgggtcacgtagccacaaactttccagacagaagtgcagccgttggcccagggtagcaggggctggggagggtctagccattcagcctttctggaaggagctttgtagcctggcacctgtggctggagttcagatgttacccgaagatttgggttttctttttaaaaagaagaaaaaagaaagagcagaagaaaaccatgccagtgtctcctggacgaaggggcatgggttggggcctgccagggaaaggcaggctgccgtcggcctgcgtgtgaagcactttataagctctgtatttattatttcttgctcaccattaaaatcaaatgtactcagtgcttttgtattcaatacacatttaaccctgccgacttagatttctcaggttttaaatccagtggggaattggctggcttcccaagtttcccctccagtcccccttgaacagagctggaaatctctgtttagcattttctccccggacgcggctgggatcctcacaccggtggggccagtcactgttgtgtgtgcctgtgggtttcttccttcatcaccagtacccacccttcctaagcacccccgaaacatgggtgtgatcgctgaaatatgacaagacttgtctgcatcgtctgtgattcgggcttcattaaaccgttttgtctgtgtgtgtctgtgcctggttgtggtctgccaccgtgtgtgtgtgagggggtgt

SEQ ID NO: 135006 - DNA, 1124 bp, Homo sapiens
ttactgaggcgtctgacattctttcctcgtgccgagtctctgaagtccagtgttttgcacttatagcacgtgttttttggttttgttttgagacagtctcactctgtcgcccaggctggattgcaatggcacgatcttggctcactgcaacctccgccttccgggttcaagcaattcttctgtcctagcctcccgagtacgtgggattacaggcatgtgccatcatgcccggctaatttttgtatttttgtatagatgggggtttcaccatgttggccaggctggtctcgaactcctgacctcaggtggtccgcccaccttggcctcccaaagtgctgggatttagagcacatcttaacgtggaccagacacatgggacattggctccccttttggctggggcaagtctggatttggtccagttagatgtatctttgtgacctgagtgacggaatgggcaggaaacaaccggaagcctcccggggattgctgtgggtccgcggcctgggtctcgcgtgaatttttactttccttactcagcctccctgtctcccatgcctgcgagagcatcaagacaggcaggctgttgaaaggacactgctgggcgttcaagataaagggtttgaggggagagctgagaagtctgtgctctactggttttgattcaaatcctgatttcaaaagccaatcattttggacaaattttatttgttcatcagacgcttgttgagcagattttttccccaggtctcacagagcctgcaggcatagggatgaacccccttggagatagacctgtaagaggtcccgtgggggcaggggtgagggatcccacgctgagtcccacatagcaggaggcacgaggcagcatccgagccgacagagctcttgaaggacaggcacacgtttggcaggccagtccagccggagcagcccattccacccggagggtgggtggcaaacaaggcatgagagcccagtgctacttaaaggatctgcccagggcaggcatgggtgaaggttgagaaaggtctgtgtggggcacagtggagtcccggtcttgggggacatgcagtgccagcctctagccttgagcaggcgcccaaggacaggagggggcatga

SEQ ID NO: 135007 - DNA, 1048 bp, Homo sapiens
gactggcctcacagatgaggacacagaggcccagggaagtcacttgcttgccaaagtcactcagcaaaccagctaggcctggagaccctgcggtgggagcaggagggccctgcacacaatcagatgttctagtgtccgaaatctgagactgcttcccacgggattactgtctaatccgctggtgacaatccagctgctcacctgtccccagcctcagctctggtccccagggcctgcacactcctggcagggcatcctgataattagtgcagccctccccttcttcctctccccagccccagggtggagggtcttcaatgcgcaccccctgggagttcacctttctcttcctggcggccaccccacaggaggtgtccccatcatatgctccagcatcataacaagcccagggtcggtgagtgcagcccccgtccctgtgtgtttcctctggtgacaggatcccctcgtgccgacaacccgcagggaaaactccccgagtgtcagaaggggcaatgtggcttcctgttcttggttgccgttgttgggttttatctgactgggtgcgccaggacatctgtaccacgttactctttcttggcatctttatatcccgctggctcactctgctaacttttagaatgggtgtggtcaagaggctgctttcttcccaccatttatcaattcagttgcaaaacagccagcacttcccgaggacaagcaaaagaaaatgagttaattgaagaatctggagaattgacatttggtgtgtttttacatgtgccaggaagtttaagccaaaagtaatttgctgagcacctattaggtatcaagtactctactagaccctatggtaaacagagaagtgagtgagctgataacgacagccggtgtgctgtggatgtgaggcggggttttaccagagatgagattgcggaggtggatggcggggccctgaatctggagggctttgaacacttcagacagcattttccaggggatattcatgggtggtatagggaaagcaagtctatgttcaaataaacttggg

SEQ ID NO: 135008 - DNA, 1027 bp, Homo sapiens
tctggagcttggaagaagcagctgacagaatggccgctggagtgggcgcccctccccttggttgtaatggcacaatgctggatttcagtattttaaatgaaaaatatatgcagttagctgtgcgctgacaatgtccttgaggatttgacagtgagattttccagcagttggtcttcgttaggatcctggcggtgtttaataaggcagtcgaactgctggcaccttgggttcctgtttgttctccgagggctcaggggctgctgcggtaagcacatcgaccagagctgatcattacaagggcgtacgccaccatgaataaaaatgtcacacgttttcccatctcacagcagtacaaaatgtcagtcctgtcaaacacacattgcagggagctgtgtgcagtccgtacaaattggagagccgcatattcccccagccttctgatattcttcatttgaagctgaagaaaaacagttgttaacctattagctaggattttaaactctgctgaggcggtggatgggtagactttgacacagatagaaatgtattccaaggtccaggaattttaaaaccaggttctccgtccatttgttctgagggaaggaaaaaaaaaaaaaaccttctgtctggtgaacctgactatctttctttaacagacacactagggaaattttgggatatttcatatctaagcttcccattgcttccacgtttgcattccactcaaaaagtctattgctttgggggatggccctggggctcaacctgttaggctaggaaacctgtaggtagagggtttttcctgatcagaagcatgccaggaatgttgccagtcttgcagacaaagtaactcaaatcatggggacaatgactggcgggtctggcattattcagatgctgggtgatggcttcactgataatttgatgctagttccccactcttgggcagccatttactttaacttgaccgcgtgccaggccttgtgccaggagccagatgtgaaccctcaaggactcaccttcttag

SEQ ID NO: 135009 - DNA, 1715 bp, Homo sapiens
cctcctcttgtgctgcctgtggcatcctgagaggaagctgttgtccttcttcaggtggagggaatagtaaagaggctaataaattggtggcctgcaccacaggactttataagaaaccttttgcatctttggatcttctaataaatgaaggtgcagcactgctttttgacacgcaggtacatctgtgtattggacacatttcccttccaaatgtttaactccactttacaaaggtttatttgacagcatgtgctagattcaaggctctaggttagagaacccagaccccaacgaacttacagttgatagagatacaaaaataagatagtgctaagcatggcagcctatgatcagtgtagccaggagcttccgaggagaagattacatctgagcactttttgagcagctccttaattcagaataccttcacttgtgctgtcgttatgggatgatatggcataaaagcaccaggactcccatagctctgggttattccaccttctaactatgtggctttgggtaagttaccccttctgagccctatttcctcacctataaaagcaggataatcccatttaccttgtgatcattgtgggaactaagtgtgagaatgaaggtcaagggtctggaaaagcacaggggtaggccgtccacacagggaaactcttctttttagcaggtgctctctccgttttgcaaattgaggttcaatttgcacagtgctgtgacatttttcaaagcttcctcctatctcatttcacccattctcccagtagctttgatgtttgccaagcaggtggtagtctcccattgcaaaaataaggcaataggtgcagagaggttgagtgatttggaaagattagacaactagttaatgggaaaaacaaaactagacgatagtatttttacttataagcgtgaactaagatgctttttccaaaactactacatgaattgttctttttttctaaataactattaccttagagttttctattaatacccagattttcttaccatattaccttgcagcttcatttttttttcagccaaacacaaacaggcacacacacccacgcacaaaattttacctgaaccaaaagtgaatttgttcatgtttgaccttattcattctctcatatctatcttgtaggatcttcacctggatccaaaatgccccttttgcccattgttgttttctagcacagatggaacccctccccatctttttccacttgacctgagcacctttggacagcccctttccaaaagagctgtttctgtttggccatcgacagcctctttcatcactgagcctcagcctggctgagactggttgatcaaacgtgggccacctgatccaagccctcccagtaaagccaggaggtcatcatctccctttgttgtttaccaagcagtacagacttctcaggtctggcctctacaggcagccttgattccttaggaaaggaggccagctggtaggcagctggatgtgtgaggtcaaatattggtagtaatggtagtaattggtagtaatatggtaattcctataatttactgaatagctaataatattcttgacactcagttgtattatctgtctcctttaatcttcatgctaccatatgcccatttcacagatgaggaaactgagtcttagagatgtatatatgtttcttccttaatgcataatttttcaataaggaattact

SEQ ID NO: 135010 - DNA, 1050 bp, Homo sapiens
tcaagtgatcctccctcctaggcctctcaaagtgctgggattacaaatctttgatctttaaaagacaaatcgagcttgttgatttagagtctctgtgattgaaaggagcaaattcacagttggtttcacagaggcttgaatttctggccaaactgttcccattgaagggagtgagtaagcatgcgtggggccgggagagctaggtagacttgtagaacagacattttcacaccttatcacacaactgtcagctccctgtctcccgacacattaaaatacgctgcagcctcaatcacagaaattccaactttggttactattttgatatcaatattcatattttaatttgcatttgctgtgctgtgaggtggcctgggaaaagaagggtgcggcacgagtctgtaaatggagacgggagttctcacacccgcagcatgagtcagacgggaaggcctctgcccataggggcctttcaactcccccacatggagatgtggtgtttgggcttctgaggcaggcaagtgggactcagtgctggttgtgtaggatgttaactatgtgaccttggataagttacaagacctcactgaacctagtttttctcatctgtaaactaggggaaatacaggtttttgctggatcgttggaaggagtagaagagataatgtgttgagacagcaacacttagtaggcactgaataattgagagtttcccttttgtctgtcttttgtttgtttgtttttgagatggcgtctcactctgttgcccaggctggagtgcagtggtgtgatctcagctcaccgcaaactccacctcccaggttcaagtgattctcctgcttcagccacccaagtagctgggattacaggcacccatcacacctggctaatttttgtatttttgtagagacggggttttgccatgttggccaggctggtctcgaactcctgaccttaggtgatctgcccgcctcggcctcccaacatgctgggattacaggcatgagccactgcatgtggccctctctgtcttcttatgtcccacatctg

SEQ ID NO: 135011 - DNA, 1049 bp, Homo sapiens
gaaatggattgcagatataaaatggagtggcagggagcggagagttttccctccttgatgcctggatcgtaggctcgttggtatcagaatatcccctgaagtaagcaaagaaaggggtccctcctcaggcaaaggccccatgcgccctcattggtcagatccactctctgcagaccgttaagctacagacatcaccttacctccctacttgtatgtgcaagcctctggccttaggaaaatccccttcttatgataagtaacatttctgcaaataaccagttaagctcagattttttaatgtggttgttcaaagatttgtttaaacaatctagatcactttccttccactctctctccctttctgttccttgatagtatctaaagcagatgtctccctccccttcccttccccctgccagtcttttcaagaatagcttcaggagataatgttctatagagagcgtcagtacatttcaggtgacacaaatggtgaaggcattttatagaaatgtggcttgtcaccatcggactgttgacagatctattagtgcacccttttcaattttcacttttccccccttcggtcgtacagatttccacagacttgatattttgcagttgttcttggaagagagctattttgtaattgaaactctagcattgttcgcatctacgggacttggggctccagcactctccagcgccctttcttgagctaatttaggatttggctgcacctgacctctcacatagcagtagaaaatatttccttggtttttttttttttgtccttctcccctttccctcctcccctttatctggcaacgaatgtacctcgtgactccccagatgcctctaatatagacatctcaagtttggtttctgccatgaaatcgaggcagtttccaacaaagatccaattttcaaatgtgctgggttgccacctggcctcctctaactctgcatagcaatggtgaccttgcagatataatcaagaacccaagcttgccctcttcaccctcgccttgggtttgaattgcaaatagaaa

SEQ ID NO: 135012 - DNA, 1054 bp, Homo sapiens
tcccaaacaaatactttttatatatctatgtatttggcagccctgatgtttttctttgttgttttagatgctcatataagctgcctcagatcctttgtaaaattaggtagggtgtaactgtataaaaataaatattctccttaccctaatatttttgggtcatcctcacagcccttgtgcaataagtctgcccagcttctgagttaatattggctagatttaagcaggaagaactcttagaacttacggaagctcgacagtaaatttaacactcatgcaactcattaaaatagtataaaagtggagcttcaaacatctctgtgtttgctaccagggctggggggtggggtgttacccttaattcagctcaagatctgaaagtctgatctttcagaattgagaatacaccgctgaaattaaagacttgtctgtgtagataagcactccaaacatgttcaaagaaaaagtgaggtgttagctctatacggataggatttttttttttttaactcagggtatcgtcttcttgactcataaaacatggtttggtaaaagcaaacttgcttatcaaacagcataagcataaaatcgattggatagtatattttatttttgatcatccccgttctttaattattttaaaatttcagtttgctattgtttaaggtcactgtgtaaatggttttcaaagtatgtcccacagccagtggcctagggactgcaaagatgcctgggatgttgggggatgaggaggtggccaagcctggagaacccagccagcacccctgctctacccccaggtcctccagagcagctgatctctgcattatggaactcaggtaacagggttccttctgtataaaatcttatttttttctgagatggagtctcactctgttgcccaggctggagtgcaatggcgccatctcagttcactgcaacctctgcctcccaggttcaagcaattctctcctcagcctcccaagtagctgggcttacaggcacctgccaacacacttggctcagctcatttttgggtttttgtttttttgtt

SEQ ID NO: 135013 - DNA, 1087 bp, Homo sapiens
gcccagtatggggaggacgcaggcttcggtggctgagcttctgctctgctggtattggccatgggtttgcactcagcctctccaagctcagggttccgctctgtaaaatggggtaacgtttactttctttcttttttttttttttttttttttttttgagatggagtctcgctctgtctcccaggctggagtgcaatggtgtaatcttggctgaccgcaacctctgcctcctgggttcaagtaattctcctgcctcagcctcctgagtagctgggattacaggcatgcaccaccatgccgagctaatttttgtatttttagtagagatggggtttcacaatgttagtcaggctggtctcgaattcctgacatcaagtgatccacccgcctcggcctcccaaagtgttgggattacaggcgtgagccaccttgcccagcctgtaacatttactttcacagcattattttaaggatcaaataattacagaagaaccctgacaattataaaactctctataaacatcagctgttattaccgtggcagtttttgactgggataaaaatttttaagcaaaaagtttaaaattttaagcaaaaatttttaagcaaaaagctcaaatattttaagcaaaaagctcatgcagcgcagtaggaaaatgagaaaatcctagggtctatataaagtgatgctttgttacccacatgtatggcaaatgtctctcattaatgcctttgataaggtgggaaactgtctggtgttggaggatcaggctggttttgaattctggctgttaagcttaatagcagtgtgatggtgagcaagtgacttcaaactctctagagccttggtttcttcctctgtaaaatgggaatcattgttcttagctcccatgagcttattccagttgtgagaagtaactggggcaatgtatgtaaactgcctagcatataccttcaccctgttcctttaatggaataaaaaaaggctgaggctgaggaagaggacagtgaaaagcatgggttcagccagcctaggttagaatctcacttgctcactgcatgaccttggggaggcactcatcttttc

SEQ ID NO: 135014 - DNA, 1157 bp, Homo sapiens
ttcccaagtcacagagcccatgggccagggagatggattcagaaaatgaaatctgctgcagtgctagctaaatgttagcaatggctagaaaatccagaagcctaggcatgagagtttagcctccgcatgtggaggccaaaaacagagtctttgatccattccttatatccaggaaactttgtaaaaccagcacatgctcctcaaaggtgagtgcaaactgagagcaaagcgtcttcttggatgctcaggcttctttccccggcagctgaccccacactgcgtgtgtgtgtgtgtgtgtgtgtgtgtgtgtgtgtgcgcgcgcgcgcgtgtgtgtacgcgcacacacacacacggtgtcccctggtggaacctggcagggggagaggtaaggtctttcagcctctccaaagcccatggtcaggtactcaggtgggggagccctgctcgcagccccgaacctgatctgctggtgttcagcggaggagattacagagcttaatgattagctcctccaagctgcagctgatgccagcccctaccccctttacacctaattactctcattaatgagctcctctgctctccatagagagagtttcctctttggaataagaggcaaaaataccttgcccaggtagattgctgaagcctttaattattgcccacacctgctaagccttgtgactcacacctagtgatagtgcggagctgaaatggagcttgtttataatcacgagcagattttaactctttcaaagccaaaaagccttctgatttcaagagacatgtttccccaagacctcacacatgctcatttcatgcatgcacgccaggctctgctcccccaacactggggatcctgaggcagcagaagtgcagctcctgccctgagggagtgcacagtctaggaagagtgacaggctagaaactacacagacaattatagtggctaccactcaccacttccctacatcaggtcgcctgtagccctcgaaataaaactttgaggcagatgttactacctccatgttacagaagaggggagggggcgcagagggaggatgtcacttgccccaggtgccacagctagggagggtgtgaggagagtgggatcaggtctgctgggctccatggccagtgtgcaccccactgttgcc

SEQ ID NO: 135015 - DNA, 1051 bp, Homo sapiens
catggaaattgttttcaaaacaggccggccttaactagtacttctaaaggtgattttttttaaccaaagtgtaggaattcacaattgtcccaaatacacctcaacttgttagtttcagcctattgttccagtctcctgagaatttttctggtcctttttgtcaccagcttctttacagattttatcagcgttttctgtgttttaacctaggtgactactgatgatgtcggttgggatcagaacatgcagggagcgtacaaagcaccttcaccagcagtgttgacaacagctactaacccactgtctagctgtggctgttcagcccgtgtttttccattttgcccataaggagactgagtttctccagttatctcactgacaccagcttgtgctgtgtctaaagtagcctcgtcccactgaacccaagccccactcccaagccacctgaccacctattaataaaagaaacttgcccttcactgcttttagacaccaaatggatgaactaattttcactagtgttagtgactgataagagccaaacttgacttttatgtgaaacaacaacaagctgtaactggggccttcggtaccacaggcagaggaagaaatttatttggagcttatgccactgaggcagagttaatagagaaaaagttgggggacttaggcgaggaaaaagttcagtgcccttcaggccatttctcattgctcttgccgaaggatgaggcttcctgcagctagtggtggagacctggtcaggatcatctactcagtgccaggattcatggatggaagcatttcctgtgtgtgccactgctgtgctagcggctcacacggagtgcctccacctaaactctctctcccttactctcctttcatcatagtaagttttgggaataggactagaacttctaacttcagatcacttgcttttggcatgacctttatctgtggtctcaaacatagtcccctccattcgagctaggtctgtggttttggttctcgcctgcagctgtatgtgtgcgtgtctgaggtgtgtggatgtgtg

SEQ ID NO: 135016 - DNA, 1402 bp, Homo sapiens
cttgcttcatattgatcggtgggttctctcaagatgtagaagtatcatgggctgtgaccacacagacctgatattttgctctctcctctttgcctcctcccccagatgtctttcatcctggagaaagtggccatttgtaacacccgtggttttttaaatgtttcctttgagaaggaaagtgggcctttgactcgtggtgttgtgacttagccacatgggccatttgaatgtccacccaaggcgggaagagctgcatgtgttaatgaaagctcatcctctcagagctattcccagctctcagaattcctggatttactgagaccatgcactcaacacattcgtttggctcccagtgtccagcactgctggctactggtgataaagaggtgaataaggcatggccccttgtccccaaactcctcaagccctgtgagggaaacagacattataagagagagagagagagagagagagagagaaagagacaatgatgggtcataatagatagacatacaagagaagtacaaaaggccaggtgcagtggctcgtgcctgtaatcccagcactttgagaggccaagatgggcagatcacctgaggtcaggagttcaagaccagcctgggcaacatggcaaaaccccgtctctactaaaaatacaaaaattatcctggcgtggtggcacacacctgtaattccagctactcaggaggctgaggcatgagaatcgcttcaacccgggaggcagaggttgcagtgagctgagattgcaccactgcactccaacctgggcaacagagtaagactctgtctcaaaaaaaaaagtacaaaaaaagggcctgaaggcttctcagtggaagaggtaataagtgaggcaggtcctaaaagatgattaggagcttattgaatagttagaaggtggggtaaggcttctaggcagagtaggcacttgtgcataggccaggaaatgggatcatcagactgtgtttcctttaatagggatgatctggcttaaagatccatctgaggaccagaaggaaatcgtattcttagctgcacttttaagggtgtgttctgtaaccttgagccacccctgaccaaggctcctaagaggctctggaaaatcttgaactcagtatcaggagtcctggtttctagtcctaggtctatcccttaaaagtcatttggcctcagttgtctcatctatgaaactgacgtacccccaccatgccagcttcatagatggcccaggtttgatccaagagggtgcgggtgtattcccaggacctccagacttccggggaatggcaaaaccaggagttaaactcagattaggccaactccaggcccatatgcttcgcactgctccaggttcctttggacagccagtgtaaaaaagtcagtt

SEQ ID NO: 135017 - DNA, 1085 bp, Homo sapiens
gtatatctgtttacatctccactatagcaacctgtgtatgtaagtaagtagcatggattctgtacaaaatatcacatatttacataaagccccatttcctagaagcatttgtacttgtacatattgtaatttaccaatcaccatagatctgtccatatagaatatctcacgcagggagttgtagctgctaaaatatgttaggtaacataagttgggtattgatgccaaattatcacggagttccttcagagttatcttgcagaaatatgtgactgtctaaagacttcattatttaacattaagagtgaacaccagcaaaactcttcttttacaaggggggtgggttcttgtgtcatgctgtcgccgctttcttgtagtcttttctgtatgtgctgtggttcatcgtgactgttgggtccataattaccaagcagaacatgttggtgtcattatggagaagttctcttcagcttagctaggcatggggaggcatttggattgtgaggccctgattggtcacctccatgcccctgaagaactgccttggtagtccacagagctgtagggaactgctggcctgggcatcaggagtgccggccctgcctgagcgcctctcttctctgggcttcagtttcttcgtctttaaaatgacagcacggggtcagcaggtctccaaagacccatggctctgcctccctcagattctgtattcagtagagcagaaagtacatgatgttctgaaatccactaagaatttgtagtcagatgctaaggatttatattctgagaaatgaaaaattttttaactgtataaaacctaagacatttaaatcagacttaaaaacactctgtcattttccagtggctccttctgatgttctgtgagcatttggtcaatgttataagcatgcatcccgtgcaggcctagtgtcaggtatacaaagacaaaccattcatggtcctgccttccaggagcttacctcccagtgggggtgaaaagagagtcaagaagtcatcccttgttaaagtacaacagggtagggtaggtgagatgaggtgaggggcaggtgtcccagaggagggga

SEQ ID NO: 135018 - DNA, 1023 bp, Homo sapiens
ttagcacagttacccgtgtaaaaatattatgtttcttttctttctttctttctttgtctttttgagacggagtctcactctgtcgcccaggctggagtgcaatggtacaatcttagctcactgcaacccccatctcccaggttcaagctattctcgtgcctcagcctcccaagtagctgggattacaggcacgtgccaccatgcccagctaatttttgtattgtttttagtagagactgagtttcaccatgttggccaggctggtctcaaactcctgacctcaagttatctgcctgcctcagcatcccaaagtgctgtgattataggcgttaagccactgtgcccagcctttttttgaaagagcataaggaaattttgagccatctctgggttctgaagcttgaatatgtgtttattctgtttgccctcaaagcaacatcttttggtgggaagaaccctggactgaagacaaacctgggttcaaccccactcctgtgactttctggctatgtgaccctgtacaggtaatttaatctctctgagcctatttcctcgtttgtgaaacagtcataattaccctaatctctgtaagttgttatgaggataaatgtggatacacttattaataatcatcatagtaataattcttttttttttttttttttttttttgagacagagtctcactctgtcaccaggctggagtgcaatggcacgatctcggctcactgcaacctccgcctccctggttcaattgattttcctgcctcagcctcccaagtagctgggactacaggtgcacgccaccatgcccagctaatgtttgtatttttagtagagacaaggtttcaccatgttgcccaggatggtctcgatctcttgacctagtgatccgcccacttcggccacccaaagttctgggattacaggcgtgagccactgcctggccaataattcttaaatagtgcttactccgtgcggggcactaattaaagcactttatacatattactcatttaatcct

SEQ ID NO: 135019 - DNA, 1389 bp, Homo sapiens
ttcttttcaagtttgaaaatgtgttaggaaaaagacaacattatgataattgggaattcagtatatctgtcttttccctctattcttttatacttttttttagatacaattaacacttcacacttcacctgatctctcctcagttacctttgacacttccttgatatttatttagatgttcatgccacgttcactttgaactctgtggttaagagaataacttttaaaacaagcatttttcctcactgaagatgtgcaattagcgaattacacacatgtggatgtccacttgtctttttttatttgtcaaaagatcatggcacaattacaagaaaattgtaaagaaaagtgattatcatcaaatcaaaatacctgctgtgaagttgcagaaacagctcattttattacagtttctagaacagcacatttcacagaagatgggaaaatgcttagagatatcttcatgggtgtcgtcttagaatttacgaaccatgaataatgcatttaatttaaaatggctgtattttctgtaagcatgtatgaatgcaaatggcaaagacacagtggaatttgactctgtcctatcaggtccggacaatatgatcccgttgtcatcaccaaaaacgaaagttaaaaatgtgctttttgccaaaacttttgctacttttccagtttcattttaggagccttgtcttgtataacactggctctggacttactaagtctagctgaggcggtgtttcttgatgagtcccatctctctttgcctgtgttatctgggagctgtcagataatgtcaccattaacccatcgccgatgtgcttgaaaaagaatactgaaactctagatggattttgatgctagaacttgaaagataaaaagcaagttgttttctgagtcaatgcattttaagaggaactgaataaagtcaaagcttcacagtagcaatggaaactgtcttttaactctctgaacactagtaattttaagacaaaaaatatttatttatttatttatttatttatttattttgagataggttctcactcccattgcccaggctgcagtgcagtggcctgatcatggctcactacagcctcagccccccaagtagctgagggctgcaggagtctgcaaccacgcctggctaattttctttttttttttttttaagagatgagggtcccgctatgttgcccagactggtctcaaactcctgggtttaagcgagctgcccccctcggcctcccaaagtgctgggattacaggcgtgagccactgtgcccagcaaaaagtaattcttatgttaaaattttctgctttagtctacttgggagggagaacttgtaatctcacatatctggaagggctctcagcctagaaccttgc

SEQ ID NO: 135020 - DNA, 1044 bp, Homo sapiens
tgttcttattttcccctttagctcctgtagagcagggtcatagtgccagccggtattgttcagtgagttattgatcagtgagaaacggatccggttaaagctgtcttctctctgtccttctggcttgtggcatttatctgctacctacacgagtatacaggtgattgaggctaactcaaacagtgtcttctctcttggagttttgatggttagcatgtttttcagagatgccctcgaaaaaagaggctgggattcttgctgtgttccttccttgtagtcatcttcccacttacccccaacaagagtaaatttaaccgagcaggccagaatctacctaatagcaggccctaaaagttagcatagaactttctctctgaagagggctgctccctgggtcctggttcccatgcagcctttccatagaaatagaaggtgtgcttagaaggacagcttgcctggtttcagatcttggctctgctgctcacttgcagtgtgacctcgaacacgtctcctcctttttcggagcctcagcattcttatctatcaagtagagtgactatgcctgtttcccaaggtagtcagagaagctagtgagccaagggctatggaacgccttagcgataagaggtatgcagtgcctatctactccctgtccttccctcatttttcagttattaaaatgcaattctctagctttccaggtgtgaaacagtctgggttgaaattcttcccatctcctcctgcaaggtagctaagtcggaggtaggcgtttggttatattccccagttgctgtaacaagagcacataccactgtctgctcaccaatcagtaaagagcacaaaggtacaaatgttgagtacgtgggacagtgaccccctcttgaaagacagcctcaactgttactgcccagcctccatcagagggcagcctgagacattgtcattgaagagattccagtcgggaagaccgccctggttcatctgccactttaccagaggtcaaactggcagcctgcaggccagattcagcaaattcagccctta

SEQ ID NO: 135021 - DNA, 2468 bp, Homo sapiens
tattggcaaacagtctgttatcaatccagtcatcattcttttatgaaaaatccatcttttctctccgggaactctgaagatgttctctttcgccttatattctgtgattttaccctgctgcatctaagtagatttatttatcatacttgatacctagggctcatgtctttcttcaattctagaatattctcaggcattatctcttcaaatactacttctctgccaaggctagttttttgtttttttattctggaaactcctatataaacatgtcggcatttcccaatttattagccatgctcttacctgctctttcatcttcctttacccttgatctctctgttatttgttctggcgaactctttagtattatctttcagaataggtgatagtgtcctaattttctggattaaaaacaagcaaacaagaaaaatttcagattggatttttcccgaggtaaaatagctagtaagaggtagagcctggatctgaatccatgtctgcctaacacctgacctgtattctgtcctttgtgaattcatgagttcatccttaaagttaaaaccctagcatagtgaagtagcttcacatcactgcattattctatcatgtgggtggatgaattgggaagatgaatgtgacttcagacccagactgtgggatgtcatgtgccagaagacctgagaagtgtcaagagttatatctggcctcttttccattttcattctaacttgtttctgagaaagaaaactttagttcctttttatcttttatgatgcgcagaatttccatctttcacgttcttttggctgtctaaatagactgtttactgaggtttgtttgtataccacttgtctcttctcggtagcagaattttggttttattttattgggcagatgttgttaaacttagaatttttcagcaacagggaagtgatgaaatgtttacaatgctagtctataaatataaaaaaagtctattgttgttattcaacatttgttaagcgcccacagagtgctgagtgctgagtatcactacagtcgggggagaaggggtctaagctcacacagattgtttctttgtaaatcacatttcttataatttgtttttaatgtatctattacttgtctcaaatagttcagtaacattttttaggtcctcataccacccagcttgggcaatatagacaaagatgagggtgacacatacattactttgtcattcattcatttgtttaaaaaaatattgcattggtcatatgttatttgacaggggaactcacaggcctataaggaaaacaaacatgaaacacagttgcaatgcaatatgatgaagactataatgaaagaagctgctaaataagagagtgacacaacgaggatgtgattaactctgccagagtaagtcaagggcagaggaggagatactcactcgaaatgggtcttgaaggagaagttttccagaaagcaaacagttacttcaaatagagggaatggcatgggtaaacatttaggaaaaactgaagttgttctccgtggctggactatgaagtgtgtctttgaaagacgacactaagaggggctagtttggaattgtttgaatgccttaccagctgccacccaaaagcttgggtgtccttgtggttagtaaagccacttaagggtttaaaacagggagcatttccctttctggaggcagggaggaagctggttggaagatgacagcatggcagaggccagtgagaagggcattatattagctctgggaagcaaaaccagctcaaaactctgatcagtggaaatgagtgagaagaacacatctgagggagattgaagagaatcagtcagtcaaaaaatgtgcagctggagggaaagggaatggtctaggataacttctaaaattctagctagggatccatgtggagatttttttcacaccataagcctccagcaataaatatatggcaaatatttctgtttttatctcagtttctgccaagcaactcccagtcctggaggaaataaagaatattggtttcccccaagaacagtatactggagaagctgcccaagaagaaaatggcttcactttctcagtagcttgctaggaaagtaatgagaataaggtttcaaaacttagttcctctaatttaatgtctttggaggaatcggctcctttgcagagaatagctttgatattgagttcatgactcctgcctttagctttctttcatcattgcagatggagtgctggtcatgtgtgtcttactagccagctctattctcatgttccccaaaatgttctctttgaataattagactttttcacttaatttttaaaacatgtctgatgcctattatgagccatgtgtgatggcaggtgcgttcacatgtcatctcatttaatacagcaacctgagagatagatagcaacatcagttttacagatgaggaacagattctgagac

SEQ ID NO: 135022 - DNA, 1856 bp, Homo sapiens
gaatcactttcaggaagatttcagtcattaacagtgctttcactaacaatgacagattgaggtaagactagagggtttgacctgaattgagggacattctacaaaatagctggcctgtactcttcaaaatgttaatgtcttgcaacaaaggacaacccaagaactattctagattaaaggaggctaaaggacaggacaacggaacgtggtgtgtgatccaggattttcttttggtataaaaagtcattattgggacagttggtgaattctgaatcaagtccaaattttagatttgtattgtatcaatgttaattttctaattttgatcatcgcactatggttatgtaagaggacattcttgattttaggaaatatagtcagtttgttataatgcctgttttgacaacacaatgttccaatgccatcagtatgtcagggagcaatttgagcataatgtgaatttcatttcatttgattcatttgattgtacagggtttcacctatgaaaaattctaagtgaatgaagaaaattgcccccagcttagccaagatgcacatgcacagaacacacatgcacacccttcaggtatttgccaattacctccattcatcacatgttataagccacatctgtcctgcccatgtctggtgctatgattttctgtcctcttctcgccacttcaccatatactcacaagctgcaaccctctgccccttccacaaacaaactgtagatctttttcaaggtaaaatgacatatttattatggggtttatatatttcttaaccatttgctatgtgtaaaagtaggctaccatttttaagtttcttatttctagcatgtcactgaagtttttgagtgtggtgaaaatgtgatgatttttaggaatgcttaagtatttgagggtaaaaggatatcatgtctgcaattttttcttaaatgttttaggaagacattttatatgtaaaacacatataattgccttctgtgtgtgtgtgtgtgtgtgtgtgtgtgtgtgtgtgtgtgtgtgtgtgtagagagagaggggggaagagaaggataaagccaatgtggtaaactgttaacattttgggtaatctgggtgaaaggtcggtggtaattctttctattattcttgcaactttttcataaatatgaaactatgtcataataaaaaggtgaaaggaagaaaaagactcagggaatggaaaagattttttaaaaatgaagtccaaatgtaaaaaactaaggaaggcaaaaggaaagggaaaatgattcagctgggaaaataatgaaagcagagtgggagagaggatcttaaacaaaccttctacgaagtggattagaacatgagtttagtttgatgcaagctgtttgtaaaatatcataggaatactacggctacaaaatgggaaagaaacatttgctttcccagaaagatttttttggaagtctaacccagaatagtaaaaaacagaatagacccacatatatggaaatcatataaattaacaattctaaatgtatttaatatctttatctcttcctaacaatacaaagactttgatatacagtagtctccacttatctgcagtttcactttccatgacttcagttatcaaggtcaaccataaaaatattatgtacaataagaaatttggaaagagagaaaaagaccacatttacataacttttattaccatatattgttataatggttctatttattttattaattattgttaatctcttaatgtggctaatttgtaaattaaactttatcataggtatgtatgtttaggaaaaacatagtatgtttagggttcgatactatctgcagtttcaggtatacact

SEQ ID NO: 135023 - DNA, 1020 bp, Homo sapiens
tctgaggtccagacccctctagtgtaacacatttcaaactttccaaggatcttgaaatatgacttgaccccatatattgaggttctgggtttccacagtggccgtggaggagagggagtggttcagcttgaatgtacgtaaacattctttcccacatttttagtaactaaacacaggaaatcccactcacagcccttaccctttactgacctttctagaaagaattcagaaactctattggacaagtaaattccttcctgcagctttgaacagagcatctccaatgggtccccctctgtagtggcagcatccagcactctccacctacctgactggttggaagactctctccctccagttcgcagtgcttgagacattgtacaagtacacagacaccagacaccaacctccaaaatccaagaggtctgtctttctgcagtccatggatgtgcagcaaatggcaggtgagctctgggctctgagaaagccaggcttgagtgcagtaccatttcttcctctcctgttctaaaactcagaatgcccaaagatattggaatagtcccatggattccatagccatgtttttcttgtgctaaagagagtgggcgaatgaatttgtgcctttttatttttaatcaagataaaaatccaggtgggagaaagaagcccaccatgaaaatagagtaaaagcattctcaaaatgtgtaccgaaacatatcttgagcaccttctatgtgcttggcacagagctaggcactctctgaccacgtggctagtaagtggtagaattaggattcagagataggacttgattctgtagaaaatgtgagtttccttttgcaggagaattcaacagcagagatagagaaagccagaatgagatctttctttctcattttgatatacattaagctgtaaccctgcatttcctacataaaatgtcctatgtgtacttgtgtgcatgattgttgtttgtgagtgccaactcctggtgaagctaccatctgcattatttatcca

SEQ ID NO: 135024 - DNA, 1063 bp, Homo sapiens
gaggttgtcttgagcaagtcagctgccagcttaaaaggtcattatctgttctctgaagggaaacttttatcccgggttgattagttttatcctgggttgataagtgtttatgcaaaagaagtaggggtaggaaaaacctggtactcactgaactcctacttcttgccctttatgtatattttcttggttaaatgtacacagtattatccccaacttgctaaataagaaacataaagcagagagaattgaaattacttaatgcaacaactttgctcaaacatttaccaagaccctactaaaccaggggactattctagatgcttggaattgcagcagtgaacaaaatgaagtcctagtcctcaaatctcttctaccttaggaagacacagagagtaaacaaagatgaaaatcaacatataatatgtctgatggtaataagtgttatgcagaaaaagaaagctaaggaagaagatagagaaagctcctgggtgaggtgaggtaggtgccaagaagaaagagtcggactagagccaggtctgtctgcctctagaactcacggtttttccactggtcccatgctgcttccgatcctctttggtgatggtttccagcatctagggaggaaacatgaactcctctagcatcttgcttcttagtctaaagctgataattcaatgtgtcagggtggtgactttgcattcctggggtacagaaaacatttttgccgtactccctgctgtcagcagcatgtagctgtttctttcgtctctctggtttcacagacacatttagtcttgatgcagaaagcatcttgccagcttggactcgagccctagtgctgaggagaccagtctgtcctaaaggagggtctctgtgactgctgggctcaaaggaactcatcacttcttttttctcttcttccaaaaagtgatgctccagggagtggcttatgtcatcttaatacctgtttcctgatctttaggactcaccaagacagtctaattctatttttaaaaatgctgccacctcctctgtaccaggcccagtggcaggcactgaagaa

SEQ ID NO: 135025 - DNA, 1050 bp, Homo sapiens
tagctttctcacagcagtgttaatccatatttcttgttggttgtttttcagttgatgttaggattttacaaaagcaaattattgacaatcatgataaaagccacattcatataaggtttatttattagggattgtattaacaatggaattttgatttatagtgaatttgaagtctattatagtcaagccttgttagcacaacatggaacaagcatttgaaatcttacaatagtggtccccaccgcagacctgaccagggcactgacttgcacacacactgacaaataagacctggtcactgttaaagacagtgagaggcagagaaggaaaggaagcagagagttgcagtaaggggtgggaactgctatagtagaatgtgcaagctgggagacatttcagcacagggctaatcactgcagattgggtgctgcggggaagcttcccagggacggatgtgtctggaataaggccttaccggaggaataggagctccccaggagcagggggcaggaagtagcacatgcagaggcaagcggccttgacagcatgtggcacggtcgggtactgtgagtgcccctgtggctggagcagggacagaaggagcgtggctgaggacgaagcagaggagtggtcagtttccaggccataagagactgtgttggcctctacaggattcagcactaatgtcataagccagcatttccagaaccctgttccttgaactattagacccaaagatattgatatattttctgatcccatagaatttggaattgttacactttacatctactgtaactttttaaatacattaacaatgtacactactgaagcccagctgtagagaaatctggatcactttgtttaacccagcatttttcagaccttttccacaaaatacatatcagcattccatgcatctagtactcctcacagcagtttacgaagcactgctagagctaatggctgatggttaatttttcttgctctgagaccatggaattaggataccagctgggttcatttttacccgttccatgactgggaatc

SEQ ID NO: 135026 - DNA, 1024 bp, Homo sapiens
tctgtcacccaggctggagtgcagtggtgcgatctaggctcactgcaagctccgcctcccaggttcacaccattctcctgcctcagcctcccaagtagctgggactacaggcgcctaccaccacgcccggctacttttttttttgtatttttagtagagacggggtttcactgtgttagccaggatggtcttgatctcctgacctggtgatctgcccaccttggcctcccaaagtgctgggattacaggcgtgagccacctcgcccggccaatacttagttttaaaacgtatcagctgcagcttcatcttagaacctgagaggaataagccacacaaacaccacatcacgaatgtgtaaatgtaaagcgaaggcacagcccagcagctgcatggtggctaaccacaggcatttagagttagggaggatcatctcctgcagaattgtcatgaccagtaaatattctcttctagttagaaatacacaagagaggactatagtcatggattaagctgaagccaccacggcagttttaaatactctatctttgtggaagcagtggcaaagagaaacggttgctgctactggtgttttaaaatcagatgttctcactttagggtctctcactttttcagtgagactctgaaaaggaaatctttctgatccattttcaagcaatgataacatttgacaatttgcagcctgaaatggtgctaagtgacttcatatgcatagctagactatgaacttcttaagaacaggagatcttgggaatgggcgtggtgtctcacacctgtaatcccagcactttgggaggctgaggtgggcggatcatgaggtcaggagatcaagaccatcctggctaacacagtgaaaccccgtctctactaaaaatacaaaaaaattagccaggtgtggtggcgggcgcctgtagtcccagctactcaggaggctgaggcaggagaatggtgtgaacccgggaggcggagcttgcagtgagctgagatcgtgccactgcactccag

SEQ ID NO: 135027 - DNA, 1064 bp, Homo sapiens
gaatatggacccaagaatatctgtaggaaaagttcatgaaacatttgttttattttccggtatattttaggcaagtggataaggaattatagccaaaacctacaggccggagctaagcagattcattgatgggggagtgtaaaggggactgcagaaggggctggtaacttgctaattaacattttttcccattttagtggtcatctgaagtcaagatcatgtcctgggaatgaagcaaggataaggggaggtgcttctgccccaggacttcagggaccatcactatagctctgtggctctaagtggctaaggaggccaccgaatgtgatggaaggagtatggcctttggaatcacctgggttttaattctagttctgtcatctactagaagatgactctggaagttacttcaccatcctgagactcacttttctcatgtgtaagatgtaaataatgcctagctagcaggactcttgagaaaaatagcaataatatgcaccaaacaccagcatagtgccttgctgatagtagatgttaactaaatgatagtgaccatccctgggtgacaaagtaaaggaggaagggaaagatgagactgcgacattctagaatagtggtgtccatacttgttcaacaagtgcccaagaacctggagccatgcaaaacaccctgaaattattctggcccatttaattctttcttttgaactaattgtgaaagtatggcttttatctcaaatgatacataaaggatttgaaataaatcacatatttaattatttcctttaatatttatttatttatttattcattttattgcccaccagcaattatggacaaataggggtggaaggtaccaagagttgaaaatcagagtcatttaaaaaattacagtcaggttttgtttttgttttgagacagagcttcactcttgttgcccaggctggagtgcaatggcgacatctcagctcaccacaacctccgcctcccaagttcaagtgattctcctgcctcagcctcctgagtagctgagattacaggcatgcgccaccatgcccagctaat

SEQ ID NO: 135028 - DNA, 1124 bp, Homo sapiens
tttgtttttggtgtagtggaaagcagaaaaatatttttaaagtagtaaaatcaaaacagcaccatagtcccactgatttttactacatatgccttttgtatttactctttattttttcattatgcaaagggtttacataggtacaagcaaatctcagttaaaagttagttccccgcccccatttaacaagatttcatatgcatttttacataactgcagaatattccatcaagtataactaccataatttccataaccaccctcccttgttggacatttaggttatttccagtcttttgatattataagtaatactccactaaacatctttgtgaataaagctttgaaatgctgtatttcaaagccttctgagtggaagaactgagtctgtgagcaggagcctgactgtgggggccaacttgtcacagcatcgcaagaaagcagatttcggttgactcagcctcgcggtggctcaagatggaaaaagaatcaagaacccttgatgggtgggagggtgcgcactccctgccctccacacagacaagcagaggattcccagaacacacataagggatgtgactaatttgtctgtgcccccatcttgtgctgaaaataggtttgaggaaccttaagacactatgtacagtacagcaagatgagagataaggaagcaaggaaaccgggagaaagaggaaactgcatgacgcctggaagggactgatgtgtgtgtgcagctgtgtgtctgtgtgaggctctgtgaccctccacacaggttgggagtggtggagctgggactcaccccatcacacccaggtctgtctaaagagcccatgctttaaggaaaaaaaatgtaaaaaatacatataacataagatgtgctattttaaccattgttaagtatacagttcattggcatgaatggcattcacaatgtgcaaccatcactactgtctatttgcaacatttttcatcactcccaacagaacctctgtatccagtgagcaagaacttctcatttccctttcccccagcccttagtaacctctagtctactttctgtctctatgaatttgcctattctagatagttcatagaagcggaatcattcaatatttgtccctttg

SEQ ID NO: 135029 - DNA, 1752 bp, Homo sapiens
cccatacaggtgggggaggtggaggtggggtcatggctgtcaggttactgcagtcacagtgctgtgttttgttggaaacagaaacatgagggacctaagcgggctcctgtctgctctgcttctgcctccctggaccctgagcagttattcacctctccaatcctcagttccccttccataaggtggatgtgtaatcccctccttgcaggagtgtagtgaggcttaaataagcccagcacggtgcctgtcctgacggccctgggaagatgggcagaaccctgccctcgcccacctcctccctctgaggaggaccctgccagtctggagcccgttgggggacagctccagtccgtggcctgcctggctctgtaaggaggggtcgagctctggcctgagaagcagaggtgggcatctcctcctctgcagtcacgtctgaagaacttttccctggctcagagctcccttgagatttttaccaccttggcctctctctctctctctctctctctctctctgtctctctctctctctctctcgctctcgctctctctcgctctctctcgctctctctctctttcctaatgaaaaaattcagaatgcagctggctgggggactcctgagctttgttttctttaccagatccagaaggaagaaggaaggggaccgcttgctgaggcccagccctgtgccaggagctaggcttctcctccccatctgtgctttctgcgggtttgttggggaggctgggtgcccggctcagggcggggagggccagtgttggctccctggtgatgtgtgtcttcagggccgggtgaattattccaaaggactctctcagggtcagaaactgagatgccaggggtgtccagtcactgccaagttcacctcagtggcctcccacagggtcagcactcagttcaactccgagttgcttcccatccgtgctctcagtaattctccatcccagcccctcactagccctttacacacaggggatggagcgaaggctgcagtgattcctaggaagcagcagagccagcagacagcctccaaacccaggttccctccaacacatcctcccgcctgtctttgttctagtttccacatgttccgtgttagtaactctctgcatttccaataccaggcacaggtcgtggcaccgtgtgtaggtatcagtgaatatattttggaataatagacgggagaatgggtgaaggaaattagggaatagggaagcatttgaggcagaggggctccacttggcctctggtgcatacacattgcatcctgtcctatctatgggcttcagaggttgctgcttcctgatagaggggaaggtgtctgcaaatcacaagggcatgtggcccatttttcggtcacctggagaaaatcagatgcaaagcccaagatatttaacaatatcagtcaaaccaacttgtccttctcgacttaaatgacagagctaccagcagccaggcagccccatccagagaaaccccctttatccatgtcaagcggcagcccaggctccagctcatttatttaggcctttcttgctctctgacacgcctcctagcagttgccaggcaactctgggagtagcagtgtgtgttagggattaactagttagggctggggtcctttttggcaagaaggggataaaagacaaatgagtttaattgctaggccgagggtcctttctctgcatggtagaagattgcaacttttggaggatatgtgtagcagtatgg

SEQ ID NO: 135030 - DNA, 1049 bp, Homo sapiens
aatacaaaaattagttgggcgtggtggcacgcacctgtagtcccagctactcaggaggctgaggcaggagaatcacttgaacccaggaggcagaggttgcagtgagccaagattgtgccactgtactccagcctggtgacagagcaagactaactcttaaaaaaaaaggtttgaagtaacaggactagaaatgagaaagcaccacccataatcctatcgtcgcaaggtgagatacagtggtggcaggtttccatccagcttctaggatttttcgtttcttttgtttttacatttttgggttttggttttttaacttccttctaggcagatgagatatgcctgagaaagcaatccagtatcctagttattaatattttttttgccttttagtttgtgtaagcattttccacaccacataaaaactcttcttagacatcattgacagtggctgagcagagcctatcaggtgacccttgtggttcccaaccctggccgcggatcagaatcacggagggatgaggagcggggggggggcggcttttaaaaaggcaaatgtccaggcccccctcagagatttctgtcaagttcctgtgatctgaaatcagagccaaggcccaccatcttttcctagtgctggtctttaaaaaaaaattattttactattgtattattattattattttgagacggggtctcgctctattgcctaggctggagtggcatgatcatggctcatggcagcctcaacctcctaggctgaagtgatcctcccacatcagcctcccagctagctgggactacaggtgcatgccactgaactcagctaatttatttttaatttttgtagagataaggtcttgctatgttgcccagctggtttcaactcctgggctcgagtgatccttcagccccagactcccaaatctcgtgctgagattacaggcatgagccaccgtgcccggcatgctggtctttttgattgtcagtaatgtttcatgataccacactgtgctaaacatctttatataaatctttatgcatggtttgaa

SEQ ID NO: 135031 - DNA, 1021 bp, Homo sapiens
aagtcattaaaaattgtttttgtttttattagacatgttctaataggaacaacattcatttaaatttcaaaaacatgccctaattctgaacacttttttttttttgagactgagtttctctctgtcgcccaggctggagtgcaatggcgcaatctcggctcactgtagcctctgcctcccgggttccagtgattctcgtgcctcagcttcccaagtagctgggactacaggtgtgtgccactgcacccagcctgaacacgtttttgtcctcccagtaactgaggtatcaaatggatcctgccatccgtaggatcttccagggctccatatgtagtgggcttagtcagccaccctactttgaccctgtcctcaacctgtgttttccttctctccatcaccagatctcttccctgaagaacaggctgaaaaaggtctccacaaccactggggatggtgtggccagagcgttcctcaaggcccaggctgctttcttcggtagctaccgaaacgctctgaaaatcgagccggtgagtagccttggcatgtcacagagcctgtgtttggtcagggctgagaagcatacctcaggggccacaagaaatgccatgattcttctggtttccagattcatctagaagagcttgtgtgtgtttgtggtgggggacagtgtactccccttgccatacctctcaacacaaggaggctgtgctatcatgtgtgagaccctcactgctctgggggctgttatgccctgtgcaccaccctagacagtaagccccaaccgcgtgtcagatgcagcgccaggcccctcacactcacctgctctccctggggcttcacagtgcacctgtgcagtagcggtgatcagctccactttacaaatgaggaaaccaagactcagggaagagaaacaacttagcccggaaaagccagatggccccggagcccctgctttcccactgggcctcgccacccctgttctttcacgggaccgctcctccacgcttgagaaagcagagcc

SEQ ID NO: 135032 - DNA, 1468 bp, Homo sapiens
ttagggaagcaggcatcttggtggcattcctgctgtgatatgctcatcttttgggcctcagatagtggctctgagggcagaagtgcattttggttcatttttaatatatgtcattcaatttgccagagtcattgtgagacattcacatgtctgactgagatactgctgatctgtagaattaattatagttaaatggaaaggtggcttttgctcatgaagaaagtcgttagtctcttgataaacatttttaattatgattaactttagtcttcctccaaatactttccattagaaaaggcattaatgttctggttcattagaaatagagcaatccttttatttttggtttgcagtccattttgttcttgaaagatattggtccacttttttaaaaaaaaattggtggatgttgtgttgtaaaaaacatataagtttccttttgcaagtgcatatcagttttttcaaaggtaacttacactttaattttgtgtgttgtgtttgcaagagaatgcttcttggtttattcatgttgacaactgaaaagccttagacctaattaaaagaatttccatgagcacctttactgaaccatttcattacgcggcactgcacagattgcattgtgaaacatggtgatagtttaaatctgacctttaaacctgaactgccagaagtatggggggaaaacccttctttgaaaacactccccggataaatatatgtgtgtgtatgtgtatgcatacatgcatgcacatatttggttagaagcaatctttttatggaatgaccacctaataatataaatacacatttactttgagctcagatcttgtagtctcctgtagcttgggtaggattttctagctacattaattgtgtgtgtgtgtttgtgtgtgtgtgtgtgtgtgtgtgtgtggtgtgttaaagctaaattgttgtataaggaaaacaaagataatttcacttactctgggccaacaaaaaaaagtatttggaggaaggtaaggtttacaaatagaaaaacacaaaagtcttcactactgtgtgtttcagtttcaaatggtgagatactcagattaatctcatggggagagggctggagtgtatatgtgtgggcaagactcctcctgagctttatttggcagatagtggaaacaggccttttttggttttgttttaaaattgcacttttttactccaaggatgtcattctaaggatttgatagcttattcctgggatgctcagcagagccactatagcacataacgaagtagccattcacataatgataattgatgcttttgtctgacaaaaagctgcctggaattctaactcttgccactaactttctgacatatacacagcccacaagttgtcaggggagagggagggagcagagacccgggctcgtagggtcatagccagctccagcatggaactccacataaatagcacagccctcactcc

SEQ ID NO: 135033 - DNA, 1052 bp, Homo sapiens
agatggctttctttttggtaaacttcacaagctgattctaaaatgtatatgaatatgcaaaagatctagaatagccaaaacaatgttgaaagagaagaacaaagttgtaggacttatattacctgtttgcaagactcactataaagttacagtaatcaagacagtgtagaaacacatataaatcaatagaacaaaattaagagtccagaattagacctacacataagtggtcaattgatttttcaacaaatatgccaaagtaattcaaaagggaaagaagagggatcttttattccaacaaacgtgctggaacaactggatatctatatggaaaaaaaagaagccttgacttttacctcatgcaaatattagctcaaaatagactatagacctaaaaatagaagcaaaaacaatcaaatgactagaaaaaaaatatgagagggaatcctcatgaattgggggtaggcaaaaatttcttaggacataaaaagcacacatcataaataaaaaagtgataaattggatgtcatgaaaggtaaaaacttatgctccccaaaagcatcatttaaaaaatgaagaggcaagccacagacaaaatgagataaaatattcttaacacttatacctaaaaaaggacttttatccaaaatatatttaaaaattccaaaactcaatagcaagaagatagctcaattaaaatgggtaaaatatttgaagaaacacatcacaacatgcacatgaaaagatactccgcatcgttagtcatgagggtacaaattaatgtcacaacaaggttctactgcatacccactggtacggctaaaataaaaaggctgaatttcttatagatgtatattttaaacatatgtttactgtatgaccaggcgatcccacacctaggtatttgcccaagaaaaggaaaacgtatgtatgtgtatgtttttagcaacccaaaccagaaacaatacagacgtcccccaactggttaatataaaaacaatcagtggtatacccataaaatagaaggctactccacaatcaagaagaagaaa

SEQ ID NO: 135034 - DNA, 1049 bp, Homo sapiens
aatttttaaaaataagagaatttggacattttggcatatggggttttttaaatgaaatttcatggaactgaaaacagtcaattttaggtttccaaaaattgtttagattttcgctggtataaatttgctgcacatggttttggggaagttctgagagatgcatttgggactttggggttggtttttttttttttttttttttgagatttgtgattgagttttaaaaggtgattttcccccctcccccaacctcaaagtgtaaatcaggggagatcagagttccattttctaaggacacttttgggtaatgacatcattatgcactgctgcacaactggacttggggctgagttattgagccttgtttcagcaccatttggacactgcacagtatattccccttccctgcctcggagtgattttggccgtgccattagcagcagctgctggtgataagcaccgggagagtcacctgtgtagggtcaggcttattgcacatcaaggtttggcagtgtcagaagagagggaagatgcccaggagggggctccaggccacctgccgagtgaagatcaaagggttgaaaggtcagagggctcagctcccttaactgtatctgtctgtgcaatagctatttcagattgtaaatcttggcgatttcattaagtcctcctggctgctactggggcattgaaataataaaattttatatctattgcctttcctgcctctggcagccaggctgatacgttgtctgcaagatggggtcgtctttatgaaaaccttccctggaatgatctgagtagcattaatgaagcctcagattgggaagttggggttcataggacgtcatcctcagcaggagggagggggtttataaataaagaagacccacacaaaccatttagcagccttttagatttgtgtagcacctctcttctgaaaagcaggtcagcaaaatattacctattgctaaatgtttaatcttaggaggaggggtgcactttctcactgctgctgcttattaaatagcccctgttctaatgaccct

SEQ ID NO: 135035 - DNA, 1061 bp, Homo sapiens
gcattcttcattgtagtaaatgtgatataaaatgtatatagaatcatgaagaaggaaattaaaattatgcacaatgccattattccagattgaaccattgttagcattttactaatctccctcttggtctttagtctctaaatatatgttttgtataaatatgtataattgatatactttataattttgtgtctttattttaattaacatggcttgggaatctctacatgtttttatctactctcagtaataatttttaatttgccacctatcattcccactatttggatataccacaacgtaactgttttcctactgttggacactgaggttgtttataatttttcactattataaatagcatttcagtgaacatctttatgcataaggctttatctgcattttgcctcatttccctagcatagaacccctaaagtagaaatgcttggtcaaagctatgcatcggatgccagattgctttctgtatggctgtaccaattagatagcaattcttttaaaggacttttctgtgcttttgtaagtgtcattagtttgtagacatgtaccctaagccctttcctcctcaggagagagttttaatttgtactagagcaaaatgaggcgtggggagggtgcttgcctgtgttgcacaggagataagctctcagagggaaaatctacagccatgtccgtctgcggtggtgctttgcatgtcttgaaggaagtgctacttctcttcttctgttcccttcatttcacgtcgacgaggaccacctgcttcactaactgttgcacactgtgctattgtgcttacgaaaatgaaagaagttggttatcgaaaaacctgtttgtttgacattgagaatcttgatcaaaatagaccacagaaatctgctcaaatttctaatttgacaggccggccatgtggctcctacattctgttaacagttcctccttgtcatcacccagccctaagcacatacagtacacagtttatggactatctgggatgatgtatttagatcagattgaagagatttcttctgtgttttacctttgtt

SEQ ID NO: 135036 - DNA, 1093 bp, Homo sapiens
agtcccttctctgtaaaatgggtattgtatctatgggtattgcaaagttgttatgtggattagaatagatgaatttaaagttcctcatataatgtctagcacatttgttattggtaggtaacataaatgataatgtatacacacacacacatacacaccgacccctgaaatcaacggcaggaccggtgtatccaaaatgcccaggttttaaacccattggagtttagttctcatgcctttgctcagtcactgacttaggcaacccgtggctccgtgaatgaagcagttggcagaggctttctgaattatagtgtcatgggatggcatgtgtgcaactggggaggagatgcttgctggcagctctccaagtactttgtccaatcagaatggacagttagatcacatctcttgatgacagaggaagcagcaaatacaaaatattcttctttgaaacacattatgcccttcatccaaccttaactgctttttctgttgtaatcatggcaataatcgttcccatctgtattagaactctgctgatcatttaacgtatattttctttgattctagtaacaacgtgctggctggaatccaggattccattttaaagataaggcaactgaggctgtgcagttgcagagccgctctttaggggctaatatcaaggttgatgctcttcctgctacccatgctgtttccaatgctgcccacgttttgaaattcttctgaagtttctaggcttgggaacaaaatgtcatattaggatttttgttgtgaaaggaaatgtaactatgcatacgtttattaaaacagtttttctccaaatagtgaaccatctgtaattttctgtcagaagcaacagacattaaagcagctgtgtgtctctgtttctcttcacagtgctcccatgccctacctcataggaatccatttaagtttaatggaggtaagttggcttctttcctccccagatggctctacctggggctttgtttcattgtgtggcggtggagagacccagtctcagcagtcacagctctgcacgtgggagcatgctgaagcagcacctcccagcgtacagagctgagcgttc

SEQ ID NO: 135037 - DNA, 1955 bp, Homo sapiens
ctctggtgtctgttctttttctttttcccgttctcttgtcctttaacctctctaataaagccaggctcattatttcgagcagaatttaaaaccacaagacaatctgtgtttacacgtttgtgtcttttacaaaaaaagaaagaaaagctcacataagacctccttcagagtttttctttctgactgtgggatcccctttgcctgatcagggtatttaattaagaaggtggtggccctctgagaggtaaggtgacactgtgatgtgtatattgtaacgtggatacctatgtgtaaacagtgatctttccaaatccctgggctgccctaagctgtgttccttcatgatagcagaggtgttgcccacctggaggtggagggaccgcctctcccttgtttcctctcccctcccactttgtcttgggaagctgtattttttttttttttaagcagccagtgttcctttatttcactggactcatttccaattagtagctgctcacctcaggggaacatgattaacagagccctggttatctgggggaaaggaattaaacaaattgtgaaagtgcggtaataatgaacaaggactacaggatcgttagtaagtctgcagtttccatattcttgcttcttccttgctgggaataagctcatgccataggacttacctgtcagagaagcgctcagcatcacaggcctggaaccaagaggactggcgaatagcccttttggtaccccagcgctcttttcctttcagcttaagtactgagtatgtgctgtgtgacctcatgtgcagagcttgggctgtctgttcagcagccttgcgtctgaagtacggcttcaccactgaccagctgtgcgatcttggcaaattttatctttctgagcgtgtttcctaacctgaaaatatggatgatcgcaccaccttgcagagttcccttgagcattatgtgtgtaatgcataaaggtgactgaattatagtagctcaataaaagttccttttcctcttaagaggattcaaactaaagatatcttccaggtaaaggttattctgttgtgtctgcctcaacaccagcaacagagcccttttccttttcaggggagaaggaaaaaagagtcacttttactctcacgtttgtaactgatgaaatcagatagtgcagtaattcccagagaacaaaagcttcatacagatataccccattctgctattccaggatgtacaatagcatcctacaatcactgtcagtcatacagcagttgtgacatggttgtcatgacctgcctatgcataagtttggttataactgttaatattatcaccactttaatttaattatgtgcattgttggttctgcacatgttgtttaattgccgtttaaaatgtcttcaaaattgcactatgattcaatattgaaaggtaaagtcactgtgaatgctaaaaggctctggagaagagaagcagagtatatacatttgctattactgaagcagatatttccattcatgttttctagaacagcaacaaataagttctttcttgaacctaaacaggaagatcacttctagtagatggattttggtttggttttgtaactgagatacccttggaaaaacatggacgtttatgcctctgaattagaaaaggattcagatgtgttggattctgaatatgaagaagttttttttttttaaatagcttacccaatttattttgctgttttatttttaatgtatgctcaagagtgataagaggtttttaaaaatgtgtccaagtgatcagaaagtcatgaaccattgtttcattgatagtttttccgttattggtggtacattagaaaggaaaggcaccctcctgacgagagtgatgagcaaccctcctgaactcagtggagtatccgggagacaagagtgtgcttgggagtcagaaatccatgtgtagagatggtgtgtg

SEQ ID NO: 135038 - DNA, 1154 bp, Homo sapiens
aataggtgcctatgcacagggaaccagggaagactttgaagaggaagtacttacacagagacctgagggaggagtttgctagaggcacaaatccaggccagtttgggggacgggtggaaagggatgggaggaaaaggagtacatgactctatctaagtgatgtattccaaggacagacttggagaagatggtacagagtgtggctacagatggctgctgtaaagctagaccgtgggctggtggagccatccgggccaggcttgtccccaaagacttctgagtaggaagtgatgggccggaacctgcacttgaggaggagcgctctggcagctagttaaagatgagcagaaagagctgagacccagggccagtggaaccctccagcctgacttcagggtggaatcaggtcagagttggttcattctccactcactcaacaccagcaaggacttttcatctctaagaagccctgaagggattagttttatatatgtgtatttttgtatgtgagatatatatatctatatcaccctcctttatatgggtacctatggaaatagaatgtgaagggatgggttaaacctgcgagccttgacggggtcactgggaactgttcttgggtgcctgctgaatcagttccagttcatggcatggacctggctcaagaacagggtctggaggaaagagtcagggcaggtgggggtggggagtagcagccctggctttaacacacagctctcacaactgtgaaacatcagcagaatatccaatttaaagctgttcatgttacactaacctctgggattcttttaactgggccttggcacgtcactctttcgccacgtaaatgttcttctgtcagcaaaggccagttaacagcttccaaaagaagcaaagtcctcatgggaacaggcttccctgaaaccaaagaaacattaaagaaaaaaagacagaaagaaatatgtgttgttggcttttgtcacttcatacctatatctccaaaagttgttttttttccctttcttttcactatattgaattttgtagcaattgtatccctttgtagtatctttgtttcctaaatttttaattgcatcaaatactgattgtatgatgtctctagctctcaagaaaaaaaaggaatacaaaatagg

SEQ ID NO: 135039 - DNA, 1033 bp, Homo sapiens
gacgacataatagagactgatcaagttcatttagaagatgtttatgcgtaccgactggcacttaaaaagctctttgtttccatattctctttgggagagctttgactggggccttggctagtctagaaaaggaccatagctgagtataatctgttcaggctctcagtaattttacggaataccagtgcagtccaccggtgtaatttggggtgcatgtgtgtaaacaggtgatgtttctttttttttttttttttttgccatttcattaaattcatccgatttctgccatggcagaaaattttattattttagtaatgcggtcaagtcatgaaataaattgtgtcttccttagattgcaggactgatagcttctcatatgactcttatgaatcagaattttaaagaatcagaattttaaaggataatatttaagtcattgacatcttaatctacttaaaaagccctgcacccactttggcagacatggctgtcataaaagaaattttgagcgcctactaggtgcttatgacactgggagcaaggactcataatttcctgtgttgtttctgcagactgaaagtgtggtcactttggtgaaccaaggtagtgtgatatgaggttagaccatgaaatcatcggtaagtgcagacacggagcacattcacatttgttcttttctgctaccttgatagcttcagagtctaccagctagatgtgtcagacagccctgctggaggtatcttttcccaagaaaaaagacagcaggagtggaggagagagtatcagactgcaagtcaggatggctttgttccacttctgcctccgccttgtacttaatccaccatgtgccactttctagccatatggccttgggcaagttacttgacctcttggagtccctctgtcctcttctgtgaaaatggggatagtattcacacctacctcaaggtggttaaaaagatccggtgaccatccagatatgaaagcacagagcccagcactgggcgcactattcactctgtaaatgttacct

SEQ ID NO: 135040 - DNA, 1058 bp, Homo sapiens
tgctgttggtttgggtgaaaaataagacctgattgtatagtacttagaggttttttttttttttttttttttttgtagcttgtaaagctccaagaccactaaagagcattcacagaataaatgtgtaagaatatccttaagtagattcgtcctcagtactttatatgggagccccgccgttctcccccacccttttaaagttcttttaagttaaccttttgagccatccatttcctatatgacaggcactatgctaatcatgtatgtgatcatttttttcattcgttcttgcagcaaccctaggagcttgtgggttttcttctccctttgcagatgggaatgttagcacccccgaaagttgatgtgccttgtctaagatgagcagcagagatggaattaaaaccaggccagcatccttgctgcctcatacttccttcttggtaactcttcattgtcatgaattccctgtgacacttgtacttagagaaatattcttagcatgaccctgttggccatggatctaaaataatataaagaacctctgcctggtcgtcgtcacctttgaacgcacacctaagctttttacttcagattcggcaagccctgtctgtgcgcctgacactactctaggcaccaggaaacaggaggcagatctgtgaattcccattgacacacccagtctgttagccacagctccatttccttaaacacttcagattccattccgtctgcccatgccttcttagacttggctgtctcccagcagctcctgcaccctattcctaccatgagtgcggccttggtggagccctggggcgtatcttctgtaactcactgtggtttcagggttcatatattgcagctatgtatctttgtcctatataataaagaataaagaaccttccagggttcatatgttgcagttccttcgagcagtgtatcttggtcctaatcaccccctttataatttagggatactgaaagaaatttggacaactaagaatatccagttaaataatgacaaaggcatatttactttcctgagaaacatctatttg

SEQ ID NO: 135041 - DNA, 1054 bp, Homo sapiens
cagcctggtacgtagcttttgcagacgtttataataaattaataaattctataatgggaaatcaaattttattgtccagtttattaagggcctaccctactggaatgtaaacgtcatgaagacagggattgttgcccgtttccttcactgctgtgcccccagtgcctgtggtaacaccacgataaatatttgtggaatgaagacaaccggataagcggggtgactggcctctgagaggataacagttcatttgcaaagggaaggcagaatccaagtcttaatgtggaaaatgtgaaaccaagaattcgtgatttagaaataaggagataaatcctgtgttgaatgtgattacttcgagtgaagggtgtaagaagaatggtgaagtggactgttccttttcatgataagccttgactactttttgttttgttttgaaatctatgaatatgtattactatgacttttaaaaggcttttcttaacaaagagttgattcttaactgggttcgaagtttcatggattgctggtagaagcttctctggaggaggtggggttctccttgtatgtcacgtgcagttggcagcatcctgagaggttctgcggagtttggggatgacgtagctgagcagacttctgttgtattcacacctttggacctcttcaaattcagaatttgaaagtttcccaattgttgccttttatttccttaagagtggctttttattatcttttagatgggggctggtgcggagggggatatgcaaaggccatctcagcctgagattttttgaggaacctctcttgacagatcctgatgtggcctgcaatacttgacaaaccacattcttctcaattgtgtttgataagatggaggcttaatgctcctcagagccaccaagcacatgaaagataaaagctgtctagcactcgagtgctgtcttctataaaaatggctgtgtcaatagagacaaactcaacaatatttagttcagaggcaggtaatatgcatttcggggtttctcggtcaataacattgtgatattctgtataagaa

SEQ ID NO: 135042 - DNA, 1168 bp, Homo sapiens
tcagccacaaaccgtgccttcttctttctcctagagaaatctgacagaatattttgtggctgtggatgttaacaacatgttgcatctgtacgccagtatgctgtacgaacgccggatactcatcatttgcagcaaactcagcactgtgagtagacagtcttaagactggctttttaatgatctaattttaattgaaagatacaccagcaagatgaaagaaaattttagaaaaaggagtcagctacagtccccttatatggcagcatgtcattttcattaattgttcatttttttttttttacagtgccaatgcacatttcatttattcctgtagtcgcacagtcaattataaatagctttccatttgattgtgtgttatgaacattttgcaggtttctacatgagcttcaattgtcattttttaatgtctacaccatatttcatgatacgggtgtgtcattatttactaaatccttctcttgatggccatttaggttgttcattatgatttaatccttttagtagataatactgcaatgaacatcttttggcttcttttgactgttacagttatattctaaggagtgggacactaggtcaaagggcttgataagcgctatgacttagggactgccaaattgctttgcaaacaggcggtgcttgtttacagtgaaggctgccagctgtagatgagtgcaccattttcaccgcagctttgccaggaaagagagagagtgtgtgtgtgcgcgcatgtgcgcacgtgtgtacgtgcatgtgctcaggtgttttaattctgctaagaaagtagatgtgctatggtatttcaggcttgctttaattttagaattacctctttggttagaggtaactgaatattttccatgggtttatttttttatttgtattttgttaatatcctttcacatttattttataggtgtcttgatttttttattaattataatgaactttctatataacttttgctgtgtgtataatataaatatttttatattccttttattttagtttttcacttgctaagtatgagttcacattttccccaatattttttatgaaaattcttaagccattatagaaagctgaaataattttacagtgaatgctgatatacttccatctaaattctactagtgacattgtatca

SEQ ID NO: 135043 - DNA, 2806 bp, Homo sapiens
tgtgttgattgcctgattataggagatagaaatgagaggatgaggatttagtctgcaggagaagcaaagtgctgggagagtggcttatcttgtgtcttttatcagcagaagctcataacgtgttctggctgtagtcttgactgaggacagcctgccgcggaagtcctcccttctatcctctgatcttacccatcggagaaatatgcttggcctggctgtgaaatgaacacatgcttctgtgtacagccctcaccccagttacctgataaaccactaatttatttacatttttaatacatgtagccacagctaccatgaaaagtcacccctccctccctccgccattcccagttacttaccggtctttgtgtagcttccagtggcagttctttttctgcgggttcttcaccattactgagtaatcaattgcttcatctggctcagagccaggttttctggagtcacatgctacgttcttcctaatgtcccacctggtccatcttctgggctggtgcattcctcactgcactgttctcgcctgagtgagggaccagcaccctcagccattgcttcctccgtgcaccgagcttgctgtcatcaaactgctggatgatgggagaagcagcttcacctaacaggaccccgtctcgtggcaaaaacatacttaaaactgagttactgtaagatggggacaatggaagcatacaggagaacttgacaaatgaattgaggaagtctcccgggaggaggtgacattggagctgggccttgaaaagtaagcgggtgtcctcaaggaagagtggggcattcgaggcagaggacacagcaggagtaattacaatttccaggtatttcactcaattgtctctcaggacatggcaggcctgagagagtaaggattggtgtggctgggggagggagattcctgactccatggggcgtgcttctgaactgaggcttgatgggaactgcgagtgctccctgcagctgctcctggggccccgctctgccccacaggtgctcccacggctgagcgaggttcccagggctgttggcactcccacccactcccacccgctcaggcgggtggcatcccagaaggaaagaggcaggggaggaagcagataagaaagacagcttctgtttagacacaaatatcttggtaatcagcacagatgggatgagaaataccaaaaaaagtacatgacagtttagagagaatttggctaaatgttacgtatttttaacatacctgtgtagagtttttggaacaagcacctgagtccctcagaatctgattggagatgggggacatgcctcaatcaaatggtgtttttatttcagaaatgtttccttcccatccacaaaagtatccttgtgatttttttttctcccaccaaaataaggcgcaggatttgtctctgacgctgtgtctccctatttggacggcaagctgtgtaacatatttctccccagcgtgaagcttcttggcagactcttgaggccacgttttggtggcttcagagttatctttggatctgtcaaaagtgctaatgggctttctggccttctttaagctcctcatttctattttctttttacttccatcctctcctaaaagaaaaattcatgtaattcatcagcagttaagctttttactgaaatgctcagtgaagggcctcatatttttgtttgtgaggagagctgtgccatgtcaccgtcttcagagcaaaccccacccttacatcattagctctgtgttcctccgtccagtggaggaaccaagatacactggttgactccttccgactgcctttggtgtttgctgttttgtttttcactgagtttgttaagaggcaagttggtgtggtggttagggtatgagttttggattgaggagatctagttttgaaacatggctctcccctttctagctgggtgacctttagaagtctactgagacttcctgagcctccagtttttttttttttatttctcatctatataatggagatgataatgcctgtctcaagcttgttgggaagattggaaagaacacaggaaaagcacctgttgcctgccacatacagatcactccgtgaatggggtaacggtaatttttaacagaagcattttcctttctttaggcatacttgatcttgttgcgtttctttttccaaatatgagttttacctacaattttgtgtggaataaaaagagcatggatttagagacagacccactcaggactgaatcatgtcacatccacttactgcgtgacctttgtcaaattacacaacttctctgtgccactgttttctcatcttcgtagagggataataatacttagttcaaggaacagtttgaagattaagtgacatgtttaataatagatgtgaatctttcaaacaatagatgtgcataagagggacagtgttgtgtacgggaaagcgtataggccatggagtcagatctgactttgccagttgctgacctctcccagactttatattggaaagaataacgcctcactggatttttgtgaagactgcacaattacacatccacagtgtctggtacagtggctggcacttgataggtagttagtatatagagctgttaattcacttgctctgtatttataaaggttgatggttaacttggtacttcagtcaaacaataataaattataagataagtgcccatttttactcccagcccataatattgttgaaaagcactttgtgctattttgcatgtaaaatccacctggtttacttcaatttatgggttatagatctttaat

SEQ ID NO: 135044 - DNA, 1025 bp, Homo sapiens
tatgaaaccaacgcctttttcatgtgtttagccatttaacttctttgaactatttatgtatttatttagagacagagtttcattcttgtcgcccaggctggagtgcagtggcacaatctcagctcactgcaacctccacctcccgggttcaaacgattctcctgctttagcttcccgagtgtctgggattacaggtgcccgccaccacacctggctaatttttttgtattttcagtataaacggggtttcaccatgttggccaggctggtctcgaactcctgacctcatgtgatctacctgccttggcctcccgaaatgctgagattacaggtgtgagccaacactcctggcctgaactcttcatttatatctcctaaagaagttctcctctcatagaaaagaactccatctaccaaagtgatgatttaatgcatctggttcaatctgacattatccaaagaaaatattccatgggtgtttcttctgagtgaaaccgtttccttttctgagtaaggaaatattttccaatcatttacctgaattctgagtaatgcaattgttacacattttagcagaaataaatcacttttgcttttcttttctagcattcttattttactgtgcctgataccagagaacttcccagcatacctgagaatgtaagtacttgggaagaagaaaaaattaaatttttattcttctctgttttctgcctatttgtttgaataaataaaggatgtgatttaaaagtatcattataaaaattatggtttttaaaaaacacattataaaaacaaaagtataagaactgaagtgtattataaaaacaaaaacaaatagagaatatttgcaaagtatagaaagtataaagacaaggaaggatttttattcctttttctcaaaggtaattatgtattaatatgatatttgattccctctttttagaatgtatttttacatagttaaatcacctattataaaaacatcttttccattttcattcatatgacttatttttgtcaac

SEQ ID NO: 135045 - DNA, 1113 bp, Homo sapiens
ttatctagaaaaagtataaaaaagtataaatttacctcaacaaactctgtctcttaattccaacaatgcagtaattcttagaaagaataatgcatcaagtattgtggggagaggaggttataatttttctgacttaataacagttcatagttgactttcacagcataatcataaaaggagtcatttttttccaaaagtatttgaggacttcagtttcccgaaggtctcttttatcctttcatattgaaatcattttcttttgatgtgactgttgtgttactatccttgtttttcttgatttttctcttcatgtcttgttaagtggtctaatacagccaggtcttcatttgtcagtgactttgcctcaactctgtgcaggtatccagcatgtccaacatgggcttcataaaatccagtctcctttgcaagagttgtagttttagttcatggcaaatttgcattttattatagatgtttggctgagatacagacagaggagcagggatagatgctaggtgaaacttgaaagggtggataggggacgtattgtctggaaactggaagggtggagaagggtcatgttgtttgaagcagtcacattgttggtgagtattttcctcttataagagcttctgttttcctgcccattctggttgaccacatggtatgaggaatttctgtagaattctggaggagcctctgacccagacaccaggaatcaaagagagattcccaaagctgagattgccaagggggacaggaagcgtgttctggattggtggctgtcatgtccatcaggtacattagcaggtggtgtatatcttttcatagaggaggaaactgagttttgggaagaccgctttctcgaggtgtcacatctagaaaggagcagaactaagattcaaactcggggttaccagactcaagccagtgttctccccagcatgtgccatgctgctctgctttttaacattggggaggaggtttttttgttttgttctgttttgttttaataggaaggctttaaatattgagtgctgaatggtcttaaccaagggatgctttgccattggaaacacgttggcaaaatctgctgacagaaagaaagggata

SEQ ID NO: 135046 - DNA, 1046 bp, Homo sapiens
ctccctccctccctccctcctttccttcttccctccttttcttccctccctccttccctcctttccctttcccttttcttttttggtacagactcttgctgtgtcactcaggctggagtacagtggcgcgatcttggctcactggaacctccaactcttggactcaagccatcttcccacctcagcctcctgagtagctgaggcatacaggattacagtgactacaggcaggcgccaccacacccagctaacttttgtatttttttgtagagacagggtttccccatgttgcccaggctggtcttgaattcctgggctcaagtgacccacccgccttggcttctgaaagtgctgggtttataggcgtgagccaccacacctggccattcttttcaaccactattattttatggacattttcccatatgattaaaaataatctaaaatataattttctgttgcctggatttgctgtaatctctctagccattctcttagcacatgtttagagaagtgtgtgtgtgcatgtgtgtgttgtgctgttataagtaataaaagaactatcatttaaaatatattaccaaaaaaattgtcacaatatttaaggccggtaaaaacatagtaaaaatgattcatgcgtacatttttctgcccttcgttttaattttctactttttgtagtaactcattaaaaggcaactttcctgcattcattcaatcctatatgagtttatgaatttacatcagaggccaggtgcagtggctcacacctttaatctcagtactttgggaggccaaggcaggtggatcacttgaggtcaaaagttcgagaccagcctggccaatatgatgaaaccccgtctttactaaaaatacacaatttagccgggcatggtggcatgcacctgtaatcccagctacttgggaggctgaggtgggaggatcgcttgaagctggaaggtggaggttgcagtgagccgagatcacgccactgcactccagcctaggcaacagagcaagactctgtctcggaaaaaacaaaaaag

SEQ ID NO: 135047 - DNA, 1101 bp, Homo sapiens
aatgaacaggagcacaaagaggttaaataatttacccaagggacagagctagagtaagaacactggtgatctggttccagagcccagacttccaaaagtgtttaatgaatatgtaaatatgtattgaatgaatgaatgtgttgttggaaagttgaggtaactcctgtctaaacttctgttttcttgatgaagtaggtggtaagatcagatactgagggtgaggaagagagagtatgaagattaaagatttgagtagatatggaatagtcatgtaggccaactagtggaaaaggctggacagtgttgaagacttagttgatgttgtagattttataaatgtagaattcctagaggtataatatgtttgtgtggaatttttccctagctatgcatattagcctaatggaggcacagagaaggtaaatagttgcattcattcaagaataaggcatttccatgcatcagggatgaaaggaaaagagacacatgcctttatggtctggatatgatggaccatagaactgagctggataagccagtggtgaagaaaggagagtctcatacttgaggaaaatgaagagaccattagtgataagggttaagaacaggtagaaaaggagccgtaagatgaatgaacaccaaggataagaaactagtttcagatttgggaagtcttaattagtgattttagaggcagggcgggtttggtaatgggaaggttaaggggagactaaagaatgtggctgggatacagtaaagaaggaggtcagaatgatgaggtcattgaagcccctgagagccagggtgttgaatgactgcccccatcaactgtgcacatggtagttatgctttaggtttgcagtaggtaggatgtcacagtagcagtggacttgaaagacattgctttgttgaatttatatatatatatatatatatatatacatatatacatatatatatatatatattttttaatttattattattttgagatggagcctccttctgtcctccaggctggagtgcagtggcgtgatcttggctcactgcaacatctgcctcctgggttcaagctattctcctgcctcagcctctctgagt

SEQ ID NO: 135048 - DNA, 1031 bp, Homo sapiens
tcccagctactcagtaggctgagttgagaggatcactggagtcaaggctgcagtgagcggaggttgtaccaccacactccatgctgggccatgggagtgatatcctgtctcaaaaacaaaaaaacaaaaagcaacaataaaaaacagatccagtgcctatagcattaatttctctgagctctagacatatagttgatgatcctggagtctgagtactttaggttagatttagtttagttgctgcttaacagctgcaaactagctctaggtagtttgctaaataactttactcactcattcattaatgaagcctgtgttaagtgtctcctttgttcagtcattgatgtgggtgaatgaatgaagaaaggaagttttatatgagtcagtgaatgaatgagagttgtactttctgtcttcaggcagctcacagtctctgataagatgatctgaccaaggctctttttatgtgagtgaattttagaacctcgtgccagtgggatatactgccaacccagagtctataaatcacagttattttttgcaagaattgagtattctcatttgtcttgctaatccagaaaagttaagttgtaaacaaaacatttattttttattattattattattttttttggagacagagtctctgtcacccaggctgaagtgcagtggcgcgatcttggctcactgcaacctccacctcccaggttcaagcaattctccctctctcagcctcctaagtagctgggattacaggtgcccgccaccatgcctggctaatttttttattttttagtagagatggggtttcgccatgttggccaggctggtctcgaactcctgacctcaggtgatttgcctgcctcagcctcccaaagtgctgggattacaggcatgagccactgtgcctggacgtaaacaaaacatattttagaagttactgaaaaataatttttaagaagccaatgaaacctgactgtggagaaatatattcctagcaaccaacctgtggactcagagaaagaacctag

SEQ ID NO: 135049 - DNA, 1145 bp, Homo sapiens
ggaactgtctccaaaaaaatgtttatgtgggtttccttaaaaagttctatagacattataggttttcacagaaccccttctgtggtctctggatcataggctaaaaatccatatttaagatcttttcttcacttgctgtttttttcaccattattaagaattacccaagtactgtatacctcttctatgataccagggagcaaatttcacactacctattgtgggtgcttgtgtgtgagcaactggtaaaagccagaggctcctccctctattctcttcattcattttttaatgctctgtgctgtgtactggggattcagctgtgaataaagcactatccctgtcctcaaggacttcatggtctggtgcatttcggaaatggtcatttttggaatggctaaagtatgttcgtgtgatagggagaggcagcatggagtgtggtggaagaatctggattcatagtcaggcttggattcaatgtgagacacgttattattgaattatctgaggggcttttgtgtcaagggaataatgatgctaatgcctaccttacatcctttacaaatgagagcttttcttcgtaaaaatgacttcttctgaaaatgaaatacatgtaaagtcctgagaagaacacttgttgcagactaggccattaataaaggttgcccattattaaaaattaacacattttattcaacaaatatttgagagggaaatcaatgctgtgagtcaggtcccattaatagagatggatgtataaagtcgtatcatagtgcaacacaaactttgatatttaaggtctgcattcactaatgcccagtaagattttactaaaaactggtttaagtcgtgagtagaaattatattaggttgtgcagtttttcttacttactaaaagctgaacgtgtttttcttttgttgtttgttgtttacctgttagaatttagtttataaggggccacgtaggtatttcctcaggaagatatcttcctcaagatttccatggcataatttgtgacagaattaagttatgccacctttgaagtcggtcacagcccgaaagcacaagaagttgtttacaaaggaacccatcgattctccttctttctctggaagcatccgagcagtgaggcccgtacagtctg

SEQ ID NO: 135050 - DNA, 2208 bp, Homo sapiens
tacctttagccttgataaagacaaaactgctattggtgtgtatagttactataaggatttttagttctcattagaactacttatccagctatgagtacattggtagagaaggtgcagtctaactagctagcttcagtgatttttcttttttctttttttggagacagggccttactctgtcacccaggatggagtgcagtggcagtggcacaatctcggctcactgcaacctctgcctcccaggttcaagcaattctcccaccacagcctcccgagtagctgggactacaggtgtacaccatcatgcccggctaatttttgtatttttggaagagacagggtttcaccatgttggccaggctggtcttgaactcctgacttcaagtgatccacccatcttggcctcccaaagtgctgggattataggtgtgagccaccacgcccagccaagcttcagtatttttttctaaaaggtgactgttgttttgggaattcagaattcttgattaacaataaaaacttttaaaaaaggaaacatctcaccacttactgttttgttactcatgagaggacaatttctagaatatcaggcaaatactgagtgtggtatgtgtcacggacgacctgaggaaatcatgatgctggcttttttgactaggacttcagagatcatgggagcatcgggaagtctctgcaagtgagtgcagagagtgtgagctgtggagtcagaggggtttgcatttgcttaccagctcttgcccacttatgatcttcttacctaacatcttgcaacttatttttgtcatctttgacattcagagataaggactcacctcaaagggttgcgagagagagagagtgtacaaattattcagcagagtgtctgatatatagtggggactccatgaactcgttccttcctggatgagctggtttagaacatctagaaatggtcatagtggaaataggggtattttaatttttatcacctggttaatattgggaagttcactgagcctttagatagatgtgccctttgatatcttccttgattttcttggggggagaaaagcttagaatataaactcagaaggttcaaatcccatctcctcttttcccagcaacatctccatgagcatctccaacttttctggcttctccttctccatctacgtaatgagagcaatcataagtccttggaggattgtagcgaggatcaaatcataacgtatgatgctgcctggtagtagtaactggttcctacacaagttttacctagtgacaacttgaaagctaacacggctttttttaaaaaataaaaaaaattattttcccaagccctctcttgggatgtgctcatgtgagaggatgaggcagaaacttgctgtaatacacacccatcatatgtctagaaccaagtgccctgaacattcacgtgcattctctcctccactcttcacagcagtcccgcagaggaagaattatcctcgtcttacagaagaggaaaaggaaccttagagaatcattattagctgatattgtcagtatttgaacctagctctgtttgactctgaagtccatgttcctcccattcttttgtcttgcccccatcccaaacttggtgccttatttgacttaggctaaggaaacgtgtattgttatttggtgtctgtaggtgtcctatactccactgcagacactgaggatgcagtgatccccgagacatgcactttccccactttcacatggcccaggatctgaaggcagacatataattaaacaattagttgcaatattgaactctgataaagaaagttaaattattatgtaaatgagtagtcatctgtgtattttaaacaggcaatttcctctgaataggtgacttctgttggtttcagggtatcacataatcttaaagtagttctccttttggggtgaatgtaacatcctgtatttccataacttatcttgctaaaatatgaataaaaacttaataatgactctgcctctacataaaaaaataaaaatgttacctgggcttggtggcagacatctgtagtctcagctacttgggagactgaggtgggaggatcacttgagtccaggagttcgaggctacagtgaactatgaactatgtgcctctctgtactctagcctgggcagcagagtgagactgtcttgaaaagaagcaaacaagaggcctggca

SEQ ID NO: 135051 - DNA, 1020 bp, Homo sapiens
atgatcagttctgtttaaatccgatgcaaggtatgtttgaatggaaaaccagtgaaatagagcctgtcttttgaaaggatctcagaattcgacatgagggaccctttttgggagatgaaaaagcattctacaggagaggctcctcggtgctttttgattgagtttgagtgtcaacaatttttcttggacctccctgcaagccagccactttccttcaacagcaataagcagaaggcatttatctgagcctgatctttgcttttcactgggtgggaggtagaaaagaaaatggctcaaaatacacctcactcctaaaattgccctttgcttctaagctacactcttaagagcaagatggatttgtgaatacaggagtctgaatttaagttgtctggccctttcagggatcagttttagaagcagtaggaagcctaacattctctccatcatggagaggccccataagactgcaataataggtacttctttacagaaaaatcgtagtaccatgattgaagtttgaagaagtttgaagactctacaattctagcaatcaattatgagccacttatttttaggatgttattttttaagattataaagatacactttctcattagagaaatttagaaaactgcagaaaagaaaagaaatctctcatcccaccatgctgataatgactaagggtgtttccttccctgaattgggatggtgctgtaggtataactttgtatctagctttttcacttattaaattgtaaccatctttacatgtcattaaatattctttcctgagagtgtttttaactacataatttatttgtgtgagattgatttataatacaaggaaagaagctcttagtaatgtgaaagaatatttcttgctaaggcttatcttctttttaaaaatgcatttgctataatgttgtcattcagctaactacttggtatttttttaaaagaaacactcaacttttttttttatcttaacatgtgagctattacctgattcttgacaat

SEQ ID NO: 135052 - DNA, 1034 bp, Homo sapiens
aactttctgaacttggtagtacaaaatgaaaaaaaaaagtatttcttgtcatttaccaaatataaaatctaatgtgcttctaggtgcactgttcatggaccacctctgattttgatatccatctcccactgcacttctgctaccctcactcttttaggaactgctcaatctttggggtgggaaaatgtaaacaagtaatgaaaacataatgcgatcagtgttgttttaagaaaacatatttatgtgtaaggttcttcaaagtcacagattagacagtgcccatctctaacttgagaataagggaaagtgttgctgatgagttccagttaaactgagtcttgcagaatgagtgggggcttggctggaggaaaatgggagaacagctctctaggcagtgagaactgatacacaaagtccccaagaaatgaaaggtatagcaagatgaaaggatgctgagaatgcagtgagggagcaatagcaagagatgataccatcgaagtctggggtccaattgtgagtgcttctggggcgtgctcaagattttagatttatccggtagcaaatggaatactgtcagctggtttcgggtagacattagagatgatgatgtttttagaccaaggcaaaagtgattttttgaatgtgaaatgtgcttgggtttttctggttattgtttgaagggatgttgcgtgtcactttggaggtagcacccagatttagactggatttttcaaacctcaactgcagggggtttttttgttttcttttaaaaacaaggatagtgattatcccttcttccatgctagttggcatatggacttgattctaaacctgagtggtgttcagtgacaaccttcttccttctggagcactttctgatctcaagactggaatgaccattgcatccattctcagctgtgttacattcattttcactcgaaacacagaaaagctccatttccacggagcaaaaaagaagctagaagtaataaaggagtctggctttaagaactttggctttccttgctgactgt

SEQ ID NO: 135053 - DNA, 1398 bp, Homo sapiens
gttagaactatggagaaaaattcggtgggttaattcattcatttgtgtgtcagttcttaattgaattcctactattagctagtcactgtccttgagtagttcccagactagctggggagatggatgatcacaatacagtatgctgtatctaatacacagaatgatcccaaggcatagtgtcgtcttgctgttgcttttctagtgccagaggatagtgactgtggctaaaaataaaagagtcctagatgaattgtggaacatgaattttatgagtatttaatatgagggtagagaagctatcttttccagcttgtgtggaaataaagggcacacccactgacactttccctctgttgggtttgggaacattgctaggctgagactagcatgtaaatggaagggtttactgttaaagctggatgactggttgacggtgtatccactggggagtggagaggtctgccaagagaatgagagctcagtttgggtctaggttacattgttgtattgtcctcttctgctgctcagtctccttgcttcctttagatactttctctttagttaacctgtgccttgaggtccaatcacccttcacagtgtgcccagggctgtggctcaagtctgctcataaactacctctacttttgctttccatttcttctcaagggatgtagctctcagttatggcatctgtgcagacgtagcccctgtggttccaggatttagcttcacttcctccttgtctgacattccaaacttctatgctttctggtccatgtgaaccactcaacagtctctgctttcacatgtttacccatcctcccagactcagcctaggcacctctgcagagtagccttccccatgtagaggtaatcattccctctctggcacacccagcgtgctttgcattctttagttacacactcataaccttggtcctcctttgttttcctcctattggaaggtcaactcttcaggggtaaaggctggatcttaattaactatgcatgcatctccagcagttagtgtagtgcttatccaagatattgtgtgcattgggatcagagacagggaaatgcatcaagaatgggagggcagggcaccaaagactttgaatgagaggacaggtgtcatgggacgtaaattcagagaggaaataagaaatagttgttggaagaagtgtagttcacattaccaaactcatttcatgctagttgtaagagatgcaccttttaatctcacaatggaggttcaatattgagtgatagacattttgtccatgaagggttaagccatctgtattttaaaatttaaacttaatttcacaatgaaaggtttttagacaccctttgtgcaacataacctacttattaggttcctttttattttctgttcct

SEQ ID NO: 135054 - DNA, 1067 bp, Homo sapiens
aaatatctgatgcctttttgttgttgttagaaatatgtttttcttccagaatccttctctccaaattatgttcccctaatcatgttccttttttttttcttttttacaaaaggatttgaggacagaaatgtttctttttgaatatttcattccttaccatgtacaatagttctttcttacattgtattatattacataccctatgggtgttgataacttttattgataccaaaaaatcattttatgtggggactatatattttctttctgttcccccacctctaaccttggtatactttaatacagaagagataataataatgaataaagttcatttgtaagaaatataaaggtttcaatgtcttaatttttttattagtttgcagttagcactgtcaaatggatatccccagattctgaggcccataaagtcccctagatgggtttatgatattgtttgacttagaaaatatgccagcctgggagacaagtaatgccccaggtgattgcgttcaaaaaagaaagcttcctgatcttttcagtatctgtgcttttctaccccaaggaacagtcataaaactttctgacatttctagtctatatcaagaggtggattttcacagtcatcatcaaatcacccgttaacattgacatcttgctgtctcgtgtgttgttttaagatttttctttttcaaactaggacttaggaaaaataataaagccagtagcttttcaaaagaatgtgcttcctcatatattatctcattttatcctcctatcataagagataagagcaggtgccattatcttcatttgaacaaaattctaagctgcagagaaattgggacttgcccaaggttctctgagcacaacctagatttccatctcccagacaaatacgtttcagtagaccaccttgcagggaagaccagtcaccaaatatatagagaagaaggaaaggaaggaaacgaggtttgatttccttatcgattctagtcaaagtgctggatgctgccacatcactgtctcatttattcttcctagaagctctaggagatagatggtgg

SEQ ID NO: 135055 - DNA, 1027 bp, Homo sapiens
tcttcgagattttgcttccagataggattctataatggataatattatacatttaaaactttactgggttcttaggctcagtatcaacagaatgtaatctaatttctccagattggagtaaattcgggccttctgaccggatgagaattagaattggatgaagtgaatccaaagtagactgaaatgaatcttgagttcatttctgaatttcatttgcaagtgtatccagcgttaggtgtgttaatttcatattttggttcatactctgaggcttggtgtctcttgtgggcagagctttgtagatgttacttttctattacactatgcaatctgctgcttcatgtatgcataactgaaagatttgtgcaactgcctctctaacacacttcctccctgccccctctgctcttatttcttcctacatgaagtatcatatattttgttaggaagaaaaacccttttggaaattgcctatttcataaattgtctggtgacacaaaggggttgaatgctgtattcttgtctcatttattttgaaaactttgctactgaactcaccttaatcaatgagctcagtgttgtctccaataagttatgtgttggatatattgattgggagggattttagaaaacccgtctggggtttataatgtcagcagtgttttgattatgaaaagagttggaaccaggggacatggaaccaggtggcgaatgtcctaaagccagtggtgacatggtggactggtttcctcctgggatctagttcatgccctgcactttaactgtggtgactggctactatagattcacttttttgctcattaaaatgttaaaaaatcaaactgtacataaaaagatttgtgaaaatataaacttgggaattgatctggagagctggcacacagtcctccccaccccctgccttagcaatgaggtcatttacatttcatcagctgtgcagcatccccaagatccgatttatgtggcagtagttgaagttgcaccgaggctggttgtctaaaagagc

SEQ ID NO: 135056 - DNA, 1041 bp, Homo sapiens
tcatgaaggtgtataaagtggtttcagaggggtctctttcactgttgaaagccttcttcttctgcacttaatgtccttgataatttagatacacagtttatatgaaacatgtttatagagtatgatgaatttattatatttatctttgaattacaacattaatactgcatattaggtattacatataaaattgcataattataacatgtatatgactcaattaactgaagtttataaaaagtaaactaggggtaaatattgaaatgtaccaaagaaaggaagcagactctgtagcatttgagcagcatgttagaaatttgacccggcttttatgtttgggtgttgaaaggcctttctgtaaaaccccttattccaggcttctttttcccactgaaaaaaaataaaaatttggttgtaattatactatggatcttagatttaatttgacacttatagtgaaggagaaaaattttatttcctgtgttcacatttaggaaacttctgatcaacattcttgaacttggtgctaattaagcttccaggaacaactgctttacccttcttaatcataagcatttaaaacctttgtgagctttcactggaagcccctggttttaacttgaaatggcttaaggtagaaattttgttagcttttttgtatgtttggattttgtgtgtgttctgtttttaactttcaacttgagttttaagatcgtcaatcaggcttttctttcaagtcagtggcactgcttgcaattgcaggacttagagggtcagcatttcccttatggtattaaaaaaaattaaacatagggagtattttaggaatttgagctccactgatcttttcatcacacacctacattttgaaatgaacaaataaattagatataagaaacccaggaaatgttctcccatggtttcccttccccttcctctttcactgtcgtttttggacaaaggtaaattatcaactgctatatcggctttcagcaagccacaaagaggctaattgtggctttacatattttaaaatacatt

SEQ ID NO: 135057 - DNA, 1030 bp, Homo sapiens
tgtattggtttagaggtttaagttgtcattaaggcacaaactagagccacttctctgacacagtttttatcacatctgctaggcttgtgtcccaagaggagacgtggagagcagcgaattcagcatgggcccattatcgactgctttttcgtgtgttgtaaaaggagtgagacctcagggaggcttggagcctcctcccgtgtaatgtccaagtcagatttgaaggactggtggcaggaaagctttggccttggggtgtgaattctaagaaatagaggcacaattaagtttaaaaaattcaaggactttgagcttgataatgaaagatttttctctagactaatgtgagcagaaaagttgcccatctgtgcacatttttgtgtgcatttaaaatatttaaaagctgacagcttttaatatgcttacaaaatagtatttctatcagtgctcttttttttttccccttttcttttaaaatagtatcttcctaagggcaagttgcctcttcaatgaaatcatgtttgcagttttactgttgggacccctattcctttggtatgttctgacttgtgtcccctcctccccccttcctttcagaaatattgataacataaatgtgcagataacaggaatttaaatgcttaaggaaatgagcaagagaaactattttagagtaatcatattaagtccaaggaattaccactgaattctgattagccactgaatgctaattgtaagagatcataaccaaatcatttgttcatcttggaagtacagtatttgaagcatgtgtgaagaattttattggcatttcatgctgaccttataaatatagctctcattttcaaccactttgtgtaagatttaaaattaataaaaggaatcttggaatagaggatgttatataatatcatgattatggaacaactttgttttagctaagtttgagaaagaggaggatgcaaaaggataaagttaattttgttaaaaagttttaaaaataagatggagtatttttgcttcagacttc

SEQ ID NO: 135058 - DNA, 1048 bp, Homo sapiens
aggctgaggtgagaggactgcttgagcccaggaggcagagattgcagtgagccaagattgcaccacttccctccagcatgggcaacacagtgagaccctgttttgttttgtattttacaaaacagaacaaaaaagaataggaacccggagctggagaggtagttcagaagtgaacacttgaatttgagagtcatttaccttgtgctgttaattgaaactaaggtataggtaaactgctaatagaggaggacgcagagagagaaggagaaagataaagtcctggaaaggagttgagaaggggcccagaaatagagcagtgagagaggcaggaggaggcccttctgtagtcttcatctaatggaacgtcattggacaagcaatgtgttttgagtgagtggggagtagagcaccagaaaaggctttctgctctttcaatattgctttaaaaatattctaagccaaacaaaccccaaattgaagagctctccattatccatagagcatgaattcatttatctgtcaagaaaacccatggaccttacctatagaaatgaactatattgatctaagaattgtctctatgaagagtccatgccacaaaacagttgtgagttttggatggtggaaacatgttttatttttaattatttatactttaaacatttttttaaaaatagcatatttgtatgcggtaggcatttggtcatttggcaacaatcacatttgaatcgttgaattaccagagaaccaacatgactggcattggcattttaccttttaggatttctgaatttgggtttttgggtgttggtgagtttgtttgggttatgcggtgtggccaggctccttaacactctagatcgggtttggcagactatagcctgaagccagctggtcacatcctgcccggggctggattttgtatggcctatgaggtaagaaggttttttacccttgttaaggattgttaaaaaaacaaacaagaacatgtgacagagaccataagtggcccgcaaagcctaaaatatttacaatctggcccttttga

SEQ ID NO: 135059 - DNA, 1058 bp, Homo sapiens
ctcctgacctcaggtgatccacccaccttggcctcccaaagtgctgggattataggcatgagtcaccgtgctcggcctttttttaaataaaatgtttaactcaaagaaaagttaggaggcaaatatccccatgttatatgagatttgacttttgatatgacactttgggcaaagactacattttttggcttcatctttttcatctgtaaaatgaaaaagtattaataatactaactttgtagaattggcaggaaaagtagccataatgtttacataatacctgaattcatctagtttaataaatgttttctgatgtagtatgaggaagaagaagtttgatgcttctgtgtaattgatgatgtctgatattgtatctacatcccagaatgtagacaagtccttcctgtagataaagagcctgaagtccagtgataaaacctcactattttagcaccactctccagtttctcatcacaaggcagatgaaacaactgtttattattttattgccctccagacaagccatggtttcccctctaagattctggtggccatagcatccaatccaggatacttttgagactgaaagggagcactgtgactacacagaaatcgtgggcataactgggatgtcctgggcaaactggcaggtgaggttaccctaccctaaggcccttcaacagaacagcacaaacatttcactctattcctgcaagttggaagtgaggttggagaaaggctttatctgcattcaacatggagggctagtactgcacaaaatcttagctgtgtgaatgcctgtgaccctggagacagaatgctaatcaagattctcaatctccatcctttagtagagaggtaggcaagttacttcaccagtctacctgaaactaatttaacttagttttcaaggtgcattccatcgataggaggataatatctgcataaaattagtggtaggatcactgggtatgtaacacttctagcaagacctgacacatagtagttgctttatcagtccctttccacttgttacttaaccccctcacccacagccg

SEQ ID NO: 135060 - DNA, 2624 bp, Homo sapiens
ctgtcaattatttacagatcctgaggtgcagaggcaattcccggaggactacagtgaccaggttcggaatgcgtaattaattttttacatgacaaaatttatttcagagttgttcaacatattattactgttctttttactgaaagagataaatgaatttttagaagggaagaaaagcagtaattaggaaccaaagacaaaaagtaaaacgtattgaagtaggactgaaaatattggtgctagatttggggtgtttccttcagggagaaaatgaacacaaaataaggaagaaaacctatcacaaattttactcttcactttgaggtttgctacagtctacacttcattaggaaatcctttttgcattgcctgtgaactttttaaaaaaatgctatttcaggagtcaagaagcagtgtaacaaaaaagagggaagagggaagtttataacatttcctggaatttgaaatagatgatgaaattatgtgttatggtagtattggaaggagaagatgcacgtgcagaaatggacttaagggtgagggtggtgctgatgaggatagtgagttaaggttggccagttggctctaccatcttgaattgacagcattctgcaagcatagaatggggtagaaggaacgattttactcacaagatagtgctgaagttctgatgttgctgtattttttataattagttctaggttatacattcaggattctagtttctatcttgagagatattgaagatgttttgtagcttttttggggcaccttacatttttagttcaaatatgcaatttggtatactttttaaagcagctttgaaataaaagcattcttgattacactgaataagacaactttataaaacctttcacatgtgaaataccatatacagtaaaagcatcttccttaagcacatctatttaatttttttattaaaagtctttgaatgaggataagtacaatagaatagaaatacccagtacagtgatagtaacacctttgcagtgtgtcttgttgtatagagagcaaggtatctgatacatctttatgaataaaggggacataatgtgaccaggaatagaactggataatcagtataatgagatgctttgtaatgagatcttatagtacaagaacccaagagaactggtatggtttgctttgtgtttgatctcaagacttttaaataagattttaaaaaatattaaaatcttctgactctgtctcttgcttcatcttctactaggagagttaaatttttattttatcttaaatttctatgagattgggctctttagattcaaactacgcaatccaaggattataggaccttttcattaatgaatttcctttctttagacaatatataaaggctggaaaatcttaacgtattatttagaatacacttgagtccacagattttaacaaaattattgttctaaagtcttgtgtctaggtaaataacctttgtagttccatgatctgaattctcagtgagagggaattttataggagaaacttaaaatagcatagttaccatctgggtctattccgttcaacatagtttcttactatatctgaaagtttttgaacaacatgatttcttttttagtataactttaaaaaactgcatgggtaatatgttcatgacaaaacatgtagaaactatagataaagcaaaaataaatttacaaaagaatgaaaagaaagaaaatacaaatcatcagttattatactgcacagagataaccactgtaacaatttggtgtttagctttccatgtttatttccctgagtacacatagaagtttgtgcgtttaaggagagtgtatgtgtacgtatatgcatacacatgtactattcttgcatatgtgtgtactgagagaaatataggctattatcaattccatcattgtatacagagctcagttgactgattagatattatcttatgaacgtaattctctttgctttagttaatggatggtcttacaagtatttcatatattgaagttggaattattagaattatagtaggaacctaaataataatgatagctttagttattttaaaggtgcgcatagtatagtagtatttgttttctttgttgaaatcattgacatcgttttgaaatttggagaatggtcctcatggaccagaggtagacttataagagtgcacacaactcagcctcacttagcagagatttatttatctcttccaacttgacacatacgatttccttttttttttcgcctcctataacccaagaaatgattaatgaaggatctactttgttttgtagacattatcttcaaattcccagaaatatgtttgagagttgtatctactgggaaagaaagtgagaactgtgtgttttttaatttatctttttatcatttaggttgtaatcttagttttttctccttcacatttgttaaattatcttttcctacagtaaaactattataaaggaattcttagaaatatttctattacatacaaaccttaaatgctgaatatgcacttaatctcgacaacatttctagtattaaaacatttatgatgtaatccttaaggaatatttgagataattcaccacaaagtatagcactta

SEQ ID NO: 135061 - DNA, 1030 bp, Homo sapiens
gttaaagtcctgcttcttaaagggcagaatttgtaattgtaagctttaaatatgttcaatattttgtctcttattgattgaaatatcctagagataatgattgggtaaattcagcgggcattaaatgtaatgttttctgccttgaatacctaacatgttaaaagtgaaagcagtgtagattcccgtgttaactgctacatttgcagtttctcttaaatttcctaaaagaggtcctattataggagatgatggcgtttggttagtatgcagttgttaacgtgttttgtacaaagtgaagtcggtgtattttttaatcagtttaaaaatatgtcatgccttgactctttaaatgaagtcattggtatgacagagggaaacaggaaaataatttggtaagatgtgtgtgtgtgtgtgtgtgtgtgtgtgtgtgtgtatgtacacataggagttaccaatgtacaaatgagccctcatacgtaaccacagcacttttatgaattattttgcatttctgttgtaaaagatctgtctaccacgttttctaggaactttaagcctaaggcagaactcagggtttttggagcctgtgtaaaataatttatagcacctttccagtaagtcttgcacacactcttattctattaattaaacattctgtagcaatctggtatatcttaaagatttaaaagtatgtatagtagaagactggaaaacatagactgttgagatggaagaagattagcctttcttaaaagaaaaaatgttagacatgtttgtttaggagatcagttttttcctgctgtgaagacatagctttttaagcatggtcatgttctgtgcctgagtgagattgtgcttttgggagtcctatactgtgaaatgtgtgtgttcaaatatggaaatgcttcttgtggccttcagtgaaagtgatacacacttttctgtggggacagcctctttgatggccatggtgctgtgacatcacaatgacatgatacgaaaccttgtctgagagctacctgcctctttg

SEQ ID NO: 135062 - DNA, 1091 bp, Homo sapiens
gccaggaggcgaataaactgtagcttaaagattttggaactactgacaatgtagagaaaatcagtttctgataaagttatagtgtttctaagtaagcagtagaaggcaatgggaaaattttaattgggtttataaaagtttatttcaggaacacatgtatttccaatttgaggcacacctatacatctgtagtcattgaatttatagtgcttgcttatttctccattggggttaataatataacaacaactaatatttattgtgtgcttacgacatgtcagtgtgatctttaggaagtctgtagcattcaaaggcttgttttcatttggatatttggaaattggccttttatccacttggagacacagggtgtttaatgagttcattttgttctattaattctattacactccaaatatttgttcggtatttataacagttaagacattttgtaggagacaaagttaagtaagacatggaacttggcctcataacagacctattcactatattgtatatgcttcagaagtgggcgtgccgtgttatgggatgagccctgatctagtcctggactctacccctggctctactacttcttcgtggaacctttttctgcccccttaggacaaggccagatgcccctgtgctgattaactcctagtatcacacttaccaagccccatggtacctgcttgtttaattctgtgtgttctccattagggctagactgtaaactcctggagggtgaggactgtgtcttatttatcaacagggccagccacagcagagcatttgttccacgagtgactactaattttctaactttggacaagtgataacctattgctttaactatgataaaattgatttgatagtctctatagcatagctttgtcaggaaggtaaaatcagaaaatttctctaaaatgcctgtcacagtgcctggcaaatagtgggtgttccatcaaatagtttttttatatttgaataaataagttatctcttttcaccaaatttgacacatatgatacatctatttatgaagaccatatggagtgatgtcatatttgtaatacataaagggcacagct

SEQ ID NO: 135063 - DNA, 1010 bp, Homo sapiens
caataaaggagaatacggtcagtttggaaaattacatagatcataatgtgtatcttcgggaattttcttagaaaacgtgattttaatacgctaaaactatttagttttaagtaataaagtaaatattaaattaatatttttaccccttcctttctcagctattagaacttaacttattgagaatatcattttaaacagtatttctttgcaaatgttatactgcaagtgctatataattatctttcaggctgcaaattttttgaagggggcttattagaagttatttctggtctgtagcacagtggctgtttgcagtgactgaccttctgatcatttttgagtagaatttgtttagtgtgttaaagttgtttctagtcatgtgaatttactgagacagttatatggtcagatgtgtattttgcagggggatgtcagactttacacatttgctgattagttaggaatatttcgtctgctggtcagtggttcctgctgatttaaaaacaaaaggtgcatctgtagacagtgcttagattgtataaattcagttgcattagcatctgacactgcaggagagcaaattatatcttgagcaaataactgtaaagaatacagctgtttgtgatatctttattatgaaggtactgttttatttccacccacagtttgagtaagatttaatttcccgcctaaccacatcgctttcttttctagtgagattttgtctttgtaggctgaattgtttttagttttatattttaatgaagaagattgtcagcattaggaattcctttaatttcatttgctttcagcaaacattggaattattgttaaactctcaaaactatcattcaatgaataatatctaattatcagttgtaaaaacattttattaatattgatgctattccaatgattgcatctttagctttccttgtttaagtattttttaggtagcgtcacttggacacaggaaactagagtgcatttttccattaataaagaagtgg

SEQ ID NO: 135064 - DNA, 1056 bp, Homo sapiens
actctgttggtcaggctggagtgcagtggtgtgatgtcggctcaccgcaacttccgcctcccaggtttaagcgattctcctgcctcagcctcccaagtagctgggattacaggcgcctgccaccaagcctggctaatttttgtatttttagtatagaggaggtttcaccttgttggccaggctggtctcgaattcctgacctcaggtgatccacccacctcggcctcccaaagtactgggattacaggcatgagccaccacgcccagccagcattttctatagtatatttctaaaagttgagttacctggtcaaagggttagtacacatttttaagatgtttataatgtaatacctaatcatattccagagagctgtatcctttatattccaactaggaaaacatgagaaatttaagttaacgttctgaggtctctgagggaagttttcaaaaggggactcccaaaataatttaacatgtgcattggctcattaaggttattatcttgtgagggcaatactcatttgcatgtaaaaattctaatatattaaaatgttggttgccttatcttacagttataccttgcacgtggatgattaacatttttaagtgttcagataaaagtgtctattgtttccttaaaccccccggcgtgtggaccaacacatttatcttttttaacctcctacagtgaaatcccactgaaattttacattgcctattgtaatttggtataaagatgagtcatctttcatagggctcaaagcagttctagggaaggtaataatctctgatcttgagggacaaagactgggtacaaatctttgtcccttttcacttatattttgaccatggagatcatctaggctttaaacctcaatgttaccattgggtaacattaccatcggggttaccattgaggttattatagagaggttgggtattactggaacagagtgttatttcctttttggagcccatggaattctgccaggaagtaacctgcttcctctggccttgaggagggactgcagataagagactagttagctgtct

SEQ ID NO: 135065 - DNA, 1028 bp, Homo sapiens
taataaaaccagtttaatgggtcttgaagtgaatttttaaaaatgaaatggaataaaatagcaattatcagagaaaataacatatagtaaggacaggtatagttttctgaaactttctgtgtgtgaatgtgtttatgtagtaggtgtcatatgtatcttaatgtgggcaatggttaaaaattttgaaagccaccattgtaacaaatagctcagtgtcatgtagcctttaggcaatcctgtgtttgagttagtgcagctaaatgaggatatatcccatttttaaagaaatgtaattctgcctttgctgacttagtacaaggttcagggtcctagaatcctccttagtcgtaaatgcatctacaaaagctcctgtgattactaatttccccccttctatagaggctgtatccatttctaacctgtgtattttcaaagtaatttttacttctatatgttgtataccatggccttttccactatgttgaaaagatatcttcaatattgttaatatttagtgttgggacacctgtctcatataaagtttatagtgatggtagtaacattatattgtgtttatcataaagaaattctctgatagctcaaattattgctcttattaaattttattgctttagtgactttataggctttagtattatcagtttgatagaaagccagtgctatacagatatataaaaactcagattatatatggggacatagaaagccagacccagacaaaaggaagccaaagcgtctaaggattaagacaataatagttatgattgtggtagcttggtaagtgatttcatttttcagttaattctttacatcaggttggtaaacatttgtgttactgaactatgattttcttctttaaggccagtggtcagttgaaaacctttgatgctgttgattttctcagcattaatcattgttttatactccagtctccaaggatgcataaattataatagcaacaaggggagggctggagccgggtggttgctgctgcattattgtgtcca

SEQ ID NO: 135066 - DNA, 1063 bp, Homo sapiens
aaattatttataaaaatgtatacctgtatacatttttctgtatagaaatttgttatatgcagtaacattttagtatttcctcaaatttgaaatgaatatcatgtgatattaagtcacttaaaaattctctaatatgagatatgaaaaacttagactcaaactataatatattttacttaaccacctttttggctacctttcttttggtattttattatatatcctttttatttttgtaaaaaagtatattagcttttttcttcttaaccgtatttttcccctctataatttgactgaagaaatgaacttgtgttactttttctctcatattaagccaagtctggtgaataaaatacccatagtcaagaaatttgtgtgagcttggctgcactgtgaactccctgatttccttcagtcttgttaattcatatgtgagcccaggggtattattgcccattagcctttcctcatagttattttatgaaagtgcacaattaatgtgagagtgtcgtgaaacctttggagacagtgccctggacatactgaggtaaattttgttcaaaatcaacagatagcaccctactgtaatctgctaacagcttgtttatctaattgtcaataaaatttctggttcaggaaagaatttatgttatcctgaaacttaacataccatgtccccggaaccaaggagaaataataatagtaactgccaaacacctactgtgtgtcagacaccctgctggatactttacacacagatctctcattctcaaattctgagatagcccttcttcctcattttattgagggaggttgagaaaacaacccctaaccatctcacttttgccaggcttcatagctgaagctctccccacttttatatagcatatataccatataccactttttaccatatcctcaggaagcccaaaggacctaacagaagtcagaatgtattttgatggaaagttagtgattcttttctactaatttttttctatcggagtgaacgaagtgtgtggtggaggagtgtgttttgagagtttttgcagtagaaaggtac

SEQ ID NO: 135067 - DNA, 1701 bp, Homo sapiens
agactgtttactccatgctggttatttggataacgccccacctgcctagtaacaggcggtgctgagtcttgcataaatcttggaaagaaggttagggttaatatagtgagttcttcagtaggaaaaaaaatacagcatatgtgataataataatggcgactctttgattactatttttgtaccggcactgtgctaggcccttggggacagagtgtgacaaagagggagataatataagtgagtacctttcatgtgtcagctattctgctatacattttacttacaatatttgtaaaacttataataactctgccaggtaggtggtgttatctccatgtatatatgactgattcttgtttatctcataaaaaattctaacgacctcattggagttctgttataattatcatgtttaaactttggtgcttttttttaagtttaaatagtcttttttttttgagacaaaaaaaattaatgagaagagacaaagaaacatcaaagagctttttcctctgattgctgtgttagaacttttgcctgaaaataggttacattccttctgttttcagctgaatcctcattaactttacattttaatgatgtccagggcaaattacaccatttatggtcagtaccttaaagggatgcttaaaggggacttaaaaaaattttttttgagtggtggatgtatttactccaggaatataaattgatccagaattcttgaaaaaaaaaaaaaatagacaaaaacacttgaaacatggggtcgatgttccatttctaactattataacaatttaattcaaaagaaattattttcaccttaaagtaaattaatcattaaagaacatttataatatttgggagtatgcaactggaaccagtgtcctacatttatttttgaaaatagtttcggtttctcatttacttggatttaaattcaattctactgcttagcttcagaaataattcataggtggtagatgctcaataggaataaatgaagacagcttctcccagttatgaaaaaaacaagggtgattgaaatgctaatatgttgatagacagattgtatttgcacaagaatgagggaatctgctgtaaggtggaactcttcacaggattccaaattattcaatttaaaagaacaatatgaactgtggagctgtgctttcattgtaagctttgaatgcttaattattattagatgataaattggaataaagtgtcgtgttgtgtcaaatactgtttatttccttaacaattattggataagtggattaagggaaattggcctgtctgtcgcggaaactgtaattatgagaatgccccatctaacatcatgtattttataaggtttgtactcctgttttttaaatgtgtttaattgaatcccttctgtgtgccaggcagtgggctaatgtccttgttaaggcgtttttgaatacaaggggtggaatttcactaaaactagctcaggaagggcagggatagaggtggagaggtctgttgtacagtgaaggacaggaagcaaaaccagctgggcttcatgaggaccaattggaaccggaaagtcatgcaccagggtggcttcatctctttcatcatggctttgcctctgctggcttccttcgttcaccacttatcttggtaatggttcaaagtggtctatatgatctttcaagcttggcttcccaccgt

SEQ ID NO: 135068 - DNA, 1043 bp, Homo sapiens
acctcatccaccttggtctttgacaagccctgccaggctggtccttctgtgtgggtgctctcttcactttgaattttgacaccccgtgcatggctgccatgtccttccatgttgttccctgcataatcctcctcaggatctgacaccctatcaggtggcccctgcatggaaagttccttaccctgctcaggtgctctgacacctcacaccagatcatcttttaacatggacacgcttctcaaactgcgttgacactgacaccccctgccatgcagctgttccctgtggatgactgtgtatccctgcttgggctttttctccccacactagttcactctcctctgtgggcacccttgtcacaattgggttctgacaccctatgttagattactctagacagtgtgggcgctcttctcgcactggttgcactttgagtccccatattgtgcaagccctcctatgtggatgccatccttacctactctggactactgtggctacttctcaccaagtatggacgtgtacctcgacttaaggattaaattgtcaattaggaagagaaagtaaagtctaatttcttgatcttttcctatgtttttttctcccttgttatccaattcattgccattgacttagttctggccttccttattctttcttggattactgccacttaattggttttctttatttttgagacggagttttgctcttgttgcccaggctggagtgcaatggcgcgatctcggctcaatgcaacctccgcctcccgggttcaagcgattttcctgcctcagcctcccgagtagctgggattacaggcatgtgccaccatgcctgactaattttctatttttagcagaggtggggtttctccatgttggtcaggctggtcttgaactcccgacctcaggtgatccgcctgcctcagcctcacaaagtgctgggattacaggtgtgagccgccgcacctggacacttaattggtttccttagctggagtcttatcccttccaaccccttttcttctgtcctgctgtcat

SEQ ID NO: 135069 - DNA, 1015 bp, Homo sapiens
ttccttttataaagaaaatgtcaggtttatactgttagtaagtgctaacaaaggtgcacatactgtatggtaggtggatgttcagatacagtatctagaggttcctttttgctatgcattcttcctggattggttctcaagaaccttagggctatgtttgccttctagctctgtgaactacacatgactattttagtatgttattatttttgtatggatttttttggtatgcatttttgtatgctattataatccctggcataatctttcctccttttattttccctttgtccttacaccctcggtttacatgtgtatttttaatcttttaactataagtatttttgtaagtcatttcaaattgtttatggaatgtggtggatgataaattctccaagtaagatctcagtcacacttggtttctcctattgcctacagactgatcatttctcagcttgtgtctttggccctgacttccgagtgccagacctgggtcctcagctctctgtccgtagctgtttctccatcctacatgggcatctcaaattgaatttaacctcctcccctcgaccaaccttttacccccactgccagtcacctagcaaaacaaaatggaaacgccgatcctaatcctaaactgttccttctatccacggtcttgttgaagggcatttgtacccactcacttactaatgctagaagcctgaaagtcaccctagactctcaccctacatccaattaaatctgagtattttttaaagatttaaaaaaagctttagaaagattttaaacaatatcaaagttacagaaaagttgtaattgcactgcaaataattttttcttctgcacaatttgggaataagttactgatctcaacctcgactacgtcagtcgactatgtcgactactgcaaacaaggtgattctcctgcacaaccacaatgtggtatcaaagtgaggaaattaacattgataccgtactaccatctaattctcagttttggcacttgtcccag

SEQ ID NO: 135070 - DNA, 1063 bp, Homo sapiens
taattcaacctatatatttttttcttccacttatgtgtcacagtttaacaagaacccagtgatcaatcctcagctaccagagtttttatttaaactgtctacttgtgagaaagagccagatgctgagaaaataagctaggattagaaatgtattaaaacaacccatttctggaatatggtctaaagtttgtgtgtatttagcccagttttctgtcctcgcagtaatgatcctgatactcagaatgatagaattgacttcttgaacataaagcacattttccattggtttgttaggttgtgcttaccatgaaaggaaaagtgacaaaagtatttgggaaagattttatacacagaccaaaatgaaaaatattttcatcatggccgtccaggaagtagaaaatcagctaagtgctaagtggaacattcatttcctctttctagtattttggttaacggaaatacatccccccaaaatgcccccaaaatatagttagagaaatttggtttagaggatggtttctagagtcaggtcatgtgggtcaaaattctggctcccctacttaggacatatccctgtgtaattttgggcaaattacttaatttccttccttgttttagttccctatgctgtaaaatggggataaatggggatgatgataatatctcatattatcatcacatttgaggattcagaaacacagtatttaaagaattaagcacagggcatggcacagagtttctctcagtttgaactatcatgaagaaaaacatgaaatttgttttgatccttcaaactggaaattgaggatcatcaggagtctgccctggggggacatcccctgatcctgtcctcctcattctgagccttctcattctgcacacatggtggaggggccctgggaccagtcctaaggcagttccaggcccagggccttgggaatgctgctttaggtttctttcttacctctaacagccccagcaagtccagtttaggctttaaaaaagttcttaatccctggggtggaccctggaacaagctgacctaatttctcttgtttttgct

SEQ ID NO: 135071 - DNA, 1101 bp, Homo sapiens
gagtgtgttgggggagcagggggagaactgggggagctgttcaggaccacctggatcctatagcctgagaatggggcagggtggttcctcagaggaaaatctggtgctattactggaggaagggagaacggatgctgggccgccaaaacagatgtctactgcagccatcaagaaaatgtttgattcaaaatattctttccaaaaaagcagtgagataataatgaagcttggaaacatttataactaaaatgatttaaatcaagttttaatgcttaaaaataccgatcttcaggtttcttgaaaactgccatgtaagactgatttccccaggagtctacatgcccgaggtcttattatcacacttctaaatcattaatcacctattctttgagtgttcactttagactgtgctagactctgtagagagtggaacgttcaccctataaaacaggaactagacctcatgttttaaatgcttagaagactttttttaaaaaaacctttaggaagttacattctagcttttgaacttctgttggtattatttcacaacacattttgcatttccttctttatgttacattgaaaacatgcagtccgctcaaaggctttctttagaaaaagaaagctttactgaagatatcactgtgagcttgctttgcccagcagaagactttaataagttgctcaatttaaagacagttttcttacctttaatatgttcttagacattagaattttctgctatcacgaagccttatttgaggagaagatagatgcagataaattgctgtctagattataacaatgtccttaattatctttgaataatttgtaataaaaacagtataatggccagtctgtagactttgaaatcaaacagacttaggttcagatttcttttgccactcattaattgtttgactttgggaaagctatttaaactaaattctggtttgcccattgtttaagtgggacttctatctacttggcaggttgttttgtaaattagagataatatgtactaaaatgctcagcacaggaagtggtacaaaccagcattcttgtggtgatgtaatttaacgtcacccttaaattaaa

SEQ ID NO: 135072 - DNA, 1047 bp, Homo sapiens
gtaataatgattatttctttaaactggaggtgagcctaatgagagctcattataataaaattcttgcccaccacctaatgaagtaagaaatattattctaattatataggtaagaaaaagagggctccatgagcgcagagattatgtcttgcttgcacttgtatgctttggtagctagaagagtgcctggcatacattaggccctcaagtatttaatgattaaatcttagagctaggaagcaacttgtccaaagaacagagtgacagagttgggatttgaattctagtgtgactgtattctttaaagaaatttatgaaagctatcacacaaattatataatgcatatgtatgtatacagtttaaagaataaatgaaaatgcacatatccaccactcaacttagaaaacagaacattttgtatctttgagtactccatttatgcctctctcaatttgcctttctctactgagatcacattttgaattttacgttaattgtatatccctgcttgaagcttgtgctttttatatactatggtgatgctctaaattggttatatagaatgagtttgaattgctgttcttaggaagtaacaaagtgagccatatattttcttttcttaatgcttagttatttgaagcagatcccagatttcttctttttcctaaagtgcgcaatttaggggccatctgggtataaattatgatataggggagccttagaatttttgctttattcatgacactgtggttcttcttgctgtgttagtggttcacagtattaggcctcaggccttctatggtggaccgggaattcattgatttactaaactttgaaatccttttgagcagtgagtttgttgaatttttaaaattccctccacatgccaatctcagagcctcattttctcaactctaaaatggggcactaatagtacctgttttagttgaaagattaaatgggagtgcaccatgcatgggacatggaaagttctttataaatgggagctgttattttaacttacttttgtttaaagcaagagttta

SEQ ID NO: 135073 - DNA, 2514 bp, Homo sapiens
tattggatgattaatattcagaaaagttaacctctaaatttgattcctcatcggtgatttttaaaaattgggaaactaaataaaacttatttactacaatatgctatgtctgtacttaaaacattttataaagtgatcaggtacttcaaaccatacctaaaacattacctaatgataaaaagatgtgaggtgataaagggtaaactttgaggacagttcttttttccattgattgcttttaatgtctacactagtgaagtcatgtattgtaaactgtccctcatgtgttctgtgctctgaagagcatctcatgacatctgtggaagggcatgtgatctgtcagttctacttagaaattgcattaagacccctaacactgaattggaacactttccaaagattgtacaaataaaatttgagtacacaagctgaactccatattttaggaattcataagattttctagttactagttaccagtgaataaactgtcacttaatatttgatttcaggtacctttgtcggtttctacagctttatttgtttttaatacaacttatgtttgcctttttctaatatttaatgcattatttttgccattttagatgattacaaagaatctgctttaagattagtctttgttcctaggatctgcatctctgatctgtgccaaagtatctgaaaaacttagatataaaccttacgctgtacagtactagtgtctgggcataatcttccctttgaagtttgtttgcatccccctagagggattaattccctgctgtgagaaggtgggttagaaagcactgaaactactttatgggtctttaattggaggatttagtatacattttgttctataaacttctgtgggagtttcattcttacaatttttcttatactgtggtatgttatattttcattgtaaattaaagtacatatactcaaatttttcttgttatttagtgcatactgacagattatcctggtgtgtgtgtttttttccatttgtctttaaatttttaatagcttgttttctgattagttcttgagtatgtaaaattttaaacttcttggaaaatgatgaacaagagaaaaattatcactcaataactactgttaatgtttcagtatatttacttccttattgtcttcttttgtgtgtgtgaatgtgtgtgtaaataaaatataaaaactttttttctgaactctcagctatatgtgttttcctcactctctccaattattcattaagctttccctaaaattattaatgttgatttgcagaaatcattttagttgctatgaattattacatcatgtttatgttctacatttacttataacggaatcttcaggttgtttccaaagttctcttgttataaatgatgtagtgaacatctttgtgtataatgcttgtcagtttatgtatgtaatttaaatgcttaaaaaaagtcatatcattttgaggagatctttgatctactttgttcttaatttttgtatgcttatttttttttgccacacttcattttgtgactccaattggtgtattggtttaagaacctacctttacatagggatcccagaaaatcaagacagttagctcaaattgcaaaaactctgaagtctgaattcagtctgtgcgaccaaaggtctcggaagagggtgctcttgtaagagagatcagcctgcaaggtcccatgatcagatgacactggccacacaaaaactctggaatgcatttcaaacacaagtgtctcattacagctggcatcttagcctgcagcgggcactcttcttgggcagatgcttagcactgggagactggcagcatcaggttcttcagaaatgcttggcagaccagcttcctcctgtgtctaccccacatccccctaccccaacccccagcattttcagtgcattagcccaatggccactttttaaaaagaatggggtggttaggttgagaaactgtcggggaactctgaaaggcatgcctaagacatggtgctttggttgctgagtttctcagatacgtgggtgttaagcagcaacataaaaaaaaatctttgcttagaatctcttaactaactatacacatttctatattagcagtatcatgaagaaaactgagtttttgctgacttaaaatattgagagccagatttgttattctgaagtttaactttcattttacaggactgtaaattgtggtctaggagcttcacctgaatatctgtgatcacaatggatactcaaaattattagacatttttaaaaagctgatttaaaaaacatgatgctggctgggtgtagtgtctcacgcctgtaatcctagcactttgggaggctgaggcaggtggattgctggagctcaggagtttaagaccagcctgggcaacatgatgaaaccctgtctttactaaacatacaaaaacatagctgggtatggtggtgcatgcctgtggtcctagctactcagaaggctgaggtgtgagatcacttgagtcc

SEQ ID NO: 135074 - DNA, 1034 bp, Homo sapiens
tcacttggagactaaacccttccatcctagaccatgctttgagcacccagcatctcagaacttcttgcccaaatggccttgagcttgtttctggagcctgtgtgagtctctcccctggggtctgtcctcctgggagtggactatgctactggtgtatacatccctaggtctaagggtggcctaaggatagctgtcagtggggaatagggtatgggatagagcttgcagtacaggatggagagggggctgtgggcagtgagccaatggccaatttgccctgcaccactgcttttctccatggaatgcaaaatacaaaaacacaatatgaacctggccttctagtcagttgtaaaggtatatttattatggcaggaggatagaaaatatttaatagtttgtatgcttgttttaaaacttttaaatatttaaatattcagatgtatggtctgtaggtctctatttgaacccttgcctaagccctgtaaatgttacaggtgggtttgcccagcaccccagaggcccctccctccctgccttcagaggtaactactatcctgacttttatgataatcatctctttgtttttcttcatagttttgctacataagtatacctcattgaaaaaatataattgaattgtgccgccttctgaattttatagaaatggaattattctgtatgtagctctgctgcttttttgctcaattatgtttgaaagggtcttccgtgttgtgtgtaactgcagtcatagattttcattgctgtgtagtgtactatagaattatttcagaatttagttatccattctactgttgacctttgaagttgttcgcagtttttggctactataagccatgctactgtgacctttcctacgtatgaatcctggcacatgtaaacatacatttccatatagaacatacttgattactgaatcatgccatacttttacaaaatggattgtgccagtctgtactcccacctgcagtgtttggtagtctacacttactgctctacaacttcatcagcccttg

SEQ ID NO: 135075 - DNA, 1005 bp, Homo sapiens
tacccattaagtaatttcttatccctcagcccctcccacccttctgagtctccagtgcctattattccacactctatgaccacgtgtacacatcatttagttcccacttataggtgagaacatgctgtatttgactttctatttcacttaaaagaatggcctccagttccatccatggaactgcaaaagacattatttcattcttttttatggctgagtagtattccacattttctttatccaattgcccattggtggacacttatattgattctgtatctttgctattgtaaatagtgcttctataaaaatatgaatgcagttatctttttaatatgatttattttcctttgggtatatactcggtaatgggattgctggatcgaatgaattgttttgagactattttaagagttacaaggacagtccagtgcgtatgctctttccttagatttgtcaattgttattattttgctgcatttgctttatcacccccccaatacatacacagcacatatgtgtgcatgtgagtatacacacacagaattattgctggatcatttaagagtgagttgcagacattatgacccttcacccctgcatatccaggagatattctggatatatctcctaagaataaagacatattcttatatacccctagtataatggttgaaatcagaaaatttaatattgatataatgtcagttgtccatatttaaatttaatcaattgttatatcatgtcctttacagcattttccctatgacccagaatccaatccggaatcatgcagtccatttagttttcatgtcagtttacttcctttcagcctagaataatttttacagcctttctttgtcttttttgacatgtttttgaagaatttgggtctgttgttttgtagaaagttcctggatttgtatctgtctgattggatcttcatgattagatgcaggttattggtttttggtaaaagtatctcaaaagtgttatgtatttttc

SEQ ID NO: 135076 - DNA, 1533 bp, Homo sapiens
aatgtggagaattacagttaggtgatagagtgtgtgttggggaaggtctttctgaggaggccaaatataagctgagttttcaatgccaagaaggaccacctgtgtgaagatcaatataaaggactgtaagatgggacttctctttggtgtgtttgaggagcagaaagaaggtcattgtggctggagttcagtgggcaaggggagagaggtataaaatgaagttggacaggtaggcagaggccagatcatgtaggactttgtaggcattgctaaggactgccaccttctttttctgttttgtttgtttaaattgtggtaaatttcacataagacttcccatcttaaccacgttcaagtgtacagttcaaaggtattatgtgtattcatattgtggggcaacaattgtcaatgtgcagctccaggactacaactttgacttgactttgagtggtgtggggagcttttaggagatttgagcaaagaagtgacataacctgaacttcagaataaaaggattactgtctgttaatgttgtgatctgactctatagaggggcaaggaagaaagcagggagacccatcaggagggtgctgcagtaatcgaggtgatatgatagtgatctatcaaggatggttgtatttgggggtgctgagaaacgttgagattctggatgtattttgatggtagaatcagtagaattttctgattggttgactgtggcatatgaaacgggagtcgaggatgacattaagttttgttagtctcagcaactagtagagttcaggagatgcaggtttgagggagaaaaatatgatatgttaaattagaaatgcttcttagatgcccaaatgggattttttttttttttttttgaaacaaggttttgctatgttgctcaggctggtctcaaactcctggcctcaaacaatcctcctgcgttggcctctccagtagctgggcatcccccaccatgcctggcccagtggggatgttgagtaggcagctgggtaagggagtctggagtcagggaagaagtagtcaggttggagatgtgactggggcttgtatgcatggtaatgaaagcccagagactgaatgagatcatctaagcaatgagtggagacagggacagtaggagagctaacctgagaaggaattcgcaaaggagtagccagtgaggtaggaagaggatcaacagagagcaacgtcctggaagccaagaaaagaaagacattcaaggaggagggcagatggatgaactatcaaatgctattgacaggccgagtaagatgagcactgagaattgagcatttaaatacattttagcaatgcagaggtctgtggttaccttgaccaagttgtttcagtggtgtcgtgggttcagaagcctggttggagtatgttagagaaaggaagaagcagcagaaacaatgagtatatacattaggccatttttcacttagatagcagggctgtacaaaacaccctgtggtacaggataatgtgttggtgtccccgtgttttaaagtttgg

SEQ ID NO: 135077 - DNA, 1049 bp, Homo sapiens
tacaggtatgagccaccacgcccggcctcttttgatttttatacattgcatttattcagtattttttttcctctgtagaggagagactttttcttcagttttggtaaaatgagaatttctttctgactgcacaatccatcccttgttcttaaaatccctttatttattgcctagactaatgtttctattcggatagttccctattttctggattgcttttagtgacggtatttgaaagcctaatggttttgagtctttgaaatacacagtaatatgtggattacttataaagcctattattggtaaggtgaagccattttatttttatatgatacgtgataataccctttacattagtttaacatcttttagtttacaaagcactttctcatttttctctcatttgatccctgaaacaacttttgagatgagcagggcaggtatatatcttgacagaggaggaagccgaaaggttaaatggcttgtcctaatcccataacaagtaagggatctacctgggatttgaacccaagcctcctgatgtttagtttggggttctttccatagaaccacatgtcattcctgtgagaaagtcttggtaaaaggaaggtcagagaaattggtatttaatgaatgattttaaaaaaatatttttccaggaactagaatcttatagaaaagttggcagtacagtgtaaagaacttaaaatacacacacacacacacacacacacacacacacacacacacacacacacacagtttaaagcacggtattgacctgatgcatcatcacccttgaatgtttcagtgtgcttctcctacaaacaaggttattctcccctctaacgcaatgcaaacatcaaaatcagcaagttaatggcaatttgttactacgtctaatcctaagactgcattcaggtttcactagtggtcccaataacatcctttacagcaaaagaatcacacattgcatttagttgtcatttctctttagtttcctttagtctggaagagattttcagcctttccttgattttcatgacgtt

SEQ ID NO: 135078 - DNA, 1059 bp, Homo sapiens
ttattataatttatggatatttatcagatgtatgctcacttttttactgataggaagaatgcatggaaaaaaatgggaggccactggattgtggaactgtgtaaatagtttttactgctgaagatcaaggtccagagcaaggttttggcagtgtaaagaaaaggaatgacaggccgggcgtggtggctcatgcctgtaatgccagcactttgggaggccaaggagggtggatggcttgagtccaggaagttgagaccagcatgggcaacatgatgaaactctgtctttacaaaaaaatacaacaattagccaggtgtggtggcatgtatctgtggtcccagctacttgggaggctgaggtgggaggatcacttgagctcccacagagctcaggagacggaggttgcagtgagtcaagatcacgccactgcattccagcctgggtgacagagtgagaccctgtctcaaaaagaaaaaagaaaaaaaaaaaaaaggatggctttgagagattttaagtagaaatgacaagacttggtgacaaattacacgtaagaggcaaaagaagaatcaaagatgacttgccaaggttagcagagttatgttacaaatggagtatttgtgaggtgaggactggttatatgtttgcttttctgaggaaaagtgaaaagttataattgggataaggcattttagtctgcattgagaatggaaggaatctttgagggatccatagtgaatgtgtgtgctttattgaatgagtaagacttgaagtgggctggactaaattgctgaaggcaaatctgttcatggtagatttagagagggggaaaagaaaaaccaccttttgaattcactttagccacaggaaaggtttgagggtgttgcattgatctcgcataggctgtatgaataaatggaaggaaggaaaccaatctagagaagatactgtttgactccacgctggcagttcttgaactccggggtgtgagaggagccaggggtatgtgagcattggagtactgagttcccagaactatacattctccctctgagttctaaa

SEQ ID NO: 135079 - DNA, 1025 bp, Homo sapiens
gagacgggtttctcccgtgttggtcaggctggtcttgaactcccagcctcaggtgatctgcctgccttggcctcccaaagtgctgggattacaggtgtgatgtgagccaccgtgcccagcctcatgtttattttaataaaggaacattgtcttgcctcaaatcaacatttaatggacaaaaaaagagaaggtcaccagtatgcaggtagcaccctggaaacctaaatgttacatctgtatggacatttatctagaagaataaaaggagcagtggtaactgacaatcttcaacaggtatttttaaatcttatttagtgtttgaatgatcccagtggactggaatgtggttaatatgaagcaatttaactgataatgcagacacacagcaggaaactatgtggcagtttaatattgcttgtggtgacatcctagaaattgcttccaggcaccaagtgcaggaagtgggctgtaagtaatcgaaggaagttttctaagtgagtttgaagaaacgtgacatttatggactcagagaaaagcatactctaagacttgaggcataggaacagggcagggcaactaatttggccttgtggtggtgattattctacattagcctgtatacctgtcttctgtccctgtcaaactgtgacctctgtgaggttagtgaccaagaaatttatccatttattcatccatttacctactgtagaactaagaagattaagcacatattaaacaataaatgttagccattattatcataattagtggcaatactgtgcctggcagtgtgctaagtactggggacacaaagatgaacaaatatttttctttaaggctttctaaagtagtggacacaaatgtaaaacaaaaacaatcccttccagactccctccccaccaaaacaaaacaaaacaacaaaaaaaacaaaacacaagtataatacagtataagttaattgcaatggtggagatgccgctggtgacgaataggtgagtaagtgaaggagagactgtcttctgggg

SEQ ID NO: 135080 - DNA, 2009 bp, Homo sapiens
caagcgtcagtctcctcagctattacatcgagatcatagaagtgcttgccttatagggttgtggtgaggatgaaatgagatcatccatggggcctgacatgtaatatgtggcccttcaaaagctgggagctcccatgatgttgggtatgaagtaaaccactgacatttgcagctgaggcaggatagcctagtggttaagagcataaggtttggagctggaaagttcatacctcaaaccccagcaggtaccatgttctggttctgtgacagcctccttctctctctaagactctggtagtaaaaaagatacaatacatataaggaactccagaatgaacagtggctgcgatcacagcaagcctgcccaaccagatcatccctctaatagccgttggagtaattgatttctgcttctagggcaaatgcacacagacaccatcgagtgttcttcttgaggcagagcacgtgtgctccagggcagctaaagccaaactgtctgccctgacttctcctgctggttatgtggccaatgacagcttaatggactctttacccttgaatgctaaggggaaaataactcacagcattataacatatgaatgtgatgtaggttttttttcttgagcaatgcagagagcgagccagaaacatatgtagaattgaacctcccttttcctggccctgtctgtataggagacagatttagccattgcaattacccatatcattcatggttgtaaaatatagccacatccatccgtgtgtgtgtgtgtgtatgtgtgtgtgtgtgtgtgttttcctgaatgatctgaggctaacaaaacagagtatgtagtcatcttattatgtgaggactgtgaatgcctctaaattattgattttccagggacaagccgttcctcttggaataaacggatggctgtgcacacacacacatacacacacgtgcacccacccacacacacacacacacacagactttgttgttatgaggaagctagtcaaagatctacctgtgcaacttttagaaagccatacaggcgcagtggctcacacctgtaatcccagcattctgggaggccgaggcatgtggatcacttgaggtcagaagtttgagaccagcctggccaacatggggaaaccttgtctctaccaaaaatacaaaaaaagttggccagacgtggtgacgtgtgcttgtggccccagatactcaggaggctaaggcatgagaatctcttcagcccaggaggcggaggttgcagtgagccaagattgtaccactgcactccagcctgggcaataaagggagactctgtgtcaaaaaaaaaaaaaaaaaaaaaaagacagacagaaagaaagaaagaaagaaagctgtgctgtcctgaccagatagtcagggaatctcctctgtgggaagctaaaaatgtcctcagctgcacagtctgagggaggagacagtcagtggcagccacggaggcctccttgaggctgagaggggagggtgaggcaggggacaagggcaaggggggtgtgggacactggtgagaccatagacttgagaaatcaggctggactgacctgggctcaaatccaccatcctgacttggggcaagcatcttccttatcttggagcctcagtttccccagctgtgacatgtactttgtatggtgctatgaggattgatgataaaccaggctcaggccaggcaagacgtgaggcacagtgccaggcccagggcggtgccgggtacaaagtggctcttcccctttgggaggagattcaggccaggcagaaggcttgcagcgtcccaggtcccaggcagtgccaggaatgtccgctgcagccacccagagcctcccggaataggaagtgtgtggaagcgcgcggctctccatctggttaatgttcgcttgtgtttcctgctggagagcatcacttttttcacctcacctggtttgtttacccaaacaagctgctcattaacaacacgaattgcattttctgcaat

SEQ ID NO: 135081 - DNA, 1021 bp, Homo sapiens
tcgccgtgttgcccacgctggtcttggactcctgacctcaggtgatccacccacctcggcctcccaaagtgctgggattacaggcgcgagtcactgtgcccagctgcccccccccaccagagtttttcatttattccattcaacgctaatctcaccaatcaattccttgttttgtagatggggaaataaaggcccagagcttagcacttggtccaagtcaaacacccagtccatttccaaagcagagattcaaactcagctctgcctgaatctgaagccctcacattctccatgatgccaggtcagggaggctggcagaacaggatcagcctgggacatcttccatttccaaggaagcaatcaacagggtccccatgcccagaggggtctgtgccttgctcaaggtcacagctcatcagcagcagagctggtgctagaacttgacccttaaaacatccctgagtttttcctgagctaacaggaggcctcagtgccactctagggggaggactcaaagccagggaagctcagggaagctcaggtcaccagtgtctccacctcccactgatttgatcccactcatacatctgagcattggcctcagtttccccactcaaaaggctctctagagccccttggctgagcctctcttcctgacccaccttgccagcccctctcccaagagaatggagcctgagcctggacccctagtaagagctctgccccatgtagatgtcgtggacctgggagaggaggcgtgtccagaccctgaaaactctcactgcagtgcctgttcaactgggtcaccagtgtggagtgccacatcagagaagtcctaaccgtgtctcccaaatgtagtggcattcgagaccctctctgctctcatgccccaccttcccccaacacatcttatgctccagccgtggtttttcctgtcaccaggattgagcacgtagtgctccctttgcctggggtgccctttcttcccacttgtcgaaagaactcttattcatccgccagc

SEQ ID NO: 135082 - DNA, 1018 bp, Homo sapiens
acctcagaagcttcgggggaggaagtaagtgaaataatgcatttcagatgctcagcgccttttaagtgcttgatgctcattccccaagattacatgagagacatggaaaatctttaatgaccaaggacccacccagggtcactcagccgggacccttggtccgtggcccagagtgtctccagtgcccctgcattgaggccctaaacaaggccagaagcaggtgccggggacccctctggattccaccagagcaccttcctaggatcatggctcccaaaacggaagggaaggagacagcgcagtttgcaaagaggcaggatttaagcaccagggtggccctgtggcgcctcaggaaaatgtttgcctgtcagtatctgctctcgttcccacctgtccccacaaagcgaggccataagtcctcggcgtggcattggagggtctctgaaggccctgagagctgtgtcagccacggtgtgttatgaagcaaggcagatgttttgttaattatttacacagcgtcggccccgcagaggactgcgctgacaggagcggctgtcacaggcctggccgtggggcagaagtgagcagccgtcttcccctggcagtcctcctgaaaaggtctgcatggcaaggcctgagggagtcctgcacattttatgcccccgccccccaaagccatttgggtttcccttaaactggcttgttttcctgagccggtggagagatccttgtcctccggaagtggctatcgctctggggcggcttctctgccagctcgtcacaccctagacccagctgtagtctgtgtggtgggagagggtgtcaccaggctctggaggtccactcctctgtagtcacctcatgcaaggagggcttcacaggggcccagcctctactccctcatccggaaaacgggccagtaacaccaggcaccagccccgtgatcctcaggcacccttgggggtgatctgccttagaaattcaactttaggattagaattctgctaagaggtaccat

SEQ ID NO: 135083 - DNA, 1046 bp, Homo sapiens
tactaaaaatacaaaaattagctgggcgtggtggcgtgtgcctgtaatcccagctactcaggaggctgaggcaggagaatcacttgaacccaggaggcggaggttgcagtgagccgagatggcgccactgcactccagcttgggcaatagagtgagactccgtctcaaaaaaaaaaagacaagtttgtcttgctttaaaaaaaaaaatacctctccttttacagatggcgacactgaggcccagagagacatcatgaccagcctcaggtcccacatgcagcctgctgctctgtagcctaaatcagatcactgtcccagctttcaggtcaaggctctggttgtgacacctgggcctggactgcgggtgaaaagttttgatgcaaaaacacagaccgtccattgtcctatgggctaagtggactcccttctgctaaccagagatgcttgtgctggctggtgtgtggcacgttatctcattctttcatgacgtatgtccggatggaagtcctgggtcaggcattgtgctgggagcccacacgaagaccctctaatggccccacccattggcctctcaccacctggtggggacagaggctgtcacaaccccttcttaggtgctcttgatcaatttgcaggtggcattttttgggatgtagtctctggggaagtaggagagcttccggcagtgaggggtgtttgaacccacctggagggagacgtggggtttgccagagggctgagagggctggggtgaagggcaggtagaccccaaggtggagaggcaggtggggccggtgggtgagaggtggggctgtggaacttcctcctgcttctttggcctttgctcctgtcggtagatggccttaccaggcacttactgtgggccatgttctaatctaacccttaacctgagggaactcacttcatcctcccagtgatgccgtgatgtgggtatcgttctgcccattttatagatgaggaaacagagacccagagagtccaggatctgtggtgcttgacgagcatcagcctgagtgctgtgagga

SEQ ID NO: 135084 - DNA, 1041 bp, Homo sapiens
cttatttaaaccagggccatttcatccacgtcactaacttgccggatgtctttgagtcatggtttcacctgcctgagcctcggtttcctcatcttcactcccagcactgtggaggggtgacctggttgatgacggtcatggagcccagaacccatgggtaacggggtcagcattcagaagtgtcagctccagctgcctgcccccgcctgccgggccctgtcctctgccaggcggagctcctggttctctgggtctgtaatgctttccttctcacttctcagacatcactgcttctggggagtctcctctgacctcagcacactgcttagaaacccctgcttggtgcctccatagccccttctgcatcttccccaacatggccccccaccctgtgaggcccactaatggccagtcccctgccccaggatcccctccagggctaggactgagccactttcctctgtggtcccagtgctcagcccagggcctggcctggcaaaggcctcggtgacggtaatgaggggagggagcaatgcacccttcgtttgttcctcaggcctgtggccatggggacagctgagatgctgagaccactgtgtccaaagcccaggccttttctggggacagataggtcagcgggacggatggaaccagctctgtgactcacatacccattgtgcctgctgcggtgatcctttaaacgacagttaggtttgatcctgcgggaggtgggtgtttggaaaggttttgagcaggggagtggcccccctgaagcagagtgtggcccgtggaggctggggggctgggaggcggctgtgaacttcaggagagaggagggggaacggggctgtcctggggagagtggggagaagtggggagcagcctggaacagtgccgggcacctggtgtccacagcctgagctcctacctggagacccctggatcagggagtaaagaattctgggctgcaagtcagaagaaatgctccccaggggcttcagtggctccagagtctcaggaatcatctctggatgggtgact

SEQ ID NO: 135085 - DNA, 1051 bp, Homo sapiens
ccaaggaatttgctgcatgatctgatctgatggccccagtgactctttgaaacccggccccttattggcaccacccagtcactccctggctgcgtttccctcaaggcacgtatcgctgtctgaaatgaccatgtctgttcactctcatgtctgtgtctacctcccaaccacgcaaaacctgtgggaggggaaggccttctctctcttgtccactcctgtgtccccaacccctcggacagcacatggcttcacaagcttctcaagaaatgcttggcaaatgatggcagagtgggttaaccctggtgttctcaaaaagggaatggaggcccacagagggcaggcccatccctgggtcacactgccagggcaggattggagcccctgcctgtccagggtcagctggggcctctctcactgaccagctttgagcctggaattccaggtgtgcctggctgtgtccttgcaggttcacaccgcccaaagaaacttccagtccacacttgtggctttggatcagctcagaaaaagtgtgtcctgtgactgctcgaggaatctgggcatttagcccagaaaagagtgtgtttcctggcttcctgagaactggggcccaccctgcccctggtctaggcgtgcagaacaggagggaggggagttgaaatcggggcctggaagggtacggcgtcagaccttatcatctgagtgaggcttgccgctcacgctgagactgtcccagccgagcactccaggagagggtatccccaccattggagcgtccttagagatggcagcagcgcctggagttgctggagaagaaacattcctcacgctcatgcgaatgtttccctgggctgctgtcccagcactgggtaccgtggggcagacatgggtgtgacgttttccaagcacgaggtgaccagtgtccattgggtcatcaggcctccagggccacatgtttggaaagctattcctggagcaccaggcatctggcacctcgctctgtggctaggcacgggtttatgaggggaccctgcagagagctggggtcctcagc

SEQ ID NO: 135086 - DNA, 1104 bp, Homo sapiens
gtaggtgccacggagtagtggcacgtgattttgtggctgttagtgtgagtattccttactttagagagcagaggaaaacacatcagcagattgtttaagccaaaaaatgtctgttgtttgaagaatttcgttttggaaggcaagcccaggttttgggtcagaaccgtattccctcaggcacggcacggttgaacgtcgaggcatattttacaggcttggtgaccgctcaagcctttgagccctccatgcgggtgctctgaggtcagacttttcgggaagccctcacacagctggtctgcttgtcgcgttggtagcaccgtttccacagagcaggctctgtttggctatgaatagatgtttttctcactcttttcttggatgcctgaatggcaggctcccctcctgcagtctcagaggccgacctgcatgtaaaactccaagcggacatcagagtgggttcgtctgttcctgcttggacttgaggctctcagcaaggctcaaagagctgggtcgatggccaccatgacccagggagcctcccgagagtctcccaggctatagtttctgaaggctactgagtgaactgaagaaatcagagttcatggaagaggcagcagatccgagcaacagccgagattgaggaggatggttcaggatctccaaacacaggcccgctggctccactgtgtccaagccgcagatgcaaagcctgttaggacagaaaggacacgagatagcagccagggccggccgcaggcaggagggccgggccaccagcagttaggagtgtgggttctggagccacacaaccggggttcagatcccagttttcccacctctattgggcagcatactgtaagcctcagttttccccttctgtaaaacggagataataatttacctgtctcacaaggctgttatgaggattaaagtaagttaacatcactcaagtgcatagaacgatgctgggtacatactaaataaatacagataaactgaggcccagagagggcaagggacttcgctgtggtcactcagcaagtcattggggcagccaaggctgaaactcatgactcctagtctcgtgaacggttcccccctccc

SEQ ID NO: 135087 - DNA, 1081 bp, Homo sapiens
ttttttttttttgagactgaatttcgctctgttgcccaagctggaatgcagtggtgcgatctcggctcactacaaccttcacctcccgggttcaagagattctcctgtcttgccctcccaagtagctgggagtacaggcgcgtgccaccacacccggctgattttttaaatttttagtagagatggggtttcaccatgttagccaggatggtctcgatctcctgacctcgtgatccacccgccttggcctcccaaagtgctgggattacaggcgtgagccaccacgcccggcccaagtccattcttgatagacatggtctactggctgtttctgaatacttcctgggacaggcaactaactccctgcctcctgatgggcccactcctgcaaggtcccagcagggtcaaggctcagttaatcttagttggaggtgggcaggtggctggctggatggatgggtgatggacagactgatggatgaatgaatgggggttggatggatggatggatggacgatagacaattatggatggttggacagttgggtggatgatggatggatggcaatttgcaacactagcatcttagaagaaagctccaaattgcatttggatgtttgccttttctccgtacaccagtggaaatggggtaagcagagagagcagtgaggtggcagaggaatgaggtgaagagaggaggggacggagggctggtgcccccaatctctctctgcccacgtgcccaggctttcaatataaagccaggctgagacagggatctgtcggcctgccttggagctccagcagagggaggaggtggtgacagaacaaagggacaaacctaacgtttgggtcctgctgagcagccggctctccctggccaggggaggggaccttaaaggagcccgcaaggtggcaaagggaacagcacgtgcaaaggcacagaggcgagtggaaaagcgggctggggctggggctggagtagccgctgtgggaggacccgggctgagggccaggcactccaagcccttgctttccgatggtcctggccaaggcagcgccaggccacaccccggcccca

SEQ ID NO: 135088 - DNA, 1163 bp, Homo sapiens
ccctggtaaccacattaacacaccggcgattctgttcatcctttattatgggtcaggcccggtgcagggcacctggggtcaggagaggagtcagacttgcctcatgcccctgaatcactctccactgacaggtggccaccccctccaggcccagaaatgtgggtctccctaaagaccaccacctctcccctgagctgttaaatggagctaggggatggccacttccagacctggtggcctgcctggacaaagggacaggaacatttctgagtttcagtgagcccagacgtgagacaataagaataaatggaagccccccacccattttgtccagccacactggggccccaggtgatgagaggtgtggggagcatgagccactcttggccatgaagctcttgcagccaccggcaggagggaggcctaagttctccggtgtccaggttggcagccacacaagctccccactgtccctagaccaccaaaggctgggtggctccgggattccatccacctggctgagcccctccgcatctataagatgggaacaggaccacctgtcttgcattgtcctcagtcctgataaatgacagacaggaaagggctctggaaacccccccaggctgttagacaccaagcccggcttggttttacagttggaaccctgactgtttttctgctttccctggagctgacttgagcagatgtggggtctggcttggagctgacacactgaaagaacttcagtctcagctgctgtggccggtgacagtccacagcagtgatgctcaggacagcgtgtccagggcctgcctcgagtgctgcgcagttgtccacagagcctgattgctctgtccccttgggactgtcgactctgaggctgacctcacagcccttgtgcatgaacttgagggctacgctgcccaccgctgggccacgtgggacccgcggccgctctcgtggccagggggtcttgtggccagggtcttttggtggtgagatttcccctccccacattacagattgagactatgagttcaaaactctgatctgtttgcagggtttaaacttcacagcatctttcttttgtttttttgagacagagtctcactcttgtcgcccgggctggagggcagtggcgcaatctcggctcactgcggcct

SEQ ID NO: 135089 - DNA, 1025 bp, Homo sapiens
gaagctgtgcaactggagctggtgacaactctgtgctttggctgtcagtctagaaatgggagtcgccctctctacttcagtgatgaggctgaaatgaacattgaagcccctgtcccaagtcagccctttcctggccacgagcccccactccccggagcactggctctcgccgggccccatgcttaggagtgagaggtggtgctcaggagcccccagcacaccctattttaaagttatatcgctgcttagaaatgaaaataagacacttttattatttttctcttgaattctgaaaacttcaaacatgcacttattgacaactgtgcgtttacttcataaattagttcgggtcacagacacttcacctgaatctggttttcttgggtattttaacctgtcagaggccaaccacaggtaccttcccccgaatattgtaaggttcagaaaacagctgtcttgtccacaggcgacttcagactccgggagtggcctagcaggctgcaggccctgtgtcacctgggcttctcggttgtaaggcatgcacgcaggtgcgaggggataccctaaggctctgtggcccagggagaaaatgccccatcagctgagaggagccctagtctacaggaagcccaggccccatccctcagcctaacgggcctgcgcagcagtagcccccgggcctccagaacgtcccgtgggcccttcccagtccctgagtgagtgtggccactgagaccaccagagccccctctggttcaggaccacccagcttcctgctgctgctgctgcttcggctgctgtggcctgcggggctgaccacccctccagcagcaggtatttaaatggaaaccaatggctgtgagcccgtgatgcagggtaagatgtaggcattttaaggtcattattttaattaccattaaaataattggcactccggctatcagaagaatggaggcgatcagaggcgcaaggcgcccctcccccacctcggggcgggagcagccttcagtgtctgtataattaaa

SEQ ID NO: 135090 - DNA, 1021 bp, Homo sapiens
gccttcatgcagacagactgtggagtgcggagcctcagtaagactgctttcttgagaataacacaccattctctcccctgcagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggctt

SEQ ID NO: 135091 - DNA, 1101 bp, Homo sapiens
agtctggctgcacattttttttacactgtttatgcttccagatgtttgtgcagtgtctaaggtaacagttaagtcattcttgttgctgcacggaagagcaatcatgcccttctcttgtgtaatgatgggatttgcttcctgctgtccctgaacagtattgtagggaggttgaagattgatgtcaagggaccaagtgcttcccagcacttgtggggatggtggggtggggggagagtcacgtgtccaccaagggccaggtgccgtgttcactaatgacactctttgcctcccaggcacccccattttgcagcacttgagaactgaggaagttgaatcccccaagatcacagagctgggatcgggagagccaagattccagtccagcctgctcactgcgttgcctgaatatttattttcactgtcttctgccctctggcaccttgaggagaatcctaactctgtgcttttgtttttctcttactaggcttggccggtacaggtgtgagaaagggactactgcagtcctcactgagaaaatcactcctctggagattgaggtgctggaagaaacagtccaaacaatggacacttcctgaatggcatcagtgggtggctggccgcggttctggaaggtggtgagcattgaggcccagtaagacactcatgtggctagtgtttgccgaatgaaactcaactcaataaaaaacaaaaaccaaattgggcagctgaggtctgggcactgtgtggtgtttttgggggcagtagggggctgctaaggccattggcctggcccttcagggtgctgatcctccttgagcactggcctaggctcagaggagagcgtaggagccatgcgcccctcctgaggacagataggttctgtctgctgtcagaagtcagagtggactcccttgaggcttcaggtgaccatcgatacctaccctttttgctggctgaatttgtttggggtggcctcaggtttggtttggttttgaaatggggtgataagtgcagcacaccctccacctcagcagccaagtaggaaaaaaatggcaaagccaaagctgtgttctcaagcccagctcagttctgagaaccaag

SEQ ID NO: 135092 - DNA, 1001 bp, Homo sapiens
ctaacctggccgttttgcaggagttttgcatcatttgaaatttgcctcattttggccatctttaaacttcctagaacaagagcactctgtacttccttggatctccttctggttctgcctgggccttgtcaggctgtggaagaaggatcatgtcatataacacagtgcctgtgatagccttcccacatgtgcccagcatctagcagtggttttgtcctatccagatgttggaggtgggaacgcggctcttctgctggtctcagaccctgatttcagtctctgcttctgacaggactggatttctgtcattgcttactctccttatcctgagaaattctagtgctggctgctgctttgttgtgacccatgaaacagattcacttcatttctctgtgttttcaggtgatagccctttccgtggctccaggagtttattgccagagttatcacgggccgcgttgtttttgcagagagagagaaatgtgatgaggatcttattagtatctgccacagcctggttttcgttttgaggattgttgagcatatttctcacttttctttaaacccaggctttctttttttttttttttttctctgattacatttgattcagtgtagccttggaaatatatatttgtatacacatatgctgtgaacattgatttcttctccttgtggaaagcaatatgttcttgtctcttttggttcttttccctctggaagcttaggtatttttccttccattcactgtcacggattccagcaaaaccacttgcccgccacagattttcctaatggtgggataggaagacaggctttggtggtgccaggcactaatctggcatgcatccccgactctcctgcttgtacacagccttgtgcctttgagtgcatcagccaacctttctgagagccccagtttcctcatctgtaccagcagttgggaattcaataaataacgcaagtgtttggctcagacccgggggtgtggcaggtgcctg

SEQ ID NO: 135093 - DNA, 1294 bp, Homo sapiens
cagcctatatcaagtgtaggttttgctagctgaagtaaaaacagttctaaaaatagccaaatgattatggtcggaacaaatataccctggataccttctgctattgtgaaagctttaaaaaaaaaaaaaaaaggtgctctttctcaaaaactcctaaggcacatcaaaactggcaaaggcagagtgtaataggggaagtttcttggcatctgcgccaccagaagagatctgtgttgccactggagttgccattaagccctctgtaaactgttgatagacggtggtccttcagacatgtgaagggtgggcttgcatgccattcaccttgagttttgttgatcaggcctgtgcctggttttaagacatggtccctttcttagtgactttacaacctagagaggggtgcacaggcccacaagcagggactatgtcatgaaaagtcgagaacggtacccatacagtgggcagtaggggtacggcggaagaggagccgatggactctatctgggagactataaagccacctcaaattgcatgtgactcctcacatgaattgtttttggtcttggggtgtgaggaaaggtgggacagggaggcagaagagaaggagaccattccggacaggaatgttaagtccagaggcacgggggcccctgctctgcctctcagtcgtgcagtcctggaagttgggacagctgggaagggaaatggcagacagtgtctaaagttgtctgggcggtcatttcccgagtcagtgtggccttttaattagcatccgctcttcaatgtgagataaggccggagcttagcatccctgtccctgcatgtgaatatttagtttagaaagctgccacgttccattagaggtgcttgtgttgcagcagtgggtgcaggagctgtgtagacttttcagatgtcctttgagatttatgttgcagtgtaattgggagatgctggtacttagtgtgttgtgcatggcggaatgtgagattacctgctgtaatgagaccccagcagcatacctcaggaaggtagttaaagttttaaccttaacagataatgttacttgtgggtgtctgttaggtaatttatactaccctcccctcaccctgaaattgtgcagaaaccaagaaatgataggaagttgtactaaatagatattttaaaattccacctagtggtacagatttttaaaaatatttgcagtgaatattttatctgtagaatgtggtcattctcgccgtcattgtcaccctgtcatgttagaatgtagtttttctagaatcagaacctt

SEQ ID NO: 135094 - DNA, 1066 bp, Homo sapiens
agcctcccaagtagctggaatacaggagggtgctaccgtgctcagctaattaaaaaaaaatttttagataagcggtctcactatgctgtccaggctagtcttgaactcctggcctccagtgatctgactgtctcagcctcctcagtagctgaaattacaggcacaagccatggtactggtgtcttagctttaaaaaaaattaatattaaagtgtgagtttattgattgacttgtaactaatcagatgttttgactacttttttaggtctactgttctaaaagtgtgggatacctagttctattactatgtaataacagcttcattgataattcacacctatgcagttcacctgttctaactgtgtagttcagtggtttttagtgtattcacagagatgtacagctattaccacagtcaatcttaggacatttccagcaccttaaaaaaataataactccattcttattggccatcactccccattttcccccaaccttcccagccctgggcaataactaatccactatctctgtacacttgcctattctggacatttcatgtaaatgtaatcatataatatgtggtcttttgtgcctagcttctttcactttgtgtaatatttcacccgtgttgtagcatatatcagtattttatttctttttgatggtcaaatagtattctgttgtatggacataccacattttacttattcattagttggacatttggattgttttcactatttgactatatttataatgctgctgtgagcattggtgtacaagtttttgtatggacatatgttatgatttctcttgggaagagaaattctaggagcaagattgccaggtcatatagttactctatgtttaaccttttgtggaactaccagagttttccaaagcgtctgtgccactagcagtgtgtgaaggtttcgatttctatatgtcctcctttccatatatccttccatatatcctctatccttgattgtcaccaagacttatcatcctttggattgtagtcatcctggtgggtgtgtgtgacttggtatcttattgtggt

SEQ ID NO: 135095 - DNA, 1007 bp, Homo sapiens
cttagccaatttttgcaggtttctagagctctggctctctgccttttgaagatgagttgctgaagcttctaccactgcctgaggcgtgctaacaccagcaggatcttttttttcccctagtcttagtgtgtcttcagttttaagtagcacatgcttagtcaatgccaactgtgatggtcctttctctggttgcaataccgagggatgagctcctaccctatacccttcagagagaagctatgaagataggtggtgacgtatacaagcgccacttcagccgtctgatttatggagtcatatctcatcactcggcaagtgttggcctctagagaagcccttatagattgctaaagatgtgagcagctatcgccctaaaggcttgtggttacctcacaagcgtgatgccaaacacctagctactgaggaaacagaattaatctgtcattgcaggcagctatagatccactttaaataatgagagttgataccaatatggttttctgacagcaaatcttagaagtaactgtgtgtgtgttttttttgtaagtccagtattaggaagacactgagttgcaggttcatttgtgctttgcagatggacagtagtgtgagagatctgcattattttgattaaaaaattgtgctatttggcatatagaatggtcccaaaagagaacatagtatgagttcaatatggttgcatggaaaggggcatggggcttgggagctagaggattgcgctgcaggtctgtttcctctgtccttacagcaggactctgggaagaggggcatccttgtctgtgcgatcggaacagagacctgcctgcacgttgctgtgagcgttagatgcggcctgtaaaaacaccttagatggtggctcacacaaaattggctctaaaatatggcagctggttttatttttttagttattcaatagtaggatacaaacatcgcatagcaacgagtaatgtgattatttgtgctggcatcaggcttggtgaatttat

SEQ ID NO: 135096 - DNA, 1036 bp, Homo sapiens
gtcattttgtctattcagctgttactcttcaaagtacaaactaaaaataatagctccaaataaatgccacataataaagtgttttacagttgtagctggaataacctggtggctgctgctcgcagtcctattaccattgctggtgcggtagtttcttccctgcgtgtcaaggtgactctaccagggccagctcattaaaacaatcttttctttggaactggcttggtatttagcgctatacccagcagcctgccaaggcacaatatggagcactagactcacagcatagaacacgggaaattatgtggcagtcactgtttgaacaaaatccaaattctccataacctcattttcatgcttcagcattttattgtgaataatttacaattatacctgtcagtggtggaagtaggaccagttgcagatttaccttagatagtggtaagtgtgactccaggcttttgaagagcactgtttttacctggtttatgtggccctgtagaattaatatttacactgtacttgaatgagacactgggcatgttttgctgtttttcttgcccctaggtaaacttgagatggataagctgggatatcataaaatacactaaaagtgcacctttttcttgcaggttctggctccttggcagcaatggctgtatttgaagataagtttaggccagacatggaggtatgtaagtccctgcagttttattctttttcaaagatttttctggttttatcttgaacatttacaaattgattgctgattcctcccgagcttgtacagcactgttgttagttggaatgttctttggcacagatggtctgtttgccgaagagaccagcttccttttgtagtggcccagctgtgcccttccttgggcttgaggcaccagcgctatccagctttttgctctgggctttgggctgtctaggaatcttcttgactgtaaatgcggtggtaacgtggaatgttttcttgcgcaccaagctttctgtgtcacgatatctcaaaatgacaggtttttctgtt

SEQ ID NO: 135097 - DNA, 1681 bp, Homo sapiens
caccatgctcggctaatgttttgtatttttagtagagacagggtttcactgtgctagccaggatggtctcaatctcctcaccttgtgatccgcccacctcggcctcccaaagttctgggattacaggcgtgagccaccgcgcccggccaggaaaaaggttttaaagaaataattatttggggagggaaatatttttcatttcttaaattattgagtgaagctgagcagaaggaaatatatgtgcctaggaaaaagaatagagcaaaaaaaaaaaaatttactgtgcaactgccaaggaaaggaatggccccggaggaaaaaacagctagtgatttttaaggaaaaatgcctttaaggtaagcttgtttttcttttttaacaattcattacagttttccacaagttgttagctcctagctaaatacctgtcttctccctgtccttttttaaatgtttatttctggcctctggttgattacccttgtgttcttcgtggagatattcttggactttgttggaagagaccagtctgctcatcagtgctgtgcaggattggtctatatctgggagtattttttcctgagattcttcatttgcagttgcctcgttcgttcatggcagctgtctttcgctttccacacaaaaccagcttgcttttactagtaagtctgagactggttctcacctgggcctgaaaacagcaacttaggttaactttcccccttgacccctgaatctcagagtaaatatgtgactcacagaacattggtggagtttgaccctgtttccacatcttcaaggacatgtttactttgaaattcagaggtttgttttgctgaatttgctctcacatatgtgctagttttatctgagtttactagttttatatctgtttaatttctatctccttttcagagggcttttaatgtccctttagatcaccattttagttttttttttttttttaaggagaaaaaaattgtgaggaggggaaaatcgggttgccttttgctcccaaagcctaaatgaatagtcattgcttgtaatgctggtttacacttgacgcttcctatggctttagatgtgatgtatccggtactgtgaaggtaatgatcctcaaccgcagcaatattccctaacaggagtatctgtcatattcatcgggattaccatgttcattgatttgtgtctgtaaatctgctgtttctaccctttaaatttgatctataattggacctccttaaatggttcagataaggtagtctgtattttctcaatgcggcgttgctgtcagcttctcctttttcattatacattcagcagacttgataaaatcagcaggacacctcatttgaaactgtttaatcgctgcctttttcctttgctaaaccattgaggtggtcaagcgatgtacacaaatcattttaaatagaaaatatggttttctctgtgacccagctaaatagatagtgttatgcaaaacaagttaaaaagtaataaatgccaaaaaaatcttctaattggagtaaaaaattgtgggcaactctatcctctctccaaaagtggagtatcctgaaatattgccaggacctgtaaagacaagatgatgattttctaaagattctctggtttttgaacaaagcaaatttaaattttcaaggagtgcttagctgccttttgc

SEQ ID NO: 135098 - DNA, 3383 bp, Homo sapiens
aatggcatatgtttaatcatttaaaacatttaactaaattccagtctcatttgaatttccaagcaaaacaacacaaattaactatatccagatgtgtgtggtaatcgagctgaaatctaaagaagaagcaagtttgaaagcatgcttttttggggtggggagctaagaaaagatagctccatctcccaggcttacttgctaatcttgatttcaagcatttggctttgctatttaagaggcaaacgtggtggaatggaaagaacatcgcacactttaaattcagaaagatctggcttcagaatcccagatttgcttatcactggctgtgtgatctgggcacgttccttatctttgagctttattctccttttgtaaaatgggactactactacttgccatgcctgaagagcaaacaaaactgatgtgactgtgctgtgaaagttcttaagtaccgtgtgcatctgttgtagtttgttcagtgctgtgtttgccaagagtacacttctggataagtggggtctagccccatgctgaaacgctcagaggacttcattattaagatgattgtacctctaagacggtcctaaggaagccctcctaaggacgttaggcaggagagacatggtgtatttgtttgtgatgattgattgctgttgttctttgggtctgttgactcatgcatggattgacctttaggcccttgtatacaaatgtaaggaataagctgcctgctgctgctgttacacggagactgtgacagctagcaaagtcttggtcttttgcttgttttttccatcccctcacaatgttggattttcttcaattttttataccttaaaaaattgctattaatgcctgcactttgaagaaaaatttaaaaatacaagtaaaaagaaaatagcaccacccagaaataagcttaatattttgatttatatgcttccaggtttgtataatatatagtgcataagcatgtctgttaattttgctttagaacatgtttttcccccactaaatactatagcatggatctcttcccattgccaaaaaaatgtacttctactttgtcatgtttaatgtctgtgtgtatagtattttattgtttattttccctggctcctgattgttgaacctttacatttacttccaggtattttttttttcccctttaatctaaacaatgatcttttaagatacgtgacttgggtacttgtccatgtgtttctttagaataagtccctaagagatttgctggtttggtgggtatgtatagctgtatgatttccaatcgatgtttctacattgcccattagaagagttctatccatttctgcttctccaagtgtgtcaaagtacccatttgatcacacctttgtcagcactattattctttttaatctttgctaattaaaaaggcaaaaggtagttattttacttcaattcatatttctttgattgctagtgaacttgatcagtgttgcttaatgtatataggcctctaccttttctctttcgtaaactactgtcttctctcttggagtcttgatgtagttatctgtgagctctttttagttattaatgttctgcatgttgcatgtatttttcggagtttcagggcttttattttacattcttaaaggagctagtaattttgtttataagctagtgggcctgctattataagatgtttcattgtaacagactggctggaggtgtggtccttgtggaactggtgcttgggactccttctcctggggcgcagcagatgtgggtgacaagagggtctgtgggtgagtccggccctgacagagctgggaagcaggccaggtgctctttccaggactccacagggcattggttgcaggaggagctttgaatgaggacctagctggagcagctgtggagtgtctgcagtggatgggggagtgccctgcaggtgaaagggaaagagacatttgtcctccctgcctccctgtctctccacagcccggcttcttggtgggttggggtggcgggtgttgaacagggtgtgtaggtgggcttgggggagggcagtggatgcaggaggtcagtctgaggggactaggtagccatcatagtgtcctcacttacattcacctaagtgctggtcactgaattgcaccttgtttttctgttttaaagagctttgttctggaagcagtactgggtactcagtaaccgtgggtgtgctgaaaggcaggcttggggaaggttgctaaggagcagcttcatggaaactactgatgagaccgagagcgtcagtagtattaatatagtgcagaaatccaggaaaggccattcactcctgtgatatcacagtggtttggactggactaggacatataacaggacttggttttgtggtttttaaggccctttttcctttttgaaaattgaactggctctacacttgagtttgtcttatattcagcctagtatggtaaactaggcgataaatattgctttacaccttatccaggcatttactgctatcctcacaccttcaggggcagcttagagttttttttggctccctcatttgggtagttggcctcacttttagtgcagcttcattcaataagcgtctctcctaatgctgccatgtgtcagagactgttggggatggaggctgcagatatgaaaggatggacaagttgcagagatgagagtgataaaccctgtggaggggagtgaccaaggaagggttctaggaagaagtgatctctcagctggagtttgaagggtgactgggagttctgtggactgccatgtgctctgtgagataggcttgaactggcacgggcatttaggaaatcatgggcagcgtggtgttggtggagtatcaggggtgtgtatgggggatgggagggagccgaaggaggtagaaacctggtcatggaaggtcttgcgtgtcctctctcaactgtattgtagcatataggactttttgtatgagagcgcgacatagggtcaacagctgagacaggaatcccacccctgtgcttgtttcctgtagtcctagacaaggagctttctcacattagtgggttgctatgaggatgatgaaatgacctaaaataggccgcatggcacctggcgggtgcttagcagaaggcccttgttcttctctttggcttccttctcctcctgactggagtaagttctctgaggcctcacccttgctcatggagcatagcctgcatttgtggagggcacgtcctctctgacctgcctttccttcactggcatactcgagtgtacagcagaggcccagtcctggccacgctgtcccctggcttttctgtgtatctgttctttaatgggaaaccagacagttctgatgtctaagatgtctctgcttt

SEQ ID NO: 135099 - DNA, 1050 bp, Homo sapiens
aaatgtaatactcagtgcttactcaggagtgaaaacatcaaattaaactgtttatgctgacaaaggacaaatctggatttcagcaagcgatgcaagattgtctgattgcttggcttgcctcgccgggaagcttttggccaggacttataatgaaatgcatgcatacaattaaaccatttaaagcctgcgtctgttttaccgagcagtgagaggtgctccactgctctctagtggctggatatggtcccctggtgcccgccttattttatattcatcaatcagctctgcacacattggcattgttggcctccagagcaagcaccagtactaggagatgaggccttggaggcaggaatggagtgaaaaatgatcccagtctgtgggtctgtggaaagcaccaaattttacccaggatgagtggccagttgactaacaatgagcaagtgtgagtaagcgctctgtcagggagagctgacactgatggattagaaagtcctgtgtgtgactctgttatcgccgcatacatcttacaccttggcaggccatggtggcaaacaggtccttggctgcttaaaatggaccgctctttagcagaaggagcagctttttttcctgagacgatctggttaaattgatttggggaaaagcagtagaaatccatttcctgctgcctctcataacttcatgactttgagaaagaaattctgaagacctctatttccatgaaagctgccaaccctgggacttgctgagagtgattgtataaaatagctgcctggaggaccaggagcttgtcggagaggaatttcatcagccagcttttcttgaacttttagtgtccccagcattttgctttacacgtgccatcttgtgtaaccctcagagccaccctttgaggaaggcacctcctgtcccctgccctcttgtgcggggaaggaacctagttcagtagggctgctgtgcccctcggtttccggttgcatcattcacgctgtgcttgatgcagttgcttgtgcctcctggagcaactttggcagctttgcagagctc

SEQ ID NO: 135100 - DNA, 1233 bp, Homo sapiens
ttcctgagagtttatttgggagactaatatatcagactcctggtggtgtggcccctggacagtttctgccctaaaaccttctttgtgaacatcacattgactacaatgagagcagcgttcatccagctgtagcacctacacctgttgtgggatgctttactgatacaatctttgcaccactgtgaggtgggtgccatcatccctgtcttaaagatgaggaaactgaggctcagagaggttacttgaaccacaagtaaggaagtatgtgagtgagaatgggaacctcagtttctgactttttcctgttggtacatggcatgtggcttattctccaaaaagaaaaaggatcccgtcggtttcatttacttcttttttaagagagtaatttggaagaggctactggtgatcgattcatttgattgttaaaagctaggcaagattttttgactttattaggaaagggaaagcattttagttatgtttttatagacataatgtgggttcttttaattctcagattaattagcttattctttgaacttgccagcttttctttattaggcaagctgaagtagtgtcagaagaagcttggggaccatcttttgctattagcttggcagtgttccttgtagcagcattggcaaggtatataaaatttttgtttttgcctgcttatccacatagagaattaacatgaataaaatttcaagcatgacattcctgaaaatgaggtccttggacaatttaggaatactgacttaaggaataaacattgctatgcaccattaggaaagacttggggtcactgccagggccatccaggtagaattctctctccagataaactggttatacagtttcctaattactggaatgcacctactaagtcccagtttacagggcctctgagcagtgagaaagatgtgggacagagtagtaagcatgctggatgtctcaccttgtgggcagaagaatcttacaattaagtgagaacttaggaacatggatagggagttcagatttgccatcgttacgctaaagtacagccttttctgtatttttacactaaagtacaaccttttctgtatttttatgctaaagtacaaccttttctgtatttttatactcaagtacaacctttgtatagatattttgatacctccacatgacttgattttgaaagttgtcctgcacaggatcaaattagtgcactttaagatggcaaatgtttcg

SEQ ID NO: 135101 - DNA, 1036 bp, Homo sapiens
atggggagggtggaagagggatggatgttgggagtttggagcagaggcaaggctggaaagcaggcctcgggggtccagacgctgcaggcagagctgttttgattttgtcctggaggtctcctgctctttcaagccagggaatgagaggattaggttcgcttgttagaaggagcagctgacagctgtggggagcagtggcgtgagaggcctggggcagggagggagcttgcatcctggccagaaatgttgagggtgaggacgaatccagtggtggtggcggtagggatggccactgtcattacagagacctctcagacagcagctaacccctgggccacatcctgggtttctgtcgtcattctctcctggcgttcctcagcgccagctccttgcggctcttggctgcagtgttgcagtcacgccttcatttggggccatctcccttttcagttgggctctaggccctttttctcatctcatttcctgttcttccttcccttgtgccctgggcttcagtggcagcagccccctcgccctcctctgaagagagcctaacagctgttgctgcctcctttcagaaacacattttctgcctggagtgttcctcctcctcatcctgagtgtggcccagaagccattccctcctggctgcccctggcggagttagcaagtccctgccaggagtgaagcaggatcccaggactcccgccttggccccactttgcttcccctaggcattgtccctcctgcccctgcacaattctagacctctgagagcagcttctgtgcctcactctcagggtctcacggagccctgtgcaactcagtgaatatttgatggtgaattaattttctgattctccaacttgtttgtgctaaagaatgtctgaaacttagtgttagaaaccttagccgctgttcattgtttgtgaactagcagtttgcagcacccctggaatgcagttggtttagattgtgttccatttgtgtggtcccagtttagctgtaaagtgttgtaaatgtgacaggtcctttt

SEQ ID NO: 135102 - DNA, 4829 bp, Homo sapiens
aaaaaatacaaaaattagccaggtgtggtggtgcacacctgtagtcccagctacttaggaggctgaggtgggaggattgcttgagcctggggaggttgaggctgcagtgagccgtgataataccactgtactgcagcctgggtgacagagtgagaccctgtctcaaaaaaataataataatgggggctgtgaggctgagctgaaatcaggtgtgtggagtgcctcacataatttatagtttatactggctgacagtagatgttcatctaatgttcccttcccttttttgttcccatcaaaacaataaccccttaatgaaacagtcttaaggaaaactttttgttacctgacttctcatgcaacttttggctaagttacagtgatgctttgtggactcatgttttttttcttatgcatactctgatcaccaggtatcaaggttacattggtgcagccctagttttagggggagtagatgttactggacctcacctctacagcatctatcctcatggatcaactgataagttgccttatgtcaccatgggtgagtgtaacgttttcctgatgtttaagagtactcttacttaccacgatggtctcttgaagagctggtctgttttctcttagaagaggaggtgcaatacaatgctttgattcattcagcaaatatatactgagttcctactatagattaggccgtgttctaggtgcttgctatatagcagtcaacacaattctgatagtgattcctgctctcgaggattttgtattttagtgagggtaaatagacaataaacaactgtgagaagtatatttataatacacaggtattctaaattaatacacaggtattataaatatatataaatatacacaggttatacaacctgtgtattatgaatatatttttatagtctgaaatctgaaaagctccaaaatcctaaagtttttgagtgctaacatgatactcattgtaacatttttatttttattatttttttcttttttgagatggagttttgctctgttgcccaggctggagtgcagtggcatgatctcggctcactgcaacctctgtctcccgggttcaagtgattcttctgcctcagcctcccaagtagctggagtgataggcacacgccaccatgcccggctaattttttgtagttttagtagagatggggtttcaccatgttggccaggctggtgtcaaactcctgacttcaagtaatctgcccacctcggcctcccaaaatgcttggatggattataggcatgagccactctgcccagcctcattggagcatttttgattctggatttttggattagggatgctgaattgggtgagttataatgtagatattccaaaacctgaaatctgaaacacttctggtccctggcattttggataagggctactcagcctgtattagaaagtgatactaagaaaaaaagtaatacagatgatattgtactatagttacacaagatactatctttgagagaaactgagtcaacttcatatggaaatgctctattttttacatctgcatatgaatttgcaatgatcataaaacaaaaaattaaattcacacatgataaggggacttgggagttgtgggcaggggctggggtggaggcagatggcagtgttaaatagaaagatcagggccaggcacggtggctcatgcctgtaatctagtgctttaggagcctgaggtgggagggttgcttgaggccaggagtttaagaccagcctaggcaacatagcaagacccggtctgtgccacatatatatataagctgagtgtggtggtgtgtgcctgtagtcccagttgcttgggagcctgaggcagaagcattgtatgagcccaggagtttgaggttgcaatgagctgtgatcaagccattgtactacatcttgggcaacagagtgagaccctgtctgtttaaaaaaaaaaaaaaaaaaaatgtcaggacaggtcttatgaagaaggtgagatttgagtagaattctagagtagaagccttacattgaaacttggcaggtacattttgacctagaggagtgattgtggtccttctttactacttaatctctgagggattggggtatttgatttctatctgaacctcaatttccttacctgtgaagtggtattggtaatacctaccacaccaagttgtaatggttggaaataacgtatataaagcatgtgctccaatgcctggcctgtaaatagtagttatttttttgccccctctcttcctcatttgctaaccagctttttgcatttatgttttagctctagctgctagattaggagattttttgacaggctctcactctgctgcacaggctggagtacagtggtgcaatcacagctcactgccacctcgacttccccgggctcaggtgatccacccaccgcagcctcctgagtagctgtgactacagccatattctgccacacccatctaatttttgtattttttgtagagatgggattttgccatgttgcccaggttggtctcgaactcctgggctcaggtgatctgcctgctccagcctcccaaagtgctgggattacaggtggctgataatttttttttttttaatgactgcaaaaaatagtgataaaattatatttagaagaattgggattttcaagttctaacatttacattattgcttctgggtcaaattgcataggtccagaaattcgaacaggttgtgtgtatcgtgtagctggtgtttttccagctgtcatttacctcttaatattttctgtcttggtgtcttggctccacatctaggaaaactgctgccttgagtagtttggaaattgccagtttgagactttgctatgccattgtgttgttatctagcctcttacaaggtttttatataacagatgttcactgtttgttggggagaatgatttatccccagataccatacggatgaatctttgcagttattctaaaatgaagatacttatggtaattttagaattgttctgaattgctttattcaaaggtattaggtatctccatcaaagtattgcttttatttctccccatctgatacctttaaatggtggtaaaggtggaataaccttttctattaagtagtttttattttttcttttttttacttaaatttcagacttgcagaaaagtaacagtaacgttcaacaaacactgatctgtcctttactcagatgtgtcagttgttagcattttgacacatgtgttctgcctctcacacacacattgttattcctatcattgtttcgtgtgcgtggggaaccatttgagggtaaatagcaggcaccacagcctttcacctctgaatccttcaagatgttctcttctgtcaccttgataaagtcatcaaatttaagaagtttgacattgatacaaagcagcttcatttgtaaaatgggaaaattggtttctcttgccagtgaactgtggtaatttgtgtcatgagcataaagctgaattaggaaaagttgttgaaagtgagtaggtaaacagctttgtgtctgcccattttacttctgccgcccaactttgtgctttttcctggccaagagtgacctcctgtctgtccaagtctcatttgagttccgggtgatgggtccacagctcttgagtttatagaataattctatttagaaaccactgactccacacagactggttttgctgccctaaaatgccagattaaggagaatgagacatcagtaacatctgattttaatacccaagtaaattgttactttgaggtcttgtttgttcctccactcatttatcagcttttttttttttttgagactgagtctcgcactgtcacccggtctggtgtgcagtggcatgatctctgctcgctgcaacccctgcttcccgggttcaagtgattctcctgcctcagcctcccgagtagctgggactataggcatgcaccaccatgctcagctaatttttgtatttttagtagagaggggatttcactgtgttggccaggctgatacggaactcctgacctcgtgatctgccggcctctgcctcccaaagtgctaggattacaggtgtgagccactgcacccggcctcatcagctctttagtgagtgccttctgtgtaaaggcactatagcaggcagcacagatagaagtgaatatcagggtctttgtcctcagatactcagtctaatgggggagacagatgtacctactgacgagggcaggaggggacccaagggagaaaaggtcacttccaagctgggataattcaggaagaacttcacttgagccgagtcttagaaggaggattggatctcttcattcatttgtctgatgtgtattaagcatcactagtgcggagcactttgctaggagctgggaagattagtggttaacacagcgtctgcctcagagcctatagtcttgtgagggagacaggtattagacaggtaaattcacatgaacctagaagaatgcattgtgataagtgccccagaggaaaagaacagtcattagagaggataataggaaggagtgtgtggctggtgggtgtttgtgtagtcctttctgagcaagtgacattcaagcattttctactgaacataatttatgaacatgacagaacattcaagtgggacaaagaactataagaaaagtctccttcacatccctccagagtaaccactgttaagaattgtttgtatttttttccagaaaatgtgttatgataaactttcacgtatctccttctctgtcatctagttacccctttaaaaaaaacacacaaatgagc

SEQ ID NO: 135103 - DNA, 1615 bp, Homo sapiens
tgggagagatgcggtcacactatgttgccctggctgatcttgatcttctggcctcaagtgatcctcccgcctgggtctcacatagtgctgggattacaggcatgagccatcatgcccagcctgaaaccttttcttaatgatcagaatcaattaccttctcctccggtttcccgtaggattttgtacctatgctattactgtgtattaaattatgtgttataatttttgtcttcttgtgtatcttacactcaactttgagcacaaggcctctcatattttctttattcccagtgcttagtgtaattactggtatctgatagtaaatacttggtagatgttgaattgcaagagttaacacacctggcacttctgtacaacttggatatatttgtagcattaatggaatgcacacactgttatcacagaaaccaataatttcatgtgttccattgggccatagataatgtatttgcatataactagatgcatattctcaattttctgtttatttaaggttgactaaacagagaagttacagcatagatatactcaaaaacatctctctgtacctgaacttcatggaagttatccaagaacccattacttctaattgagccctctggtaattggatttcagctaagtttctaattggatttttcagttgttgtggtgctgggacagctgcagacacagacatgacaacccagctcatttcttccaacctggagctccactccctctccactggccgtcttcccagagttgtgacagccaatcggatgctgaagcagatgcttttcaggtaagtttccagaatggggattcctactagtatcttcttctcatatcttagatttttttcagccaagagaagcctggaaagtagcaaaaacacattcagaaatacacattttgttccggaaatcagttgttatattaaagagccattttaaatggtttttgatggtgcatttgaatttctggggcctgatttttttcatgagtaaatcacatgtcaccagttgagtcatttcctggagcatagggatattactggataagagaaacttttttgttcacggtaagaaagttatagctggaggaactatcaagttgtcttgtgaaactactctctcctccccataaacacaaacccaaatgattgtctctccttccccccaccccctccctttaggggcaaaataacagtgaatgaaaagtgatatttataattggctgtcagtgggtatgataatattaatattaaccaacctttatctacctcttactctgttccaggacctatgctaaagcgctttatgcacgatttcatccttttaactctgagatagggactattagcgtctcctatttgtaagtgaagaaattgaggtttaaagaggtgcagtagcttgcctgacctgaccttcattctctgctgactcacagctcatattagtagttttgtttctctttctcctttaataattgcgtcattactttatgtttgtatgggtcttggcagttttcaaagtgtgttttctcatttgcttctcataagagaggcagtgattttaggagaagtagcctgggcatttagtcttgggttggaat

SEQ ID NO: 135104 - DNA, 1969 bp, Homo sapiens
ggctgtgtcggtgtatgctccaccagttggaggcttctcttttgataactgccgcaggtgccgccttgcttggggcttggttcagggagggagaagagtgcggtgctcgggtgggagctgggccaaggtgtgatacgagaattctgagggaagaattcatggcggggcctgtggcccgcggctagtgtgactcaggggaatcagggcctgggcgtgggtttctcctgaagccgggtctgctctcccaccttcccagcgcactcggccaccgtttatctccgtctcctaaggcacgtcacggcccctttgtaagactgtcttcgttggaaaacgggagaacagtgctgatggtgggaggattcattaaacagatgggcgtgaaaacaagtagcagctttcctgagttctctgttaggcacttttcatgccagtgctgtgcgatgtggtcctgcccttcaacacttgattctctcatttgctcttaggaatgccgtcttggaagccgattttgcaaagaggggatacaagcttccaaaggtccggaaaactggcacgaccatcgctggggtggtctataaggtaagccgggttaggctaagagcagcagtgactgaaccggcaacaggaatcagaacacttggcttccggtgtctctcccggctcggtctggaaaggcaaatgctatagaatacatcaggagaccgtctttcaggagcgactgcttttgtcaggttttgtgtgcttcttaacagtttatgttctttcctcactttgctgaggttttttctttctttcttttttttttttttaaacaggtcagttagcttcttaattactagtttaggaagctgaagtatgtgatgggagatcacgagatttggggtcagacaggtctgtctcacctttgaactctatagtgctgattccaacttctggcagctcactttccttctcacagggacaccttcagatgcatcaaatggagataactcctgccttaaattgttggaaacgtcaaaagggataatgattacctgtgcaacatgttttaaagaaaagcaacatgttttaaaaggaaattgatagtgatggctaatttaatggaaagattcctgagtcttaatccaggttttttccagattagctctgatttacaaggaatttacccgacacctgagcctcacttgaaaatgggaataattcttacctactcaggattcaattagtagcatttactaagaaaccttttcttaaatcctgaaagtgtagcacaatatttttgctatgagttttggctggcgttttgagattaggggagcatgtggtatggccaacatagtattccctaaagtagaatagagagttgcggttggcttatatttgtaaaattgtttaaaaacttttttttttaataggatggcatagttcttggagcagatacaagagcaactgaagggatggttgttgctgacaagaactgttcaaaaatacacttcatatctcctaatatttagtaagtattgattcgtttgaataactcttatattttcaaacatgtcagggctaaaaattgaccttcctgtgctccttactaaaacctgtttttcaacctgtattttctgtctcccttaaatggcatttccagccacctgttacctaagccagtaacttcaagtcctctctttgcttcagtctccaattgaattggtggccagttttgccctctctgtgcctcttgaatccattccctcctatcctttcctttgctaaggctctagtttgggttcttttttctttttctttttttcaaacattaacttgaaccatagaggttcttttttcttagctggactattgcagttaccatttaattggcctctcttaggcatcctattgttcactcttctgccatactggattttgtaaaacatagatctgatggcatccctttcttaaaaagcttttcaag

SEQ ID NO: 135105 - DNA, 1031 bp, Homo sapiens
acatgtttctgtcgggaaagaagccccgcctgccctggggtgttggtgtttttgtctgtgttgccatcccaggtctgccataggggctggtggctgcattgtgatgtctgggctgtgtctggggattccttcccacctacccagccagggactagtcacccccctgaagaggcctccatttccttcctgtgctccagggcatagggagcaccactcccacagacaccacctttaagggctctagtggcacacacatccacgagcctacccccaggttacctgccctaggtccacctccacccacagtcctgtgtgtaggaatcgaggaaacgggatgtccctgagcccttgtctccaaagggccggccaagggctgcccgccagcctgactccatcaaccctccatgaccaaatgatagctggcgggctctgcaggctacccaggccctctgctacctcccaccctgccagctggcaagggatgggccctgttctgtgaattgactacctgtggaaatgtgaccaattagtgtgaaatgcatgtttagcaagtgttaggtactgtatttgaaccaataaatgtgaatccttctgcacatggcatctgtctgtgaagcttgtctggggttctggggagggatgatggcgtgtcctgaggcgccggcttgtgccttcagacctgtgtctcttgctcatagctgacacccacctcaattctgttgctgaggctctggcagaaggtggtgtctcggaactgcctgaatcaatgaaccagcactgactgaagtgcccaacttgtgtgccaggcaccatattgaacttcaaggattattctgttttataagtgaagaaactacagttgagtgaggtgaaaagactctcccaaggtgagtggcacaaccagagaagtgagcctagtggagaggcagatacagacttttgcagtgcaggggggatgaggttgtcattagggatgtatgtggggttgtaagggcctggagaaggagtggcttgttctatggaggatagtc

SEQ ID NO: 135106 - DNA, 1030 bp, Homo sapiens
cacgtcgtgtgcatactgggtagtccatgtctgattgtaattgtttctttctggtgaaatgttacgggtaccagcagagtgatgattttggcccttgatggatctaaaactcggaacattactcctcaatgccgtttccccagttgctctgagaaggaagagacatgttcctcaggaaaagctccagctagcatgtttttcacgtcagtgggaagattcttgtgtgttcgtgtgtatctgtttatttctaagttcacgatacttgttcccctgaattttatttaaccaactagatcacattctttggccacaggtcagactctgagctgctttcctccagatcgggaaggagacacatatcacagatgccttctctaagacagctcctgtgtacagcatcgttctttgctgaggcctctatctgtccaattattatttttgaaattgcttttcaaattaaacattttacccgttgtgttgggtgtcaaaagaaattgctctctgatgaggcaagaacatgtctctccaacaacgtagtattgaacagagcaagttgttaatttgtggagtaggggaaaggttctgcaagttgccattgtacaaatccagttttacaaatgtttgcagcagattccacagaacaaagagcccattcattgccgagagccctgcagaatctcagagcaaagtggctgtgtgttccgagccggagcctgacctgtggaccgtctttaatgtcttctgcaccagtccttttatgacgtgggctttttttaaacagggtaaagtgaatgtgttgcattgcaaactcaggtattatgaggagaaggtaggagtgtagctagcagcgtggagacattaggtcagccactagatgtatttgtgaatttggtttgaaggacacggagaaaggttggaggggaggtttggtgtgtttgttttttgctttcttccccataatgtttggttaacaggtagcctttttgcgagtggaaggagagaaaagttgtgcatgttttctctaatttct

SEQ ID NO: 135107 - DNA, 1743 bp, Homo sapiens
cctccaccagcccaaggaggctgacttgcctgtccactagagtgaccactgctaactcttcttctccccccttgttcccaggaaagatggtgaatgtgcccctggagcagctgcccctcctctttaaggtggtgctgcattcctgcaagaccagtgtgggcaaggaatgacctgttccaggcgccctcctcaggccaaccacagcgtcttgggtgggcaggacaggctctggagggaaaagccagagagaccaagatggaggctgtggagcagcatttcccgttgcctccatagcaagaagagtttttgtttgtttgtctgtttttttaacctcatttttctatatatttatttcacgacagagttgaatgtatggccttcaacatgatgcacatgcttttgtgtgaatgcagccaatgcattttcttacagtttacagaatgtgaagatgtttaatgttacagtgttgtcattgtttagaaatagttcttttgtattttgagggagagggtgggatggggctaagatgactatttccataatgttgacaaagatgactacctcaatggaaatggggggtgtggccatccctactttttccacattttctcagcagactcatacatttgtctgtcagagagcaaattgccttttttagccacagaattgccagataaaacggcacactgtaagggggcaaagtgttgttaggagattcactaagcaaggttggtgagacggcaacagggtaggaggtgaggattgagccacgtcctttccttggaaagcgtgaaaattaagagagtagggcacagtgaccatatttaaggcaggtgtccttccacccaacaagtcctaagggcagaagaatttctgttctcacaccttgctgccccccttacccctgcaccaccatcattgtctaccactgcgaactttccatctaggcaaagtcctggcaatcacttgatccacaggactcgcctcccagctccctcggggcccccagctacctagtttccttacctggatctcctgaggcccaccttcctccttcccactcccttacacatttgacttcctattggccctttgaaaaaccagctgagcagaatgccatgttctgaagcctggtgcccactactgatttattctcctttcaccttgttttcttcaaagggtagtagggcaaggccagactgcaaaaagaatagacactccccttttgaaatctgttcctctcccctccccttcctaccgcaccctcaggtctaaatccgaaaacttcaggcttttttaaacaatgagaaggaccattcacctgtctgctgaccagaaatgttgcccctaagttcttctccaagttctccttttctctccagagtgagaccagttttcctcagggacccaggacacaaagcccaaggcccagagtggctcagctgccccttacttcagcagtggactggccagccaaggcctggagggctggagccagaagcacctggaagggaaggggggctttaaactacctcaggttcctaatggcccggctgctacctctgcagacatggcctggactccttgacctctcactacctgccccaccttatcccaggacgtgttccttaccctcttgactttggccagcgctacaccaggtctgtctttgaactctttcaggtgcttgtcctgcctacacccaggtatctttcacagccagtgtggcaagcagaccactta

SEQ ID NO: 135108 - DNA, 1049 bp, Homo sapiens
cctgtgtctgttcctcagatttagtgatgaagggatggaggtgatcgagcggctcatctacctctatcacaagttccatcagctaaaggtcagcaacgaggagtatgcttgcatgaaagcaattaacttcctaaatcaaggtgagtggctggggtgggaaaagggacgtttgcagtgcgggaggcaggcagtgagcatttgccctcctgtttcacccctccttaccctcaggactatcacacagaatccatcacaccatctgggtttcaatccaggaagacttgtgcacccccttgtcatcaccctgacccttatagtacagggaatgcgagaatgctttggatttttttttttcttcaaactgaaatgccacaatctctataactcatagaggaaggaagaggattcgctttgtttagtcagttttaatgcatttgcacacagacaccaaggacagtacatgcgtcattttaaatatgtaccaagtttaccagtgactgaagaagagcagagtgactgatgaaactgttggagataaggcctctgtgacaggctggcagtggttctgacagccccttcagggcagagcaggggtgcacaaacacacacacacacacacacacacacacatacacacatacacacaatcaagcatggcttttaattaaaagaatgccagatgtgatttatgtggtatcttacctgcaaaggggcacttggcagctgctggtaaaaccagtatagggaggagggttgtattctcttttttccaaaatagctaatgtgtactctgctcctatagtggcactgggctgttctgctgcctgtggcattgcaagtgccctcgtcctgtgtcccatttccagtccagagctcctctcctcttggcctactcacccctacattggccaaacctcttcctgcttttacaccattcatgcatttatctggtgttctgcatgcttccctttggccaagccctgtgctgagcattaaagacattgagaaaacttagactcaggtctctggtctcaagaagtatacattct

SEQ ID NO: 135109 - DNA, 2307 bp, Homo sapiens
tctcaaatattgaatcaaatttatggtgcccatattccttaatcacaccgttatcagacagtgaaccgggtgaatttgatttaaagcagattgtagcaccagccagtgactgctcctggccctaatcaagactcctctcaggagaagatgccttgagctagatgggctttaatgggtacctctatctcatgagcaccagctccatttctgctagatctctggaaagttgcctcccagcttccctgcctaactataaggctcaggaaacaggcttttatttttgctacaataatgggagagagatgatgatgctatttgtaatgataacagctaacaattatgccaaattctatcttaagtgccttacatacattatttgttgaattcttactgctaccttgtgtgactggcactaatattatccctgttctagagatgaggagcatgaggttgagaggtgaaaattaaaggctacaaagatagagatggagctaagtttatcacctgtatctgttgtgctccaatgcccagcctctttaacattgccttatactaaattcttattttcccagagcattttcaaaaggtttgactttctggaatttgtcctgaaactagtcttagttttcgtcttggagtctttacatgggtgctgagatggcagtttctctaaggttgtggctgatggccactcctgggggtaggtgcatttagatcaatgaaaaagagacaactgagtttctcagcccccttaatgggacataacttacatagtgtcagtttcaattgctgactgaatggtccagtggtttgggggatcctggcaggaatgttttccttgtcccagcatgcttgtgtaatgggaacctagaagaagaatgggtgtgtttgtccaactttctggctttgaatgctgataatttgtagacagtgaatacaggggcattaaaactggagtgggcagatgtggaggaggcacggctgcaggcaaaggcaggcccgtggaacagagaacaactttgtttatcaaggggtgggatgcggggtgtggaggaaagctttgcagtcaggctgtggagactgagtgggggctgctaggctggctgccagcccccatcactgctgggggtccacggtggctgcctgttggaggaattttggaaaagaaggatgtgctgtccgcaagagaaagggcagatctagggtgtatggacaggccaggcacttgggaactcctttgtgtccctcaggtcaagagtcagccaggaacaggtttggcactcctggctaggggtctggctgatagccacacacctgcagggtctggagtgccagagtgaacacttggggcaaggggttgctgattaaaggacagagcattatctttgcttgctacatactaggccaccagacagatgctgacactgcctctcccgttgtgtcctccttttttgtgccctaccccatttcatccccacccctccagtcagatactgaaagaaattggcagtaaagaactttttttcccactcccaagaacataaatatccaacacagtgctatgatgaggagtggtcttcactcccaggcacaccgcctcctgcaagtcttagcatcctggaggcacttgcagtggcagttctgtgcactgtagcagacctgacatcctcccaaggttgggccctgctctgagttgctgtggggacacaactcctgaggtcccctgtggtagtatgtggttagccttttccaggtagcagctaagaacaagacaggatcaagggtaggcagtgtagtgctgagaaaagtccatatgcttggaattagaaaacctaggtttgaacattggcctcaccaccactaccatttacttcccgtgcaaccttggggtagccatctctttttctgcttcctcatccctaacatggaagtgatacttactatgtatccttccaggttatcaggaaggtaaagtgtaagaatgcatatgaaaaggcctaatacataatagagactcagtaaataactccctgagccttcatttccacatgtaaacaaagggggttatgatttgtatccattctgtgaatttattgggaatatcaataagattaaatgtagaatacttaatgtgcctcgcaggtagcagacactcaacaaatggtagagtggtagaaacggtattatagattggtggttattgtggttattcaatatgaatgtatcggccaggctgggaatgtatcagtaaagttgtaaaagccattgggccaggtagagagaaactgagtcagccatagtagctca

SEQ ID NO: 135110 - DNA, 1030 bp, Homo sapiens
agcctgggcgacagagcgagactccgtctcaaaaaaaaaaaaggtgcccctatccatgaaagttggagaggggaaagtagcagcccttacactttcttcacagaactgggatccatctccccctcccacccagttgtggcataaagacaagccaagactcaggaagagcacagtgctccaagacctgcaagggccctttgcacagctaggggagggaggagtcagcttgctgactctctctacttgttttctaatatttccttattaatgatgcttactggcttcagggtgatctgtaaatgacagagttttgaacccagctgacactctgtctggtaaatagagctatctgattttgcagttgacctaaccccttgtccagagactctaattcattgtttccatcaaattcctgtctcctgctccataactctgctccataggggtgtttggatagcagtcagcctgctctgatgctgtcagggtttgcagagctggcccaaggatcccagcctctctgggtgcctggaatctaccagttcggcctgggactacaggatcagcctttggactccacttccaagtaatgggtttgcccaggccctctgcaggcaggcaggggtcactggcagtacagggttctctggctttgagcttcataatgcatcccatctcactgtagccagtcccttaagccccaagaccaaggcagaagtcagtaacagcagaagtagtgaggaaacttttccttccttggtaggaatttttctcatcaaggaggatctaaagctgtaccgtccactacagtagccactagcctcatttggcttttaaaatgtaaatttattaaaattagaaatttagttctcatttgcaccagccacatttcaagtgctcagtagccacgtggcgagtggctactagtacaaataaagatcatttttatcatcacataaagttttattgagcgttgctgtctttagaacatgtgttgctgctgagctgtcaagtggcttctgagaataggaat

SEQ ID NO: 135111 - DNA, 1054 bp, Homo sapiens
ttcttttttttttttttttagacagagtcttgctctgtcacccaggctgaagtgcattagcgcaatctcagctcactgcaatctccgcctctcaggttcaagtgattcttctgcctctgcctcagcctcccgagtagctgggattacaggcatgtgctaccacgcccggctaatttttgtatttttagtagagatggggtttcaccatgttggccaggctggtctcgaactcctgaactcaagtggcctccaagtgctgggattacagtcatgagccattgcacccagccaattgcacacatttctaagtctcctttccccttagcagcctttcctcaccagacccgcctctccagccctgaacttgctgctggcctcagccttccccctttatcagaaaatcacactgaatggaactggagacccgtgggcatggagcaaggagcccattgccagggtccctttgtgcccttgggactaccttctctctgtacccttatcctcaccctctgaccaatggaagtgactttcccctgtccctgcccctcagatacgctgtgacacaggcagaactatttgccctgctttgccgcctggccgacgagctgctctttaggcagattgcctggatcaagaaactgcctttcttctgcgagctctcaatcaaggattacacgtgcctcttgagctctacgtggcaggagctaatcctgctgtcttccctcaccgtttacagcaagcagatctttggggaactggctgatgtcactgccaagtactcgccctccgatgaagaactacacaggtgaggcctcctggctggggaggaaataccaaacaaccaaacaattgtcatccctgtaaggcagagttgcctggcccttcagaggataggcactacacctcataggcctggatttgaatcctcactctgccactgactagatttgtgaccttggccaagtctctgatcctcaggttctgaactggtaaaatggggtgataacacaatttccccagtaagatggttgttaggaatacattttatgcattc

SEQ ID NO: 135112 - DNA, 1052 bp, Homo sapiens
aagtaggagattgtcattgaggagtggtgtttcagggttaggaaagaatagcctcaaggacaaaaaggagttgaaagaaccttgaggcttcacggcttgagagtagtgtaaatgagcaggaggaaggccacgaagggccatggtgccagtaggaaggaagccacgccgtcctaagattagtgagaggcccggaatatggggatggaggagagggaacctaggtttctgggaaatcctatgagatttaaataagctctcagtcctgaagaaagagcaagtgtcctgagcacccatctaacatgtctcaattccttgtcaaagatatcggaagaagaaatcgaaaggatcatgtctgggcaggagtttgaggaagaggccaatcactggagcaaccatggtgatagtgaccacagttcccctgggaacagggcttcggagagcaaccagccctcaccaggctccacactgtcttccaggtgagctttaaggcaaacccatggtcatcatctagggatcccccaccaaagggagagctacagaaaacctctggctgagtatccctgccaggctgtctcagccattgtactgttgctccctcagactcttggagtaggggtcaggaagattaaaaacagtgtttcccagccccttttatgctaaagaccttgaaaatgtcagtggtctcttctgcagactgataaagtgctatagcttctatccatgcccgtgcattcttcacctaacagaataacattttaaatgttgccattttccctcatttattttatcactgaaataaacctttttgacagttttgaattaaactgtaatttctctgcctcacaagagtcaatgtttttcactttataaattttaagaaacattgaaggctttttaagccagtcaaatttgctgctatcagagaatacaaacttagaaactcttggttcaagcatatctttagttagttgtcgagtgtgaaatagatccttcagctattagggaagctttcctttccccagaaacctttcttataggatatggattgacaa

SEQ ID NO: 135113 - DNA, 1025 bp, Homo sapiens
aggaaaagtctttgttgggccagcctgcaccacttgttcttacccgttgttcttacttgccagcagaagagcttcatgagggtagaaaattggatatatctctgcccatcaggtgaatcccttggcacattagtaggcagagagcatgccttaggaattactagtggccaggagcagtggcacacgcctgtaatcccagcactttgggtggctgaggcaggaagatcgcttgaggccaggagttcaagacgagcctgggcgacatagcaagacagaccctgtctctaccaaaaaatcaaataaaattttaaaaaactattattgttactggtatgagccaagaggcaaccactaaaaggttttatttagatttgcattttaggaagatcattctagcaggtagaaatggtttgtgaggagtgaggtgagggtgagtaaaactgagggagagagaaagcagttagaaggttttcacagaagtacaggcaagagatacagataatagtttgaagcagagcaatggcagtgcagatagaggggagagaatagactcaagagatatttactgggtaaatttataggatttagccagttaaatgtgagggaatgaaagaaaggtgttcggagttgtcttaagacatacactgatgatgtttgggggatttcttatcatatgagcacagcgtacattcaatcaggctgtgtgattcccaactctgctgtgtttattctttttttctaaaacatttttattctcgttattcaagtcatatatatgtcttacaaattctttttgtttcttggtctggactaatagctgctcttttttattatggcagaagtaaaaaccatataacatgaaatctaccttttgaacaaaattttaattatacagtacagtgttgttaactatatacacactctgatacagcaaatctttagaacttttccatcttacatgactgaaacactatactcattagacagcagttcctcattttcctctccctttgcccatggcagcc

SEQ ID NO: 135114 - DNA, 1167 bp, Homo sapiens
cacagggcctggacacagaatagatactctgctagagtgtaagcttcaccaggggcttctgttcactgctgtatttgtgccttacagcagttcccaggatagaagagttgcacagtaaatatttattggctggatgtctggctgaccggcttagctcggtatggttagaactcaattacagctgtcatttattggctgtatatcatgtgttaggcccttacatatatggtaagtaatccttaccgtgctcctacagggtagaattgatgggttatagatgagcagggtaagggtgatagaggagtcaaagattctttctaggtttcagtcttagatactgatccaagtgttgatgaaacccaggaggaagagtttaggtagactgtgttgtggtatctgcaaccacagatacagggactactcttgggacaaggatccgaagatgggccccctgtttgccctttagcctggagatagtggtggtcttaatctacccagagcagagttgctcactttaggaactgtaggcttaaagccattatttccactgtgttctaacttgaacatgatcagtttctgtttcagatgatcgggctgaacaacgaacctgtctcatttgtggggaccgcgctacaggcttgcactatgggatcatctcctgtgagggctgcaaagggtttttcaagcggagcatttgcaacaaacgggtatatcgatgcagtcgtgacaagaactgtgtcatgtctcggaagcagaggaacaggtgccagtactgccgcctgctcaaatgcctccagatggggatgaaccggaagggtgagtggtgctgatggctctgatggcccatccttcattcaaaactttacctttagtgtcagctgtttagttacttattcctcaagcttgcactacatatcaggccttatagtttgtactcataaccaaaaatgaaccattcttgcctataagaccttcctaaactaggtggggggaagaaaactagtgagatgttaaggtgggaatgagtgcacaggccctgtgtgaccaagaacccacttaacaatcaggtcttaactgggattaatatacttcactagttatttcaggaatgatgacagaagtagaaatttttggatgaaaaggcatgaggtaggagattgctgaatg

SEQ ID NO: 135115 - DNA, 2096 bp, Homo sapiens
cttcatgtgttctcaattcgtatgaccttgggtaatcatttccctgtgattcagtttcctcacttgcaaaatggaggttctctcatcaaacatattggaaagaatagtctctagcagttgttcctacctttttcttgacattttgaaatctacctccttccctccatgttcttgaagttgtctttagatgattagtgacaagattagtatgattgccataccaggccattattggagccttgaggcaaaaggaaaattctagtgatagtcatctgtttaaaactttttcttgcattaattttgtattttgatttttaaagtttgtattaaaatatttatatcgattgagtgttttggcacctgcctaaattttgcacagaggcagtagtcccagctctgccttttgcctcgtccctcagcctgttctcagttcatagcctcagtttctccatactgttgactgctctctgtttagtacagctctttgtttccttgacttccctggcattgtactgtccatattttcctttgctcctagggtaccttttttctatctcttcttgttcttcctgatctctaaatataggcaggctttcattaaggtctgtcatagtcaattttttttttttatggtaagtaagagaaactcatcaaacttaactagctcaagccctgaatggaagttattggaaagaaactgggttagagcatggaacacagagaaacatggaagagttgggattcaggagggatggcaggagtcatcaggagccacaggaactactctcagcccctctgaagccatgaagcatagtacctctgctttacttcatcccctaaccctcatgatcaccactaccacctagacaaatatcctttgcttttcaggaacaaagccatctcactagtcacctcacagctcactctcatccgaagttagcaagccctgtgaaatcttggcaatagagagaattgcattaaaccagtgcctttttccagtcccgtcagcagtggccattatctgtccctggtccagtcaacttgtctagcagtgtaaacatagtgccccacaggcagggcagtggctgctctcaaagaaaagattggtgtgggctgagcagacagccagaaagatatctactgcagattccagtctctcttcatatcctgtcctctgcaatcgcatccatgcccacagcctccctacagaaggactcctcaggtcaatctaactccagaattgcatgtttgtgttcattgtggctctcctcatctcccactacctcaactaacccactcctaagacacagttaaatacccacagccagcaagcccttttgtctgtactcttccctctggctgaaattctttttgacatacttctactctaaggctcagttcaggtgatacctcttctagataatctttccttctgcctccccatctatctccagaatgactcattcactcttcagtgtccactacatcgtctcttgctagtttagtattgactgctctgtatttaaattatgggattgatgtccatctcctccactgccatgagatacataaagggcatagaggggctctcaaatatttattcagtgagtaaatgttgcaatgatttgagacaagaagtaagaattttaaataatcaatgtctgctttatacttccaacttcaaaaatacttatttgtttagatacagtgcatggatccaagctatctatgaatgaaatgcctgtatattttttccactgagaacgatttatatttttgccttagattcaagcaactgtttccctgcccccccaccccccaccaagtaaacaaggaatccttaaaagtttccagtgacataagacaaataatagatttctccaactagaaaacctaagtttgctatgaaaatgaaaaccttgtattacaaataacagcttagtttctaattcagagatccccacatagaggagataagaagggaattaaggactgtcttctgaatttttgttttcttgccctcacctacagttgagaagtcagatgatggagtagcctttttcctggattcatttcagttcattgtagtttgtttc

SEQ ID NO: 135116 - DNA, 1013 bp, Homo sapiens
tatctcaaacttaacagccaaacggaactctagattctattcctacctcccatatcaacatgtttcttgggaaaagttgtatcttagtaaataaaaccaaaatccattagttattaaatactaaaatctaggagtcattcctaattcctttactttcttttacatttcatcatccaaaccataaggaaaccctatcaattctccctccaaaacagatctaaaatctattctcaatctccactactaaaagccctggcttatgccaccatcatctctcatttcatgaccatttagtctactaagtagtctccttccttctcttagactccctacaattcattttccaatctattctataatgtagtcaaatggatccttaaaaattcttctgttcaaaacactctacttcctctagaagatgaaataaaacctagggcctacatatagccctatatcatgaggctctagcctaaatctctggcccaatttaatcctacccttcccccactcactatgccacatactggaaataatcctttctcattgctaaaagggcaatttatatctagggagaggattataggggactagatcataatatatcaattcaattgcttaccattcctaaatcccacaaggtgctatagaattgtgagaaactgccaggtgccagtggctcacacctgtaatcccggcactttgggagtctgagacaggtggattgcttgagcccaggagttcaagaccagcctgggcaacatagggagactccatctctactgataattcaaaaagttagccaggcatggtggcatgcacctgtggtcccagctacctgggaggcttaggtggaggattgcctgagctcaagagtttgagactagccctggctacatagcaagatcctgtccctacaaaaaatttaaaacttagccaagtgtggtggcatgcacctgtggtcccagctacatgggaggcttaggtggaggattgcctgagctcaagagtttgag

SEQ ID NO: 135117 - DNA, 1099 bp, Homo sapiens
tattctaatgtttgctttaccctgttggttttggaggcatcattaagggaatgaaaaaactaagatttggttaggatttgagtaacacatgtgcgaaatccctccccgaacagctggtattggctctcgaaacttcaactgagctaaacagatgttcctagtgtgttattttgagataatttaaaccagacttatagtcaagaactctacaaaaattgtagatttgatttttaaatgcactaaagttgtgatatcgtgccacatcttaatacatgttatatgggtgttaagcaaaaacacctgagcttgggaaagtgagcagttccgccaatgaaattgtgatatttaaaacactaccaagtttgttattcttttactccagcccagattttcatttttcagattcccctttcccaaaccctgtaacattcctgttttactgtatccttttccagaggactaaggcattaattcattaggtactttcttgatgcaaattctttatggcatttggaaagagtaatggagtcattgccacctttcttctactaaacttccaaagtactggtgacaactgactggtaacagctgagaaaaatggaatcctaaacagccttaaatagtcttctcccaacttgaaatcttccaggaataaatgcataaatgaactgggggtccataatgtggcttgcagacagacaaatggaataaggggaggcggggagacctgcgcttgaaattagcaagtttagtttattctaggcttcttgagttgaaaactgacataatctggacaattttgaggctaggaaaaatatctggatgcctcacatcatctggatatttttaacccatctctaatcggtacccttttgctggggaaaatgatgtacaggaagaaaatctgatttaatcaccgcaaacagtacctccttgacacaattgattctgcccctctgatatattgtaattctccattaatatttaaaccaaagaatcgattattttaatggacattttccatggacatacaaatattactaacaaaacttggaaattcagttaccatttccgttgtgttaaaatggggtatgaaacc

SEQ ID NO: 135118 - DNA, 1058 bp, Homo sapiens
agcaatctgcccaccttggccttcaaaagtggtggtattataggtgtgagccaccacaccaggccttaattttaattttaattttaattttattttagagacagggttgctctcttgcccatgctggagtgcagtagcaccttcttagctcactgcagcatcaaacttctgggcttaattggtccttccgtgtcagctcccaaatagatgggactacaggtatgtgccaccacatccagctaaattttaaattttttgtagagatagggtctcaccatgttggccaggctggtctcaaactcccggcctcaagcgatccttcctcttcagcctcccaaaggctgggattacaggtataagccaccactcctggctttgaattttaaaatttatttagctactatatacagtactgccatgaatatcttctcactcctgcacaagtacttctgtaaggtacattcctagaattagaactgctatattaaatggcatgggcattttaaagcatgggcttggctttaataaataatgccaaaaataacctctcaaaatgttgtaccaatttgtataatggttgtgtgatggaagatgtgaaagaaagaaagaaaagaaagaaagaaagaaagaaagaaaagaaagaaagaaaaacccaaactactactttgcattgacattgataggatatatgggggtttaccttacccacagtacaagagttgtaactgaaattggatcatttttaagggtataattccttggcaggcaaattcttagattggtgtgatttgcaactggcccatctgctaacccagttaagtaactgagaagaggggagtatctatgaggttcctttgcatagtgctcagatgtgagctccccctgcttatgttcctggtactcttccctttaggtgcagtgctattttaagtcctgaagagatgctggggtatctgtccaagcaggcttgtcaagaagggatgcttgaagaagtcccaggaaagcattttctagaagtcattggtctcctctcagtcctggaactgtttttttctctg

SEQ ID NO: 135119 - DNA, 1051 bp, Homo sapiens
ctgtaatcccagctttgtgaggctgaggcaggcagatcacctgaggtcaggagttcaagaccagcctgaccaacatggtcatggaggttgcagtgagcggagattgtgccactgcactgcagcctgggctacagagcgagactctgtctcaaaataaataaataaataaataaataaaacctaagattgtacaagtactaagtggcaaagtttttctggctccaaacattctagctactgctcattttaattgtctgaattccaggaacatgtaaattttaacctataatcagtcttctcttgttcagctctttgacaaaagccttgtgactcagtgtctgcttaccaagttttgtatcattctgggaaaaaaaaaaaggcaaaaacccttatatttcacaaggatttgttaggtgctttgtgggggaatggagaaagttggaaggttgggataattaggattacgaaatagttgaaataaatattgtgttgctactgattataataacctttgctagtttccagtgtttgacctctatagaattcaccatatacacatgcaggattttaaaggtgctatatgggcctttaagagaccaggattttacttctcagttttgtacctggtgcccacgctggaaccccaactatatgtgcctactccagtttcctctcagaggcctattatcattttgctgagtgttgattttcaaatcattatgactagttgtgaaacacttactgtaaaaagcatcctacccattttgcttaatttatctttctaattagggcattgtaatgatggaattacattctatgcagtttttaatgcattagcctggaagttcagcaatttctttttatgctgcattcatctgagcattctcaaagttacatgataaagaatctaagctctccaactttgtattaacttgatctgaatagaaacattcagtggaatccaactatcttatttgtgtgaaaagtgaacctcaccaggactgagtaaacaccattaaaagagcaataccaggctttgaatccagttata

SEQ ID NO: 135120 - DNA, 1049 bp, Homo sapiens
cagctagtgagtggtagagctacaacttgcccaggtcctataacttcaaaccctggcattttgtccttggctatactctctgtgacatctggggaattctggaaatagttatgagtgccttgtggcttttcttataactactatcatactgctctttggaaccattttgtgctagaaagttatccaaatatatattggcagaacctaaagattttgttttcagatgactctaatgatgccctgaggttggtagaaaaaaaaaaaaaaaaacaagctagcaacagaaaaagtaatgtcaaaaagtaattagagcaggacaaatggattgtgctgccatgttcaaggctgttatttttgttggcagtgaggaggaagggcactaatgcaatgtgacagatctggagcaaaacccagagcactgcgcaagctgcagagcctccaccaatggcaagctcaaatcacaaagtctgactgaataatatttgatatctcaaagagctgtttcatgttttttagaaacactaattgttttaggggacctattttcttgatttcagcttttgggaaatagcctcatggtcctatgaaagtagtcagtgtgtcctaggataactcccgtcccagcgttctgtctctgcacattctcaggctaagcagggacatgatgccaacagagattttaagaaaagatacctaatatgaaactaattggagtggctggatattacccattcagagggagaatgaaatagaaaaggtgtcttttcagtattcagcttagtattcgaaaattgacctgaagaagttcagatggtaacattctcatctgtctgaggacaggatgctttggtttgctagcctagcttacccacggctgtgatcccactgctgccaccatgtaccgggaaactgccacagccctcaagaacgatagaacttatcatcatttgcctggaaggaaatctttgcaaagagaagagtacattaactcttgcccctgtgagtcaccatacctttgaagtcttggtaattactaattgttgccacca

SEQ ID NO: 135121 - DNA, 1022 bp, Homo sapiens
tcaatctaaatgcccaccaatgataggctaggtaaagaaaatgtacatatacatcatggaatactatgcagccataagaaaaaaatacaagatcatgtcttttgcagggacatacatggagctggaggccattatccttagtaaactagtgcaggaacagaaagccaaataccgcatgttctcacttataagtaggagctaaatgatgagaacacacggccacatagaggggaacaacacatactggggcttaccagagggcagagggtgggaggagggagaggatcaggaaaaataactaatggatactaggcttaatacctgggtgatgaaatgatctgtacaacaaacttccatgagacatgtttacctgtgtaacaaaccagcacattctgcacaggtacccctgaacttaaaagttaaaaaaaaaatgcaggtagctgctggaattgaatagattttagttttttgtctttgtgggagcaaatgccagaagagttccagtggtgtttggggaaagattcttggccccattctccctacaatgtatatgtctgacagctggcctatcattctatttttagacataatctgtgagattacagagtggtttcatttaaagctatgctgcagaaatgcaagctgtgtagaaaatgttttctctttgtagcaatttgggtaccattttgtatatagattaaaaagaaaatcattttatttaattaccaatgatccttgtatcttaatatttcaccttaaagtcatcttccagttgtggccatattctatgtaattcagggagaaacaaacgctaaaatgcagaaattctagaagtataaataaatcttcactacttaatgtcatatcactgatcttcatttccctctcgctggtcatgggaggtacagcacgcatattccttatagggcttttaaaactgttcataacaaacatctattgagtacttattggtatttattgaacatcatttatatcccagaaactgagcttgcctgaaatat

SEQ ID NO: 135122 - DNA, 1047 bp, Homo sapiens
tttcatcgatttctgctctaatttttattatttcttttcttctgcctactttgggtttaattttgtctttttctagcttcctaaggtggaagcttggttttaggttgtcttttctaacatatgcattcagtgctgtaactttcctccaagcactactttcattgcatcccacaaattttgatgaattatatttttatttttatttagttcaaaatatttttctcttgagatgacttctttgacccatgtttttatttagaattgtattgtttaatctttatgtatttgagatgttccagatatctttctgttatgctagtttaattccattgtggtctgagagcaaacattgtacgatttctattattctaaatttgttaagatgtggtttatgggccagaatgtggtctgttttggtaaatgtttcatgtcaacttgagaagaatgtgaaatctgctgctattgaattggatgaagtattctataggtgtcagttatatccaaaagattggtagtgctgttgagttcaacatgtttttaatgaatttctgccttctggatctgtccatttttgatagagggtggatttatctgtttttttcttgtagttctatcaggttttgcttcaggtattttgacattctgttactaggtgcatacacattaggattgttatgtcttcttagagtattgactcctttatcattagtaatgcccctctttctcctgataactttcctcactctaaagtctgctctgtctgaaattagcatagctgcttccactttctttcagttggtgttaggatggtatgtatttctccatcccttcatttttattctttatgtgtctttctacttaaagtaggtttcttgtagacaacatatagttgggtcttgtttcctgattcactctaacaatctgccttttaattggtacatttaaaccattgatgttcaaagtgattactgatgtagttgattaatacctgctatatatttattgttttttgttgtccttgttctctttttctcttctacacatttc

SEQ ID NO: 135123 - DNA, 1038 bp, Homo sapiens
ggggctagttttttagtcttcatgcagtcgcttttcaataaaaaacaggaggttagtcttctgctggtttccttttttaactagctcagatttgtttgtttttttcctttattctgccgttacttggacatcgttttcttctcctttggacttaaattagattggctgtcaagcttttgggcctctttgtttcttgggagaggcagaaatggtcaggtgccaatgtctacttgggaagaggatcaaattgtgtgggtaggattggggtggaggcacagatcttaaactattactctatggctgccaggaaaatgcatattttctttgcaaaagagactagtccggtgttaatgctttgattgtataattaaagccatggattttggataatttctttagatatgtaatgaggcctattttagtgtaaaccgtatatatagtagaacttcgtatttttactttgtatttttgtccccagttttatcatctgggcaaagatggcaaagtagattgggcaaaaagaaagggagaagggaaccactgtggggccaacccctatggtaggtactttgtaaaattgttactttgaattcttacagcattcttattaagttggtattgtcatttcctcttccataagtatttggaaattgagatgtgacatggttaactaacttctccaaggttcataagacaaagccagtaatcaaattcaatttttggctgagataaaagattagtaagacagagccagtggctgggcgcagtggctcatgcctgtaattccagcactttgggaggccgaggtggacggatcacttgagcccagcagtttgagaccagcctgggcgacgtggcaaaaccccatctctaaaaaaaaaatacaaaaattaaccaggcatagtggcacacacttgtagtcctagctacttgggaggctgaggcagggggatcacttgtgcctgggaagctggaggttgcagtgagctgagatggaaccactgcactccagtgtgggcagcagagtgagactctgtc

SEQ ID NO: 135124 - DNA, 1418 bp, Homo sapiens
aaaaaataaatttgcctggcttgatgatatgtgcctgtagttctagttacttgtgagggtgaggagagagggtcacttgagtgcaggagttcaaggctgcagtgagctatgatgatgccaccatactccaggatggtgacagagactctgtctcttaaaaaacaacaacaaaacaaacctctgacaaatacagaaaataacagcatacacctgatagtcccattttataggcaagtgacatctagtattttcatagtaaaatatcatgtagtgtcatctgatactttcttctttttactaaaaaaaaaaaaaagttacttgcaagctactcagttgatttcacagcttactgaaggggcagccagaactttggaaagcacaaaaggtgagaaaactgaggctctggtggttaaatgacttgtccagtgtcacatagcaaggaagaggcagagctgagacttgaaccagagcttgattccaaagttcttgctcgtactatgttatatagattctctattaatgaaactgaagggaaaaaaaagcacaaataacctttaataatgattatacaaaatgtaaatttcccaaagcagaggctgtaggaaggggcagaaatattcttcctctgatcattgcctcagcatttttcagagttgttggccatctggagttgttggtccctctctggggcagaatacaactgacgctactcattagttatgctgggaatggacagattcccagagcacttacatctcattactcacctagccttgagctaatcttggctttttaaagtaatagctgggtgtgagacctagcttctgcgtgagtgtgtggcctctcaaaagtgtgctgttgcaatgtgacttggagttcatgctcagatatgggaagggctgtatctagagtctggctccagccctggcatttctgacctggtcatggtactgagttaattttatggaaagaaggaatgatgtccctttttcttcttggaggataaggctgtgtcaaagggaaaggaaggaaattaattcccgttgttgtctgctatgagccatgcactgtactaggcacatttgacattggtttttgaattaattctcataacagtgctgtcaggggaacagtattatcctcattttgcagagaagtaatattgaggctcagagagaggaaatgattcataagcagtcacacagccaggtagtaatgagattaggagagaaacttcattacaccttaattttaaaagtcatacccttctccttagagctgggttgtaaccccaagctgataagacagttgaggaggggacattcctaggccttggaaataataggttatatcagaggaagcccatgaaaatccaacagtgtggaaatagagctgcttctttactcttgtgcattgag

SEQ ID NO: 135125 - DNA, 1720 bp, Homo sapiens
ctctgtctatgcttgcctctacccccaccgccccaggcggcacaagtgtttggccacacaaaactagagatagaaaaggtggtaaaaacttcaaacttttctaaattctccaacagtttatttcttgtgaatttcttccttctttaaatactccattttaagaaaacaaaaaaattaattatctaaaggcaaagaatggaaagcaacctttgtgttccttataataactgacttcataactctctccagctgcgttatgggatgtgtataaaaagcttctgttctgagaacaaaggagcacgtgcagaaatgagacgaaaaaatccactgacagtattccattacacaaattacttaaaagattttagtcaagcccctcaacagattcaattttaaaatggcttttagttaaaaaaaaaaaattgaaagtgcttacccagtaaaagaaccgaagtagtcctgaactgttacgtaagactttttacagttggatctttgtcaaaaggggatgggggtgatgggagaaagcagcaacgacaatcaaaaaagttcgagctgctgtggctagaggacaacttctgtgtttccagataggattcttgctgtagaaatggaacttccagccagcacagcatcctgtcccagtagagaaatgagtttgtcagttaaaacaaaaaaaaaattagatactggaacccaggctagacgaggtattgaaccgcgccagatttccttgcagccctgtctgctcagctcgcattgaactatatatgacccagatgatggacagaagcacatttagtcatgtgcacactggaagaaagcggatttgctggtccctggcagtgcaggggtttgtcttctgattgggctgtgccctgatcggtgaaatgtgaagccctcaccattcagaggccgtaattcaggactggcagtttgagtgtctggctgcctctagtcactgagagactttgaaggtgttgcttttgtttggtggcattacccacccagaggttgcttacacctctctacttgtgtcagaagaaatactagtctttctgaaatacaaataggcagccgatttttcctgaatcctaaatcaccctattgttgataaacttggctctaactgaaaccaattatttgatttgaaaatttattgtgatcctaaccaagcttcatatccagaccaacccttggtcttgattttataggtttgataaggtaaaaataaaagtggcatatttgactttgaagcctctatatgatataaattgctcttaatgaaaattggatagatggacaacagagaagtgaagttttagattctggagtgtttggatgtatgaggaagaagctttatgtctttttatcccctttgtgagactgtcactcttgtcccagtcctagtcacattaggggttgctgggggggggaagctatgaaagcatggaccctactgagctgtgacatagcctttaatcatgcaagacagccacggtctgctctcttcagtctgtctgaactagggtccttggggtttattttccatctttctgagccactgggaaaccaggtcattatacaggactgtcatttgtgacatttttgtttagtacatggcagttgctttgtttatttaatgcaagttgacacttctttaaagtttcaaaacagtaaagttgttttgtgagaccttgactctgatatatgaaatcta

SEQ ID NO: 135126 - DNA, 1068 bp, Homo sapiens
ttattacatgtcacttgtgttactaagcgtatttttttcctgacattttatttataaaatgctctcctttctaccagagtgtacagctaatcaactctggatgcttttgatatttcttactgtgccaagggcattgaatgaagttccctgtagtgagaaaagcgagcacatgggactcgtgactttatgtactccaacaatagagcttttatgacattggaggtggttaaaaaagctagaagtagctcttaaacatggcatctctgtgttgccttttttttttttttttttttgtattctcagagctgccaggagtgcatcgagcctgtaatttcctgttctctgaatcccccatctttctgcagctccaagctttgtgtcccacagcctgtgactctgtgctaacaaatcgctattgtccagtggggcgaatggtggctggaactaaagaattgctgtctggtttctattcaaatccaggtagcgagatatatgaatggacttttcgaatcgtcatgtgaataacgtctgctcggcatgaaggctcagagccatgctaggaaggattaactcgtaggctgaccactaacatcctttgtggtacgagggagaaacattcccaagtatcattttattcacacttaattttctatcccatacccccaaaataaggctagctatttaattagttggctgcttttctcttaatttttagtgtttctgttgataatgtgtaagtttgggaaaatgctaagtagcttttcacttagaacactgttattttctctttaaagttttctaccttacatttattatagcatagttatctttatagcatagatgcagaaagtaagagagagcttgttttttcaagaaaacaaccctttaaaatactttccaacccatgaagggaaaaatcctccttttttcccccaagtgcattctacttattactttgcatttttctcccaaagtccaaatttatgcaaagaaaatagaaacaagttcaaatgcaatgcattaaccaaataaaacaagtctgcttcaaattaggaaccaacctaagca

SEQ ID NO: 135127 - DNA, 1052 bp, Homo sapiens
atctaaaatctaaccctacatccctaagtataagactgaacacaagagaacatgctgattatgtaagccaaatatgacatgagattttttttgacaaagcagcctgcatgggacagcatggtcacacatcggctggtaaagcaatctcctgtccaaatgtttcattttattccagttgaattgctgacatggccagcattaatattttaggatacttgtttatgaaggcttgccttgtgttttgaatagtatctatctgatagtctacaaggagtcacattgtgagtatttaaggggaaaaatgtaataataatagctactcttttttggaatctctaccatgtgcctggcaccttactagatactttacatacttcactgcgagccgttctatataaatcctgcagggtgtctatttccccattttgcaggtaaggatactaagtttcagaggggtaaattaatttgcctaatatcatctagctagcaaagttgatactcataaacctactcaagaccaagtgacttctaggtcctggttttttgttacacatattgtccattgctgtgataccatgaaactattgaattaattgtctcatatgtttaggaagaagtttttgacactaaattagtaccattctggagcatttcacgtactctggccatgactacctgtcttccagtactatctaatattctttgtaacttcttcattgcaaccaagggggaaaaaaatggacctggacctcttttctcatccttggtttcaaatgctttttttttttttaaaggtatttctcaagtattatggcactagctatcttgtcatacttgtcattgtattttttacttaaattttttcatgtccagctggatgtgtagttgaagatgggtatgctggatataagcatagcccagatcagcactgtccagtagaactttctgcagtgatagaaatgtcttatatctgggctatcccatatgatagtcacatgaggctattgagtgcttgaaatgtggtgtgtataactaaagaactgagttttctg

SEQ ID NO: 135128 - DNA, 1062 bp, Homo sapiens
tcctccaaaaggttatgtggtatatccagcatttttcacttatttggcatcattaagaaacactgatttctcattcctgctggattattatcaactttaaaatgaatccacagatgtagtaggaaaataccttgcccaggaattccttcttaaatctttgattttaagacatgaattttctgtgttttcaaattattttaatttctcattcttggacagtattttaggactttgatgttgttgttttaatcaccaagaggaggtcgtagaaatcttactcagaagagtctctaggaaatattaattcttattttaagaaaagggttctttttttttatacttaatggtactaactttgtatcagcattaaattataccttacattattgaagtctgacattccacctcacttttcaaataatactttttctgtattcattcagttcattcaatatttatgtttctaagatttcaagttatttgtgcagtgttgacagtttttacattcatatgtttgttttaatttaaaatttaaatggagaatggcctgtgctatgaaccagcctggaacccttctatttccattctttgtggtctcagacgatgaacagaacctcaagcccttactgagtgttcacagaattggcatttccagagtgttttccatgtaccagaaacactggtcagtgtttatatacatatccttgactctgaaaacagcctggcaggaagggattgatatttgtattttatgaatgaagagtctgagacaaagaggggaagtgacttgtacaagatcctgtagtaaataaggggcagagccaggattccagcccctgttcacttgaccctaagactcatgtttcttgcaccaagcaggcataagataggctgagaatggcatccgaatttaagaatctcacatgcatgtttatcacgtccaatttatttgatggtagatttgggggttaagacgtggtcatcatagaagtcctttggctttctaaatttttttttaaaaccacagaagcttgtgggtagtaccatttgttgcactcggtc

SEQ ID NO: 135129 - DNA, 1047 bp, Homo sapiens
agtgcagctgccaaagctcataatgtttaatttcagcactgtctgtttgccagagtttgcagctcaatatttttttctgtatggatcaaattataatcacatatatttatcttattggggtaggagaagtaaagagttattgtttgataaatttgccgttttcctagggaatggtgctgttttgcctgtcacatgcttctgagcattattcccccactgattcctaagaacttattctcctgggtgaattcttctaacttgtgacacagaggggcaattcacaccttgcctgtttatattttgcaagaaaacccttctcttagcgtgggtatctattcaggcagttccatgtgctacattccatccatttgccaagtcttggactcttatccaaagtacaatatttgagtatacaattacacctacacgtaccggcaagagcgtactttttcctagcctctcttggagaacgcttgaagccagaggagcaaatccagatgttctggattgagtttggcaccttcaattgagaattctagatggaaagatttcatttggaagtgtaccaggcttgcccagcagttgcttcctgttgctaaccatcatatttttatgaccaaagattctagactgcctcctttgttgagcagaaagaattacacactagggccacatgggaagtggcttctcatcatttgagagaaatatcagcaggcatgcagaagagggtagccttgctattgggaataaatctgggttgagagcaggtacaactacagctgcagctctttagccagacctggctttatttaaatttcaaacagaaatctttgacatcaacctaagtgaaccattattggctgtctgccacctaacagtaccttgtacaaggaggaggtgctctctgactgtattcagtcaacacttattgaacaccttctgtgtgtgccaggcaatgtgctagatgctggtgatgaataaagtattttttcgagaagttacagtctggtaggaggcacagactcttagacagataaattacaattc

SEQ ID NO: 135130 - DNA, 1080 bp, Homo sapiens
tgtccccagaagtgcttggtttgcatgagcatatcaacagtggtgcacattgctaaatatgtcacatcagctaggttgtgtcatttgattgaaatactaagttctacagttaacgaagggtgatgatatgtacattattcagacttaggacgttactccaagagaaagtggtgattagggttctcttttaatttgtatgtatatactggggctaagaccgtgtaggaatctagctcttttaggaaggttgtcagcctctaggcatgggagcatggccttaagatggttgtgaactttaaggaaaatgcaattggaatgggatttactcagatacctactgacagccaataaaaacatttaggtttaaatattcagccaaatattctctcaaaactgatttagaaatctatactcattacaggcttttttcaagaaacagtctagtgtattttctttaggatttaagtcaaaatgaattccatgtttccctttgttctcttttacggtagcattctgagtcttctgtccctttaaaaatgttgggaagcttgtatgcattctaaattgtaaggtcttttgcatgttacatagactttctctgtttcatggggtcactgtagccaaaatacttatgattgaaatagacattggcaaactataaagaaaacaggaaagtaaaggctggatttgattattagtggtgaaaggaatactatctgagattagaatgataagtatgttttggagagaaaggtcacgagggaatcctgtgggctgcaataaatgtgtgctcatattttgatctggatagtagttaacatatataatacatatgagaaaactttatcagacttaagatttgtttaccttaccatatgtaaattatatctcaaaaggtaaaataaggctgggcatagtggctcatgcttgtaatcctagcactttgggaggctgaagcaagcagatagatggcttgagctcaggagtttgagactagcctgggcaacatgatgaaaccccgtctctacaaaaaaatacaaaaattagctagtatggtggtgcccacctgtagtcccagct

SEQ ID NO: 135131 - DNA, 1317 bp, Homo sapiens
attgaaatctttgactacatgtatgtgtgtttatcataattataccactctgtctcttcatcatgaaaaagaatttttttttttttgcagaagtttcctattggccatctgcaagatagatgatatagccttcaagtcaaaatctgcctgatgagtcaaacatcttagcctcagggatgcacccaaaactattgtaaatggaccattgacttggatttgggaggctttcctgaagcatttaactaagtaagcagtactgagtggtgttgggttaaaatccgtccatggtatgaaatgagaaatagctgtaaagtgatctaaactctgtgatggtcctccagggtctgacatttatcagctgctgctacactttaccgcttttctttaatcaaagatgactaccactggatggaagaggctcgaggaacccctggctgctctctggggaggaatttattttaattgccagtaagaaggtaggaatgattttaataaagatcaagaacctcctaatccacttcagcttgggctcctggccaagtgtccatcctcaggagagagttggtgtcagctgctgccttgtgtcttgaaggtatttcagaaaagccaaaggcattacagaagcctttcctgagttgacaggcaagagtggcaccaggaatcaagggctgacacatgtcatcagcctggaaaaagtggagcttggacattaatgatggctcttgtgaacactcagtgtgataaagccaagaggacttggcttggggtttagtttgcataggcagggagttagagcttagagaacacctgccaagagttttcactgtcccggctgttggtgatgcatccttcatccttgacttctgtcactcctttttagtgggtgatggtagaaatgctggatgggtaaggaagagaggcagcttggtcatacctagcacatctccctatttgcttgttttcttgctgttgtctgtgtagaactaaatttgtatggcgatactcgaggctagtgttttgttctgtctatatttgaaggcacactgggcaagagtcataggtgctctgtttccaaaaatgccactttgctagtatccacacaaatgttttgattggcagttgtgagacttttttgctaatacatctattagaagtattgttttcaaatcctggttctgccatttagtagccgtgtgacttttggcaagtggtttaacctcaggttttcatctgtaaaatgaaggttagtgagtaattgtatttatttatatttttttatttttgagatggagtttcactcttgttgcccaagctgga

SEQ ID NO: 135132 - DNA, 1367 bp, Homo sapiens
atggggatgtaaatgttttcatagtcttcctgggacttcttgatatacttggaagaaataagcataaactcaataaaacaatgtatctggatgattagtagcatgtttgcttcagcagcacataactaaaattgagtgattagtagctaatagaagaggagtcatcgtctcaggtgccgtctgcctaggtgtttcccaagcaccatgcaggaagcatcactataagtgtttgggggtaatgctgctagccgtgaggataaattcttaagttatgaagataacaacagcatgtcagtgtgaattcatgtttctttttgccaaactgtgctagttttctgattcatccttttactgattcggcagtagaatcctagggattgtttttcctgtatataaaacccttgccatcctggagcccactatctgactagggagctacacgtaaatataactgatgacaaagaggatgcctggtggattggtgtgaactatattaagggagaacagagaaaagaggggttaattctgcctacaagtgccaggaaaggtatatctaagtaggttaacctggtttgagctttaaaaggttagttgaatttttactagacagagaaagggggctaattccaatggaaaaccatgtacaggaaatcttagaggcagaaatgtttaggtaatggtgagtagtgagattaatgtctcagagtgtcagttaactcatctttaaaatgtgagacaaatagcacttgcccttcctgcacacacagccatgaaaatccaataaggttatgtatctgaaagagcatgcaaatgtaattgcttctcttgtctcccattgcttttgtttcatatgtgcgagaatagaataaatgaaataccttattataataaacttttccaaattggatgattctttggccttcttgctttttttccctttaaaatgaccatagttaaaaaatttcatgtattaaatgtttggagaagcagtatttacagcatagtaaagagcagattttggagccagaatcgtgactttgaattttactagctatgtgatctttgacaaattacttaacctctccatttctttgcttccttatctataaaatggagatttatatgttattttaaaggtatttaagttgttaagataatttacaactattatttctatgttaataaataaaattgcttgttttccccagtatttggcttccaggccatatatgctaataaaaaacctgttcttttatagttaaaacaatctctgactagctgttgtattgtatgtgtacatatatgtgttttaaggacatatttggaattaatgctctaccacttttttggtaaggttttcatttccc

SEQ ID NO: 135133 - DNA, 1602 bp, Homo sapiens
ctgatttttaaaatgtgatgtgatatccagatatgtatttaattcttcctataaaatatcatttccttaaatctagactattgaaaaaggagaaaagtactaggaatttagagaacttactccatgttagaaccaaggagaacaagaaaagctttagctagtgttttggaaatagtagcagctcccactcacagcagtagctgctgcactcaggcgactctctgcacatgcttttgcttcctttgggttgtttggtccgcagtttgcattcattgatcagtgagttgattcagactcaaacccaccgacagcaatgaatgttgagtgcagccatcagtgttttcagttggtggggttgcctttgccctccctggctgactcctggctcttcttttccatctcagttctttgaagtctgtgtgtctggcttctcccttagtaaccagccatctgcatgattgagggcccacacaggtgtccataacattgacattggagctgggaggttattgcagatgaggaagctgtggttcagagaaggaaggagtgcttggagaacctcacaggtagcactgcgccacacaggcagtgcttgcatattagtacctgtaaaccacagctgagggacctgcttttcctctttgttttgaactgagaagtatgagtgcttttttgaggtaaattagcagattatgttggagtttaataataacagcttacatatattgagcatttgctgtgggctagtaatggtacaaagcaccttatatattatctcattgagtctcaaaactccatgataggtactcttagcctctgttttatatgtgagaaaactgagacacttgcttagggggtcaaataactagttaagggcttgagccaagattcatcccagatctgactgactccagggctaagtttttgcttgaatttagcaaacatttaaataagcatatgtggggatatgtgggcactagtaaggcaatagctcatgctctaactgggatatcaaaaattaaccatattaactataattcaaagtgaaatgtgataagaactgtcacaattggataattttgtgctatttttgcttattaaatcctccccttgcccctaattaaaaattttgagaggatgtgggagaaatgggagtaattatttaactggattttattccaaaacaaaatacgtatttttaataaatttttacttgctacgtcctgtttctcaccagaatggtgcatatctaggagacatgtaggtacattagatatcatcatggactgctccttaccttgttgaaatgaaacactttttttgtaaaaacaaacaaataataataaaacacacaacagaaagcaaggaacagtgagcagtaggaataaaattcactggaccacatttgggggattgcaggaccatttctggtgaactcatgtgacatgtgaaggtacagcttgctcttttgcttcaggaaatgtagtgtcgtctgtaaggaccccaaggtacagtcaacggtcagtggttttttcaaatcccaaactcaccgacagcgttgaatgttccttggagtcctctgaaggctggcctgatagccct

SEQ ID NO: 135134 - DNA, 1113 bp, Homo sapiens
tgtctaccagtctcacaaaaaactcttctataaagaccccctcgggccgggcgcggtgactcatgcctataatcccagcaatttgggcggccgaggcgggcggatcacttgaggtcaggagtctgagaccagcctggccaacatggctctactaaaaacacatttcttctaaaaacacaaaaattgactgggtgtggtggcgggccagctacttgagaggctgaggcacgagaatcacttgaacccaggaagcagaggttgcagtgagccgagatcgcatcactgtactccagcctgggaaacagagcaagactgtctcaaaaaaacaaacaaacgaaagaaaaacacacacaaaaaaaccttttggtaatttctttgggtaggttttagttttttagatagcgtaaatccaaatccattcatttccataaaacatcagacacaatttgatgtatatttggccaccaaacatggtgcaaaattttatgtagtctggagatacttaaaagcagcacaaatgtgactctacctgtctgcactcagcagaatagtggcgatttcaggtggtgacacaaaaggttgggcaatagttgaaaagtggatgacatgaaatgtggtggtgggatgggggcaggaagccgatgttaagctagtgaactttatttactttgcttccagcttccagtgacccaaaatcacctcgtctagagtagggctcaggaatttgccattttaaaagcaactctagatgattctggtgtacaagaagtttgggaaacactggcttgaacctgatattttctctgaactctcatagttttctttagatttttcttttggctttgatttctctttctggttcttgtctcattaccccatcacttctccttcctaatttgacaggaaagccttgtcaaattaaggcttgcttaattgtcaaggctaatttgacaagactcttctcttactgtcttatttgacttttgctatgagaatctgcttcttcttagacttaagtgtatgataaattattcatgaccaagggccttgtttttctttctttaacatgggatttagtggcttatctcatgttacaggatttagagagttgat

SEQ ID NO: 135135 - DNA, 1046 bp, Homo sapiens
tctccgaatatcctgggttggagtatttatgcacatcagacacctgtgtgagcccagactaccacacatccctgaccaatgcaaagatgtgtgggaaagccaagcaaaaagtaactggaacagacgtgaaggcctgaagtgtgagtgtgctccccttatcctgaccatagttgcagcagcaggtagtgaaagagctcaaggtggttgattaccatctctgactaatctttaatggagtaggaagctatacagttagaggggtatctcctgcaagtcaggcttcaaaataaaaaggtggggggaaaaaccggagccatcaggaactacacattgcagaggagacagacttggtggtttagtgcaggaaagttagtaaacaaaacaaaaaacaactcatcatcaccaccaaccttagtgggggaaaagtcagaatccagagttgccaaaagcacattgttttaaatgtttagtatcacaacaaaaattaaaagacatgtagagaaacaaagtttgacccatactaaggaaagaaaaaaaaaaaaacagtagaaactgtctctgagtgatcctaaatgttggatctagcacacataagacttcaatgcaactattacagatattccagagaaataaagggacaacttttaaagaattaaaagaggaagtgtgatgacagtgatctagtacatagagaatttcaatagagaaattataagaaaataaaaatggaagcactggactggagttgaaaagtataactaaaatgaaaagtagggactcagcagccggtttgaggtgatgaaagaattggtgaacttgtagatagatgaattaaaaatattcaatatgaagaacagagaaaaaagattgaggaaaaaggaacagaacctctgagatctgtgggacatcaagtgtgtatgtaatgagactcatgggaggagaagaatgagagaaaggggcaggaaaatattagaagaaataatggcaaaaactttctgaatctgatgataaacattaatctacagatttaagcctaataaacgcca

SEQ ID NO: 135136 - DNA, 1072 bp, Homo sapiens
attcaacttggcttcactgtaatcttggttaaattacttaaactctctgccttccttttctcatctatgaaatgaggacagtaaaatgtatttttattttattgggttgctgtgaggattaagtgaatgtaatatatttaaagtttggaatagtgcttgacaaatggtaaatactattaagtgtatactgttctaggctatgtagtataatgttgaaattctcagtctttctgcactaatgggctgttgaaactgttttattcaattaagctggcctgtgtttcttaatgacacaaaggtgttggcaggtgtaagttactgcttcaagtaaatagttcagatgagattgggcgtgttcagagtgtatgaccatagactcaattaaatagttcagtcacaggaatagaagagctcatatgctgctgactcttttggtcgggacttctttaccatctcagtgactgttagggtgttttggtcctcttccccagccaatagcaggtaacctcccaaatgaccatctgccaacacatttaacctcttaggagactgaacatgttaaccttctgcttatttaaaacagatactcgaattacacactttctttttggtcaatagcaaggtcttacagaaagcatactgaagaaaaagtttgtagaatttaaaatctgactattaccatggattcctgtttactcagactttaaaaaataaagtatattctaatgatcaaggacctatataaatgatatagcatatatataatgtgtataataaatagtatgtattaatatatagtatatgtcactatatgtaatatagtgtgtatgtatatatatttatatgagtattttaaaagagacttgaaagttaagtgctgggtgtggtgggtcacacctgtaatcctagcactttgggaggccaaggtggacagattattttgagcctaggagtttgagaccagcctggacaacatgatgaaaccccgactctaggcgtgtacctgtagtcccagttacttgggaggctgaggtgggaggatcacctgaggccctggaggttgaggctgcac

SEQ ID NO: 135137 - DNA, 1019 bp, Homo sapiens
aattagcagtgttaaatagaatatgacaggtattaaatgaattgtaattttcctgtgaatttttattccaacggacattgccatgataactcataattacttgtgctgttgtatattgagctcctactgtgtggcaaggcctatggtaagcattttattttggtaacttgtttaatcctcattacaattctgtggtaaatgctattatctgtttttatattgaagggatgaaatggaggctcagagggatatgtagtagctaaatgttagagctaggattgaaacccaaattgacttctgagtatagatttccccccaactgtatgatacttcatatttggagtcagcttgaagtaattcacaaattgtaattttttttcctattgttttctctttaggtttctgtcaggatgaattggcagagcttgacccaggcactagtaagttctcaatgttacccaatattctttggtaagaaaaggatgtgtgtgtacacttttaagtgaataacttaaggtgtcattgataagccttactttattgactctcagattttatttcactttaatttgtaattataggaagggcactctgtcttttctagttatgctttcttctgatattattcagtggccaggatctatctgtttaatagaaagttggtttgctgaaaatttctgtttaacaccagtctccttgctttgttctccatccttccatgaaaccaacaaaaataaaaattgtactttgaagccaggcgtggtggctgacgcctgtaatcccagcactttgggaggctgaggcgggtggatcacctgaagtcagaagttcaagaccagcttggccaacatagtgaaaccctgtctctaccaaaaatacaaaaatcagccgggcgtggtggcgggtgcctgtagtcccagctactcgggaggctgaggctgaagaatcgcttgaacccgggaagtagaggttgcagtgagccaagaacatgccattgcactccagcctgggtgacaaga

SEQ ID NO: 135138 - DNA, 1035 bp, Homo sapiens
gctaatttttttttttgtatttttaatagagacggggtttcaccgtgttagccaggatggtctcgatctcctgacctcgtgatctgcctgcctcggcctcccaaagtgctgggattacaggcttgagccactgcgcccggcttaagttaagttcttttgttcccatttttagatcggggaaatgcctatgggaccacaattagtgtttaaatcacaggaatcctacaaatgttattccctttaaacaatttctcctttctgtaaaatgggggctacagtgggatggaagagattaggaatgatttatagtttatccttctagttttttttaaaaaatctaagaatcttgataaccccttaagggttcctcaagtgttagcattgtatgatttgtaccccctattatacacaactgcaacttttgataaactcatggactttagagctgaaaaatgatgctaagaaaattgatctttcactgaggagaaaatctaagtacagagggagtagatcacttagccttatacaaatggcttattaatactgaagcaaggcatcttgcctagtatatcactttattgatatcttaatattagaaacttgctttaacatcaaagttggtatatttgcatctctgtataaagagagtttgcaaataggaatttaggtgttatccttttcaagctttggggtgtttcgaggaaataaggttgcaaaaagtagcttttcaattgttggatttgtttatttctgtaatttggtgctattaatgtatgctaaaaagttgaaaaggggaatcaaacaggatttttgagtggattaggaaattaaattccaggaagagagaggagcagtcataatagtctaggattatagggtgattagatgccttgagcttgatctagggatatttgagagagaatgaaaatgtcctggtgattgactatattattcgaggggactgttgggaagggtggtaaagtgggagcccaggaggagtctttggggatctctggcttgggggatgagagttgg

SEQ ID NO: 135139 - DNA, 2044 bp, Homo sapiens
tgaaatcgtgtgagcaataaggttgttcagggtaaataaaatgagatctctgaaatactcttttgcctgaaatatttccacggtaatgtgactcaacctctgaaaagcagatctttgcagaaaggagttactgtagtaatggtagacaaacttcagcagtgggagggcaggggttaaaaattatttcagcaaattggtaggatgtagtgataactaggtgcattagagcctgagctttaacgttagacttgggtttaaatcctgtctattcttgtgattttttaatgtatttttttgacagttgagtggaaggggggtggagatactgggtggagggtggtaaaaggatgtggaatcaccacattgattattggagaatgaaatgaggtagtttatggaaaacctggaatgtagctgtattactttacaaaagtttctgagttaatttccttatctgtaagtaatgttaatatcatcgatctcataggtacagcagaccagtttaccacaatccaagtcattgaaaaccagtttcccagatgttcagtttacccagtattccattcaataaaagacagtttgctgaatctaatctgtagaccttacagaacccgttgttcatctcgtttttcttaaatgctccccaccatttttttcctttttgtttttcccgtttcctatacatcatttctcccccatgccctgcagcccagacaaggatgtatatttctaccagcagaggtcctctctgcttcagctctctccagctgcagtgtagagacaaattgaacatcttaaaaatgctggtattccaacggtcagttctgacttggcagaaatccttaaaaggtaattaactgtctcatcaatatgaatttttataaactgtccaaatatttaaaacaaatttttgacaaatttagagaattggctatttggagatttggcaatttggtcagttgacttggaattatctcatataggtttggaaaaatttggcaatatatgtaaaataaagtgcctattactcacaatggtgggactgtagtaagtactcagttggtgttccttttcttgaagcattcctactctgagttggaactcctcctcccaaggtttttctcccctgtgggctctagtttgacaatatcaggtgataaaggctggttatgaaccacctagtgactttcttttccattacagagttgttgaatttgcccaaatgaaatactttattttggcttggacttgttataaaatggtccttccttccttggtgccctttagggtttgacttctcagtgatttaagatatgtgccccttttctgtagcactttattcccagtcttgcttgtaagtagaattatgagccttaggagagtagactgcagctttatcagggtaaaagcaaggctaggtccctggaggttcttagtgggaagtattagaaccagagcaaatgctcctgtctctgatatacaggaagcccagcatccccatcccctacccaaagtctctctctggaggtctctaaaaaggttttctggtaatatccttaaaagggaagggaacaagtagttgttgaacactcagcactaggcacagagctaaactaactcatgtaatcctttccataacttttctttggataggtggtgatattcccttattatagatgagtaaactgaggcttagagttgaaaataaccttctactaaccactactctgctaaaccagtatttttaaatcttcagtttttcctgtatcaccacatgatttttgtcattttctaatatattgcttatttaattttttaaatattgaatagttaacattctgcaacccaacatttattttaaaatgaatttttttattagcttaaatgaaaaattatttgccacaagtagaaagtaacaatgaaaaaaatttaatgaaaatagaattgtgttaaattctaaatgctattgtctgccaaggtctctgaccaggcctttgatagagagattagtaagcactagagaggcactagaaaaactaacacc

SEQ ID NO: 135140 - DNA, 2369 bp, Homo sapiens
ggaatgaaggcgttttgagttactcaaggcaggagtacaatgtcttttatctgtatcctaagcactgagaattggtgttccatgaatattgaatgaatgaaagaggcaagtcaggaatatgagccttttgcttatctcagagtcccttgctggtagtcagagtaagtctacaaaatataagggaaaggaatgtgcttttcagctacttgaggaaattggggccaatatctaagtcaagcagtgtgtttaagctaaatccaaggtttgataggccctcctggaactagaatgtagtttctgtttggaaacatggttctcctgtaatttaaagtgactagatatcccagattaagacgagatggccaataaactagtggctgtttgcttgactgtattcgggaatgcagtttaggaaaaggtggcctttgtcccatgtacctttttaaaattctgtctcacaaaagaaatataagagctaggtgtccaaaatttataaaatacagaaggtgatttcctaatgaaaagagagatagtgagaaagatgtaaaagaggataggcagtgtgggttaatagattatgttagcaaagtagtttgaataggaaaagactttagagaggagcccaaacattgaggagttatgaggcccaggagatactttatgcctaggatctgattctagctctgtctcaaatgcatgtctctgtgggtccacctataaaaatggaggagctaaattagataatccctgaaaggattttccaggtttatgatggaatgaattgggcaaaacaggaagttgcaatttagaaaagttctgcctaaagcaaatagctgtggtactgactgcccacattctctgggatgattttgatgtcagatactgttcaatcatccctctgagaatatttacatttaccaaactgtttccctgttctgctttagaacccttggctgctttaaagtctgtgagatcccataatttatctgtaaatttcattctttgagtctgccttatagaaatgtttacagttacagttctgatgttatgataatttgtaatgtaaatttgaaataaattatggagtatttttgttgtttaaacaagatcacttttttcatttataacccctccatgccacactttctcttttttgagtacagtttcatttgctgagtcaaactcatagttaattttagagtttttcctcattccttgtaatgggatatttatctgcaaaactcattcagcattgagaagagtgctgtcttcctaagattaaatgcgcttcatttgagaacgttgattcattaagggaaattgcaaaacagaagggaaacttccttaaatgctgctggtctgtaaaaagggaacccagcaggaaaggggagaggtgcatgggggaggggtgaagtgaagagtgtagcagggtagctgcagttgaaatattcatcaatcattttactggcaccaggaaaccaatcagccttttagggagagaacttaatcaatcacctaatgtgggaaaatacaattgctttcccacaaaaaaatattccctttcttggtgacagatcgaatctgagagatactttggttccctggaattcagaactgactgcaagcagttgctgaaagtactgctgtgaagaagtgcatttaacatttggagataaaatttcctatctgctgcgagccttttcaaaatatttcaaaataagtttgcttttcgtacagtgtgcccatcaaaaaataaatactgagcaagccgaagtgtgtgaaacactgtaaatttattctccaaagctagtttcagagcatagataaggactcctggctggagaatacccgatgtttcaaatgccttgtttggaaagcagggttaaagcgttgtctaaggaacataccctgggaaacacagttggaagtgcttgcatataaataaaagcaggaaagatacagctgcatcgtatatttaggttttaaatacttgtgatttctgagggtctgtctgtgcttgaattgcctgtggcccttaggtcctttggttcttaagatgtgagctgcttaagaatccagtgtttttaaaattaatgcatggttactgaagagaatatggaaaacgaagggaaaataacctataatcctaccactaagcaactttcattaacattttcttctagacctcaaatccaaggttttttttttttttttgcatttttttagtcatacagtatatactattacgttttctgctttttgtttaattttaaatgttttttctcctgttataaacttcactcattgaacatcaagttatttgaaactttcgatagctgtatgacagcccattgtttttcattgctggc

SEQ ID NO: 135141 - DNA, 1026 bp, Homo sapiens
catgcacttgtatttttcaaaaagacttttccacttaatgtcatccttgatgaagcagtaaaaatgatgattaaatcttgacccttgagtacatgtacttttgatattctgtgtgacaaaatggaaaagtacatgccaagcacttctggtgcaaactaaaatggttgttttaagacaaagtgcttgtgtgattatgttgtgatctgagccagctacttttgttcatggaatacttgaaataattaaactatacttgattcagccttgggcatttggcagactatttttttcttaaacgaacagtgagtctgtcatatcaaggaaaactgacagtattggttgccagtaaataaaatttgagctttcaagcaacaattagttttggaaaacttgtacttgccactaagagcttgacagcttcccaatgattaatgtcttctgatgagatggatgatgaaataaatatgattttcgatgttatgaaatgtgtcaacattttgaaaatctgaatatctcagtaattcagtattttccaaaagatctatgtgtgatattacaggatcctacacagctaagagatctgttcaaaatgccagattgatcaatggattttaatgtaacggattacacatagttcattgatatggttttaaactcacactgaactaacctttaagaaagtaccacttaattgagttttggtgtagtatcaaagaagactatccacaattactttaaaaagcaaatacttcttccttttccgattataaatctgtggggccagattttctgcctgtgcttcaacaacaacaaaaaatcacaatatactgaatgggtaaacagataggagatctagctgctaggattaagccagatattaaggagattagcaaaatgtaaaacaatgccactcttctaatttttatgttttattggacaattttatttttcataaaaatgttatttgtactaacgtgaatttattaaatttaaatggattatcaaatattttaaatttttcatagg

SEQ ID NO: 135142 - DNA, 1020 bp, Homo sapiens
agtggttgtcatttgagaaagcaaactgagagaaaatacgttgtgaaaatagcctactttgaaacttcatttgcattttggaatttttgttcttaaaaaaattataggaataattgaactcccaaatttttatcttgacagaagcaaactggccaaattcttacgtctaaatagaaaattcctggatttcctaaaatttttttgctttaaaaatttcgggggctgttttaatattgacagtcacgatttcaaaagagaaatgattctaattataaattcacaggagggcttcaagtgttctgagtttctttaaggagtgtgtgtttgggacaaataaagttatgcaatggagtagttttcattcagggtagtttgtggtttctccatcagcattatataatctcaaatacagaatcacggattcttacgtcttatactaaataaaccatacaattcgttacattaagaattaactttaaaaaagtgtctttaaatgatgaggcctttggattctaattgtaaactctacacccttcaatttgtttacaccagagaagctattcaagcataaaccacagatggcagtagcagtatatttttctgtttctggactgattcttgcctttaagttggtgtcagttctatgggccctgctgataagtcagctggcaggtgtaatgtttctaaaaccaattccctgggcagcaacatgtaatgtattcagggaaacaaatccaggcatttgatttgaagatatactctgtgggtggtttgacccagaatagtgactttgcactcactgcccaagtgagaaattattttaaaaatttggtaatagtgattaagggagttgttagagtaatagctatagcacattggaattgtagtggtattattagcagagaatgtatctaacagatatttgcttgaacaactatttgcattgtaaacaatttataactcattaaaaatatactcaagattcatattttgagagagaaatgcacaactaaattcttc

SEQ ID NO: 135143 - DNA, 1110 bp, Homo sapiens
tataagtaattaaaagcatattttatgtaattacactttagaggaaatggggagaagttcactgaatagcacggtgcctttttcttctgctataaccatgccgtccaaatgtttatgctggaaaataaattggcaaatatttcccatgatgatttaacttttcagttctgtgatttaaaaaattaagttaattctgagttgccccagaattttttcctactcccattagaaaaaaacaaaaccaaaaacatgctgtagtactgttgtttcttagtacatacagcacgcaggtttttcttttttttttttttttctttttttgtagcttctgtgacctccaaagacggctagggtagaagaaaggcgacagtgagcaaattcactggtgattttgcatagctgaggtgggagatgaccacatttacagtctccagtgtacaagccaccaaatcattcagcagttctgattcatgtaaccaaaatatgatgacatgattcctaatctataattcattctgacttccgtagcaaaaaggtgtatgcaaggcacatgtgttagtacatgaaagggagttggatggggagctaatgaaaaaaataactgctggtaaatttccaaaaatatgtccaaatcatgcatttccatattttatttagaattttctggtttctcattccctacttttttcctagggttttggggcaaaggtggaaaatagagtttagattaaaataccacattttagaatagtagaggatggtaggtagaaatgccaactgttgctgtaacattggtagaggaagtttcttataccacccctagtgtttgttgtgcaagttggctttaaattgctaatgatgcttgcatgttttggagcttggagctgtgtttcatttgtgttagtgggaagatttaccacttcatttttataattgggtagatattatttattggttatgttgaaaaattggtttgttaatgaattgtgttcagatggcaacttctagcttaagaattgcataaagccaggatagattctcccacattaggagacttcattgtcagcaaattcatcgagatctttggggctggtcataatctttgcttct

SEQ ID NO: 135144 - DNA, 1049 bp, Homo sapiens
tttattgagtctctatcatgtaccaagaatcggacttatattagaccattgaggacaggggagcagggagagggatagatggattggggttggggagggcagagaggggccctgtcctggggctgtatagggaagtgtgtgtggcaggagatgacacagatggagtagaaggaacccggctgtgcatctgcgcacaccctgcactaccatgctctggctctgtgacctcggataggtcgcataccctttcacaactcagcatcttctgttacgtggcggacagccatgctggcttcctagattccgtgggagcctcatgggctaacatcagcatcactgggcacacagcaagtgtcctggacatgcagctcgggtctgcagatagagcggcagcatgggattgtgggaggagcttgggtgtgagggccgtgtagacagcttagttttgtgaccttgcgcaggtaatttctgttctctgagcctcaattccattgcctttaaaatgagataatgattattgtcacaaggatttttggaatgagatggcgtgtgaaagcacctggcacaggatccgagaccttgtggcgatttaaaagtatgagttcctttccccttcagtgaagcagcttctatacttctggatcagggctctgtccagagcagtggttgtgagcgattttgcacccttcccctccacccccaggaaactggagacattttgatggttacagcttggggatgccactggaatccagtgggcagaggcctatgacacacagctaagatcccacgtcagagaatcctgggtccacagtgtcagttgtgccgtgattgaggaagatctagaggagatcaagggctgggcaggattccctcagcaccacagcctgttctctgaaaaggcctaaagccagccaagtatgacagccggcttcacaaatgataggtgacttcagggaggtcctccctgcgccccacatctcccaactgctgaaggccctcacccatcaatgggccgagtgattgctggacgcgtggtgctgagttaa

SEQ ID NO: 135145 - DNA, 1004 bp, Homo sapiens
gcaactgtcctggaggggtaacttgatgtaaaattggattgtgctcacttgcacctgcttggtgctgagcactgtatctcccctactggatcctcacagcacccgtacatgtgaactggaggtcgttctcatcttctcattctaaaaaagcggaaaatgtaggtacaaagggagacctcctaactcttcatcaatgctcttcatcaattaaactattaaggaaattaagatgtgctagaacttctaagatctatcgggatcaatgaggtcccaactgttacctggaaagagtttatcaatctaacagaagcttttgccaacaatgagccagtctccacccttaccccccaacctcagttgcaatcctgacaacacattctttgctgagttctgaatacccagcatgcaaaagaaaattacaatctgggttaggtccccaaaggtgacacctattttaaactgaattacatcagccaactttcatttcctcgtatgaaacactggcttcagccaaaaagcttcaaaaatagaacaaggaatggcttctgcccaatcgggtctctactcctcttcatgcagtgatacccacgtgcagacaggaagggccttcggagcagagctgaatctcctggcttccccagtatgagatccatcttgagtgagctgggtctgcgccaccaggcaagccactcccagcgctggttccccagctccctgcttggctctgatccaccttccacactcaagaggcagtccagtccctctgtctttcagttctggagttccttttccccatccaaacaaggccagcctgatatcagccactgataacctctactttgtaactcctttttttttttgagacggagtctcgctctgtcgcccaggctggagtgcagtggcgcaatattgcctcactgcaagctccgcctcccaggttcatgccattctcctgcctcagcctcctgagtagctgggacgacaggcgcccgccagcacgccca

SEQ ID NO: 135146 - DNA, 1281 bp, Homo sapiens
aggaatcctctttcgaggatctgtgacgggatctaggtcagggaatgtcccccctgtctctggcaagccaggctccccttggccagccaggtctcatctgacacgttttcttttcctgcccccacaggccttagcagtaggaggactaggctccattataagagttcttacagcaagaaagactgtttaaaaaaaataaaaagactcatgttaccttgagaagaattctggatgcccaggctggtgaagaagggattgacaatggaccatcttcctaggaactcccaagtaaactatttcaggacatgtatctgctgaaatgtattttattttcaaggtggaggggaaaatcgtctgtttcctaaatcctgtttaggatctgatagtctatgcctttgtctccgagtactgcagaactgacattttgacggtctaccagcgtggcggctggtgttggtcagatgcacctgtgtgcactgggggagggatggtttgggcaggtgcagatccaagggctgtggtaaacgggagagcttgtgtttttgaagtggaaaaaaacccaagagtttgtacagacatcctgtcttcccagagaaggtggacactcttgggctcattgtaaagtgcctgctgcatcaataaagctcttggcttattagtctatacattgcggtgtgtttcgtgtatgtaaaaaaaaatggtaatgaatgggatggtaatgaatgagagttcagttgttgttccggaaacccgatgtggaaggagtagacctgtgtccctgttgagccacccctgggagcgagcatggcaatccacaggccctctgccacaggacgccagcctcggcctcagagctgccggctgctgcagagaggtgtttgctgaataaactatttattgtttcttattcctttgatttgtatgtaattaattttggagcttatttaattaatttaataaagtgccaaacatttaataattgatctaggctttaaaagtcttcagtttgtgggattgcacttggaatcttttgagggtggggcctcagatgtgcctggtcacgtctcctgatgctgggttggctgtgctgcagaatcactgctgcatggacaagctttctttaaagaactaaacgtcagaaatggggagcaatcaatcagcaaatagatggtataatttggttccccataaccaataacagagcttctctgaagggcaaaaatgcttttctttccttttcagcacatgtgactgcagcttgcattctgttaaaggttaggg

SEQ ID NO: 135147 - DNA, 1082 bp, Homo sapiens
tcaaagtgcattaaatcacttagaatatttattccactcttcctcttaaagctgaaggaaattcaacatgcaggaggaaagcctagtcagtgaagcctccctaaagtgagtacagacctaggaacgggccccacagctacacctgaaactgccgaggagtggggcctggggtgcgtgtgggaccagttcaatggctggagaagccacggaggcagcggatgggcttctgtggaaatgtagctgcctttggctggctgtgagctacccagtcttagagattctttcctggaacagttgaaaaaggaaatcctactttgaaaaaaggctacctcttacccatcaaacttgcagaacagaagagactcctgtttcgtgttcccaccaggtaaatggaaattcgtgttctaaacaagggataactgtctgcaaggaggagccagaggaggaggttagtcactggagaagcggcctctggaaggcagagagcctgagctgggactaaggagatgctgccctgacttggttcttcatggaaatttcgttaggttaacgttgcaaatgcgtgtttttctgtgacacattttatatacctattttggccctaagcatgattgagaaatacaactttccatcactggataatggataataaatttagaggctccagttattaatttagttttttatttaaccagtgaaactttcatcaaacaataaacggtttccttttagattcaatattgtggcttttccagaaccagcatgttccctttcctcagtaaacgaggaatccataaaacaagtttttgttggttactaccagagtcatgtgcatgctacaagtgctgcagccagctgggcgccgtctgggtgtagtgtcattttaagtatttggggtgggatgagggagagagagcagctccacagacaaggcagactgccccagtgtctccatcgaggctgggggacagctgctgcccccactggagacagcggactgtccttcagtagaagacaggtggtctgcatcgcccagcggcagcgcagcacagaatcaagacaaagcacacgagatcccactg

SEQ ID NO: 135148 - DNA, 1032 bp, Homo sapiens
tccaaaagcgtctgcataaatgctctaataggaaaaaatacctgcagttccactaccttgttcctgtcaactcagtgtttttctctcatttccctcctgtactgagcacgggcctgcagactggttactggcaccatcttcttgctctgctcagagccagaggcaggatgtgtggggggcaggagtgacaggctcacgggaggggaggggcggttcagtttccctggcaccaagtcctgatttgcatctcagaagccttttctgtttcaaatgcagatgtcatggtttgggtccaaaccagctcccaagggcagcatccggccgtctatctcaaaccctcggataccatggtcctagaggggactacccaaggatggagctccgtgggttgacactttttctgtgaaaagaacactgacacaccagtctgggtgggtttttaatcactgtaactgcagtattttgtacaagtgtctaaacattgtttacaagactaaggcccacttccctgcaggctgacctgaacctcagggggtagctgatcctgtcattctggtcaccaaacaggagggtcctggcactacccagatttccacagtgctgctaatatcccagctccagccagcaccccatctgcacctgaatcctctaacttcacggtagcacttacagctgaagccatcagcatctggcaggcacacctgagtcaccatgtagcgctgctactggaggtagagacggccctttgagatggtgcccagcaggccaaacccacctgcctctgccaggaacagccaactccatgggaactctatgggagtggcttttaaaaattcagatgagttagaagctttttatcccttcctctcaagaaaatattctttcaccctgtctctcaaaccacctagaactttagaggatccatctttaagggtcggtgtggatgaatgagaaaatgcacctttctgacagtatctccactttacttaagaaaactagcaaatatatgaaaagacccttagtaccaaatac

SEQ ID NO: 135149 - DNA, 1075 bp, Homo sapiens
ctgtgttacccaggatggccttgaactcctgggttcaagcgatcctcccacctcagcctcctgaagtgctgggattattggtgtgagccaccgtccctggtcattacttcttcttctttccataaccaattgttccagtcccccactccattcacgtggcctgcgagtctgacttcttgttcttggctactgtccttagaccagctcttcaggataggcccctagccttggtgtgggtcctggcgggggtgctcgtggggcaatcgatcctcagtggtgtgccatttccagagaagtcggtgggttgcctgccaggatagctctgagagggatactgagggcatggcagggaggggccaggctgggagcctgggaagtggggagcatgttggtctggctctgcaaagccatgccctgtctgctgggcttcttgcgtggcatacagctaaaaaactgtgaactaagttttggggctcagtggttttctgcattgtaggaagaatggagccaaagagaaattgtgagcgtggccatggctcaagccctggaggaggtgcggaagcaaagggaagagttccagcaacaggtgggccctgtttcacgctgaggggcgatgtccccctgcagtcccacaggcagcaggcccatcctgccgtgagactgttggagagggcctgtctctccagggtagggtagtagactcaggactcagggaatgcagtcagctgcgtgggcccctgtgctctctaggaagctgggagacaaatgttataaagaaactcttaccccataggatgcccttttctgatttttcaactataattacctggaaagtggtccatgtccacgggcctagtgggctctaattctgtgaggtgacctatcattgcccacctgccccagaggccacgtaaggttgggttgagtttttgcaggaagtatgggaaagcctcccttgaaggtagactttgcatctgaccccagagcttctagttaagtggctttaggcctttggtaagtccttaacaaatctgagtctcctctgatgaggactctagccttctacttacacctc

SEQ ID NO: 135150 - DNA, 1043 bp, Homo sapiens
gtttagtccttgcaggagacctgagaattatgcactgtcatcctcatcctgtagacgaggcaagctcagaaagattggctcagtagcccacaggctcgcagccagtaaatggcagaatccacatctttctcctgtcaaagccctgttcttcattgctgtattatactgcctccccagtataatttctccccagggaaagccgcagccactgaggcaacactgagtagtgtgaaggaggcctgtgtctaagggctggctggtgcccagagctgtccccacacaccttgaggatggagtgatgacatcaagactccatcttctggacaggccagggtccaggagcaacaggcagagcctgcaggggggacctcagcaacgccaggggggatggggtcaggagagagttgtttctgttggatactcatcttctcacctagggccagactaagatcccccactggaaaccattgtcaccctgactgaccgtcctttggtctccccgcaggctgccgccaaccaggagagcagccatgtgcagcagcaggcccttgctctggagcagcagttcttggagcgcacccaggcgctagaagcccagatagtggccctggagagaacgcgggcagctgaccagaccaccgcagagcaagggatggtgagtgaagagctaagagagggtgggcccaggagcaccagggtcccccacagcgaagtcagcctcgtgcttgacagtgtgtcaccacctctgcactaggaaaccactttagaaggcagctttttttttgtttgagacagggtctcactctgtcacccaggctggagcacagtggcatgattacaactgactgcagcctcgacctctcagactcaagtgatcctgccacctcagcctcccaagtagctgggactacaggcgtgcaccaccacagccagctaatttttaaattttttggagagacaaggtctcactgtgttgcccaggctggtcttgaacgcctaggctcaagggatctgcccacctcagcctcccaaagtgctggaat

SEQ ID NO: 135151 - DNA, 1055 bp, Homo sapiens
ggtcattatgtgtatcagcttgtctctatccagttgacccctttatttaggctaccctcaggttttaataaaatctagtacccatcccttaggtctggattaggaaatgggttctcaccacagcttcattactgctgtgttgagtaactgggagaaatccctgtcatcactccctcagcaataaatcatacattttgtgtagtctaccctcaatcatatattctttgggtaccatccaagaaagatgttagtagaagtagaaagttattttttttgttgatatgtactaaaacttttaaggaaaataaagtaaaagaaaggttttttgtttgttttgatttttctttttgtttttaattctgataaagtggtagtagccatcacttagcatcagctttgatgttttctggcaacctacctaactcagtgttctatcattgtaccatttaaaaagttaccttttggcatctttgtaaatatatatacttgtctattacaaaaaacaaaaacgataaggaaacaaacaaaaactgtggtctattaccaaggccaaaatattcttctggaaagttgaggtggatccagcttttcctagtatcacaatccacttatgtgactttggcctttttcattaggtgacagttgtaatcacatgggctatttgtcatgctgtttctgaagtgttttcatatctcaaatagagcctctttgttaacagcttccatgcggaaatttcaagagcagaatgagacattccaagccaacagagccaaaatggcagaaggactggctttggcattagccagaaaggaccaggtattttatatgtggcactgcccagaactggtggaaagatttcacttagtgacgtgatttcaaaaatcatgacataacctatagaaaatatttatagcctaggagaagagaaatgttaaaagttcgttaaggttttctttggccttttcttgtaaagtgaagaaactttacagttctaatcatgaaatgtgtccagaatgtgagagtatcattccttgtatctgtgtagtttcataaaa

SEQ ID NO: 135152 - DNA, 1030 bp, Homo sapiens
ctaggatcccacggtctgtgagcaaggaatcagttgcctcaatgggagctgactcaggagatgactttgtaagtacctttacttaagaaataaagatacttttgcagggtattcttccaataaatattttaaattgcttgattatttcatacctttcatggtttatagctgtacaagagcctgtacatctgattcttcttactctgaggtacctttttgttaatgtttggtttgtaaatgttaaggtactctatatttttttccttatttttctgtgagttcctctccatattctctccagtgtcctcttgtactgtttttccgtctatataccttatacatcttcttttgcatttcatttctgaaaatgtctgggcctgttttcattgcagacatatatacttatataacaactaagtcattgctgcttaacaaggtctctgagttgtggtatggggttagcaagagtgcattgttgtattgggacgattgttggaaagatggccccagtgattacagtatgttgctttttttcttttttctttcttttttttttttttttgagatggattctcgctctgtagcccaaagtggagtgcagtggcctgatcttggttcaccacaacctctgcctctggggctcaagcaattctcgtgcctcagcctcccgagtagctgggactacaggtgtgttccaccatgcctggctaattttttgtattttagtagagacaggtttttaccatgttgcccagggtggtctcaaactcctgagctcaggcgatccgcccaccttggcctcccaaagtgctgggattacaggcgtgagccaccatgcccagcctacaatatgtttcttattagtaaaatacatttgtgactataagatttcaaaaaatgaagatgttgctatatgagggaaatgtcatgcttaaaaaataaagtgtggcttttgcatatgacaggatcctcttaagttagataaatttcttttctcttcttttttttttttttgagacagagtctcact

SEQ ID NO: 135153 - DNA, 1036 bp, Homo sapiens
aattatactgtcactatcatttgacttgaacatttgtggtattgtaaaagtcttgtcagttgtgttctaaattgcttaagccatacgttctcttaaacaggatgtttttttcttcctttccagcagcctttttcttctttgtctgttatggttaatactccatagattttagaaattgagaagttcttgaaacattttattttcttgagttcatcacttttgactcttgtatgagatgtgatttgtcataaaagatagccttccactacttcactaaatgaatttcagagtaaacactgtgattctgcagagcggattcagtaggctttccaatgttttctcctgctatacagtgcctaccaccttgagggcacttcagtactagaggatgaaaactgaaacgttgttttgatgtttattgaataacgagattagagaatatttgatttttgttgtcagtgtattaaagaaattttcacattgataaatgttctctaggaatgtgtctacattcatcaggtgtgaactcttgtacatgaattttgtaccttgaatccacatatatattaagtgtatcatcaatataaaaataaacattatttgcttaaagtttttggtactttttcggtattgacagctgaactgttagggtttgcttcattcaaatatctcagaggctttgaactatcttggggttgatgcttcttgttagtttgtcaatgtttgaatcctggttttggttttttccctgccctgctcctgcaggtcagaactggaacacgcgagggaagggactgttgaagaattgggtggaatctgcttattcttgggcttgtgttgagtctggggatggaaccagagttccttaaggtggaatggctggcttggcattgacgagttcagggacctgacttagggtactgatttggaccgtgactttttgtttgagatagagtttcgctcttgttgcccaggctggagtgcaatggcgcgatcttgactcactgcaacctacacctcccgggttcaagcgatt

SEQ ID NO: 135154 - DNA, 1067 bp, Homo sapiens
gacgggaagggtgtcaggatgatgtagggtgatatgcctttaattggataaagagaactgtattaagtataactaatttaataactgattgaagcaccattcttaattttaaaatatttttgttaatttcttttgtggttttaaaaattaataatttttttttttttgagatggagttttgctcgttgcccaggctggaatgcaatggcgcgatctcagctcactgcaacctccgcctcctgggttcaagagattctcctgcctcagcctcccaagtagctgggattacaggcgtgtgccaccacgaccagctaattttgtatttttagtagagatggggtttcaccatgttggccaggttggtctcgaactcctgacctcaagtgatccacccgcctcggcctcccaaagtgctgggattacaggtgtgagccactgtggccggcctaaaaaaaattctttttaatagttatcagactactttaaccagtgccatgtttaaacatacttggacaatagactcagtttttttaatagtttgaagtacattatattaaaactacaaactcacttattcaagcctaaatttcatcatagactataaattgggtatcaatttcctattttggtggacaattccagtctgtctactacgacaatcatctttttaggtgtaatattgtttaagacataggtaattttaggttttatacttttctcctaggcttatggaatgaaagctaataggatatcactttcagaatgaaatagggaattatggctagccttcttatagggctgccgtaaatgatacttaaatgtttgttatatcactgattttcttttctcttctgaagctgttgtgaatgtccactttgccatgattaaaagttgagatttgtaaacattacaatttgaaccataaattttctcaaacatgaaatcagtatgaataagtataaaatttgaaatgatcatacatgagaatcccaaaagtaaatacttccaaaccatagagggataaccactgtatttttaaaaagcttatttccacccttaaagaagca

SEQ ID NO: 135155 - DNA, 1010 bp, Homo sapiens
caggataatgggaaaagcgacaaatcggatttatgtattaggtattatggagctttctttagcactctcctccaagtttaatctctgacatgtgtgatatagtaactttctgtctctgagaagcagtttggacccagctgaaaaattttatttatggagacttgtaatcagcctgatatacagagaacactctggactggaaatatagtcaggtaccaaggtctgctaatttggccattgccagtgattcaaaaccacctccccaccctgagtaaaagatttgatatgaatatgaatgctatgagtctcctggtgatgttttgggtgtatatgttcctgtgtgtgtttggaaatcatagagggtatttaccttgagggctcttttgttgaccttatttatttgaaattcttattttatttgtaatggcatatgtatatttttgtgatgctacatgcaatctctgtgtatactttttgtatatatgtatacatatttgtaaatatattggtatgcagtgatacagtatgtgtatattatgtacccatacccattgtgggctgaatttatttaagttctgtgaggacatcctagtggcattgttcatgctgctgtaattaggttgtggctgtatctcattcataagcctctattttgagaggcttgtgtttggataaaatgggctaatttggagttgaaattaggatatgaagatcttaacagaaagctagatatttattcttagctttaaaatcacctgcaaatttttatttaaactgatgataaattagtgatataacctgaaaaacctaagtatgtgaaactgagacaccagcagattcttaggctgtagtagtcctttattttcttgatccatatttaagtattattactgagtagtaaattatgtatattggggcttaatagagaggctgtggaaaaaaattgctttaatcacatttaaaaacataggaaaatgtccattaaataggggaaatatattcccagttgt

SEQ ID NO: 135156 - DNA, 1098 bp, Homo sapiens
gcaggatctcagctcactgcaacctccaccttccagtttcaagtgattctcctgcctcagcctccccagtagctgggattacaggcatgtgccaccacacccagctaattttgtgttttgagatggggtttcaccatgttggtcaggctggtctcgaactcctgatttgaggtgatccgttggcctcggcctcccaaagtgctgggattacaggcatgagccaccacgcccagcctaaacatacagtttaataaatcctccttgtaccttacccagcttctgtatttctttaatcaagggagaagaattatctaaaaggacagttgcccaatgggcttgagctgatgatagtggcaaagaatttcattttttaaaaatgcataccacctgccctttataaaaaaatttaaaccctaatgtatttaattttataattcataaaaatttaaatattggaactaagaacagagcaaagcaaagggaaaaagcactcctttgttttcaaattgcacaaactgtccctggagattctgatagtctctcatctctcttaactatcactgtaaacaacatagaaagcataagactgcaagaagtcagttatacacaaaacaaaatgaagcacagtggaattttctctttctttatctgtatatttctgaagttggtaaagcaactatcttctctattttacagaagagaaagctgagacccaaaaagctattcatagtgatagagctagaactaaaactcagatctcctcatctcagcccagtcttctcagtagctcagactgctttctataatgaacaagaaagaataattagggatttgtattttggcacaaaacagtatcaaatttttattgtaaaaatccacaaatctgacattttatcttttattctagccaggatgtattcttcatttgcatgtgtgtgtttctcttagaaagtggtgctctcaaacctttcaaagcacagaatttattgtaccctctttatttttaccaaattgaaacgtttcaggatttcagaagcaaagtgcaatccaattgtggctggagttttcctgatagaggatccgggtggttccctcccc

SEQ ID NO: 135157 - DNA, 1914 bp, Homo sapiens
gaaattatccagaatcatatccacaactgccaagggatgaaacagtggagaatcctcatctccagaagcacattttggaattagcatccattctggatgttcgaaacgtgttctttgagaataccattgatgactattaaaacaaaaaccctgttgtcgaaacaagttttcattttccacaaattttaaatggtgcagttttctaacgtgataagacacatagtggtgttacttagtttttattttttaatttagggccaccattttaaaaacaaacaaaaaaatgttcacacttttagggtaactgttttaaaatgcaacctttcaggtcttttaaaatcttaaccttggaatttttattttttgattttgagggatggatatttacctccaacttctaatcctacactcaaatagtcactattctcaccctgagaagagtaaatcatttatttttgtataatgaggtaaatccaactcttatacttggacctaagttaaatgtctggatttggaaatatgtaatggttcataatgatgaagctagccaccatggactactgaaaatcaagaacagagtccctccataatatattttttctcattccaacttagctggtagaaaaatgtttgatcctttgaaacatgatcaagccagttttttgaaatcatttaatttctttcaatactgtcataatttcagaaattggattgaattgcatctgaaagctacatcttgattgaggacttgaggtggtaatattacttggaatgtatgagtattatgagatttatttgcatattttctttgtagtctgtgaatgctggaaatgaaaaaggaaacaactttgaaatattttagtcaaaaaaccatgtcattggtttcataatacaatgtctccaataggaattctatttaaactcttggtttatgagatcacatttaaagactggattgatgtctgtgacataaagttttaattttttgcctcattcaaatttatgagacttcaaagtcatagatgttttaaattttggtaaggggtaactgggtgttatgaaacctaaaatgtaagttgattttgcattggtaatttggaaataagatttattaacattccctgtatttagtattttatattcatgcacaaaatttttattatcttaaataggactcagtgtatattataaagatttttcttttttgtgttttccttccctgtcattccctttataatttcacagtcacttgctatgaagtcctccctcctttttgattatgcagcattcaatttcagaaatctatgaatgagaaggccttatacctaattttctgtacaggatcacatctggcagtcccaggagaagtgagctgattgcttttgatatctctttcccatggccctaggtaaattatactctaaatttatttattttttttgaaacagagtcttgcttttgttgcccaggttggagtgcagtggggctatctcggctcactgcaacctccgcctcccaggttcaagcaattttcctgcctcagcctcccgagtagctgggattacaggtgcccgccaccatgcctggctaatttttgtatttttagtagagacggggtttcaccatgttggtcaggctggtctcaaactcctgaccttgtgatctgcctgcctcagcctcccaaagtgctgggattacaggcgtgagccaccgcacctggctattatttttaacttggttttcatttctggcatagagactaatttgggtctaagttattcccattcctgctttgatttgctgatttttcaaacctgaagtccaaagttactgtttttggggtttggggacttggggagtattttacttttttttttttttttttttaagagacagagtcttgctttgttgccc

SEQ ID NO: 135158 - DNA, 1262 bp, Homo sapiens
tgtgcaatgggccaggcgcagtggctcacacctgtaatctcagcactttgggaggccgagacaggagcatcacttcaggctaggaatttgagaccagcctgggtaacatagtgagacctcatttctacaaagaaatttttaaaattagccaggagtagtgatgtgtgcctatagtcccagctcttcaggaggctaaggtgggagaattgcttgagcccaggggtttgaggctgcagtgagctctgattgtaccactgcatgggccaactgtgcagttccacttaagacacagcctttttttttttttttccaaaaaataaattggaaaaattttggagatttcctacagtttggaaaacagatgaactacatagcctaggaatattgaaaacattgctcacctgggccctgcggccagcagaattggccccgctctatggctgctggggcctgcgcactggaatcgccgtggcctgcgcaccccaccatgccagtttgaacctccatggcctcaaccagattcggaatgtcaaaaagcagagtgtctatttgatgaatttgaggaaatcgggaactttgggccacccaggctctgtagatgagaccacctatgaaagactagcggaggaatcactggactctttagcagagttttttgaagaccttgcagacaagccatacacgtttgaggactatgatgtttcctttgggagtggtgtcttaactggtaaactgggtagagatctagcaacctacgtgatcaacaagcagacaccaaacaagcaaatctggttatcttctccatccagtggactcaagcgttatgactggactgagaaaaactgggtgtactcccacgattgcgtgtccctccatgatgtgctcgctgcagagctcactaaagccttaaaaaccaaactggacttgtcttccttggcctattctggagaagacgcttgatgcccagcccggttttaaggatattaaaagctgtcaggccaagaccccagcttcattatgcagctgaggtctgtttttttgtttttcgttttttgtttttcattcctgcttttgaggaacagctctgtggaaagaacgtgttgcctcctaccttgcccacaagttttgatttttaatttctacagaagatttttttggattaattgtctgatttcctccctcatatgatatcctttatcttttataatgtcttatccctatacctgaatataacaacctttaaaaaagcaaaagaataagaa

SEQ ID NO: 135159 - DNA, 1032 bp, Homo sapiens
gaaaatagggagatggctggagatagcacaatgactagtagccagctgcaaagatactaagcccatagaaccatagaaccaacaggactttgtgatggactaggtgtggggagggaaggcaggaatagacttccaggtttctggctgagatgctggtagaaatgataatacctgatgagaagcatatttgtagagaacaaaaggggaaataatttgctttgagttgttgacatgttgagtttgaggtgcctttgagaattaggttgaatagagtagcctagagcagcagtacttaaaagaagtaagagtgtgagtcattaaattttctattacctatatcaaaaacagtaaaaagaaacaggtgaaattagtgttaacaatgacattttgtactaaagctttgaaatcatctagtcacattttactcatctagtcacatttttagtgtccagtattttactcatctagtcacgtttttagtgtccagtatctaccgcaagacagagcagtgccagacctaaggaattcaatttaggctgctgatagagaattagaaatttgtaggcatataaatggtaactaaaatcatgggagtgagagcagtcagcaatgtatggggccaaagaaagaaactactcatatttaagagataggaagggaaagagcagctcatagagagcaactcagaagagaatgaaaaagactggcgtttgtagcactcatcagagaattctatcaagataacccataatccaacacttgccatatttggatgaaatttgttaattgagagcaaaaaatagtaagaaatatcattttccatttctcttaagttttctaggctctttctgaagtttgttcagcagaaagcaacatagcaaagtttttgtagtttcgtgaagaatctgctttgatgaattatgatttaatgagatagctttaattttatatattatcagtatattaaaatgttcctcatatgtatctcttatcttttgcaaaactattgtctatatatataacatgtttgtt

SEQ ID NO: 135160 - DNA, 1050 bp, Homo sapiens
gtcagcttgttactgtaaatcacagattcacattctggtcttttatgtcattccatgagagcagttattatgacccacaataagagatgactccaggaatcaggttttggagctgaaagccagatcctggatcttggaaagttcacctttatatatataagtgtgtgttgctcgatggattggcctcttggtatacagccagatgacttctccgtgcaaaactacaatcatgtttatgccttgtgtttaaaaaatcagtagttcactcagtaaactatttcaattgagagcctttaagaaagcctattatgcatggtacttatatatgaatggcagtctccttagctgttgctgatgtttctgcatctatttatgagtttaagggcccaatctatacactaaaaatatgctttggaaaattactaagtaactatctttggtcaaatctttaatgcaagttttaaattcttatatattacagaatttcacaaacttgtttggacagccactagtctgcttgctttctcctacagcatatccaaaagctttacaaggtatgtaccctcattgcctggtatagccataggttgcaaataaacactatctatattatgaatagtactgatctttgttttttcctcccataatgatcgcgtgtggatttatggtgtttaatatggcaggtgtcgctctgaaatatacccagaagccttgccaacaaccaggatcccttaatgtgctaccgttaggccttgaaataattcatccctgagaaagaagtggttttgttccttgctgatggggaactcatgatttgtaaattttaaaatttgttttataggtgtttgttttgatttgctggtcatatccatatagcatggttttcctatacctttgcaggcatgttttaaaagatccaaggcatcttttaagactttaagattgctggtctaggaaacttctcagtctatgccacagagttaggataacctaactggcacaacttaaagtgtttcttttattcacatttttaccttgttgtgatttaaa

SEQ ID NO: 135161 - DNA, 1022 bp, Homo sapiens
ctcttgtaccagcaccactttaattactgacgtttttcttctgttatgttttgttttgttttgttttttgttttgagacagggtctcgctctgttgcgcagggtggagtgcagtggcacaatcagagctcattgtagccttgacctccctggtgcaagtgatcctaccacctcagcctcccaagcagctgggactgcaagcatgtaccaccacatttggctaatttttctattctttgtagagtcggggtctcactattttgcccaggctggtctcaaactcctgggctcaggtgattctcccacctcccaaagagctgggattacagtcgtgagccactgtgccgggcctcactgaggtgtaaagtatgtttcaatatctgatgagtctagttccccctctgctctttttcagagttctcttggggaatccagtttttccatatgaactttagaattacttttttcaattgtaggaaaaaaagtctgtggttatttttattgaggttggtttaaattttaataagttagtgtaatgacattttagaattgttttatctctaagaacatagtatgttttggctgggcgtgctggctcatgcctgtaatcccagcattttgggaggccgaggtgggtggatcgcttgagctcatgaatttaagaccagcctgggcaacatggcaaaatcccatctctactaaaaatataaaaattagccaggtgtggtggcatgcacctgtagtcctagctactggggaggctgaggcaggagaatcgcttgaaccagggagacggaggtttcagtgaaccgagatcgtgccattgcactccagcctgggcaacaagagcacgactcaaaaaaaaaaagaacatggtatgtctttacatttgttcaagtcttcattcaagagtattttaaaaaatgtttttgttgtttgattttttatttctttttaagtttactcctaggagttttatttttcttgttgctttaccacacagcttatgattttacttccctt

SEQ ID NO: 135162 - DNA, 1060 bp, Homo sapiens
gaaaatttctgtaacgaaatattagagaaaaaggtacccaaagccctgaagtacatgtgaaagtcacaactagtaacgtgataaaagtctttaaagtctgcgtgttgcattaaggctaggttgtgtttgtttttttttttcttgcaggttaagttcagtgaactaactgttgacatgttccggatgttacaagctctggaaagggagccaatgaatttagcttcccagatgaataaaccaggaatgcaggtaatctcctcttttacatttgcaagtttggtaaccctctggctgcgtctctcctgttggaacgctgattattcaacagatactacagccttgaataaagaattcacttgatgagacatggagaaatagatcatcacagtaagactgagtgtgaaaataagacttccttgataagggctagtgaaaatagatattgataattcatttgtcaaatgcagcttttatgtataatgttttctgtgtgtaaatataggaatcagctgacaagcctactagacgagaaaacccccacaagtatctgctctacaaaccaaccttcagccagctatataccttcttagcagcgtcttttaaggtatgtgtgatccagtactttttactatgaggtgaaagtgtgccctaactaaaatctaagagtcactcttttgaaaaaatacttaagagtttaggtaaaatataaaaatgaaaaactgcctttagagtaatgatcctgataatagatatttttgttttgttttgtttctttttttttttttgtactcctggtaagctgtgaaatagctgtttgggaatgaaaattgcttatgatgttgtgattattcccatcattaattaatgataatagtggttctccttcctccagttttttattactcaatgattttaggtgtaacaatgcagaattggccaggcgtggtggctcactcctgtaatcccagcactttgggaggccaagccaggtggatcacctgaggtcgggagttcaagaacagcttgaccaacatggagaaaccccatctctactaaaaga

SEQ ID NO: 135163 - DNA, 1127 bp, Homo sapiens
tcatgtagtactgataggaagtagatctctgtaaagactttatttgatgggtgttattctgaagtttgtacttttgaagaaaatttattagttttcatctttgttttttgttataatcaggactgtgtattgctaataatcaaattttgtaagtatgtcggtttctgtcaggaatatggttctatatggctgtgtgtttttatgggttttttaataaccttttttgtgatgtttttaaaatcaggaattgtcagatgaaattgaagattatactcaccgatttaatactgaagatcaagtggaatggaacttggtgcttcaagaagtagcagctttcattgaggtcagtttttgataagaaaaatcataattattgataaataaatgaccgtgtagtttatgtttttattgtgtgtatatgtcaagaagaaggaatagcttactctattgatatttagtcttggccattcgttaagttcttattgcttttttctttaggcggatcctgtaatggtattaaatgatgataataccattgttatcacatcgaatcgccttgctgaaacaggagccccattgctggaacagggcatgattgtgggacagttgtctctggctgacgcactcattattggtaattgtaataatcaggtaaagaattgtgaaggaattatgcttaaaattcactgtgaaaaatagtgctattgatgatcacagaattattttcttataaatatcctaacatcctcttgtgaggaaattgctgattaaattatgctgtgtgcatatatggaatatattacagatatttaaatagcttagaaagaatttttaataacatagaaagatactcgtgatacagtaaatgaaaataaacttgccatggagccaggaagcagaattatttcatatatgttagaatgtctatatgtatgcacacaggaaaaagacgaggaagaaatgttacaactatctaagttttatctccaaataaccaaattataggggatttttattttattttttacaacattctaaagtttccaaaatttctgacctggcacagtggctcacacctggaatctcagcactttgggaagcccaggtggttagatcacttgaggtca

SEQ ID NO: 135164 - DNA, 1063 bp, Homo sapiens
ccaagtaggtttgtcttgaggattcaatgcaagaatctgtgtaaagctctcagctcagaatctggtgcataataaacagtcaataagtgattgcttttattactactttttcttcccttccaatgtgaaaacctgggccacttctgacatatatgttgcaagttgcaattctaagctaaatgttggcaatcaccacaagagacaagagctacttctcatagatctgtagaatacactgatatttgtgctttaaaatcttacattaaagtatggcagttccttaaaaaattaaacatagagttattatatgatccagccactcaacttctgggcgtgtgcccagataaattgaaagcaggtacttgaacagattggtacaccaaggttagtagcagcattattcacaatggccaaaaggtgcacacaacccggatgtccattgatatagatggacagataaacaaaatgtgttatatccatacaatgggatattatttagctataaaaagcaatgaaattctgacacatgctacaacatggatgaacgttgaagacactatgctgaatgaaataagccagacacaaaacgacaaatatgattccacttatacaaagtacttagagtagtcaaattcatagagacagtagaatttaacacctgttactgacagacacatgatttcctcatattcattactcactcaaagtctggaatgttcaaggccagccagagcctaagccaaagtaccagtgataattcttatgttttgcttaaacataaggtttgtatttgtttttctttgaaggatgaaaagctgccgtctgtaatcctagcactttgggaggctgaggcgggtgcatcacttgaggccaggaggtcgagactagcgtggccaacatggcaaaaccctgtctctactaaaaatacaaaaaaattagccaggcatggtagcgcacatctcatctactaggcgggctgagtcacaagaatcacttgaacccagaggcggaggttgcagtgaactgagatcgcactgctgcattccagcctgggcaatagagt

SEQ ID NO: 135165 - DNA, 1045 bp, Homo sapiens
gcccctttgaagactattattattcaggaaacaaaacagtgttgacactaaatttttttttttttttttttgagacagggtcttgctctgttacccaggctggagggcagtggcattatctcagctcactggaacctccaccttgcaggtttaagctattctcctgcctcagcctcctgagcaggtgggattacaggtgcccactgccatgcctggctaatttttgtatttttagtagtacattaccagtgtagtttgtttgtttgttttttgacaaacaaagggttttgagaaagatggagtttcaccatcttggccaggctggtcttgaactcctaatcttgtgatccacctgcctcaccctcccaaagtgctgggattacaggcctgagccactgcactggcctttttttttttttttttttaaagtaaaacacaggatcagaaatctctttgttttgcatcatttgtgcaatatttgttttgtttgttttttccttaatgtcttgagagccagcaaagattatctgacagacagaattagactgaaatctcttagggaggttgtgaagtatttagagttaaaggctagagttaagaataagcagtggcaaaggtataactataaacctcaaagtgttactgacttaggattcattcatgactcttctgcattaagattgggagttaacttttaaaaactaggtacctccgtgaaacatgtatgcatcttactggacactcctttgtcgtttttccaatcacttctgccagatgggttttaatataataggaagaattgttacgatgtcagctctgttgtaatttggactggaatgattctgttctcttgtgaacttgaagagtccagttgaatcactttctagttattgtctttatttttttattgtagtttttaagtgtttgtttctacttgtggtaataatcctgttaggatgcatattaccaactatatgtgaaggcctggctatatggagcataaaattagatatgcttctttcctttggctcacagtctaaattta

SEQ ID NO: 135166 - DNA, 1052 bp, Homo sapiens
ctcagttcactgcaacctctgcctcctgggttcaagtgattctcctgcctcagcctcccgagtagctgggattacaggcgcctgccaccatgtctggctaatttttgtatttttagtagagacgggatttctccatgttggccaggctggtctcgaactcctgacctcaggtgattcacccaccttggcctcccaaagtgctgggactgcaggcgtgagccactgcgcctggctcttcctcctgtttttctttatcatttgactctgaggataattacttgtaggccattgaattcatttcatcatggggaggagaaactccaggttattgtctttaatctctttactccttgttttttacaggaaaactctacttaataaaaaccaataaatactattaacaaaaagtcaactttggtatattctggcatacaaccaatgtattggtatgacagattgtatttgccaaatgtgtctacagcagtatcgttcattttacatgttctacctacaatgtcatcttcacactcctcccatctagtggtgaagcctgtgtctcagtctcttaaccagagcagacttttgtaaatgcctttaccagtagagcatggctcaaacgacgtgtcacgtttagggctaggttataaaaatgccatggatttctaactttctctctggagtgtcacttttggaatctggctactatgtgaggagcccaagcaactaggagtggcctgtgtaagagggaaactgaagctcctgactctcagccccagctgagctcccagctgacatctgggatcagcttgccagccatgtgagtgagctgtcctaaaagcagatcctaatcttctagttccccatcacagtgccctaatgagtgcttatgtagtgtttatatgtagagcagagatgagttgttcctgtcaaactctacccaaattgcagattcatgagcacaataaaagattgttttaagccactaagttatgtagcaggggataactggattagcattccattttgccggagtttagagatcatactatacg

SEQ ID NO: 135167 - DNA, 1223 bp, Homo sapiens
aactctttttcaaccccttttcttggctttttgggaagagtgggcaaaatagagccaagtcagttatgatggttcattttatgtgtcaacttgactgggccactgagtgcccagacatttggtcaaacattatcttaggtgtgtctgtgaggatgtttctggatgaaattaatatttgaagtgattgagtaaaacggatacccttccgagtctgggtgagcctcatccaatcatttgaagacctggctagaacaaaaagactgagcaagagggagcttctcctgcctgactccttgagctgggacatcagtgttttcctgcctttggacttgaaccaaaactttggctcttgagcatggtagctgttgtattggaacttgcgccattgattcccttggttctcaggcctttagacttggactgcaactagaccataggctctcttgggtctctagcttactgactgacaatcttgggacttttcagcctccataattgcatgagccaattccttttaataaatatctttttaaatatatatacctctgtctctgtctctctacctctacctctgtctctctcctgttgattctgtttctctggagagccctgactaatatataagcctagtcttttattgccttacttttgtctcatttcaggtttttcagagtgctcctaatctctgagaacttctgcattactggcttaattctctgcattgacgcagtctgtcatgaaatggctatcttcatgacaaaccaagcaaaaggagaggtgcttgggttttcataaacttggcagctgttttggaaacattttactctaaggctaggcaccactgtttgtattcttattttgcatttggggtttctttctcctaagttctctctccatatattctcctggcctggaaggcatgtgtgcctgtttgacagtgtcctggaaattcttttctagacggggagtgcatgttgaaggtgctcacacgtggtttcctaaaatcctgcaaagtggcagttaggacttttgtttgtttgtttgtttctttgtttctttgagacggagtctcactctcgcccaggctggagtgcagtggcgtgatctcggctcactgcaacctctgcctctcgggttcaagcgattctcctgcctcagcctcccaagtagctgagattccaggtgcccgccaccatgcccggctaattttttgtatttttagt

SEQ ID NO: 135168 - DNA, 1098 bp, Homo sapiens
gatgtgactgagcacattgtctaagaggatatgaggcgttgaagcctggggattctgatgtacaggcttcagctttgcttggtacaacacatgcccatttctctctgaggacttgggcactgctaggacgtggggttgcaggttccctttttgtggattctgaaggaattccttcttctcagataaattgctcccatttttcttcttatttctacctaacccccagctcccgccaaaggcactcattgttctacccttcttccctcagtataatctcctcaaggagttcatattttcagaaaacatgcacaaacctcccttgaggcaaagaagcaaataggactatcatcttggggattgggaagtaccatgataataaaacatccattgatgtcttaataacttatctggctacttatattttcatcagtaattctagtccctgtagtgggacttaatgatctatccaaaaatgatttgattttcccttctttaaaagatggagctgaattctcctcccttgagtgtgggctggacttagcgatgcacttctagtgaatagaacacaggagaagtgatgagatgtctcttcccagattgggtttttaaaagactggtttctgccttgcatgtgtgttctctctctctctctcacacacacacacacacacacacccacacccacccacccacctcactttgcgggaggctagctggctagctcagattgggttttaaaaaaactggcttctgccttgcatgtgtgttctgtctctctctctctgacttctgccttgcatgtgtgttctctctctctctcacacacacacacacacacacacacacacacccccaactcactttgggggaggctaactccatggtatgaggcagcactgcatagagggaaggcacttgccatgttgtgaagacagccacccaggcagcccatggggagggccatgtggtgaggaagtgaggcctgccagcaaccacaacagctagcttggatgtagatcttctgaggcctgctggcagccacatgactggctcagaaaagtgagcttgaacagggatcctcctactctagttgagcct

SEQ ID NO: 135169 - DNA, 1049 bp, Homo sapiens
gttccctctttgctttggttttttgtttttagggtttttgttgtttttgttgttgttgttgttgttttttaaagacggtctcacttcagggtggagtgcaatggtgtgacaatggctcactggagccttgacttctcgggcccaggtgattttcccacctcagcctcccaagtagctgggactacagatgtgcatcactatgcccagctaatttttgcattttttgtagaggtggggttttaccatgttgctcaggctggtcgtgaactcctgggcttaagctatctgccttcctcagactctcaaagtgtttgaattataggcgtcagccacagtacctggtctgctttgggtttttgtatgtgatttctttttctttctggagtactttctccttgctccttgacaagccccctcctttaagactttgctcagtgagggcttccccccaccctccctctgctccaccttattgggtcccatcatggcctgtacatacacttacatgaaatggtctgggctgaatttgaattcagctctgtcaaatgtagtttgcgagatcatgtgcaagttaataagcctgtctctgcctcagtttcctcatctatatagtagaaataatagttctgctggcgtggtggctcacgcccgtaatcccagcactttgggaggtcaaggtgggcagatcacctgaggtcgggagtttgagaccagcctgaccaacatggagaaaccccatttctattaaaaatacaaaattgggccgggcacgatggctcaatcctgtaatcccagcactttgggaggccaaggcgggcggatcacaaggtcaggagatcgagaccatcctggctaacacagtgaaaccacgtctctactaaaaacaaaaaaaatcagctggacgtggtggcaggtgcctgtagtcccagctactcaggaggctgaggcaggagaatgacgtgaacccgggaggcaaagcttgcagtgagctgagctcataccactgcactccagcctgggcgacagcgagactccgcctcaaaaaaaaa

SEQ ID NO: 135170 - DNA, 1008 bp, Homo sapiens
tggggtgggggccagggagcgggcccaggggcagcggctcggggcggtggagcattcggggcgcagagaccggaggggcggggggtgcaggctggggggaccttgggggcgcctgcaggcggcggcgcgggctgggcgcgatcgcctcctcgaggccaggtgagaggggcgtgtgagggaaggggcgccgaggggtgaggctggcggcgcggggccgggaggggcaaggcgggcgcgcccccggaggggccgtggaatgcgggggtcgccgggcccggagaggcggggcgtggagggggcagtgcacggtcgggaacgggtgggcacaggaaaggggaggctaggggggcttgcgggggtgacgaggcagacaatgagtaggtggaggtgggtgattttggggagctgggctgtgacgagcaggggtcgaggatggggtgagggaccaggaaggtttgagctcagggggaattgggggaacggtgagtcccaggaatgctaggtcttggtaaataggggaaacagggcatgaggcgtttgtaaggtcagatctgggcttggcgagcctgtggtcccagagggtggtctatttagttcttgactggcacggtagcgccgggagatgttttcttgtatgttacttttagttaccgtcttatttgtttggtctgcagactgactggcacagtggagaaaccgcctcgaaaacggagaagcaggtaaggcagtgccttcctattttgcttcatgtttttctttttgcttggctgcacctgtgccgtactgcataattgtatactgtcagtagatgaagtttcttatttatcccccttttaaaagaatataaccacatgcatgatttttcttttgaggacttcaaattactacctctacagtcgattttttttttcttggtatctaagataatgtgggaaatcttgagaaatcctacttttttactttttgatgttgtgtaaggatctcagctatttttttttttaaccttag

SEQ ID NO: 135171 - DNA, 1030 bp, Homo sapiens
tttttccctcaaaccacccagctccttacatagtttttaattatatagctatatgaaagaggtggctaagacatttgctgcacacacttgaactaatgttgggtcagtagcttcgtgttactgccctgatcccagtgtaattcaggtggaaaggtatttttatctcacagggatatgtagctatgtattttactaattgtgaaacactggaaattaatgatgcagacaacttggtgtggtctttgaacagctctctgcagtatttttttttttcctgttaccataaattgtatttaagtgcttgctttccacttaagttgtactaatagaaccggtaactcccagccctccctgtttgacactccttagcttagattgatgtagttgtttttgttatccctataatgtgacttttatttttaagtcattgtgtactgcatttgtttgtcactagttgggcacgtgccaataatattctctccattccttatctgccatctctgttttgcctgatttctcttcaactgaataatggctttttgcatggaaaaaatagtttttactattagacgtgtaaagggaagagagagctaatgtattggactttgtgagcctacaaggaatattttggatccctccaataaataagggctatgtactatatgtactatatagagttatcatgtggtggaagatacttgcaagtcatagatttatgggcaggaggatttgttactccctatatctaggctgaatgtaaaatcccttatgttgtatcaatgggggtaaaaactatttttatttgcctatgatatacttggtttctaataaagtgccctaggctctagtgagaactgtctactttgaattgccatttactccctttcctcctttggccgatatgctcttggctagctttttataagttaatgtgtttccccaaaaagtttcactactttatattcatttgagtgtgatcctaaaacacctggatcaacagtacatctcatatgcaatctgcatcagctcc

SEQ ID NO: 135172 - DNA, 1039 bp, Homo sapiens
cctcttcttaccccaattttcttgtattaccctctacaatatactttttattgagcactttgctgctgaaatgctgcctcttgcctttttttttttaaattttaaattatctaaatttattgtttgttgtggtgtctatagcaaagtttttctatcaattttcccccatcccatccccaccctggactcatttgagaagacttgagaaatgtcttaatactcacactgctgcatgtagctcttgcttatttactggtctgggaaacaggatgtgtttcctttttttaaaagccaattgacagattacacctaaatactcctccttttgtatcattcagccttttgttttagtttggtaagttttaagaaatttcagcagcaaagttgttattcagtgggcacgatggactccaaatgcctcaagttatgtatacctgtcccagatgtaaacttcattgtcctttgttggatgatattttaaatggatataaaataaattggtctaaagggctgccctccttgttgtgtttttaaattttagttaaaaactgctacagcttatgactttgtactttaagataattgtattgatcttttttcagattccttgtattttttaataaagtaatcttaaataaaactcagataggttaagtgttagaaattttaaacagcttacattgttagcgtaaagttatcttttcttttttcctaatcagagttcttgaccctttggttattgagtttaaaacttcaattgaaattcaatagtatttatttttgaaaaaaatcactaaactgtgcctaaagaacataactgccatattaatgttttggtttatatcctctatagtaatagaaaaacatttaatacttgtaatgctgatgtgttaatttgataccagttgagtagaatgtgatcaatccagtttacaatctatcatgagtattattaactaaaatctatgtgcttttcaataggaatcattcttctcttgctgtaacacttgaccttaacttttagaaagtgttcattttt

SEQ ID NO: 135173 - DNA, 2839 bp, Homo sapiens
tatgaaacaaaattttgtgttttctgatttaataataaagatattgctatcagtatctaccatttactgaaggtttagtatatgtagatgttgcaataattctgaaagagattattcttttgcaacttaaggaaacaaaagctcagactagataaataacttatctaaattaagatacactgatgcaggatcagaatctagttttttgacttcattatgatgctggagcacttcccaatataaggggtgtgtgtgtgtgtgtgtgtgtgttttaattgaaaacagttgaaagttcaaagtgtgtgtgtgtgttttaactgaaaacagttgaaagttcaaagtactgcctatcttgaagatggcggagtagcatcgcaaagagattagtattgagtctctgggccgactttggttgcagtctctgcagcagcagtgatcacttagtgaagagtgcttagggtagttggccaggatcctgaatatcaaaatcttcagcggcagctcccaccagggcttatctcagaaaactgccgatcgcctgggcctggagctcggcaaggcagtgattgagaaattcagcaactaggagacctgtgtggaaattggcaaaagtgtacgtggaaaggatgtctacatcattcagagtggttgtggcaaaatcaatgacaatttaatggtgcctttgatcatgactaatacctgcaagactgcttcagcgagccagcttactgcagtcatcccatgcttcccttatgcccagcaggataataaagagtcaggtgacaatctcagccaagcttgttgcaaacatgctatctgtggcaggcgcagatcatattatcaccatggacctacatgcttctcaaattcagggcttttttgataacccagtggactatctgtatgcagagccaggtgtcctgaagtggataagggagaatatctctgagcagaagaactgcactattgtttcatctgatgctggtggagctaagagagtgacctccattgcagacaggctgaatgtggactttgccttgattcacaaagaaggccaatgaagtcgaccgcatggtgcttgtgggagatgtgaaggatctggtggccatccttgcggatgacatggttgacacttgtggcacaatctgccatgcagctgacaaacttctctcagctggagtcaccaaagtttatgctatcttgactcacagaatcttctctggtccagctatttctcacatcaacaacgcatgctttaaagcagtagtagtcaccaataacataccccaggaggacaagatgaagcaccattccaaaatacaggtgatcaacatctctatgagccttgcagaagccatcaggaaaattcacaatgaagaatccgtttcttacctattcagtcatgtccctttataatacagtaacttctgaggctttttaagaataaaatccaccccaccccttgttttcccttggtatttgatgacgaattcagcagaagacccagcttgctccagtgtagctttctatatcccacatcaggtatatctgagcttatccgaaatgaagaaagaaggattgagattaactgctgggacttcctatctgcattgtctcattctggcttccttgatgattctgtgagccttgcagctttaactatagctcagctgttacaagatttcagacttttgaggatgttgtgtgggggtgtttgactgtgactggagaagctcagactactctgcatgtgaatgcttcagggttttctttgttgagaacaaccagcagcaaagccaacccatgtgtgagcagttctccccaaggtctatgctaaattatggcaagagccctgggcaaccccaaacctagtcccggtggctgagcaccctgtaaggcaggagtaggcagttgggcttgagcagccatggggtagggggtggggggtggttgaggggggaggcagcacagcgcagcaaatgtttcttgggaggaagaagcctgatccatcatcatctgcttgactatgtagcttggattctcttttgtacctactcctttgatttggctttaccttcatccatcttgatcctttcctggccaaagatcctcttgggcccaaatgaacactgtaccgtagtcttctggaaagcaaatgtgcttcctgctatgtaatcgctaacattcacattacatgatttgctgtagcttgatcttccttagcctactaccactgtggcagtaggttttaggtggtatcatagtgccttttgattaatttaagtatttaattttcatcttctttctttggatctatttggcttttcaaatgaacagagatttctgttaaaaagaaaaaaaagatttgacgtaggctgggcgcggtggctcacgcctgtaatcccagcaccttgggagaccaaggtgggcagatgacctgaggtcaggagttcaagaccagcctcaccaacatggtgaaaccccgtctctactaaaaatacaaaattagccaggcgtggtggtgtacacctgtaatcccagctactcgggaggctgagacaggagaatcgcttgaatccaggaggcagaggttgcagtgagccgagattgcaccattgtactccagcctgggcaacatgagcgaaactcttgtctcaaaaaaaaaaagattcatgttattgtctcttgtagaggaaactaataaagtgtctgtatctgtgtgatttgaggtctttgagaaaaaaaaaaaaaagtattgcctatcttggtcttgccattttgttacttaactacagtacttgaaaggaaaggggctggccgggtgcggtggctcacacct

SEQ ID NO: 135174 - DNA, 1040 bp, Homo sapiens
tatccccatggttaagggacatacaactgtatgtagttagtcactagcgttcttttggctctatgtggaggtcctagcaggactaaatatgtgtcatatcttgctatcctagtttaagctgaatttctgttgtactgaaggctgctctagtattggatatattgtttatttttattagcagattcattaattaaaacccttctgtttctttcacagatgagtgccaaaccaaatatggaaatgctaatgcctggagatactgtaccaaagtttttgacatgctcacagtagcagctgtaagtttctatttttaaagtctcatgtacgttcctgccaataacacattgcatatttttatctagttgtcatctcaattatattgatatctttagtattcactgatgagtttagatatgcctgaggttatatgttcaactctttgttatccttttttgctagttaatagatgagcagattttgtgtgtccatggtggtttatctcctgatatcaaaacactggatcaaattcgaaccatcgaacggaatcaggaaattcctcataaaggagcattttgtgatctggtttggtcagatcctgaagatgtggatacctgggctatcagtccccgaggagcaggttggctttttggagcaaaggtcacaaatgaggtaaagccaacatttttggaaatgtaatttgtggattgctaatgggctgcatagagaactatggtggccctagataacaaacttgtagtctagcttactcaaaatatggtggctgtggatattaaatttctagtttagttattaacgtatgtctttctttaatggttaaataagatgacacagtgaaagcacctactccagcatccatttggtaataatgtataaagtaaatgttctttccttttttttttgtttttgagatggagtcttgctctgtcgcctaggctggagtgcagtggcgtgatcttggctcactgcaacaacctctgcctcccaggttcaagccattctcctgcctcagcctcctgagt

SEQ ID NO: 135175 - DNA, 1083 bp, Homo sapiens
cacacatacacatttgctatagatgtttgcttttcttttggaatgtaatgttactgttgaactttttctggatccttctctcattttctttccttctgaaagtttctgggtcactttcttattttttttttttgagacggagtctctctctgttgccaggctggagtgcagtggtgcgattggcttactgcaacctctgcctcttgggttcaagtgattctcttgcctcagcctcccgagtagctggtattacaggcgtgcgccaccacgcccagctaatttttgtatttttagtagagacaggatttcactatgttggccaggatggtctggatctcttgaactcgtgatccgcccacctcggcccctgccttggcctcccaaagtgctgggattacaggggtgagccaccacgccggccactttcctattctttcagctgttttcctattggtgtaatattggcccaagtcagacattaatgggaagtgtaaatagtatattatcatatatggttgttaaatgcaaaactgagcctagaacgctgttataattatggtatttgcttttacaaaaaatttttttcttcaagtaggcaactcttccaatacagttaaaatgattcttaaaataaaaaattattttacctgggcatggtggtacatgcctgtagtcccagctacttgggaggctgaggtgggatgattgtttaagctcaggagttctagaccaacctgggcaacatagtgagaccccatctctaaaaaaaaaaaaaaattgaatttttaaaaattaaattacttggccgggcgcagtggctcacgcctgtaatcccagcactttgggaggccgaggcaggtggatcacctgaggtcaggagtttgagaccagcctgaccaacatggagaaaccccgtctctactaaaaaaaaaaaaaaaatacaaaattagccgggcttggtggtgcatgcctgtaatcccagctactcaggaagctgaggtgggagaatcacttgaatccaggaaggggaggttgcagtgagccaagatcacgccattgcactccagcctgggcaacaagagt

SEQ ID NO: 135176 - DNA, 1025 bp, Homo sapiens
atccagtccagtcgcggtggagggcctcccccattgccagtcgacccggtcctacccggcgtcacgccgagggtctcgcgagccgagtcgtcgaatgctgtcccggttgcctcagtggggatcccgagggatgtcgcggcctctgtcccagggtcgccccttctggccttcgggctgccccaggacccgcagctgtaacagctttatttagaaggctcggctccccaccccatccctgggtctcccgcagtcggagccgagcccccgcggcagtgccctcgggatggggtcgcctccaccggaggtgacaggagcgcggagtggccggcgtctgacaggagatgccaccggctaccggaacgcggcctcagtgtgtttaggtctctgaggaaggggaaggcggtgggcccgagtggtttggtactggcgggagcgaacgtcaggtcgtccctcttcattgccactcctccaaattgctttttaggatcgtcggttttgctaattcagaggtgaatcccgtttctgagtatgttgttgagcttactgaagtggataaagtagttggttctcaataaatacaaatactttctccttaaccccttcttaactcagtatttcattttcttcgttttctaaaggaggtgagttccttgttactcctgagtccaagtaagagtaaatgtatgtatgggtaaaggaatgactttggtatactgcttttcttttttaaaactttttaattattattattattattattattattgtttttaactgagatagagtctcactctgtcacccaggctggagtgcagcggtgcgatcttggctcactgcaacctccacttcccgggttcaagcgattctcctgcctcagcctcccgactaggtggaattacaggcgcccgtcacgacgcccggctgttttgtatttttagtagagacggggtttcgccatgttggccaggctggtcttgaactcctgacctcaagtgatccgcccgcttcggcctaccaaagtgctg

SEQ ID NO: 135177 - DNA, 1034 bp, Homo sapiens
cctcggcgtgacgccgggtaggaccgggtcgactggcaatgggggaggccctccaccgcgactggactggatacccggcgggggtcctggagaaaggaagggccggccggcgggcgccccacagccggaaggggcgagcccgcaaatagggctcaccttcaggtcgttctctggcaggtacttgcacagccgcgctatttccacatacttgtccaggtctagcggcgccattttaagaataacaagccgcggcaacagcggcggcggcggctgtagcagcggcggcggcagcggcggaggccgaagccggaactttccctgcgtcacgtccggcccgtgagtggcgcctgcgcagcgccgttaaagcgcgacccgtttctccccgctacgtcggtacgcccggcgccccctctggctgaaccccgactgcaggccccaagagagcccgcttcggtccaccccgcgaaacctgctgggacccgtagtcgtctgccgcgggggtgctgggatgtgtagttttctgttgtggacagccacccctctcttttcctcccgttcctccagactttcacctcccggcagccggcgaggcttttccgaggcaaaacagcggagtaggtggtcctagccactcactggtttgtttttccaacccttttaagcactctccagaatatcttcacttaacaattgggtaagcctggccgtagtaaccgtttgcacctttccaagtccctgtgaaaacctcgcctaagcctgtggcagagatgtcaggccccagtcttccagcctgaaaggaagggaaacgaatattattaaagcatttctgatgctaaatgcgatacaaatgatatttttccttttaatcttcgtaacgattgataggaaagtgaggctaggaaactgcagttcaccccaaatctcacagggaacaaaatggtggggtcaagattgaaaaatggcttaagcttaagcatgcttccagtgagaatcccacgagggcagggagttttttgctgtaactccagcaccga

SEQ ID NO: 135178 - DNA, 1078 bp, Homo sapiens
agcgccgggccctcggggcggagcagggaagagggagcggttggcccggacgctcttccgggtcctgggaggagggcccggacctaagccccgcccctccggggtggagtcacggctcgcgactggcctaagtcgccgcaggtattgcagtccggggctggagggtaggggcgagggtccccggataccgggtctatcacggtctcgggcagggagtctgaatcttttaggggagtgggcccaagccgggtgcaaagaacggggaagggccttccctggctccgtcccggccactttgaccgaatcagcctgttctttcccgaccccgtctcctatcccctagaactgccacgtggggatgagatttgctgggctggtagcggcggctgctgcgggaggtcccgcccacgtgaagccagcctaactgagctctggactttggggacagctgtcagtggcctaggccgcaggtgagatttatccattcatctctcaatctattttctttcttcattcactagccactcccccacttctactccatgccaggtccattggtaggttctcggaatggatctgacaggcccagccctctaggaacttagtctagtggaatttaatctagaatctagtctagaagccttaaatagataaacattccaaatgattcctgcaatggtgatggctaataccttcagagcccagtgggtggaagaaggaagtaacttggatgtgggtggaagagaaaagggcaaatcagggaaggtttcaccagggaagggacttttgaactgggctttgaaggttaactaggagtttgcaaatttcccagaagggaagcgacattccaaataggggaagcagaacaggctgcaaaattatgaaaaggcctgccatattacaagaacagcaaaaaaaccaataatgcaagagattgtggaggtgagttcacgggaaaaaagctcaacagcagaaggccttactttctatgctatgttgaggccaagatttatcccagagctcagtatttctcagcttctttaaatattttgtcctttgagcggagagcagtggctca

SEQ ID NO: 135179 - DNA, 1030 bp, Homo sapiens
acctcctgggttcaagcgattctcctgcctcaacctcctgaggagctgggattacaggtccccaccaccatacccggctaatttttcagatttttagtagagatggggttttaccccatgttggccaggctggtttcgaactcctgacctcaagtgatccgcccgccttggcctcccaaagtgctgggattacaggcatgagccacactgcacccagcctgactccattcttgtgcttacagcttttaaatcttggggattttggactgtcttggcaaatcctaagtatcatcttcattcttccttgatgtttgtgagtatgagatccctgcccaaaactatgctggcccccctggggattggagtttggaaactgacttcactcagccccagagtcaaggtcagaagcccctctacctggatattttaagtgcctgcattctctctggcccagaaaccaggacgtggaccacgccagaagtgaccagccccccaccatccccaagaacattccacacatcatcggcagccattggaaaccagctatatgtctttgggggcggagagagaggtgcccagcccgtgcaggacacgaagctgcatgtgtttgacgcaagtatggactggtgggcaccttggggctggtcagggccatcccagtttacacattacctaatataggaagcagaagttagaaaaggaaagcctgactaagtgtctcacttctagacttctttgttatatctcttagctgatatctttttcccacagcaaaattggcatttaaaaagggatagtgaggcctggcatggtggctcacacctgtaatcccagagctttggaaggctgaggcaggtggaccgcttaaggtcaggagttcgagaacagcctggccaacataccttttctctactaaaaacacaaaaattatccgggcatgatggtatgcacctgtaatcccagttactcaggaggctgaggcaggagaatcgcttaaacccaggaggaggaagtttcagtgagccaagat

SEQ ID NO: 135180 - DNA, 2286 bp, Homo sapiens
cctaggctggggtgcagtggcatgacttgcaacctctgcctcccgaatagctgggattacaggtgcccaccatcacgcccggctaagttttgtatttttagtagaggcggagtttcgccatgttggccaggctggtcttgaacccctaacctcaggtgatccaccgacctcggcctcccaaagtactgggattattacaggtgtgagccactgtacccagccaatgattagcattctcactaataatagcatctgagctggctcctagagtacaagaaaaaggagttcacagtactttaaaatagataaaattcagttgagttagtaacctaactcattgttagtactagttgctgctccttgtagaccaatatgaaattacttttagctcgataaaaccaaaagtgtcactttatgcttcagactgaaatgcggggatctagatgtgctaatgcttgtcagtaacaactaacaagtttttctgtatgtaacttctaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactggtctaatgtttgtgagaagcttctaattagatcaattacttattttaggaaatttaagactagatactcgtgtgtggggtgaggggagggagtatttggtatgttgggataaggaaacacttctatttaatgcttccagggatttttttttttttttttaaccctcctgggcccaagtgatccttccacctcagtctcccagctaattgagaccacaggcttgttaccaccatgctcggcttttgcattaatctaagaaaaggggagagaagttaatccacatctttactcaggcaaggggcatttcacagtgcccaagagtggggttttcttgaacatacttggtttcctatttccccttatctttctaaaactgcctttctggtggctttttttaaaattattactaatgatgcttttatagctgcttggattctctgagaaatgatggggagtgagtgatcactggtattaactttatacacttggatttcatttgtaactttaggatgtaaaggtatattgtgaaccctagctgtgtcagaatctccatccctgaaatttctcattagtggtactggggtgggatcttggatggtgacattgaaactacactaaatcccctcactatgaatgggttgttaaaggcaatggtttgtgtcaaaactggtttaggattacttagattgtgttcctgaagaaaagagtccaggtaaatggtatgatcaataaaggacaggctggtgctaacataaaatccaatattgtaatcctagcactttgggaggccaaggcgggtggatcacaaggtcaagagatagagaccatctttgccaacatggtgaaactccatctctactgaaaatacaaaaatt

SEQ ID NO: 135181 - DNA, 2273 bp, Homo sapiens
cttttcatgtattatttaatgcttacaattccagggacataaaattttatatgttgtattcatcaataagttggcttaaaaactaaagtgatggtttgactgtaattttttttttttgagatggagtcttgctctgttgcccaggctggactgcagtggcacgatctcagctcactgcaacctctgcctcccgggttcaagcagctctcctgcctcagcctcccaagtaactggaactacaggcacaccaccacacctggctaatttttttttttttttttaattttcagtagagacagggtttctccacattgcccaggctggtcttgaaatcctgccctcaggtgatcctcctgcctcagcctcccaaagtgctgggattataggcagaagccaccgcctggccagactgtaatttaaataagggttaaactatgtgacaatacacttaattatcttttatccttttaggttacccatgcagttgttactgtaccagcctattttaatgatgcccaacgccaagcaaccaaagacgctggaactattgctggcctaaatgttatgaggatcatcaacgagccgtaagtatgaaattcagggatacggcatatttgccaaatagtggaaatgtgaagtactgacaaaacttttccctttttcaatctaatagtacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggtatgttccttgttttctgctttgctaatgagatctccttagactctgaattcaggacattgcatctagatacttagataacagacatcacagtaaccatgtcttttttctaggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtaggtcatcatcgcagcatctttcttagtgattcagtagcttgatggaagactcattagctattgctttagaaaataccagaatatgagcaacaaggtcacacagctagtaaagggtataagtgaagacaagactggggtagtctcaagatcattagcaactgtttaattcactgcctttaaaatgtgtgtgttagaacctaaccaaatgttagagagataaactttacatagctcatagggagaacttgaattaaaagttaaataacttatccttacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtaattacttaagtttgttaatatcatggctttttttttgagatgaagtcttgctctgttgcccaggctggactgcagtggcacgatctcggctcactgcaaattctgtctcccgggttcaagtgattctcctgcctcagcctccagagtagctgggattacaggcgtggaccaccacacctggctaatttctgtatttttagtagagatggggtttcaccatgtttcccaggctggtctccaactcctgacctcaggtcatctgcctgcctccacctcccaaagtgctgggattataggcgtgagccaccacgccagatctatctatcatggcatattttaaaagaacatgacttaatatgtcctattgaaatggctagggaactaagtaactgctgttttcagatgg

SEQ ID NO: 135182 - DNA, 1548 bp, Homo sapiens
ctggatggaagctgggaagagaaagctgcttcccgcttcggggtgagggatggaggaagggagaacaagcagtagagaagaaaaagtttcagatcccacagccccggggggtcactcctgctggacctactccgaccccctagggccgggagtgaaggcgggacttgtgcggttaccagcggaaatgcctcggggtcagaagtcgcaggagagatagacagctgctgaaccaatgggaccagcggatggggcggatgttatctaccattggtgaacgttagaaacgaatagcagccaatgaatcagctggggggggcggagcagtgacgtttattgcggagggggccgcttcgaatcggcggcggccagcttggtggcctgggccaatgaacggcctccaacgagcagggccttcaccaatcggcggcctccacgacggggctgggggagggtatataagccgagtaggcgacggtgaggtcgacgccggccaagacagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctggtaagtggggttgcggatgcagggggacggggcgtggccgcctggcctggcgtgagaagtgcggtgctgatgtccctctgtcgggtttttctgccagcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggttcgaccgggtttttctcatccagttagagaacgggtgggtggtgggagtatttagagttataagtctctggaaaagtgttgagacaacagttgaaggttatagacatgatgtatgtaataactttaatactattagtatgttacaaaacttaagacagttgctgtcgtactgtctacgatagtttaggaataaaagaccgattaaaactgaactttgtaagacacctatactccctgaagtatttctagtcaatttgcagccccaagggaccaaaataaaccaaattgtggggatggtagtgggtcttttaaactttgagatgtcattgtatctgtgtctgaaaacaataattctttaaaataggtggttgaaaagaaaactaaaccatacattca

SEQ ID NO: 135183 - DNA, 1008 bp, Homo sapiens
agggagagacgcgtgggggatgggatgggaagggacaggaggaccgcggggcggcctcgggtgggggccagagacgagaggcccggcaggtagggaactgagtataggaggcgagaacgaaatggaatgtcttctgagtgtcgctgataaagatatcgtgctgcagggaagcttgacaagctggacacacgggtctgggggcagcccacctaacacagacactcactgtacttggcatctttccacttgctgtcggaggtctgaaagtgagggagctgttggttgtttccatcccttttcttttaacttcaccttttattgactggcaaaattgtagtgagtgctggctaggcaaaccacagaagtacacccagggttctgtgtataaatgtgcataaaaacagggagacatagtgataggttcagatgagaactaggtcaaaggaggaatcagtgtttttatttttaaatttatgacgaaaatcagttctgagcaggactttgaactagagaggggttttaaactggagttcattgatggatagaattagaagggtcctttcactagaaggaggataaaatgacatcattatttttattgactgctaactgaaacttattatttccttcagttacgaatgtggacaacaagccagagtagcattagcagcgcctatgactttgtgatcaataaaaattacggatatttttgcatcatgtttacagttgcagatagctcagaatatcatttatggttaacacttctttgaatttctggtgttactagacccgccgttagacattgttatttaatgtgataataaggctgtacatatattatgaccatattagtttgttgttttgctaatatttccatataattggtttcccttgtaatcacatgtatttaattatgcacttaaaagaaatctgagaaagggaccataggcttcaccaaactgccaatgaggtccgtgcacaaaaagattaagaactcctgaaataatt

SEQ ID NO: 135184 - DNA, 1033 bp, Homo sapiens
gatgcaatctcagctcactgcaacctctgtctcccgggttcaaggaatccccctgcctcagccttctgagtagccgggactacaggcgcgccccaccgcacctggctaattttttgtgttttagtagagacaggggtttcaccatgttggccagggtggtctcgatctcttgatcttgtaatccgcccgccttggcctcccaaagtgctgggattataggcatgagccaccgcgcctgcccaaatgtaactgaattcttaaagtattctcctgtcccttttgattttagaaaagaacttaagtgacatacataaactttaaatctttatctttttactcttagtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccaggtaaagagatgattttcaggttttaagttttgtgaaccactatgattctgtaaataaattagtaactataaataaatgaatctgtttccaacaaagtgcattatttaagataatttacatcaatgttaaggtgagtctttgcttataatacagtttatttggattattaagtaacttaggcacttttatagaaaattgtaacttaagcattgacattttatatcacaccaattggttttgtgtctttgtctatataaaatgttattgttggctgggcgtggtggctcacacctataatcccagcactttgggaggccaaggcgggtggatcatgagggcaggagtttaagaccagcctggccaagatggtgaaactccgtctctactaaaaatacaacaattatctgggcattgtggtaggcgcctgtaatcccagctactcgggaggctgaggcagagaattgcttgaaccc

SEQ ID NO: 135185 - DNA, 1098 bp, Homo sapiens
tttgtatttttagaagaaatgggagtttcgccgtgttggccaggctggtctcgacctcctggcctcaagtgatttgcccgcctcggcctcacaaagtgctgggattacaggtctgagccaccgcacccagccccaatacttttcattgattctgatttgataagaggaaattgtcctttgtactttttagttttgttgtcctttactcattgagttgctgttagtttaaaaaattttagcaattcagagtgacctcattgttgggaccataatcaactcacatatccatgtttggatatagtatatgtgttattattattaatactattattttgcttgtttgctctttttttttttttttttagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgt

SEQ ID NO: 135186 - DNA, 1058 bp, Homo sapiens
agagtgaaactttgtctcaaaaaaaaaaaaaaaaattcaacatcttaaaaaaatatgatttttaagatgtttaaattttttcatgcttgtccaccttaatgagaaatttcgttccagtattttaaagggaaatgtttcactgtttttttcctgttttaacagagctgtgttgccgctttccttgatgttgtgattgggggccgtgcagtggagacccctccattgtcttccgtcaatcttctggaaggattgagcagaactgtggtttatataacctacagtcagcttattactctggtaatggcttcattgtttaagagaatttctcgaaagtcttttagctaagcgtgagcaaaaacatacatgagtacattgtgtgggaaatacatattgtatttgaaaaagtgatttcattagctaatgttctttgcttttgccaggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctataggtaaagagaatttctcgtattggagctttctcttaaatctaatatttcattagcctttgttattgctgagtgttttggaacatatgtttaagtacttgggaaagtctttctcttcatgtttactgatggtatttcagtttttagaaatcgtatcagattagttaaggtttatcagtagtctttagctttgcctacatacttttcataattaattgaagtcatgctatccacagtatactttctttaaattttattgtcttttcttgaaaaaattttggaaatgttataagtagtcatctttaaaactatgtagccctcagcctggtgtggtggcacgtgcctgtggtccctgctacttgggaggctgagatggggagattgcttgagcctgggaggtcgaggctgcagtgaaccatgattgtgccact

SEQ ID NO: 135187 - DNA, 1251 bp, Homo sapiens
gcctggctaaatttttatatttttagtagaggctgggtttcaccatgttagccaggatggtctcgatctcctgacctcatgatccacccacctcagcctcccaaagtactgggattacaggcatgaggcattgcacccagcagattaatttgttattagcaccttaggataaattcctagaagcagaatttctcaaagggcatgtgtttttttaaggtataaaaagtattaaaaacactttaatcagttgttagtcttttatcaaggcatgaaaaattgtgtggtggctcatgactgttttaaaaagattgctcacactataaacatttctctaggtccttcaaatcgctccaattcagtgtcctccctagacctagaaggagagtctgtgtcagaacttggagcaggaccttctggcagtaatggagttgaagctctacagctgttagaacatgagcaaggtaaagtgaagttgaacacagttgcctaagtagcaaagaatttacctgattgcaagatgagcagtgtgttttcattaagttggcttggttcagtaagagattaaatcaccattaaacttaacatttattcatcattccttcagttcttcaaaatctatttagttggtaagtggattgtttaggcttaataaattaatataaattacttgaaattcagtaatatttgatattttaattatgtaatattttagggatacaatgtaaatactcaaggctcaaggaacttagaatagggaaagaatagtacacaattgatttaaagtatcatgaaagtatttggcagttctgagtgagagatacatatggttgaaagtatagggaaagctgctgggcccggtggctcacacctgtaatcccagcactttgggtggctgaggcgggtggatcacctgaggtcgggagttcaagaccagcctgaccaacatggagaaagcccgtctctactgaaaatacaaaattagccagggtggtggcacatgcctgtaatcccagctactcgggaggctgaggcaggagaatcgcttgaacccaggaggcggaggttgcggtgagccaagatcgtggcattgcacaacaggctgggcaaaaagagtaaaactccgtctcaaaaaaaagaaagtatagggaaagtttattggaagaaaatattagccttgagggctggctggcattgccttggcagaagttggagataggtcattctaggtgaaggacaagcataagcaagtca

SEQ ID NO: 135188 - DNA, 1914 bp, Homo sapiens
aaatacaaaaattagccaggtgaggtggtgagcacctgtaatcccagctactcagaaggctgaggcacgagaatcgcttgaacctgggaggcaggggttgcagtgagctgagatcgcaccactgcactctagcctgggcgacagagtgagactctgattgaaaaaaaaaaagatgggccgggtgcggtggctcatacctgtaatccctagcactttgggaggccaagacaggcggatcatgaggtcaggagatcaagaccatcctggctgacacggtgaaaccctgtctctactaaaaatacaaaaaattagctgggcatggtggcaggcgcttgtagtcccagctactcgggaggctgaggcaggagaatggcctgaacccgggaggcagagcttagtgagcagagatcacaccactgcactccagcctgggcgacagagcgagactccatctcaaaaaaaaaaaaaaaaaaaagatgatgccctcaactaggtttgacacagtgattttagcatgcataagaattacctggttagctttttaaaaattccatttcccaagtcttacttctaaaaaagaagtcagtttttagaaagaaaaagagtattgtcattggagtgtgtgtggcttgaaaaaagtaatgctgtattttactggatttgtttatcagtgtattaattaggattaagtttgttgcaagcagcagagaaaactcaagtaataaagtagtacctccttatccatggtttcaccttccatggcttcagttacccatgggcaaacttggtgcaaaaatattaaatggaaaatttcagaaataattcataagctttaaattctgtgccattctgaataatgtgatgaaatctcacacagtctcactctatcacatccaggacatgaatcattccttagttcagtgtatccacatatacactacctgcctattagtcactgcttatcagatgaaaacagcatggaatatataggatttggtacgatccgaagcttcagttatccactggaggccattgcataagtggaggaggaactttcatatgagcttatgaaagaagttgaacaaatgtcacctctttagcaaacttcctgggagattctgagataggtggttggcatatgcaaaatgctagattaagaagtgaattgataggccaggcacagtggctcacgcctgtaatcccagcactttgggaggccgaggcgggcggatcacctgagattgggagttcgagaccagcctgaccaacatggagataaaattctttaaagttgattaaaaagtcatagctgtgctactattttaaaagtgcttaattttgtttttgatagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtaactgccatttaatgtctctgaaatatcacggtttagttattcaaatccaccaacctttcatgggagggagcaccagtgccctgacaaacattgtgtgtgttagcaccatctgggaaactgttataactgtatggaacaaggcatttgggtacttttttctttacttaaatataactagtgtttttcctttctacatttaatcccaccccttacccatcctcctcccagctgcccaaaaaaaaaaaagaaagaaagaaaaaccagtgttttgaattagcttctggtcaagtgttgtttgcagggcatagtataagttcttagtctgtctctaattagtatattctctgtttgaagccaaacacctaaccttaagatgaaaattctta

SEQ ID NO: 135189 - DNA, 1039 bp, Homo sapiens
tccaccaaaaccagtcaggcgtggcggcgcgtgcctgcagtcgcaggcactcggcaggctgaggcaggagaatcaggcagggaggttgcagtgagccaagatggcagcagtacagtccagcttcggctccgcatgagagggagaccgtggggagagggagagggagagggagaggtgtaaatagatttcttaattggttttacattactttgttccagatgccaaagtggtattgttcttggcagttagctgtatttgcgcaataagctgtatttgcagttgagtgagtgctatgaagatgtgtattttcctgtgaatgtatcttattgccctgaatagtgactaatatgctggaagaaaaaatatttggccagcataacattctgtggttaaactctcagtgtttttaatctttgtagggctataaattttagaacgatattaaggacccctgtaaaatttgctgagaaatcaaagctaaagctgttgaaattacttgacttaatgatgtgtgttttctctatggagagtcaaaggtgaactggaggaaactggtgaaaagggtattgtgccattgtgaccaaagtaggaacttgtgtttttagtggtgtgcttgattgaagttattcttactttggcctctttcttgtaggtagagaggaatttggtggttttttttttttttttgagacaaagtcccaaaatgacacggccatttttatttttgagacagggtctcactcacattgaccaggttggagggcaatggcatgacctcggctcactgcagtctctgcaccccctgcaacctctgcctcccgggttcttgtgcctcagcttcccaagtagctgagactaccggtgcacgccaccatacctggctaatttttgtattttcagtagagacggggtttcgccatgttggccaggctggtgttgaactcctggcctcaagtgatctgcctgcctcagcctcccaaagtgctgggattacaggtgtgagccaccgcgcccagccaggagattttgttagctagtg

SEQ ID NO: 135190 - DNA, 1104 bp, Homo sapiens
gtcacctacgtggcaataagagttgtgccttaaggcaaacaagactgactttcttatttcacaaacttacttaaatcctttttagcctgagcaacatagtaagaccctgtccctacaaaataaaaataaaaaattagctgggcatggtggtgtgtacacctgtggtcctagctacttgggaggctgatacggggaggatcgcttgagccagggaagtcgaggctgcagtgagctgtgattgtgctactgcactccagcctgggcaacagaatgagatcctatctcaaaacaaaacaaaaacaaacaaaaagaaatccttttcttagtaatttatcctgctatccaactccaaataaagcctccaactttttctacagactgaagaacgcaaagatagcgatgatgagaaatcagacaggaacagaccttggtggagaaaacgttttgtttcagccatgcctaaaggtaattttataaaatattagaacgctgtattagcaataagaagcaaagccccagaatctctttcagagagccaatgtctcaactcctctgtaagacttgctgggcttaagtttctagctactttgagggtgtagaaagtggttccactcagatgaatgctaaggcagagctttagaaatgttcttgttctttgcaggaagtgatagtggtttcataaatggaagtcatgcctgtcactattgtttaaatatcatataccattgaagttaaacatatagaggacttctgacatatatattgctattaattattgcaggaaaatgggacgttattggtaattaaacattgaaaactcatcctttacattcctggaataagttgaagctttttatgtctatgttcattgagaatgtttatactgtaaatatcagtgagtgtttattttggaaggtagctgtataaaattgtttacttttttggtgaacagcctggcatcatttgagttggcaaaagcatctcttcctgaaagaagagagcatccaggagtaaagctagaaacttattccaaaggcctcttctcagcacggtggcactcaggaactctggggagagctgctttcacgccatactcaagcgctt

SEQ ID NO: 135191 - DNA, 1043 bp, Homo sapiens
actgactttatttaatttccagctcctataccatttagaaagaaagaaaaacaagaaaaagacaaagatgatctggggcctgacagattctcaacactcacaggtttgtagacccatggacttcctggctccttcattcccagagcacatatttcataacactttttcttgggtgccataagcgttgcctttctagaagagtgtgtctgtgtgtacagtggggagtatgttcttcatagctctgtggtttccagttggtggccacagtaaacctgtgtgctcttcctgcagactgccaccaccatcatcatcctcattatcataactccgtttatgatgaggcccctgatcctgagcctctaggcataccctacaactcaacatctagtgggatgatgacacacagtgccttttaggaaagtgtggtgacagttttggtgctgtgcatgctgtatctttggatcattgattgaatagttttctctaacattgatcgtagaattctacatttattttcatctacagtttgttcttgattattcaggatcacagtgaaattctgttttacctaatcgtttccttttttgtgataaagtgtttgttcaaacagtatcataaatgccaaccattataatgaaagttttaaaaactttactaattttttacagcttgaaccattttaacattgccatctgacccaaggaaaatacagctgggggttgggtttttacctgattaagcgtttgtatttctgcagctgctttttggcacattatgaatgagcaccctaaaaggacagtttgagagtagtgttaatgacccagtcttgggtttgatagctgtgtattgtttccagtggctattatagagcatcttgagcaagtttgttcaacccacggaccgcagaccacaggcagcccaagacagcaggacagcttcgaatgcagcccaacacaagttcataaacttaaaacagtatgagatttatgcaggaaccctttttttttttttttaagctcatcagctatcattagtgttagtgt

SEQ ID NO: 135192 - DNA, 1021 bp, Homo sapiens
ttggccttccctatatgcttgtttcacagctctgtgtgaaatgtagtgttttctttttcttttctctctctcttttttttttttttcttttgagacagtatcttgccctgctgcccaggatggagtgcagtggcgcgatctcagctcactgcaatctctatctcctgggttcaagtgattcttctgcctcagcctcccgagtagctgggattataggcatgcgccaccatgtccagctaatttttgtatttttagtagagttggggtttcgccatgttggccaggctggtctcgaactcctgaccgtgggtgatctgcccgcatcggcctccaaagtgctaggattacaggcgtgagccaccgtgcccagcctaatacagtatcttcaatctgcatttgattgcaaaaaactgtgtataaatggacctgtgcagttcaaacccatgttgttcaagggtcaactgcagtttactacaatttcacggagacatgaataccatgtgtttgtttcatgagaacaaaagaagagccgatgagcatgctacttaagctgtctatgtcttgatttcgtcttctgtaaaatgaggatgataacaacgtttctctgtaaggttgtttgatcagtagttgagataatctctgtaaggtacttagcacagttcctggcatgtggtaagtgctcaataaatgttagctgctattagctgctggaaacacaacacacacacacaaaatacgtatatgtatatatacacataagtgtgtgtgtgtgtgtgtatatatatatataaaatctagtgatttcgatgtgtttgtataatttttagaaaatgggattctaccagaatgtgaacatttatggtcacctgcctggcctaggactaacccaggagtttgtgtttcactatggaactttgtcctgtagatctatagcaatcccttgctttaacaacccagttgactactattttagattccaggataatatttttgatgtgctgattttgacagagtaatggtc

SEQ ID NO: 135193 - DNA, 1007 bp, Homo sapiens
gagatgcaaaaaagaaactgaggcttgctctttgctctgcggactctgttgccttcccagtgctgacccattcaacaaggaatggtttaccagaccacacagacccagaaggtaaattgctgcaggatcgtttaatttttcctatgtttatgggttgcaccatatgaaattgccagtattcagctgttgaagctgtacagcaattccatatggttcaacttaatatgtttacattagtatcacttaagggcactttgattactgatgatttattaaagtattttctaattgggagtggcaatacagcttagttctaatgatacgtgacaaagcagaattgacgtcccaaatgctgaattagcttatttaagcacatggaaattctcaagaataacagaattcttgtatcttttatttagacaatgaaattgtatgcttcttaaaagttcaaatagctgaagcaattaatttacaagataagaatctaatggctcaacttcaagaaacaatgcgctgtgtgtgccgttttgataataggacttgtaggaaactgctggcttcgattgctgaggactacaggtaatataccccacctgttcagcttttaaacctagttgttagctgcaagtgttttcttttttatccttatttcagaaatgaatctaggcttcctacaaagtgcttggctgtattttcctggatgtagatttctgtgttagtctgttctcacgctgctgataaagatatacccgagactagccaatttaccaaagaagaggtttattggacttacagttccatgtggctgggaggcctcacaatcatggcggaaggtgaaaggcacatctcacatggcagcagacaagagaagagaacttgttcagggaaacccccctttttcaaaaccatcagatcttgtgagacttattcactatcacgagaacagcacaggaaagacctgtccccattgattcaattacctcccactgggtccctcccacaacaca

SEQ ID NO: 135194 - DNA, 1249 bp, Homo sapiens
ccagctaattttcatatctttagtagagatggggtttcaccatgttggccagaatggtctcaatctcctgacctcgtgatccgcccacctcggcttcccaaagtgctgggattacaggcgtgagccactgtgcctggcctagaaacatatttttataacaaattccttgcacttaaactttcacatatttcttgctttttctcctgatttaattatatggctacatattgtcctaaaataaactacactgaaacacttttggctttaagatcatggtgtctgcatagctagtgattaaaattatttctatgatttcctttttaaaattatttagatagtttttattaaactatttaaaaattattattttgctttggagactttcagaaactcaccgcagctgacgataaaactgctcaggtagaagattttctgcagtttctttatggtgcaatggcccaggatgtcatatggcaaaacgcgagtgaagaacagcttcaagatgcacagctggccattgagcgaagcgtgatgaaccggattttcaagctcgccttctaccctaatcaagatggggacatacttcgcgaccagtaagtacttctatgttgagtgcctatgtggaactacatagggatctaccaggtagcccatattttaggcaagctatacgtgtaacttagtgtctgattgtaaaaggaaattcattggttaccatttttcacctgtcagagttacatgatcacaaagaataatacccagttttcagggatgtgggcagtcaagctggaaggagtagaaattggtatagcctctttggaaagcactgctgtttactctgccttaactaatcttcccttccttctcgtgattaagtcttacttatgcttcaggtcttgacttaagtatcgtttccctgatgaagcctgtcctgactaggttacatcctgttagggctctctcaggcctcggtgcctttctttagtacttgccacagttgccatttgacatctgtttgagtcatggtttctgaacccagccctactaacatttggggccagattgttgatgatgtgggaggctgtcctgtgcattataggatctttaggagcatccctgacctctacacacaagatgccagtaataccccaccagttgtgacaaccacatgtcttcagacattcccaaatgtcccttgtgggggcaaaattctcccctgttctttttttctttttcttttcttttgaga

SEQ ID NO: 135195 - DNA, 1051 bp, Homo sapiens
aaaatttcaggtatttgagctttctgtttgtttttgttacaacccccactaatgagacatgaattagcataaaattttaaattatctttagttttttgaatctgttatttctggaattactgcaacaatggtacatatttttaaattaacctcttttatcacatgtgataaatctagttcctgtgtagagccagtttaagctagttttaaggaaaagtcctcttttagtagtttgtacttctggaatcagctactaaatgtagagaagttccattctagctatttaagaaagagaatggtttgaaattttgtgaattctagcttctgtgctgttgaatgccctttttctattaatggatatctggtttgctgtattttaaaattcagagcaacttatttaaaagttctaaagttacaatctttagtgaaggggaaaggggcctgcaatatggttttaccaaagagaggaaaaagcaaccacattatcctctgcctcctgacacggaggttgcagtagtcactgcgcagggttgccactggattcagaatctgtatattgtctatggtctcacttaggtttatcttcgagaagcaccatggccatctgcacaatcagaaatcaggacaataagtgcttataaaaccccccgggacaaagtgcagtgcatcctgagaatgtgctctacgattatgaacctcctgagcctggccaatgaggactctgtccctggagcggatgactttgttcctgtgttggtgtttgtgttgataaaggtgggccccttactactatcagttaaggagttatgtggcattctgagcaggtggcacagggcttcacacaaccatagatatcttggctcttttccaagtcacaagctctgggttactcagaaagaaagtgcctaatgtcaagatttgttcttttgagacagaatctcactctgtcacccaggctggagtgcagtagtgtgatctcagcccactgcaacctccatctcctgggttcaagcaattctcatgcctcagccacccaaatagctgggattac

SEQ ID NO: 135196 - DNA, 1122 bp, Homo sapiens
agtgaccaagaccaaggcccaccaaggcagcagactgttaatcagacaaacagatctctgagaaggtgcatcagctgctttgaaggctgaagattgttttgtatgatactgcacagcatcaggcattttaaagcagatctttactaaacaggttaatgagctaacaagcaggttctctcgtctttgggctctttcctttctgagttgcatattctattttcttgtccccaagtagagactagtactacaaaaagggaccacatttttcaagtatttctaagtataaaaaacaaaacaaaaatctcttaggaaatgtctagacctccattcttggattccctttctttccttttattttaaaaaagaacagtacccctcttttaagatgctgtcttacattaatgagcatctaatggaaagaaggtatgagttgcactgaggattagaatagtggtgcgttagtggcattatctataaatacactcacctaaattgaaagctaagaaggaaatgtaaatataatatatatttatatttgatgtaatatggacatctgcagattctaataaacaaggactattgctgatagtaggctgtgacatactgtcttgtgaaatggtttccttgacaaaatttaagctgagcttaaaagcaaaaaacaaaaagtacacagaaatatttattaaaatgtaatacagtttattgaactttctaggtatggagtttgatggacagggctgcctttaatgagtgtgaaggtcactaagtcacttagacatctcaccgtggaagtttgtgagcctgcattaggagatagactgattaccatacatgacataaaaaggaacagtggatagctcatactttatggtggttcttctcctccgaaataatatactgcagaaatcccagacagagctccttacaaacctttaattgtaatatatttttgatgattattcacattgaatgcacagaccaagaattcagtgaatgtcattttttaaaaaactaatttgtattgtctgctctagtgatacaagttttactagtgataaactattttaatcaaccatactattcttatggaaaaaaatatctattttggcaggtttctgtgcc

SEQ ID NO: 135197 - DNA, 1097 bp, Homo sapiens
cccagttcaagtgattcccctgcctcagcctcgcgagtagctaggactacaggcgcatgtcaccaagcccggctaatttttgtatttttagtagaaacggggtttcaccatgttggccaggatgatcctcaatctcctgacctcgtgatccacccgccttggcctcccaaagtgcgggattacaagcgtgaaccaccctgcccagccagaaactagattttctttatgcctccaccccttcttattcatttactttacaataccaaaataacaaattgcataggagtgtgggatgtggtttctgccttctagagagagatcagaattaaactagtactatgaaatgtccttttgaatgttaggtcaagaaatccatgtacagagtcgtgcacttcattggctgtaactgtcaaacttgccttgtattagaagttaaatcccatcgtaaatacatcacgaggccagctgtgtgatttctgagacctagatgagagtccatttacttcagcctttgattcagtaaatgttaagcagcagaagacttcgaatggttgaaattcattgttacaggatttaactcataaaccaatgagagattttttttttctctgcaatggttgctaagtctattccatgttaacactgtggaaataaatatgaagatgtggacattgcatcggggctcttttctgtggaagagaaggtggtgggattggggtgaagggctacactggaggcaggagatagggctgtgctgtgttggagccggggctgagggtagaccccccagagatttgacatctgtgacacctgtgaaatgggttcgggtgctcatgactccatagctggcggaggagcacagcacagctgttgcaggggcagctaaggtttcctctgaaaatctgtcaggagcaaggactactttggcattaaccatcactgtttgatttcttgacaggtatgtgagatggggagtgatttgatttttttttttttttttaatagaaaagaggaatagttgttccccaaatgtttcttcctccactgccttccagtactttctttacatgaaagattagtgtaaaagtacaaaatca

SEQ ID NO: 135198 - DNA, 1001 bp, Homo sapiens
ctgaggtgcgtgagcaagagaacaatctcagccccaatacgggggctgtgttcttgccgtaagaatctgtagctgactggtgtgctgaacccgggcactctttttcctattgtttgccatggaaatttccactttggaccgagtaaggtcaactaggtgttttaaaattgtttttctcctatgtgattgggtgtgaagagggaaagtaggaatacactcagaattattactggattgcataaaagtgatagaagtgtagtggggttcacttcctcaattggtgcttcctagatttttctctcccatctcttcctgctttgtttctttaaagaaaaggctgttgtctctctttttaaatatttaagtctagtgagtttattttgtacgcaattgctttaattttaagggaagtaaatctgaaactatcttgaagcccaaaggatttttagtaagtggattaacagtgatgaggtatttgcgattactttaaatgccaaaatgcttgagaactttgccaggttaaaaattacttaatatattttagaatgtaggttagaaagtagtaggacaaggaatagctttattactcttgagaacacttggataaatgaaaatatagtttgcttccgtgttaagttgtggttgagctatggagtgaccctggagctgccgcatcccacaggcctgagctcagcaagggttcaattcaagagagatgacgtctccacttggataatggcagacagtgtgggtagcggccatgcactaggggaattcacctctgtcaaattaatactctcctgtctactggattcttcttgtgcttcacctggattaaaaagctgtactgcctcttttgaaacagataaaacctttctataagtctcaattaatgagcttgcacaatcttgtatatgtacaggaaacccctcctgtctcctaatgtgattagtactgtaaaatattctataaaactgattaaaaggggagagcagtttgat

SEQ ID NO: 135199 - DNA, 1019 bp, Homo sapiens
cccacgtaaggcctatgccctccctctaagggccccactgctggctctcccctccctaccccttcctgcctccacatagtagccccaggcaggaggcacatctttatgcattaactccatgaatgtaagaaaaactgaggctaattctttctaaaatgataaaatttgtctgtattacagcattccagcccccagcttcctgaaagctaaaaatattttaatgtcatatttccatgtaaattttagtttagaatttaatacccttttaacatacattaaattgttagcgttcttcaagcccttgactattttaagggcttagctgatgtgcattgcagaaaagggctgggggaggctgtaaattatgagggaaagttctagaagcaaggttaccctaaaccaccacgcccacctcatcttgagagttactcttcaggacaaacgctggaatcctggggagatgtcaaatgtcttggttttcctgctgggaaacgtggctatgattggtggcatccctgggggacccgaggatctgctgcagagcccaggctgggagacgcccagatggctgaagggccagggacaggggcgctgcagttgcacgggctgggctcagatcctagtgctgccacttgctggcaggtgactttgtcatgcttatccatgccggtctccttgcccaaaatgggaccaaggttagagttcatgcacaggtgttctgggtgaattcacaggaaaagaggttatcggctccacagaggaggtaacttccagggtgaattggctggccttgctgagagccgctggtgacatgtgagtgcagtggtgacatgtgagtgctagggctggcagagaggcagggaggggtcctggcaggactgggagcagagggggccccgggccacaggagccatgggcaggcccaggtcctgctcccacagcaacccgccagcagctgactcagggaccagggccccccagcctcggcatcgcctgagagacctgacaccactctggcg

SEQ ID NO: 135200 - DNA, 1062 bp, Homo sapiens
cactggcctccagcctcaatctgttccgtagctcagagcctgcctgccagggccaagtgccctagagtccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaaggggccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggccacaccagatgcctc

SEQ ID NO: 135201 - DNA, 2068 bp, Homo sapiens
acaaaagctggacgtctccacttctgacatttgtgccactaattagtttctgcttggtattaaattctatcttctctgtcttactttgaaaaacttacataagtgtaaatacagttctacatatccagattttcacttcagtactcacgagtggaggtacagtttcagtatctgccctgagcatgtgaccagtgcttagatgccacatttataccctcttatattgcattttatttacatagcactataaaagcaaatctgctcaaaggaggcccaattaaaaatgcaatcttcaaagcaattagcattttatcatcaaataccagttccatcatagttaaatgaatgaccacctccctgctatatgcagggatgtatgtgacatataagagatcactgacagatgctatcccctcctttacagccaggcaaaccttggaagggacagtgccttgccaaggtcccacagctgaaacatggcagagctaggatttcatcctaattctaacttcaggaattatgctttttttcctctgtgtctcaggcttttgttaaaccttaatttaaacagaatttaacaattaatgcaaaataatttgaactaattggaatattaaactttacatttttttaaagtcatactaatacataactttttcttagctgattttttttttttttttttttgagacagagtctcgctctgtcacccaggccagagtgctgtggcacaatctcagctcactgcaacctccgcctcctgggttcaagcaattctcctgcctcagcctcccaagtagctgggattccgggtgtgtgcctccatgcccagctaatttttgtatttttagtagagacagggtttcacagtgttggcaaggctggtctcaaactcctaacctcgggtgatccatccaccttggcctcccaaagtgctgggattacaggcttgagccactgcgcccagcatctcagctatttttttacaactagtgtctcagctattttttacaaagacagcttgctcctgtgacttaaccctgttcctatgaaaaccgctggtggtcttggaattttcaaaggtaacttgcctacctctgattccctctaacgccccagggagatgcctggtgggctgcagctgaggaggtcattggccccctcttcctcttctacctgagatgaactgtgaggtgtctgaggctgatggtatctgataacaggtgttcttttgttcagtcagtattgaagtgtgggcagttccttcttcccagacacctatggtggaaatttactatgtggcataaattactcatgtttattgacagattcatttccagcaagaggtcaatgaattgttacactttaatatataggtcttggtctgggtgaaattatgaaagtgtgaattctgattattagctattattctgttgtgaaagagtctccccatcctgccaacattaccttctctgtagttctcgcctccattccttttcagtatcctttctgcacctgtctagctcaaaactgcactcactcctacctggctgactacgggaactgcttacctcgcctccaggctccagggaaccagggagaacaccctaaaacacagtttgcccatttctttcacttgccctgcttaaacccctctagtgacccccatcagctggtgactccaggcactctcagccctttgtgtccctctccctcccacctgcctgccacacatgaccctggtttgcccagagctcccatggagaccctgtatgtttgcccatgccgtttccttgccctgtggcatcttcctctttttcacccttctccaccctcacctttacccagctgactccctgccctcctccaaaactgcggaggtgtcagctcctcccaagaaactgtccctagtggctcttctccacctctggccaggtgcttctgccttggtgtctccacggcagctccctgcgtttaccttcttcacgctcatcatatttgactctcggtgttcatttctctgtcctttgctctagcccatgctcctggcagagcccagactgaggaa

SEQ ID NO: 135202 - DNA, 1088 bp, Homo sapiens
gtgaaagcctgtctctactaaaaatgcaaaaattagccaggcatggtggcttatgcctgtaatcccagctactcatgaggctgaggcaggagaatcgcttgaacccaggaggcagaggttgcagtgagccaggatcgcgccactgtactccagcctggacagcagagtgagactctgtctcaaaaaaaaaaaaaaaattcactaaatgggagcagattagtatgatgatgaaaaaagatcagtgcattacttatctattgccacaaaacaaattgccccaaaacatagtggcttaaaacagcagtaacatttactgtcttacagtttggtgggtcaggtatcccacagcttaactgagtcctctggcttggggtctctcaaaaggctgcaatcaagacatcagctgggactgcagtcatctcagggtttcattcagacaaggtcttccaagctcactgagtcgttgctggcagagtttacttccttgggaacaccctcagttctccaaagagaagcttacatgatggagctggcttcatcaaagtaagcaagagtgagagagtgctagcaaggaataagttacagtcttctataacttattcacagaagtgacatcccaacgcttctgctatattattcattagaagcaagtcgctaggtccaggccacaaacaagacaagggcattacacaagggcatgaaaagcagaaggtaggatcattgggagccatttcagaatctgccacaatcagtgaactctatgacagaacaacagaaactattcaaggcacagagaaaaaatggatgaagagattagagcctttggagtcatagcaagtgttctaacatatatgtaattgtagtcttggtgatggaggggaaaaactattccagatttgatttcaaatatcaaaccagcaatcttggaagccaaatgaaagctaagcatgataaatataaagaaaaccacaccaaggcacattataatcaaactgctgagaaccagcgataaagagaaaaatcttaaaagcagccgaagaagacatattacgtagagaaaccaagataagaatagttgctgacttctc

SEQ ID NO: 135203 - DNA, 1050 bp, Homo sapiens
aactgaaaactgaacttactgaagccagaatttagaatccaaaagttattccacataatttatgttgtaaagtgcccaaagatgtattaaatgaatcggcttgatgttatgtgttttatgatttccagtatcttcatcaaattaattcagtgactcaatctagcaagttcatcctcagaccatagaattaatctgtggggcgtcttctgtttctttattatttaaaggattaatggtaaccctttttatcttttgtgtctgttgaaccttagaaaaaagttattttaacatcactaaagaaatgaaagtcactatatttcataagtttagcctgtgatttttatcagcatagtgatgtatgtttgtagctgagtttacatcaaaaattgttcttggggccttcttgaatgaattatggcaaagagagagagtctagaagtagataaggtttttgatttctgcaatatatttcctttttcatgtttttatctctggtagcacaagtgtcttgccgaagaccggaacgtgtgaccaactggaataatttagttgtgaaaacagagcagacatgttattaaacagctttctttacaaaaagacattaagtgtagggaggataatgaagttgtccccagtcttagttgagacatgtttgtcagaattttgaacagaaaagaaatggtttttaaaccttcgactgtggccagtttgcagtgtttattgagaaagccgctgtcaaaccattaatttggtcgtcataaggcatagaactcaagtttaattgatgccatatccaaaaagtgtgtgaatagctgacttggcaaagagactgagcatttgagcggctgcagggaaatacataattacacatactgcgggaccggagagacccaggctcagaagccgtgcttcgtaaacaacagttctgtggctctctttccattcccctcgacttctccctcttaggctggggtctcagagggaagatttattgctctgtccctgtgagtgtttaaggacttgaacttaatggctaaatagatacatgcc

SEQ ID NO: 135204 - DNA, 1095 bp, Homo sapiens
gcacaatagtgagtgaaagcagcagcggtggcctggactgcctcactcctcaggcacactctcaggctaaacatggttctgggtggccacatgaataaaacattttcccttgttagtttccagtggggtacctgtggagtacagttcaagtaatcacataatctgaacatgcgtgttcttaggaagtggattgatcttccatgtttccatttcactttgccgttgaacactaaggaggtgcccctctccattccaagacacaatcaggaggaggcgtgcgtcacatttaactcaaatccctgggtccgttcagtaatttgaagttggcaattctgatattaaatgattgttcagtccctattgtgacagcatttcctgaaccaaactttggaattgacttatactaatgaactgatgaggcagaggatgcatgctatcaagactgcctccagaaaactccgttaccacttttgcactaaatgcagtgattggcttagggaaaaatcacctaactggtaatattggaaacactgtgggctttttcttaaggcctagcttcctctggctccctgctcccagagccacccttttgagaattcctatggagtaacccagggttattaatgacaatgtgtcaggttcctcaggtggctgagaaagaattgagaattggaagaagttgagaagcactggcatgatggaattaatgggagtcggattcatgagcgttcatccagagttctgtgctcctttaatcacttcctcatctttggcacctgagctccaacagggcctgaacatggggaagatcaggttttccccactctacaagtgatactgtaaattctcttagggcctgctgcttcctagctgacatcataggctcacctgaggtatccatttactgagagagtagtttggtgatctagctgtcctagtgcagaatctttgtaaatgccttctctgcagagagaacttagcactcattcaaagacaagtctttctgggattaaacagtcccaggtctgatttcataagctctgccctggtgctgtgtcctgtgctgactgctgctctgcgttcgttcgtgtccag

SEQ ID NO: 135205 - DNA, 1052 bp, Homo sapiens
ctcatctgcccattattaacatttcagcaaaatataaagttttcattaatctcccacagcaaatttaggagtgaaaactggcacttgtttgagcttttaggactacattagctggtgtattaaacaaaatatgtcattcttcagtagcttctgtaagaagctaaatcaatttccagccatatttatgcaccactttatctaaaagcatctgaattatcatttatagctaagatgctttattagcagctggcattgaaattgctcagtaaaaaattatatgtcacgttatagtaatttttaaattggttttaatccaacatcataaaatgtaaaaatcttaagtgtgggttttttttttttttttttagtaattggcattttagcataatgagctgttacctctttccaaatcaaatacctgcaatatttagaaaacactaattagtaaagcaaacagaagttcttgagctcagagctaaattgtatctaataatagcattttctcagaaaagatgacttgaaatgatttttaaaacattaaatgattttaatattttaccaaaattctctgcaattctcatgtataagaagttctaaaatagaaataaaacatgttttggcagttatgtttcagtaaaaatgactggaaaaagtgaatgattatttgaaactccaaatcctaaccagcctcagtattacccaggagagagtggtaatcaggatcatggcatctctgtccaaaatcataggtgctgcaaagaaaggaaaggggctacccagtggcccttgcagatgtggagtgaagctctgcagtgtcctggaggtgcaatgttggttaagtcactctgtctctttgaccctcaccttcctgtggacatggcacctggtattcgttcagtacatgtttattgagctctgctttatcctctgagtggtagcactggcagtgtctgagttgcagtggtgagaaagcagtccctgtgttcttggggttatagtctaatggcagagacaggcaattactccctgtgataactgttctgaagaaaaat

SEQ ID NO: 135206 - DNA, 1055 bp, Homo sapiens
gctattacaattgtctttatatgctatgagagagaagcttacagatgaagcagatatgacaagagtttctgcctaggtactgagagctaacatttgtgcttggatcttggcctaaataagaaaatgacaagccaaagtccttgagctttccagtttggattcttgtcggataatctactacatccttcagccaaatgcctgctagaagctggaatcataccagaaggaagcccaagtacattatggggaggatgtaacattacaagacttccattcttgtccaagcttctatatacatcctggcaccaaactgagcctcaattcccttgtctgccaaatgttgccagtgacctttcccaccaaccatgtggaggtagtccatgcaggtccttagaagaaaggtgccgcttgaaccaacttattctttccacagctttaagagagaaagtggaatttcccatcatcagggccaatataagcctgaaattaaactggctttatggaatactaacaaagtgtcagacaccatctttctgttttatccctgactagtctgtcattcacagtgcttaaagcacagtcattagaatcaggcagaccttgggtgaaccacttgcagcctgtgacagtggacaaattatgtcatctctgatttcatgtgtaaatggaggtgaatgaatctatttcacaaggatttggtgagaattgaatgagatataagtgctcttattataacaacattttaggccatgtagtcatcatccttgttttatagaagaggaaactgaggggtgaagtgatttgctaatatcacatgaacaataatgagaggcctggaaaactgtcttttattcattaagtctggtgaaagagctgaatctaattattgtatttcctaaatagaaggtggtgtagagagagacttcagttgctctgtaaacattaattcagcttcctttgatctttccttttgaaggagattcacagaatgtttaagttcatccattatttcagcacttaatgaaattctcatttcctaattttaaggttatact

SEQ ID NO: 135207 - DNA, 1086 bp, Homo sapiens
ggctggtctcaaactcttttttttttgagacggagtctcgctctgtcacccaggctggagtgcagtggtgcaatctcagctcactgcaacctccacctcccaggttcaagcgattctcctgcctcagcctcccgagtagctgggactataggcacatgctgccatgtccggctaattttttgtatttttagtagagactgggtttcaccgtttctatggtctctatctcctgacgtggtgatccgcccgcctcagcctcccaaagtgctgggattacaggcgtgagccaccgcgcccggcggttcaaactcttggtctcaagcaatccttctaccttggcttcccaaaatgttgggattatagatgtgagccactgcagccagcctgtatttagaattacatacttttctcagtgattgtttaatatctctcttccctgctagattatcaggtctgtgaggatgaccctggcccataccaagttgcccttcatatagatctgctgtagactatgtgctacaggatctcagtaaatatagattgaatgagtgaatgaatggtagatctttactcatgccactgaccctctaaacaagatcaggctgctactctttggatgtttttggttttggttttggtttggttttggggtttttttgagacagagtcttgctctgtcacccaggctggagttcggtagtgtgatctaggctcactgcaacctacactttctgggttcaagcaattctcatgtgtcagcctcccaagtaactgggattacaggcatgcaccaccacccctggctaatttttatttttatttttattttttatttttagtagaggtggagttttgctatgttggccagactgctcttgaactcctggcctcaagtgatccatccatcttggcctcccaaagtgctgggattacaggtgtgaaccaccacaccggcctaggatgctactctttgactagggccccagacagcctcttccgccgagcatgcacaaaattcaccaggaaggtgaaatatgcttttggcatttggtagcaaattctcaaaggcagaaggttactgtcccc

SEQ ID NO: 135208 - DNA, 1049 bp, Homo sapiens
ataatagaacagtgaagaatgtgaagccttatgcaaaagaaaccccaaacttccatcctggatagctagaccctcaagacagactttaacactttactaaggctttatcagcttttcaccagtatgtggtgttttttaaatgttaaattcgctgtttcagacttcctcccctcctcctgcccctttgatcttccaggccctcagtaccgcctggagaagcagagcgagcccaatgtcgccgttgacctggacagcactttggagagccagagcgcatgggagttctgcctggtccgcgagaacagtacgttggccgcctcgctccatgcccgctttgtccgttgcaaacttgcttagaagtcatgtgtttggaaacgctcactggtctggtttccctaggcagatttgaagtgactgttttccaaggcagactgcagtcttcgtgccaaagtatatcccaaagtgaaatgattgattttgtgctttttggtagagaggctgcatcctgtttagcactctgtgattaatattttcctgttaaactgtcttcctaagttgggagcatccctggaaacagcttagaagcatgaggccttttctgaagtaaaggctattttgtatataaagcagctggccctgtcagtatcactattcagacatcaggttttagaaaattttaaccatttgcatattctagcaggaggcagtgtagtgattccttatgctatgttgagaacttcaaaacttgttaactttgttcattctctcttcagagtttccaaattgtgcattttgccatcctctcctccatactcccactgacacaagggcaagtgatgtgtgaaactgcgcttgcggcagcagactgtctgtagtcattcctgcttcgaggcttttacacaggctatttcttccacctggaatgctccttcccccattctggttaataactctttctcattctttgtctcagtttaaatgtcctgtcttcagaaaggccaccaggatcttcctgtcccccattgcttaaacctgatccacctctcgtt

SEQ ID NO: 135209 - DNA, 1323 bp, Homo sapiens
ttaggatggatagaaagccttgagagtggggtaaggaatttgcatctaaactagtagcctgcaaggaagttgtgaagggattgtatgaaagtgataccttgaatctaccagaatttggctctggagagcactctaacaatagggtgaagagtggttggctggaggccagaagaaggttgggaaaccattactgcggcctgagtgagaaggaatgcaagggagatgtattaagtgggtagagtctgcagaacttgggagccgatttaatgtcatcaacaagggggaaggctaagaagtattccaaacttgagagtgccgtgttcactatgccaagtccttagaggccagatgcagagtcttgttcatcttcatatctacagtgactagctcatgacatggcacatggtaggagtttagtacagtttgatgaaccaactgatttaattcattgggtgaatcgtagtgtcgtcattggaagcacagttacaaggaaaaaaagctggtttgagaatggaaggatgataagtttatagttgattgtcctgtaaaattagaagcaaaaaagagcttagagtctctttcttcctgcaaaggctggtccaaccattcactggcagtggtgcttccctgaagagttggtagaagtccctaaagaggccctgtagccttttgtcccaccctgggctagagccccttccaccagggccactggcatcaagctagccaaagaataatcctggtgcctcactgaatctgctcaaaatcctgtcaagtacatacaactactgtattatccgcatttaacagaggaagagactgaagttcagagaggaagtggtttaccgaagcctctgacataagcagatttgaatgaaagtcttcagattccaatatatcataacagagtctgctgactgaaaacaattggctctaagcttgctctccactgactcaggttggagtcaccactttcatgtagctcagagaaggttgaagataaatgaagtctcatttttgtttcttctgttttttgtccttaggtgcttgtgactaaattcactaatttcactggctgtcaaggctgtgttaaggaaaatgggtttgaactgctgtgggttttgagtactggactggatgtcagaaacctttgccatcacgggaaattctgtcactctggatttactgtctgttccccacagctaaattcctctgcagtgtgatttagcaccctggatccccatcaaccagttttggcatttatttgaatgcattaccccactggtttccataaactattttacaattgtttaaaataaatgactg

SEQ ID NO: 135210 - DNA, 1006 bp, Homo sapiens
gacctcgtgatccacctgcctcggcctcccaaagtgctgggattacaggcgtgagccactgtgcctggcggtccttccattttctaactgaaaagacttccttgagtcctcaggtttgggagttcccctcctagagggagtctctctggctcccaggctcaggcataacttcattctttccactcgtttccacgcatctcctaattgggctaccagcacccctccttgatgcaggcagggagaagtggacagggcagaaagggctgggtaaattcatgagcagtaaatgactccatcaacagtggccatcaagggaaacaggccatgttccagccatggaagctgggaagggacactaatcctctccagagatcagtatccctcagccacttaggcttgtggcagaggcactgtggccctgtccccagtaagttccaaatacactgatcttgccagctgctggtaagcaccttgcaaaagaagagaatgagagcccccgcttttccttgagtacagtgaaagctccttttggagaggtaggttccttatggtttaccagcaccgcagctggcccagggttggtggttagcacatttgtggaatgaactaagatgtagtgaaaaccagtccacagctcgtagccacgtgtctctcagccagcccacacctgaggccaccactttgtgtttaggagtggattcactgtactttggttatcagagattaaactcccttggagaattacatcatcaaatgaaaatgtaaatgtgtttaaaatgaaaggcgatgcatatccgttgaaattagtgttgccgcccagattcccgtaatgatgtggatctcttctgagtccttggggagccagaggagtataccaaaagcagacattttaaacattgatagtcacgtaagggtgcccagcaggaggaagttactgtaggaagctactgtattgcagaaaaagaaaagaaaagcaaactcactttccaaaggacgtgtgggtgtg

SEQ ID NO: 135211 - DNA, 1073 bp, Homo sapiens
agatacttttttccattacactttaatccttaaaacaactatttgaatcagttgtcatgttcattttataagtgagaatactaaagctcagagaggttgcaggacttgctgaggtcgcacagctagtaggggagtaaggactcaaagccaaatggccaaaggttgtactgctagacactgtggtgcttccttctactggataaggttacggggcccacggctcagtggaagctgttgcctttctctctagagagaccaaatgtccctgcttcagctgggggtggcagcaagactcagtggaaacagcatgggctttggaaccaaaccaaccccagtccccaggccacctgtcccttttacaagctgtgaagttagggaagtcatcagccccttctgacctcagttgtcttttctgtaaatagaggtaataatacctatcttgcagggttattgtcttaactgaatgcatgtaaaacacttagtccatagtaggcgctcagtggacatcagctgccatcatccctattgccactatcatgccaggcacgccataaaacctggctttctctttaggttttggtttacttccttttctatccatatgatttggcctttgcctgcaccttttgttttccagtgaattaagtctatagaaagtttttaccttgtggtagaatgagcctttgaattgtgtttgaattagaatctgctggaagcacactttattttgaagaaggagaaaactagacccagagagtcaactcaaatgattttttttactaataagtgaaccataccatatatctatagggatggattaatggtcacaagccttatttatcagatagcttatgtctgcaaatttaatttcctatgccaaagattctggaaataatgtgaacaaactgtaattgcctgtaacaaacacatttataagtaagttttaaaagtctttgtgttcacagtttagtagctcacagaccctgttgctgtttctcagaaaacatttaaaagaggaagtatacttaaatatccatgtgattttgaaaatgaaaatgattctataattacag

SEQ ID NO: 135212 - DNA, 1057 bp, Homo sapiens
tgtatttaaaaaaaaaaatacagccaggtgcggtggcttatgcctgtaatcccagcactttgggcagctgaggcaggcagatcacaaggtcaggagttcaagaccagcctggccaagatggtgaaacccatctctactaaaactacaaaaattagccaggcacggtggcaggcgcctgtaatctcagctcctggagaggctgaggcaggagaatcgcctgaacctgggcagcagaggttgcagtgagccgagattgcgccactgcactctagcctgggtgacagacatctcaaaaaaaaaagtgtgtgtatgaataaagaaatatatttactagctagttagagcattttcttttcctccttctcaattactttggggtattactgccctgcggccccacatgacgtttttttgtctggggctccatgagcttagtatgatggcagtatctgcctgtagtgacatctactgacacaagccaagtttatcagttgtcaatccttgttgcaagatttggtttggaagccaacactaggaacccatggtgctgctgacccacacagaccacttaggttcaacttggacaaattagaagaaccttccctaagcgtgacctctctcacatggaactgctcacgctagaatcgtttatcactgcccccccgccacccaccatttgaagtatatttattcaacctatttttaaataattggcacctcagtatgcacttactttaaaacttgcttaaacacggccgggcgcggtggctcatgcctgtaatcccagcactttgggaggccgaggcgggcagatcacgaggtcaatagatcgagaccatcctggctaacatggtgaaaccctgtctctactaaaaaaaaaaaaaaatacaaaaaattagccggatgtagtggcgggcgcctgtagtcccagctacttgggaggctgaggcaggagaatggtgtgaacccaggaggcggatcttgcagtgagccgagattgcaccactgcactccagcctgggtgacagagcgagactccatttcaaaaacaaaacaa

SEQ ID NO: 135213 - DNA, 1048 bp, Homo sapiens
aaatagaataaggaataaaagaagatgcttgtgttctttgtaaccaggcctgacaaaatgagtataaattatcctggttatttattgtttgcttgattcatagaggaccaactgtgtgttgtttcttttcattctgttgtattagcaaacattttcattgtccagattgtcctcgtgtatggaaatgtaacatatgcagcctgtttaattttgtatttgtaaatctgacttgatttcctttttggcaacagctactgtctagagaaaagaaaggatttttctttgtgtctgtttaaagtgacagaaatattggagcaagtgataaagatggaaagcattaattacacacttctaagaatttaaaggtcagacaagctaaatatgtatgttttgctcactggaatgtcttgaaattgtgccaggattcgctttgttcctaccataaaagcacacattttagataaccatcaacttactttgtatctaaaaattatgccagattgttgctttagttaatatgtgtcttcaaagtcggggagctcccatttctgagcccatgtgattggtttggtgatgcttccccctttggccatgtttagttactatgtctcattttgatttcctctgttctcccctcagcttatgtcggagtctgtcagctgctgctatgtacatgtcaggctagtgacttggaatgtttattaatacaatgtcagtcttgctgttgaaaaaaactgtgatgcttctcagaaggttgtgatagaacgaagcgtttgatttccagatcctgtctgcactgcatggtgaatacattctcagatgttatgcagttcactgacctgacagttatggaaccccgcctgggaccccatttcagcaggacatatttgaacagaaacagtttgcaaaactttacacacttaaactcctgccaaggcaaactgttagccacttgagtttgttataaatacccagtggcagtggttggaagtagcccacggtgtgttttatattctgaacggaatgtgaatgtctttgcagttatata

SEQ ID NO: 135214 - DNA, 1046 bp, Homo sapiens
catagttgctattgttatttctgtcagggattctcagtgggaataatttacactaaggtgagaatggggtttaaccttcctttgagttattttttattatataattaatatgtgtccattatagcaaaattgggaaatagatctgtttctgcatataaaagaaatttttaaatttgtcttcattccatcatgcaaaggttgtgaattatattttataattatttacattttttaaaggggaactaattaatgaatttctcattggaaaattattctgtggagggaacgtgaaattggatgtcttctgatgttcttactaaatcaggactagatctatctagctttccctctagaacccctgggccccaggaatcccctggatagagttgttgttcagggaaggagaatggattattctaacaacttgcaaattaggagcctggtaatggaaactgcctcttttaacaaatcttcaagtggattcctaagctatccattgttcctgattgattttggacagagcaaatatatctataaatgggaatccctaacttgctgactactttgagcttaagcagtaaagatgtttggatatcagtagtgtcagagaggagaagtagggagtgggaggaatgggaaggtttttggctgacccccaaaaccagataaagagctggagctcagatagtgcccagcatctcaagaagtgtttcttgccagcagtgaccaagccaaagcctactgttcctttagacaaagtaggacaagggagaatgagatcttgagtgggctaagtgcctctcaaggatagggacctgccttgttcgtctccttctcccattcccaacacagacctaatttagtcagaatttgtgagactgaattgagttcaaaagtggcaatgacaaaaacaactgtggtagtattattaccttatatgtgttgacattaaagtttcatgccaggattctactctggagtgggggaagaagggcattaaaggaaaaaaaaaaaagtcaaggccaataaaatggtcagaatctcct

SEQ ID NO: 135215 - DNA, 1589 bp, Homo sapiens
cacagtgtttcactatgaaccctgccttctggagaataggaaggagggggaaggcagagagtaacaactgctttaaacttaatactctgttttttgatcctgaattactcccatccctgtgttcccactcccagacacacacatagcccagtcaatcctttttctattttaaaattcaagagagtttatttgatgtgtctggagtgtttctgaaaacacgaggtaaagtgaaatctttatatgtgagcattaagaacaaaagtgtcaataaattttctttttctcagtcgtctgatgaaatagtacagattactgaccgtttgccctgtgtgtattttcttggttcagcaacctcttactcgcctttctggtctatattctaagttagtaaagcttctcctacagatgcagaacagagcagaccttcaggagtctgtagggatgtgtctaaagtttcagagaaggaaatcccagcaaaataaataaagccgtaactactcctcctcgtcatttcccccctttcctccttccatttgtctcccagtagaggagggacaagaagtggctgggaagacactaagctgaaacagaaagaggcaagtaggtttgacatagggagtgaactaatacttactaagggccaactatgcatatgctatctcacttaatcccaaaatagcccagtttttatgaacaatttagaggcgtggaacctgagggtgagcaatattgttcttaggcctggatttgacgccatccctgactttaaagtccatgccctttccaaccctctgctgaaagattgaggctggggaatctggtgttggtttaacctgtgaatctcactgtcttaaggctgacattcagccactgctatagtgcagtaggtgacagcatggtgggctgtgagccagatcgcttggatgccgatcctagccttgcccttactagtgtgtgtggtcctggatgaatatttaacttttctgtggctcagtgaaatggagataataatacctacctcacagatcagttatgaggattaaatgagttaatagatctgaagcacttagaacagtgtttagcatatgtacgcatcatcttagtgttagctgctgttattgttactattaataaacaacccttggagagcaagaactgaattatctgtgcccacaatactcaccatcactccattactgtgatagatctgtcacacgtatttcttgaatgggttactgagtagatctctgccacttctacatttttcttctccgactttgttttatagcagaggaggggtagtgtttaggtggacattgctcagctggactgaaaaagctgaattggaataactttcagtgaacatgggcagtgggtaaacatcgaggatctacatactttcaaatgagtcctcttatgagcacacatcctctgagttagtagcaagaccattaacttcttgaagactaggaaggcacagtcttattgtctctctgtatcctgagcacccagcacagggcttcatggagaaggaatgactgaaacttcaggtgtctgtgggctgccaggaggacacctgacccagcagt

SEQ ID NO: 135216 - DNA, 1041 bp, Homo sapiens
cataaaataaaatccactggaatataaaagtattctgttatttaaagttatcagattattgaacaaattcatgatatagtaatatgtgtggctttactagtagattaaacaatatccagctgtatacctaacagtaactcctgaagcctgttgtttcaaagcggtgatgagcataaatggtatttgagaaatctgcaacagctgtaatgtgctgtagtgttagctatgacttctgttcatgacagagtcactggcactgtgattctgctgtgattgtttgcctacacttataaatcaaggaaatgcaaaatattagaagttagtgaaaattaaaatgtagtttttatccattcaagtttatgagctcctgagttttatccacatgtcccagttgttaagggaaaacctgctgcatttggattttactctcaaacctaagctttttttcaacctaggcctcagcagtccttctcatggctgtctcctgggaacaatagcgatccctttggcaccccctgctgttagtaaccagcaaattcactgctcaaaagggattgctttagaagacatttccctgtctctctcaacatactgcctttgtttgagattgttacagaaaatagggttatgctacatatgatatatgagtattttggctctttctacccttgagcaaagaaagaataactgagtacctgggggtaagctggggagtgggccctcaggctttcatggtggccgtttcatccctactacaaggtcaagtttggtgtaaataacagcaaattttttcctgctttttcatttcagaggtactaaaataactttaaaggatatttaaaataattgaaaagttggccaatgatgcctccatcttaactatttttaatcttgtataataatcgtgtgtatatgttactcagtttcacttgtagcacacatatttttgtgttatttttacttgacattaaattaggtcaggcgcagtggctcacgcctgtaatcccagcactttgggagaccgaggcaggccaggatttg

SEQ ID NO: 135217 - DNA, 1067 bp, Homo sapiens
ccccctttacagttttgtttgtatctgttttatatatatattttttacatttgtattgtagctagtgtaatgcttattacttttcctccctactatgctgtaagctgcttttagggctgatactaaatctcacctttgatctaagaggttaggttctttgtcgtagctgcaatagggctcagtgaatgttgcaagaatagagtagtataaagaccttcatttcacactgtttttctcccctttgcattgccatgtgtattctctctatcaaatgaagtaggatttgggattttttactgtatcaccaggcttggggtaaagaaaagcagtctcctcaatttgcttgctgtgcaccataccctctggtcttcttgtcccttccctaccttggtattcactcgcctttttggttttcctttcagtgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaatgtgagtactgactctattacttctctcggtatctcatcccaaccttctagcattttggatctgattttggttttgttcatcaaataaatgatatttggcatctggagagtccactggtaataacgatgactcccagagagatgctgaggacgacattcgcattgtatttcatgcctctgcacctaggctacgcagactgctttgcagtggcacattgtgtgaagcagatctctgaacggcatgtccagagccaggcctctggaaacactggtgcactgggagcctgtgaagcaaaacttctaggtttgcaccttctctgcgaggaatacacactaactgaaaatgtgcactgtggccacttctctcttgtgacttaaaataattttctctcagaccaaatttgaccttccctgtcagttgcctgccttgagactgagcacatgtcttcagctttttttttgtgccttt

SEQ ID NO: 135218 - DNA, 1067 bp, Homo sapiens
aggaatcagtcttcttttccttcctctgttcctgatgctcaggacaggccacagcccaggggggcactttacaaatgtgttttgaatgaatgatttcacacttcatatttaagaactggggagaataatagcacttggcagtgaaccttttgcatctcaaatcttagcctgtgatatttattgaatttgttttgagaggatttggggatgtcccttaacaatcaaagcagaattcttctgatatcattgttggacttttctgctttgatcaataggcttattatttgcccctgaacctctgtgatgctggagaatcaaacattcctcaggttgatttacatggcaataaataatctgtgctgtctgttgcttgttccatccatgtctgccctgttcataaaaccctgggggctcagtgacccaaggttccaaggttggaacacagtggacatgttgactcccattacagttgtgtgtacatagaacatgctgctcagatgcattgttgcttaatatgcatccacaatttgtgtttaaggattggtgcaactataagttagtttccatatgactttcttattatagttaccttcccatttattttttacttctgttacatgccagacactacatatattatctgatctaatctttacaatctctgagggacgattataccctttttatagaagtggaaactgaaactcgaggtgaagcttattctctgaaatcacatagccatgagccatggagctgaaatttgaactcgttctgaccacagagctctcttagccagtataccatgacattttcctcatccaaagtgctttcttttgcctctctaattgttctgtttttaagttagtacccggctgcagagatccaaaagtttcccatgccattcaaagatgaattttaaatatcttaacagcattacaaatacctgaaatgtaaagtgacaaacatagctagattactttcttgttatcaatccatttagcaaatttacagtttccattaattttaatttgtccttattacttgttttttataataaatatctctta

SEQ ID NO: 135219 - DNA, 1050 bp, Homo sapiens
gtgggttttagctggctccattactgcaaccttttatcagcaatgtctttatgacctgtattttgtgttgacctcccgtctcatccaaatgccttaaccatctgggaatgcagcccagtaggtttcagcctcattttacccagctctatttaagatggagttgctctgactcacacgcctttgacagaatgagaccgagaggtaggcaggggtcacagtggggattgagagaagtggacagattctgggagtatttgagaaatggaattcacaaggacttgggctgaactcaatatggagagtgtggcagaggagaggcttcatgactcacacaccgtgatgcactgtggtgctcttcactgaaatagctagcattggaacagcaggttttgttggggcttgctgtgtgactaggagggataggggcggcatgagtttggttttctgcctgttagtttgaggtggctttgctagatctaaacaaagtgttcaagtagtcacttgtattttcttgtctggagtttagaggggagagatatgagctggaaatatgaatttaggagtcatctacgtaaatattaattaaaacttctagcatggatgaatgaaaagagagacaggcctaagactgggtggacattgaagaactgtgtggatggcaaggtcgaaatgggatatcctatagaaataggtttctcagtgtgagtggagttcagttttgggtgtaatgaaggcggagattacttgagagacatccaagtgaatgaagaagtcttttttctttttctttttctttttctttttctttttctttttcaagacagtgtctcactctgttgcccatgctgctgcaggggtgcaatcgcagctcacggcagcctcatcctcccaggctcaagctatcctcgcacttcacctcctaagtagctgggactacaagcatgtgccaccacacccagctaatttttgtattttttatagagatggggtttcaccatgttgcccaggctagtctcaaactcctgggctcaagcagtctgcctgccttga

SEQ ID NO: 135220 - DNA, 1144 bp, Homo sapiens
gtggaactagcccccagtctctgagaaggcaagcacctgtttcagtgctgcgggcctaaatccttcctgggagagtatgacagcttcccaggcagctcatctcattgtctcaaggacaatgagacagttgccagagaggcacccagtgctaaggtccagggacacactgagttagtagcaaagccagcctcctaacaccaaacatgaactctactcaccactcatattttcctcttagttgtagtgcccatttaccttcctgctggcagatcccgatccattagtttattataaaatgaaaatttaaggaaaaaaaatccttgaaactagacagtgtttccactttgggaccattccatggtcacagtaggtctgtagagcaaggatgaaaaatggctgtgctgcccacaggcctggagagcagtggggtctgtataactggcagtgtgctttgctctcacgtgtttgttctgtccacagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaagtaatccattctctttttggctgctctagtttcttgtggtcttttggccacccaaggtgtcttctaggctggttagtctttctaggcattggcctggaaccacacttctgcactgatccagctctgggtgctcaccaggtctcgcgcctgtgcatctcagagaatcagcttgcaaaatagacttagaagtttgtgaattacagacatgagaacatggatttttagtaatttccaaacccttttatgatccctgctaataagcaacctggaagggaacgggaggggattgatgtttgttgagcaccaatcatgcattgggcactgggctgggcactttgtagctggtatctggaatctcatttgatcctcccagctccctgggaggtgagggtaatgatcctcattctgcagtggtggaagctcaggttcagagctgttactggctgaaggttgcacagtgagagatggcagagtcaggatttgattccagg

SEQ ID NO: 135221 - DNA, 1174 bp, Homo sapiens
gcccagcaggaagaacttgctttttattagtccctgtttgtcccaggtgatacttgggccaggctttctgacttgctgtctttgttatccacaatcagccttgctgtccctgttactcacacttagatttggctactctccctgtgtcctctaccaagctctgttggcgctgtgcattgaaatcttccttaaatctcacttctttcatgaagtctccttcagcaactcacacttcatagacttctcttttcagctttgggattgagcggtcttgcatttacaacagctcacttagcagagctaaagggcttgtaaattcaaaaaagggaagtagtgattgctaggagccaccatgggtttcctcagaaccaagcagggcagaacaagcccatttctttcttggatagggttgttagctagatagagggctgtggttaaaattctttgttctgaatttcagtaaagcatcaatttttgcatagtattcttgcacgcaagctggagatattctccagtcacattgtggtcaggtggactttgcacctggctgagagacgaggcacagagtggtgattaatggatttatgtcaaactggagagctatctttcgtggcaagctgtaggtctcttgtgtgttcattgctgtcagggacctgaatgagaacattgatgataggctgatgacacttgtggaaggcagaaggctgggaagaatagcaggcatgtgcagtgacaaagtcagggactaaagtggtcttgacacaccaaaatgatacttgcacttaagtcataagatgcagtcatttgtgtatgggggtggcagtggaaaaggggaagaggaagatgaggtttaaccaagtagcacatgaaagaaaaggtttagggtcatggttaattgtaacctcagtatgattcagcagagccaggtagttagaaggaaaactcatgcattcatttctcaaatatttcttgagtgcctgtatgtgccagggacttgactaatgctgaggatacaatagtgaatgagatagtccctaatttaatggtatgtgtaatcttgtagggaagtcagacaattataatatagcataataaatgctatgagaggaaaagtttagtatggtgagtttcttcttttttttttttctttgagacggagtcttgctctgtcacc

SEQ ID NO: 135222 - DNA, 1057 bp, Homo sapiens
ttagctttttttcctatgtattttcaaaccagtacttcctagtgtttttaaagtgtttggtttcattttttgctttcagttttattttttttctcttctgtatattaatatgtccctttcaggataactttcatctgttctaggcaatgacacctgctattaggtgttttctgcctttggcttggtccacagttgtgctcatcttagaaccagcctccttttttctgttgttcagcagcagttccccagggttcactctgacacaaatcagtggtggaggaagacttgggaatagggaatgtggtctctgccctggagccgtgtgtcctttaggagaaggcacttcaaagcagcagctgttcccattacaccagccgcagctgataccaggagttcatacatgtcccaggttgaactgagctgctctagttgagccatatatgagttaacatgtctgttaacaatttctatttagtttaatttagtgaaaacttatcaaccccctactttctgggtcccatggatacagacatgaataaactgctacgcctgctttgaagtaacttgtagactggtaggtatgcaaatgacaataaagaagcattaagaaatttctgtataaagacttaccttaaaaatcagaatttcatgattgtatctctcttcaagccatagatgcaaaatcatctttacatcatttagcatgatttatagtgtaggtgtagttttgcattctgcttttttacctgcttttgtgttgagtttttcttgtttgtgtagaatgcaaatagtgtttagattacattcctttgggcagatatttcagttcactagtctctttctcagacagggctgcttcatgaacggtcttgtggcaaaaggtagggcgcattttagcaaatagtagagcagtgatctctgttggcaaaggtgccagatcagcctgaacatagggtggaaggcttttttcttgactttttaattgagcagcagctggggagctaagaaagaaaaagatggtttgggaaatggagagaactcactgatagttcatatc

SEQ ID NO: 135223 - DNA, 1041 bp, Homo sapiens
ccatttgagagacaatgatgtgcttagggacagagtgcactattctcctgatgacagaatgctttatgtgctgcagtcttaaagggtgcaggccctgtttcctcaggcccgaatgattgagggacatgagtgagagtaagcaaattgcagtttaatcttgggcagatcgaggtaatttgtacagaatagtgtttagacttggctgggagaaaggatgttgcttgtagaaaaagcagaaaaatattaaagtgtattttgtgtgcaaaacaatgggtctttctgtgaaatcagtaatatccaggggattattttcaaagaaggattgtttccaaagtgagacttaagccagaattgactggagtacttttcttctatttcaccactctctccccacagtgtgtgtccctaaggtcagccagtgattccttctcagtgtctgtcagatttgacacttctcagattcaccagtcacactcttgtttcaggaccaaatcacagcccatttatattacaggagcaccttccaggctggtctctctgcttcatgtcccctctcttttggtttgtcctgttcattggtggccagattaaatactcccactgcccttccaaggtagcaaaactaaactcctccacttgacaatcagagccctttccctcagacactttccaattttaattcttattgttgagttcagttcaaccattaagtacccattaccagctgggcgtgggggctcagacctgtaatcccagcacttcaagaggccaagactggtagatcacctgaggtcaggagatcgagaccagcctggccaacatggtgaaacccgtctctaccaaaaacacaaaaattagccaggtgtggtggtgcatgcctgtaatcccagctacttgggaggctgaggcagtagaatcgtttgaacctgggaggcataggctgcagtgaactgagactgcgccactgcactccagcataggaaacagcgagattccgtctcagaacaaaaaataagtacccattacctacctaccttccta

SEQ ID NO: 135224 - DNA, 1100 bp, Homo sapiens
gtcattgaacctgagttgtctttaaaactccattgtcatctgcgttctcactgagcttcgtttctcaggtgttgggggaaagtgtgcatgtgttttacttgaggctggccacagtggaaggactccagtcacatccttttgtgaggaggctggggttggggtttgcctctgtagctcttctgcaaagctagggggcttgtatttctctctgcctgggcagaggcctgctcttcaggtcccccttggctctagtgtccctttcagctcatctcctttcagcctttcccctcccctttttcttttggtgacggttactttttatgcgcagacacaaaggacccagaatgaatttgtttgtcttcaaaactctccttgtagtggttttgagattcctttccacctcctacatgtttgaggggctgccacattatgactgatgattgcgctatgtctaacatgctcttgaatatattaaaaaaacacatttttcatattcaattagatatacagagaaaaatgttaatatgtaattttgatctttaaatgcagttatgtagaactagaaatggatattatctctttaaatgagacagcaagaataggtctgttgaccatgaataatttttgtcagttttgctaccccggcagatccttcattaagcgttcagcattaaattaaaatagaaccagtttccaatagtaattaacttgagtatattgggaggctattattcacattaaagtaaccttttaatagctctgcctttaacttcactgcaggtaatgactttaaagagcacttattaaaagagaaatggtaatgagctttaataaagcagaacaacttgaaaattaagaaccattttctatggaaaaggatgtataggtgtgacttcgatattacattaatggtgctaataattctttatctggtctcttaacattagcagtgattgcaaagggacaattgtgttgcaaaaattaattttgccattttgggttaaaattgtgctaatgtgaaattttctgtttcatgtttttttttcaaggactcttactactacgatagatgagttgcctacagtttgtaattttgaacc

SEQ ID NO: 135225 - DNA, 1068 bp, Homo sapiens
agggaggtgattgacatcagtgagatgtaggggggtacagatgggaaaactacaacttttgaagagttaatcttttgtgtatacattggaactttcctcttaattatcctaacagaacagtgatctagggagtattagctccaggtgagggaacaggctgagagagagaaagtgaggtgctcaaggattccccactagtgtgtggcagagctggtattcagctcctttttctcctattccagtaccacagctctttttcctagactcttgcagtcgttgttatggcgaaaacaaaaacagttaacatttgaaattttttaaaatttaaaaacaaaagtttttcctttagcagtggacttgaaacctgacggactgcttcagatctttttatcagttatatggattgggcaagttactgcatcttgttagccttaacttccttacatgtaaaaaaaaaaaaaaaaaagatattgggactggggaaggggaatgctttcacacgtagtaactggtgtgtgcctcacaaatgtttgtttatttccattgatttttctggtgtgcagagtggattcgttcacacatctctatccatcgaatacatcatttactaggcacccacactgtactggctcatttcaaacatttattgcataccagctctgcaccgtgcactgataaataaaatggggctgactgcccttggggaacttaaaagacaagagcggccatatggccatcaagtggagaaactatactttacatgaatgatcgtgcccagtgctgaggactgtgacagtggtccatgacattaggtgcacctgaccgagcagaggaacagaaccacgaacaacaaaccagagagcaaatgtgatgggcactatagatgaatagtagatgaatactgtctacggctcggatctgagccagtttcttatccttggtgtggttgtccgaatttcagttgtattcctacaggccagggaattcagctttggtcactcttataatgaagcccagaatggtactctccacatagaaatgtggaagtttttaaaaatggcagtgata

SEQ ID NO: 135226 - DNA, 1155 bp, Homo sapiens
taattaactgagttgcttaggtctcttgggcaaatagtacataattggggagagaaggggatggggaagagtttggggtctaattaaatatgctaaaaaactacttaattatgtattgcctcaagagactaactgctgtgaaatcctccttaagattaaactagtgttagatctgaagaaaggattttgcttttgctatggctttactgttacattttagtcaagcaggcacatatagtgttcttaacagttcatgccaactggattgttggtttttatgattctgagggtgagcatctcttagctgttgtgctaaattaaagtgaatatttccaagtaatttttggttcctgtagctggttaataattttataaaaagctttttaaaacagtggttggctaataattttttaaggcatgaaattgagagggaaaggctgtacttaggcatgtgccttggtgtaattttgacaatttttggggtcaggtttatcattttgatattatttctttagcaaattggtgatgctctctgtgatctgttttagagtctgggtctggattatcaataactgtttactgatcatttgaaaaaagttcaaggttgatggccaagcagttttagggcatgctttggtcagatccgcaaaaccagcctcagccatctgcctgaattcttaagcattgttgagaacggaacctctgaatagcctcgttaacaacacaaaacctctattctagaggttgagacaattggaaaacttcttgtgccagtccttctgatttcactggatgtgggaactgttggttgtgacaagaggttgctttgaggtgatcggggagtgggctttgctgagaggcaagtagacattcagcactaatttacgtgcctcaaaatatgtggattttctgccctgtttctccacccgtttcagattaggttatgttttaagaaggaaatctaaccctatccattttatgccatatcactttcttgagactcttttgctagtacattatcactattctggtcaaattgcatttgcagatattatccttaatagaccatcagaagttcaagtacccatttcctgtcaatacagttagtaataaaaaaaaagggactgattagcaagttgtgtcatctcagtcagt

SEQ ID NO: 135227 - DNA, 1112 bp, Homo sapiens
tgaggttattgatgtttctgagggataagagcaaaaactagaaacaaaatgcataagtaatataaaggtcctaatatgctctggaagtttcctccaaagaacttctgacagcacttttagtaagttatagactgtattgatgtaaagcttctctttcgtctgcccttgctgctttctcctgttttgtggaatgtagcatggagaaggaagttcccccaggggacaggaatgtcagcctctggaaaatggcgagttggactacataggatttaaaaaaaaatactacaatgattcatttagacatgtgagaagttattcttgggattagggtaagcagttggaatttatttgcttccattgcctgataccatctcattgtttgaggatgtaatttctggaatagttgatgtgtgataatgtgtttatatcaaaaaatagcacagatcttttaaaatactctataattctctttataccatagactttattgttaattacttaggttcagatttgtcacaaggttgtgaactctgcttggtgtgtatatatctaacttctgaagtaccagcgggaaaataaaaagtaaaccatctccttagtcacaaaggaattattctcgctagatgtgtgtttacactgaaggctctcaatgcttttgtcatagcaagtctatttgtaatccacgaaggatgtgagtgcagagcagtcaccattatgcattgattaagaaagatttagatattgataagtctatcttatgtgatgctattgtattattatcttacatattacaattgctaaaatacaattaaacccttgttctcatctgttatttaatattgatgcatttggcagatatgtaatgaaaatggctaatatttgaaggatattgtactgtacatattaaattagtctttctttatctttgtgaaatgcgtcaatatgatatacaatgacatctcaatgattaatagagaattatacttgagtcaagcctttttgtaacctagaaattaaaatgactattcaaataacacctcaaaatgatcaaattagcattttgtgattgcataataatgggattgtagtagttataacagcaccatggctgc

SEQ ID NO: 135228 - DNA, 1039 bp, Homo sapiens
ggttctcattgatcatgatgttgacctagagaagattcatcctccttcaatgcctggagacagtgggtcagaaattcagggaagcaatggtgagactcagggctatgtatatgcccagtcagtcgatattacctcaagttgggactttggtattagaagacgctcaaacacaggtaaacattgtgttctagtcatgtcttctgagctttaaatcagtaaacagtcttatggaataatgcataatattggaataggcttaatgggggatgtttccgggtattaataggaacatgcatatgtcagactaagagtgagtctgagcaacatctccatctctgcgactgcgaatggagagggcctctagaatattattagaagtagacagaagggggatagtgaaaaagttggttaggagagacatgttggacatttctaacaagtcattgtgtagaaaggcaagtggactggctttgagtgtcttcacacagcaacattagtcccagtaggtagactacccggagacagatttcaggttgacataataaagagcatttaatacagagaggtgaccacccaaagagagcaggcacttcttgcccctggaggaattgtgggggagtggggaaatgggaggagacacctgagtatttgttagggctggttttagtaggattctatacatagggtgtgagattagaaaaggggcccctgtttttgatacttcgcctttattttcttaaattgatcaccttttgatttttctggcttgaaaacactcaactttggtatacacgtatttagtcattagctttaaaagcttattgcccattttcccacttatatttttttggtggccttgtttcaaggggaatgtgatgaaccaaggacttttttttttacttagacaaattatttagaatacatattgtagttctaatatgacaggtattctaggaggtaattttttttagataatcagaaaatataatcttcaaattagcagtaacctgctaactcccaggaaaggtaatggcaagga

SEQ ID NO: 135229 - DNA, 1193 bp, Homo sapiens
caagagtgaaactccatctcaaaaaatatatatattttatatatatatatatatatatatatatatatatatatatatatatatatttatatatattatgtattatatatatttataaattatatatttatatattttgagatggaatatatatatacacacacatatatatacacatatgtgtgtgtatatatatatactttttgtatatacgtatagagagagcgagaacgcgcatgcgtgagtagcaaaactaggacttgacctttgttttgactcagagtactgaaaagcactattactttttttttggagttgggggtcacttttccatgctgctctggatttggatattgggactggccctgtcttgggactgtcattaattatggccctttgccttcatttaaacttaatgtttacagaaagttattattgattatattgtgagagtgtttgattataggtatagtgttatgatatgaagcttaaggatttgatgaaaatactaatactcattgataataaagattggtggtaagatggtaagatggttactcatattgatagtgggaatgtaaatgagtaaaacttttctggaaagcactttggcagtatttattaacaagcttttaaaaaaagttatgcatgccttttgagcttgtaattccatttctaggaatctttattaaagaaatcagagatgtcgaaagatattcgtgttcaaagatgttcactgcagcagtatttagcaaaaattagaaccttaatgttcaataaaaattagagaaatcatggaaaattcatagaatggaaataatatacagtcatcttagatgtttcagaagaattttagtgacatactaatatgctaaccatataataagtgaaaaaaggatatgacactctataaagtatggtcccaattatgtcaaacatgtatgcaaagaaaagaaataggtggtgagattataagacttgatatttttctcagttttagaaatgttctttgataaacaaattatttaaaaataaatcatagtttaaaattgatattaacaaatatgagtagagtcagtgaccatcattttaaccaatagttttcactaatgcaggtgattgtgaagttgtaaatggattgtattttcaagttagttttcacctcttttattttgcacttagaacatggtttc

SEQ ID NO: 135230 - DNA, 1050 bp, Homo sapiens
ggcggccacccgggcccggcgcggggcgatgggcggttccctggcgggtccgggtgcggacggccaagttctcggagagggagggccgccttgcaaactttgccgagctgtcaccctcccgctggccgcagtcggccggcctcctctgcacaggagcggacgcgggagcccctccgcacccgtcccctcccccgggtcgccttcgcctgcccccggggcgaggctccccgcgcgggttcgcgtcgcgtctgcagtggccgaggctgctgcctgccgggcagatgggtccgccttgttccggctgcagctttcgccgccggggcttgctggctgtcgggaactagtcaactggagtttttgttgacttcccacggttcaaaagggccttccagaatggggggctggaattaaatcttgggtctaacttaaaggaaggcgccatattattccataggtgatgctaatacctttgtgtttcgttatttgttttttaggaaacatgccctgaactgtcacagaatgaaaccagcgctcttcagcgtcctgtgtgagatcaaagagaaaacaggtaagacgctgcgccccgcagtgggcctggagacccccgaggtgggggtcggagctactccttcgactctccagttgagagctgctgcttttgggcaccgccatctttgatcattctctccttcccacgtcctgatcttgagaaaaaactgcaataaatctggagtcaatttctcagttctgctcctggtgtaaaatgaagtgtaggtgcggaccgggctggatcgccgtccctcggcggccgcccctggctgcaggcggggagggggcccggagcgccagccgccctcttccctctcctttcgccttgtttgtgtgtcagtttttaaaaggagcaacgggagactggatgccaggaccgagtccccgggagaagcatcgcccgaactttgttttacttagacagtcttaagcttcagctgcacggatagaagaatagatgcaattgaacagaccccagtagcatgcttgaattagtgtttt

SEQ ID NO: 135231 - DNA, 2536 bp, Homo sapiens
cttatattactagggagaggggatggatacttatcgcttctcatccccttctcattatttgtatttatttatttatttttgcctttttaaagttttggcctagctagcttgagaactaaacccagcaaactgcttttcatgttgagacatttagcagcaggcagaattcaattaggaagcataagtcctttagttgcttatttgcacaggacttagttacaccattctgaaaggaaagtatagtcaaccacatgtcaaaggtgagttacgaaaaagaaacaaatcttttcaaagtctgggattactggcagagagagctttggtagggctattgctatttaaaaaccaagaggcagctgacaaaagaaatttttgtgttttaaaattgtttctggggctttcagtgataacttgtaaattagattctctttttgtgctttggccagtggatccacatttgcacgttatctcttttgtaaaaagccaacagccgacaaagagtaaaggcggctgtctgggtagaggcatcttcctgctagcctctctaagctcgagagggatgggatttaagtactgagtgattgatgggggtgaagctctttctcttctttccattctcccctactacccatagcttcacctcactctccaaaactagtcttagaatgagacagggactcagaatcctcaattcgaaataaaacagctgtgtagacattagtgttaccaaagcaaagaaagcggggctgcaaattccaagcccccccactcctgcttccatagtcggtcatgctttagaaacatgaacttataaaagaaacattgtagaatatatgtatattgcataaatattttttaaaaatcattttatttaatctaataatacctaaaaattaattctttgtaatttagagaaagtttacctagtcatttatgaatagaaaccagaaacattatgttgatgactctattctgcttaatgaagggggttgagggtgaactgtcatttcagtggataatgtcatttcagttgtgcttttcttctaaaacaaaacaaaatcattttaaaaaaaatctgtttatttgtagctctgccagtggattttgaggtttctgatcaggcagtgaacactgccagttcttatgcacatgggggatttagtttagaaaacatctgtttccccctctaccatatatgaaaaggtatttttcccttctgacagataaatgggtaatctactacaattatattattttcttgttgagaggtaaggaaagtatacttctactataagatgctgctttttcttgagaatatattctttcgtaaaattgatcataccattatttttgggcagaaatgtctctcattgttgaattgtgatatttgtgcattttgagagcacccaaaaagttgtaggctttaaaataaaaatagttgtttattttaaaccaagtaaccagtgagattattgttgatatgttaagatttttctcctgatttttaaagccatattttatcatctgtctcttattaaatatccctgatgccacaaggtctgctcacctgcatacctcttttggtgtatgcccccacctctttttggtcatcttaatcttaattgttgaagtgctttcctttgtgaaatatttcatcctgaaaaatcttgtcttctttccaaagcccttaattgtgcgagtttaagtgaaggaaatagttctttttcaagaaaaaaatatttattttttaaatgaaatcccacattttagtagataatatgaatcacattattgtgaaaaatgttatgcatgaaaaaaaataaacacaaccttttccttttcaaataataggttaaaatactccatgttgatggctgccaaccaaactctgatttattgccaccacaaaccctaaatagcgttcatttactagtaatgtctaatggcatacatgatggtttgccagatttgtagcctttgtgaggcttataagtaggactgacttgggaagatcataaaacttaatgaacttctctactgcaggaggtgtccgcaggggaagagaaaggcctgcttggttggttgggctggttgaagtattttttatgtttaaggagaagaaaatgactagtaaaaatgccttacttttaaaggaaccctccctagaaagagtcataagaattttagatattaaaactagatcaagagtatagtttacaagtgaggttttatgtgcatttagtatatgatgtgagattaaaccttttatctttattgctagaagtgtgactagctttcaaagagacaaggcagtactgtcattcgacacctctctatttaattgtgaacccacaggtttagagactctttggagtctttttttggtgtgcttctctttttaaggtttcaatataaaaatctgttacatttttctttgtacagtgctgtgtgattcttttaattctacatatgtaaaaatcaattttttcaagtgaaaatttagcaagaaaggtgaaaattgttatatattagtcta

SEQ ID NO: 135232 - DNA, 1015 bp, Homo sapiens
ttagaacctcatgatctaaagtatcatgtggatattatctttaaaatatagagacattttccaatcctgttctttatttttttcttcccaataaaaatgtattgaactctcttgtcaatactaacttgatctgtgcaagtaattcttttgttccttagttttaatgaccctcattttattacagatttgaatagttttggtattttatttgggactttactatgttattttattaatttacataattttattctgaattagaagtcttttaatacactagcaaaggaggccccgacttgccccaaagagcacactggttgatcggctttcataaaatgtacttgtctacatttttcatactatgatgcttttccttttaattaattttgcctgtatatttccatctcaatttataaattttgtaaaaggttacttctgaggcaaatttaaattaacgtattagttggattatttatattttgatactttatagtggcatggtataggatgaagttacattatatgaagtgggactataagaattgaaactgcatttcgtgaaccacaccctaagtcagtcatcactttattttgtactctaccctgaggtatctatttagaataaatgcttaacacatcagcactaacacatcaagttatataaggttttagattatcttttccctattcgtgtttgtgaacatctttagatatttattagttcaatattgacattatgagaataatgttttgttttctcagcagtcttgtgttttagccatttatcagtgtgatcagcatgatttaggtattaactgactaacaaagcttacacattaccaccacctccccctcaagcccgtgttgaccttttcaagcatttgctctacttcagtaggccatttgagtcttcaagtatgaagagagtaaataatttatatcactatgtagtataaattggtaaaagtttttcagaactagctatctgattttttacaaagttattgaagttaat

SEQ ID NO: 135233 - DNA, 1686 bp, Homo sapiens
taaaaatgttaagctgtttagacaataactcttttttagtgatcatattaatgaggacttggtatacaatgtaatccttttaatgctgatgagtcctcacaatgtttaaaccattatttgtgagactcaacatgttatggcaaaatgattttttgtttgttttgttttcttttatgtgatacatcagttttcaaagcatatttcttaggcttcagagtccagcaggtggctttttacattaaaaaattcataaattttaaaatcccataaaattttatttcaaattcaaattaactaattgagaatgtcaacattttcactgtctctatattaacatttataatagaacaaatggttgcatatagaaattatctgcaacagtctaaattaagattctaaacaggcattacagatgctggtaactttggcaattatcattttgtttggtgaacagtagtaaaacagtgtgcggtaaaagtgtttagagagagaggataaataaattgaacagttttgcaatgcaaagtggtttgtggtgtttttgaggatttcttggctctctcttaactgctattgtgagcctggagcagatttccccattgctaatgccctagaagtattaattcactttgatatgctaattagagggcattatgcaagaaatgagattaagtggcagcatgaagccatttgcctgtcagtaaattgagagctttagcatcaggaggagctttgttttttttttttttttttttttgagtttctcttggttttgcatataaataaaattgattgaaaggtctagagaagcttccagaacattggtggattcttttttccccctcctatgattatttaaatgaaatgttacaggatttttctgaatattaattgacctaattggagatactgaatataaagtttttattgtaatgtttctgtataaaaatatactaaaatttttgtgtcacctagtcttttttttcctaaaacataatttcattaacatggctaatgaactgtttatcacttatctcttctcagaagtgtaaacttctgtgtatgggcttgtgcaccaatgtcactaaattgaacttcacaaggatattttcttcactagggaaggaaggaagaagttgaattgggcttcagaaaactatattaaatgagtattaacattctgacttgaatccataaaagctgtaacaattataattcatggttaaactgccctttatacaacctgtggaatttatatttcagcatatatcttataggtaagattactgatgacattttgtgtggaagatggaatttcatactggattcagattttgttgacttttgtggcctaagctaggcctctgaatttttctctataaagctattttgtgatatttcttatattctggggagaaatacatgaatgaatactaggattgctgtggggaaagggaggaagacagaccttctgtgcctacaagaaggttaaggtttactcaaacatggaacttctatctataaaccatgcatagaggatggaattgcaaaatcctggcctaactgtatttgctgggtatggttagaaggaagagggtttgggtaaggcattcctactggggtttagttcaagtgtctgaattccaccactgtagctgtgactctggacccagtaaaccatatctt

SEQ ID NO: 135234 - DNA, 1305 bp, Homo sapiens
ccctgaactagttaaatcagtgaatcctcattagtctctgattacttgcaaaatttcatttaaaacatatgaagttatttttgattgaaaagggaacaaaaagcttttgaaattgcatgttattatttaaacaaaggtttctacaggctttcagatgtactaagccctgcaaataatttatagaggaattattgggaaggacttatgaaattcttgaatggcatttgatggggaggaaatcattgcattaaaaaatatatatatttgaaatggcaagcttaaatgtgcatcttacctttactatccaagtgtccttaaatgaggaagaattgacttaggtggtcttacaagtttcatttttctttcttttctcctcccaccattgtttttttttaaaaaaaaaactacaggtgaaggttgttggaattcatagtcagatatatcattttcaacttggaataggaactagagcaggaaattgattttatatttattatgaaagcaagaactctgccaccaactgacagccatccatgttttagttttgtgataattgttcacagacattactctgtagttggtccagattatttataatgttgattgggactgttggtccattaaaagatatgtgtgtaattaatatctttaattaaacctagtaatattggcatattttatttttcttttacactggatcttgggtctaggattaactgtcagtactggtaagaacaagttataatagattgtgcagtgatttctgtggcttcatggatgtatttattaccatttttgaacaaattacactaacatgaaaagttgtatttgaaatgattgtgtgctagataaggtgatacattacaggaatggttgggtttatggagctttatgcagaggttttctcagaaattatagcacagggctgtcactataaaacccagtgatacagttggtaataacatacagtgaagatatttttagattttcacttgttattcaaataagtgagaaacctccagtttttctcatcatatttctttgttagaatcagtagagaaaaaaatgaaggaaaattcttttaactgtgtatgaggtgtgggtgtttgacttgtctgaatttcctcgtgttcaccacttgttacagcagtgatgtgatactgaggatgtccttaggaacttactgacttcttggttcttgaccttttgactgtgatcaagtagagatactgaatgcctgaaaatgaaatgatggactctataaacataaattctgttctgtcaatgtattgcatgaactaattt

SEQ ID NO: 135235 - DNA, 1005 bp, Homo sapiens
ctaggagcagtttgtggaccgcgtctgtgaacgcggctcataattgtttttcacacataagttatgcaaatgagcttttatggcaactggcataacaattagcatcctccagcaatattttagcaggttaattgcaaaatttctaaattgtacatctgacttgttaattaggcatgacagaggtggtaaaatagttatcttcaggcagtggcagccaggagctgcttgaaatgcaaagagcaacgattgattggatttgagggttacaattgtgggagcactgctgttgtcaagtgccgctgagcagctctgctccatcagttgcctcagagcaagaactcggtagttgctgcgaggatcctgccatttacaaatctgctttatttaactctgcaactcttccattccaacctatctgagcagtttatttcacgcggtttgttctgcgttgggatcattaaaacgagatggcaacacaaattattttgtgctcgaatttcaggacgctgaaagtttactttctattttaaagttcatctcaacatttttctcttaaaatagaaaaaaagtcataaattccctattttaattaaattgtaaatttcagttctcaagacttcatatgtgattatttgctttttaatgatttaactcttttaaacagtgcatctttttgtgcttcataggttcattgcaggaaaatactgtttgtgtattttagtcttaggttttttttttgagacataggagaagaaaagaatctgatgtaagggtttcatacagtggacaaattcattttgcttgtagaatttataaaataatattagcatggcatattgtgatgatattgtataccactattagaattctatctacagtatgttttaaaaattattttttcaaaattgtatttaaatttctgtggtctatttcatagttttacttggatagtaacaataatttggtaaacataaacattagtgaacacagcatgatggcacattg

SEQ ID NO: 135236 - DNA, 1046 bp, Homo sapiens
gagattttctctaggggaaatggatacttgaagttcattttcttcctcatattaaggcaaaaatgtgaacaaccttcagtataggacatatgattacagtatttttgcaggggcagtttatattctaaatatatttgcaatagtgaatgttgtaaatttaaaacaatgtagagattcagaaatgttagttgctattctggctgagtgctactttacgtacattgttttattacccttcttgtcattttttttcttgtaaaaattactaaattttcaggaactgcaaagctgagtacaatcatgactgtattccctttctttagagtgctgtaaggcctttaagagagttaactgattgcaagaagtgtagttccccaaaaaatatagtccacccactatgtgtatctgtatatatttgtaatataggtaattgtgctttccttctcaaattctttacctttgagttatttttttccctttaagagaatatttacttagttagtattcacttaattagaactgactgtttaatgttttctgggagggtatttatggtattttctttgctatatttgcattccagaaattaagtccccctgccattattcggtgagcctttcatacattagaatgatgaattgaaagcagaaatgggaaaaagactgcaatgcaatgaaaatttaatcagcgtcttctgctgctttaataaggcaaataattcttattggccgctgtgttaaggtttctaatatttaattcataacaaaccttgcattattctgcagtagcatcgacagatccactttgctgcctgccaacaggcaaccataaaaacttaaaagcagatgtaaatgtctaaaacaaggagaatgattcgatctaaagcggtcaaaaaaatcaacaatattgtgaaagagtttgatggatctctatatttagtgatgcaaaaatgatattaattaaactcacttgagcagattttttttttggacttagaggtaaccttttacaaagcatagcctttagtgcctagtcaaagacttgga

SEQ ID NO: 135237 - DNA, 1359 bp, Homo sapiens
cctgccaaagctaggtgcaagctcttgttacatggaagggttgggcctgttctcatttcttcttgaaatggcttaattggtgtcagcaccccagggataaaggcctctaacactgaaatccacacgattcaccctgtctctgctcagtgtagggaaactggtaacaactggtggtgaatgaggagcgaacggtgctgtaacaatactcgatgatgtttgggatgacagaaattaatacgcacttgcttgaagaaagcaatgattaatggcagtgagcacgggaacgctgtccctccttttactccactttgatggggattgaaaagcaaaaggctgttttcattctctgtggaaagcagaggtcacacagagtacattatagcaatttttcctctctggtttttttatttcataaatattatgataagcatagattagatagatttttttgtggaagcttaaaaggatattttatgtcatttaaacgttgtttatgcataaagaaatcacacattcttttcttcacttgttagatcatttcccttcatgtcagaataattagtgtaattagaaattttaaaagcctgcaaacatgaaattgtattaatgctgcttactattttacaactggaatcaaaagagcttagttttctaaagactgcaaggacagggcggggataagagtgttgcaggggctttcacctttttcctgcccctccccctggtttttctcagtgaatgtttgatgtaaatatattttgcaaggtacttgcacttgtcagcagctttcttagccatttgataaagattctttatcctacaagaaagcctgaaataacagaactgtactttggataatgaattcttcatctgtggagaactttaaaacaaagtacagtgttggcatttttttcttttgagtgagaaggctgatatatcttttggatccgacaggaagacataaattaatagagttctggagttcagtttctcattaataatccattttgtcatggttcttggcattgtcagcctagtagctggttcatattttgctaacggataaaagcagattatgtcttaaggcacaaagcaagaataaagagtttatcgccttttgggggaactacatgctataagaaaaatattgttttgcaaaaagtttcaatttttagttagcaatacactacattttctaaggtaaagctgttattttaagatccgaaatggttcttggaaccttaggatattagagttttagatcattgcttagagttgcctttgctgattgcaaaggtttgcttttcagggacagttatagtagatttaagcttgtttttatattttatttttagaact

SEQ ID NO: 135238 - DNA, 1046 bp, Homo sapiens
gactagttttattttagttttcattctcaaagggactgtaggttcttagagggcagggactatctgtcatctattttttttagcacacagaatctgctcagtaacatttttaaataaatgcatgccttctccatgtattattagatatatatctgctgagtacattaaatctgatactatattcttctaattctttacatataaatttattttaattacagtaactatatacatacagtataagaaaactgccatagctacctacctggatcctaagtaatttatatgtaaattatttgtaaagtaatttatatgtattactgctccattgctatcattaatgataatattttaaaaatagaaaaatctgtggtgaaaactcctggtaacatgcttaaagttgaatattcacttttaaagttttaactttaaaactatgataataagcactctgttttctagtgaggaaatatttgtgtgtttccaaattgtagggttgaattaggatgatttaagacttgtttctctatagagttgggaaggacatttgttttagtacattataatgaaatcttaaagagtagattttgacaagagacattttgctgacacagaatattttgttcattttgactctcaaataagttcttctgtcttaatgattgatttatattcattttagactgtacagtttcctagctgagttttctatctataaggtacagaaatcactgtttaagttaatgataaattaaataattatctttaaaggtgacagatgggtcacgtccaaagattaacctaagagtagttaagtaaaaaaatactatgattatgagttattgaaatgaatgctaattttaaatttagcatgattgggaacagaatacagtaaggtatcatttatttaattgctatagttttttgttcttttagacttacttgacttctctgtgttacagtcattgttgaactgtttacttcctattttgaatcaaccactgatgtgttgctgtcgctcatcaggtggaaagacctggaaaatt

SEQ ID NO: 135239 - DNA, 1080 bp, Homo sapiens
gtggttctacaaacactcagaccaccagtcgtttctgagtgtagtgaatctttgagtgtattgaggggaaagaatcagaaaaatggaatagaacaattacatgaaaggcaggagcaggctagcaatgagactcaggtgctagtaggactagagaaaaaggctggcggccggtgggacggggagaggggagtttagaagagggaaatctgaaattagagacatgggttgttgaaggaacttatttggtaattagcatatattaccttgcaagaatgatacaaaaaaaaaattactggtttatgacctagatgatataaggtccttgggggtggtggggggcaagtttgtctttttggtaactgttttgttatttcatgttgctttatagggatttaatttctgctatgtgatagaattcttttaagatacatgccatccttgtgtatataaaataagtagatgatttattgggttagaatctgtatttaatttgttaaactttcctatgtaaagacttttgaagagaatatctgtgtcatttattctcaaactttttgatcttaggactcctttatactcctaaaataagttttgtttatgcgggtttaatctctatttattgtatgaacaatcgaaacaaattcttaaaacgttaagttaatttaaaaattaaaatcataaatcgattatgttagcataaataacattattacaattatcagcttgttatatgttatcctaaacagcattttctgaaacaaaactaagcaaaactaaatgataagaagaatagtattgttttacacttttgcaaatcttttaaatgtcagacttaatggaagacaactggattctcatatctgcctttgcattcagtctgtcatcatatggttgatgtatatgaagaaatatctggcctcatacagatacctaattggaaaaggaaagagtattaccaccaaacttatcaggacagtttttttaagtgctgggaagatttcatactcacagtggaggacacagtgtttcaaaattctaatttttgcttgaaagcatgaattttattattagcgccaaaac

SEQ ID NO: 135240 - DNA, 4049 bp, Homo sapiens
aggaagtaggacgaggagatttctaaggctttattcagtttaatattctgattctttgacttttttttaaactgagtgaattgtttattaattagctcttaaccacttattaatttatttaagctcaactggttatgtataatttgtatttgttgctatcacattggttaagcattaatgttattttgcagtattgaaaaacggaatgtatagaagaggaaatggaagggaattgtaaatgaagaaggcttctacaagcaagtgaattttaagtggcaaggaagaagaaatttggatggtgggggggatgtacattgcagtgtatttaacatatttctgaattcagagtctttatagcctatgctataatagcagagaaggaaaatttgagttcagaaataacagtaaagcctgtaagttaaagaatctaccagtaatattctctgatagtgacatgtgtaatatgaactgttgaaaaaaatctccagagtaaaaagtggttcagcacataaatacataatgttgattctgaggttcctttagctccattaattttgaccagaaagctataatagtttttgaaggggaatatagtacttaggcattaaaatatatttatttttgctcctcaatgaaaaaaatcttgtattaccttgagatcttttgatcttccttctcatactttagaaggaaggaatactattcagtaaggaaaaaatgacccccaaactcaggttcttactcagcccagcacagtgtcaaagtccgttaaaaatttaaaaagctagtggaagggactggatgaatcctgggaaggtgctatttagattcttaaaaaggagagagggctcctgggatgcagtttgtgttcaggcaaatcagacttggaagctgggaagctgctattgtggcaatatttaagaaaaaaagacttcagagattatgtattttggaaatatttgacaacattagcaacatcaactactgacaaaaaaagaaccacctctttggcaaatctttcacagttgtgccaagaaaagcagcttcattggaacattttcataaactatcatcagttatgcagcagcagcttcacaaatcagaaatgatatcttcaggcgctgctgtcaagtgttattcaaataataccagcctcacatttgaataacagcagacattttgaattaattaatcagatgagatagtctaggccttttctcattagtctctgggtcaggcttgggaagatatatgtgttggtgatgatatacttgtctttaatcatgatttatgaagatttaggattgtgtgtgatttgtcaaaggttctgggaaaaggctggtgcatatttcattacttaatctgagattgattttatgatgctaagagatatcacactattgttcaaatgtgtgggaagtacaggtagacacaacatcccaggctttttactggcttatctttgcaactgtcaaacaatgctgtaaactttaactgcttgtagttaacaattcctgttttaattataggcagattttttattctgtccaaagggagaagtttcaatggttatttagctaaaatgcatagcagacattataactatgacctggtatgaatcatggacaaagttggtaaatttcatgggttggtcatggtgaaaatataaaatttcatggcttgtcaaagattaatataaaattcccattaaaatggtgcaaataatagaggaacaagaagtaaggttactctccttgcatgataccttccctctcaggactaattttagcaaaattgagatgtaaaatcatatcttttttcagttatttaagcaacattaatgatctattaaatgaaataatttgtctgaaaatatctagtataatgcctggttgatagtaggtactgaatatttgctattgataattttattttctcatttcctacctacttttcttcctttcctttaatgtttaaggctgtgttagcattgtttagcctttacattcttcagaatttgaatttttaatcctgttgggtcttaatttcttgggatgtgttttattttgaggagagtagtgcaagggtgagaggttatcattttagcgtgctgggtaaccagggggaccccagtgtgacctgagttcttgttgtgtctgctggtataatttatgttatggcaggcagtggggtgggaggtaggtaggtggtagatatatgaaaagtagaatattaacctcttagtacatttgaagcatgtactgcctaattcaaagtgaatctttctgtatcatgtgcctcctgagggcagttacgtgtctgggataagtagagcgtttttcattctactctcaagcacactaaaatgcttattatgtgaagtattaaggaataataaggtgattttcaaccttgttatacaaaacaaaaatttgcttttctttccaatcttggatgattgacaggtattgctttattgaggtgatcgggctattaataattactagttctttttcacttttatgttttgggaactgggttagtactcctaaagtagcttggcacatcttaacataattacaggcagacaattctaattgatgttcactttggggaagatagtttataaataacaagatgtgttgatatttggagagatacagtaagagtagtctgggaggcagcttgatgcagaataatactgattttggaaattaatagatgagtcctacttctgaactgctgcttaattgatttgtaactttgacaagtcacctaatttttcctgagctttagttttcttttcctaaagtaaggccactaattcgtagctttcaggattgtgagaattagaggtgaatgtatgtacaggacctaatgtgatacgtggtatgtaatagatgcttaataaattgcagctattgctgttatcttatctattcatttatctcttcgagaaacatactggggcatgtgtttgcaggcccaagcctataatctcagcactttgagagccaagatgagaggattgcttcagcccaggagtttgagaccagtctgggcaacatggggtgacaccatctctacctattctccccagaaaaaagagtgatatatgtggataaatacaagctgagtcatttataaatacaagctggaccattaagtaagtagaggcaggtgatgagacaggcagggatgacatcattgaggcttcagttctgtgcgagggtagtatggtctttgttctatactttggctagctactggtgggttcaaacaagggattgatctgatcagattttttatatagttcactttggaaacttagaaggaatatattacttatgagactttcgtagatcagtgacgatatgtatttgtaatggggtaatagtggggttaaaaaagaggaaacaatggttttaaactgaaaaatgagaaggaaggattaggcgattggttggagaatttttgtgtcccttcgttcacttggctgactcctatgtatctttcagatcctagcctggatgtcctttcagaaagccttttgaccacctctgagtctgctgataacctacctaagtctgaaaacctatcttatgtgctccagtagtatcctgtgttcccccttgttactgtgctcatgacactgtatttaattacatatttaattttctgttgcctccaggaaattgtgaactcagggcagagatactgtgttttgtttactgttttgtcctctggcacatagtaggaagcactcaatatctgttttttaaaatgaattgaatgtagtatgtgaggaagaaggagaaaacaagggcgtctgtttctagcataggtgaccccaggtgagtggtcgttttccacctgagagagagagtagagtagaactgcggggtcgtagcatatgttcgttatcaactttgctagataatgttgaattattttccaaaatgtgtgtgccagtttatattcaatacagcagtgtatatttgttctatttgcttgaggacattagtttttttcatatttaggtaaaattt

SEQ ID NO: 135241 - DNA, 1062 bp, Homo sapiens
tgggctgtgatgaagtagagtttgaagggagtgatgaagtcctggaatagttactccagataatgaaagagtgagctggccaaggataagaaaagtattgtcagattgaagactcagctgaggttggagactgaaattgaaatggcactatcatgaccacttgtcatttctctagcaggttaacatcgactacaacttgagtatatgcttggggcttgcttggcaaatgagagaaaaggatagggtgaaatggattataggggtctgttgcaagaatagttaagatgttcaaccatataatccattttgcatagatgggaaaggtaaaggagtggctgatagatgagaaaatggagggattttaggattgtttggtttaattaaattgaggaataaataggtggagtgcaagaaagggaaggtgactggcggagtaaaagactgttatcataggatgagacatttgaattttatttcagaaatgaagcacttctaggtgatggatgataaagttcaggatgtggccctgggagcttgtgtgtcaaagtgaaatggagctaaaggtcattggtgatttatttattttttaaggaggtcagagaactgtaaggctaggttgttggttgaatatcttatatgctccctgaagccagactcatggaattacttgggatagagaaggagactgaatcttgtgccaacattttaaatgaatgtgacaattattaatattagttaataaccaacagtggatgctaccttgccaagttaatttttcttagataattagttgtttaatgtggagatcatgctatggtcagtttatttagaaaagcagaatattaagttaggaaaatgaaacccatataagcactgttcataccataaatttattatgtgaatatttactaaattcttattctgggacttgaagttgcttgcagccaaggggaagagacaaatttctaaacagataattgatatagtgtgctcaatgttacagtaaagcagtggtgtcgtgggaaggacatatcccaaaacccattgggatgggcaagaaaa

SEQ ID NO: 135242 - DNA, 1271 bp, Homo sapiens
ctttcctccccacactgaatttattattcaccattcttattagtgtttactaatattgcatgtttttgaacctttaagattgtttcatactgttgttatctttctatgatttgctttcactcaacacttattttaagattttcaacattgacacatttagttcaagttaattcatttttcctgctgtatcgtattctattgtgattattctgtaatttccttcttaattcttgtgatgatagatattgaaattgctccaatttttcctattataaaatttcagttgtcaattgctgcataaggaatagccctaaaatttagtgactgaaaacagcaaacatttatcatctcatggtttctgtgggttagatagctagacatagtttagcagggtgccactgtgtttagtttctcacaagatttcagtcaggtgacagtgggctgcagttatcttgagagtcacttgggggagggtttgcctctctgctcactcacatgactattgacagtactcagtcctcactgactgatggccagagacatcagttcttccctacttgggccccccattttagggcagcttacagcatggcagctggcttccctcagagtgagtgagtgagtgagacagggaacccaatttggaagtcacagtgtttttgtaacctaatcttggaatcccattacttctgccatattctgtttggtagggtgaagtcattaagatcagtccatgctcaaggggaggctactacatagggtgtgaatagtaggcagtgggaccattggagccttcttagaggctgcctaccactctgggtgaaagggtatacatcatccattttattatttaatagatattatgaaatattcctattgtggctattctaatgtatactttcctaaaaagtaagaatttaagctttactagtgtttaaaataggaatcaatattggtggtttgtgtgttagaagcttacttagagcattcaggattgagaagaaatagtgggagttccaggtttgttttgatagattaccactttctgttcctggttgggagtatttgtattttgtagatgtaactaaactgatgctcatcaaatggacaagttatctgaagacatctgcaaagaaatacgtggattaaaataagaggaataatgtaagtgtataataagaaagtgggagaaatgatacttctactcttgatataagctcttagtcaactgtgtatgagggaaagataattttgatctctaatatctgaca

SEQ ID NO: 135243 - DNA, 1052 bp, Homo sapiens
atgtaaactgtaatgattccaatgatgccttattgcatctaaagaaacccataaatcagattccactattaatatatattagcagagggctttacccagaggcactgttttgtttccttggtattgacactgtaagaccatgggccattaacaccaatacaatttctattttaatgctaatggaaatggaagatttaaaaataaaattttaaaaatttaaaataaacctttaatacacgaggtcccacagcaattagaaaatgatttctttaagtggtgtcctttttaagagttgcattggaacttatgatatgaaagatataaaaacatggtagttgtacatatattgagaagttgctcaaaatttatattgtcactattttgagccatttttggtgtaagagactaagagtcctcttgcatattttggagtgtatttagttcatttgagtcttgactcttaggtgtaaagtctagcttatccttttgcagtattctgcatgtctattttctttatttgcggttatacaattagtaatgtgcagtgaaaatatggttagtgtgggaatagctcagattaaaattagaaactggacttggcatgtattcagttcactgcccagggttaaagtccagcgccacagaaagtggatcttcacctttctctcctggtgttttagctttactgatgatttgaaaccatagcagttaatatgctttagcctttgcttttacagatgagaaatggatcttatacttatatcaccaggtttcaaaactatttacactaagtgggatggtttactacctcaggggtagtgcattaagcctattgctcttgagaatccattttctccaccaattgatgggacagatatgacaagcctttaaagttgagtggaaattttctgtggggcgggctgttgtattaaattgttccttaccactatcatggatgttgtaaagacttgtgagtgggtagcctatggcgaggaaaagagatatattgtctgcagtagggaggctgtaaggtctaatatatagggaataat

SEQ ID NO: 135244 - DNA, 1194 bp, Homo sapiens
atttcctgatgtttttggggttgtctgttgtttagtaatcataaaactttattacatctccattctgatattaaatcaccattcatcctgaagttaaatgtttcagttatttttttgttcttttcacattaagggaatgtgttttatgttgtgatgcagtatggagatgaccagaagtaacaataattaaagaagcaggccggttcagtggttcaggcttgtaatcctagcactttgggggccaaggtgggcggatcatgtgagtctaggagtttgagaccagcctgggcaacatggcgaaactccgtctctacaaaatgttatctgggtgtggtggcgtgcacgctgtagtcccagctactccggaggctgaggtgggacgatttcttgagcccagggggtcaaggctgtagtgagccatggttgtgccactgcactccggcctgggtaacagagcaagaccctgtctcaaaacaaacagacaaaacaaacctcttattttaggaagggtttgttgactacttaagtgtgaacattttttcttctctaaaatattgcattatagtacaatataaatataaaataagcattatagtgtagacaacattttcttttcctgggcatggatgtaattacatgaagacatgtagagcagattcagcattagcagataattctctattttgaaaggcatataagatccagtttaaagaataagataaaaatgtcatgagctagaatttagtggtaattttctatgtgtttataatatctttgatccacagaactgagttttcacatccttctaaatcagggaaactgtactctttaaattcaattctgtctaatttttggcactttattttccaggatatatatatattcagtgtatttttcttgatttcctcttgggaggtgaagcctcacaaatcaagggactgcattgtttcagcaatgcttattattgtaattattaattcaattatttttatgacagtaataataattgtagtaataaatgctacaagatatttgatgttaaagcagttataataaatagaccatcagatcttaacaatttgatgtttggtttttgcttcaactatggactcagtggtgcttactgatctgatagagagatgttccacttcaaagaaacatcacagatgtctactgaaaagataagtaagggtg

SEQ ID NO: 135245 - DNA, 1009 bp, Homo sapiens
gtgatcctccctcccacctcagcttcctgagtagttaggattataggcacgggccaccatgcctggctaatttttgtatttttagtagagacggggtttcatcatgttggccaggctggtcttgaactcctgacctcaagtgatccacccgcctcagcctcccaaagtgctgggattacaggcatgagccactgtgcccggcccccactgatgtcttttataagaaaagtaaaagtaaaaaaaaaaattattttccaggattcaaagtatgaacatgaactacatttagtttttatgccacttttgtctcctttaacttggaacaattccttaacctctttgtcatgaccttggcataaaaaaatgggccatttattttttagaatatgctttcaatccaggattttctgatgttttcttataattaaattgaagttatactgttttggcaggaatatcacaagaatgatgctttgtcctcagtcattagatcaagaggcatatgatgtcactttgtcatattactagtcatactaactttgatgactactctcgtttattttttacacgtttattgaagtgtaatagacatacaataaactgtactcatctacctctaatttttaatataactgatgagtaaagttaatgaccttagagtgtagtcttatgaactctctgtttgaattaccagaaccttatgaaatgtcagggccatgtgctagcctggtttgctagcaaagtcagtgtagactctacatgtcgtaaaaggtgaataactggtgtaaaagaagagcaggctttctgactttggggtctttatctagtctgagtgttgagcatctttgttgtgattttatagcttcttcatctcttgctacatttgctgtcatgagttttcatgtcagtagcctactctcagatcagtcttggggataacaaaagttactagaaatggtgaagactaaataggttatagactatatgtaggtaatcagtggtagggttt

SEQ ID NO: 135246 - DNA, 1070 bp, Homo sapiens
gaaaagaatatttttcaactagttagcaggtaattttaaattataaaagtactctccttgcacagttgaaaaaaatgttgtaacctcttgctgttcttctccttcctatagtcccactcatcagagaagaccacatttcatctttctcttttttgttttcttgctagttacccaccataaatttaaataactgaaattgttgactgtatatcatttttccatggtaaggaatttggcttatttatataatctcccacataatttccttctcttcctctctggttttgttgttgtattattttttgttctgctgtaggttcctcgtataacataagcaatgtgttctctagctttgattccatcaatatcagactgtattactttacttttatatgaaacaggaggaaattagtactcccttctttaactgttgtacttttgatattacctcttaattatttttggagaatggttgtctgacttctcctttgggcaaatgttctttgcagtgactgggtgtgtgtgtgtgtgtgtgtgtgtggaaaatgtgaggagggaccaaatttctcaggtgttactcagaccttcttttaatttactgccccatttcctgttgctgttctctgtccaaggttggagcctctgtcagtctttgctgggaaaaccggctcctacctccttctcattgtagatttgggcctccttcactgtgatgcacttgtcattgtggtgtctcatttgttatctgtgttacagaaatttatcaaaatctggtcttcttcagccccaccccctactctttctctctgcctccctccgtctctctctctctctttttgttttttgagaccgtgtcttactatgtcacctagactgcggtttaggggtgcgatcatggctcactgcagccccgactgcccgggctcaggtgattctcccacctcagcctcaggcgaggaccaccacgcctggctaattttggtttttgttttttgttttttgtagagactgggttttgccatgttgcccaggctggtcttgaactcctgagctcaagtgatctgtgtgcc

SEQ ID NO: 135247 - DNA, 1020 bp, Homo sapiens
cttgcctgagtaagttgcagaactgggatagagattagtgctcgaatcttccaactcagggttcagttctctttatattatactcttttgactggggaaagggttgtgtctgtcctcaagttttagtctgtctctcttttttgtgtgtgtttgtgtgtgtgtatatacacagaacatttcaacactgaaattgcttggcagtttcatggtctttgtgccataccttctttaacatagaatcccagtttaatctttttatcctttaccagttctcttcttttcttgtaatgtctcatcatttagattatcagatgattggtcctttttgactatttttggagacaccagagttcttatatggtttcatttttttctgcagttaatgtatctgtgcatgcgtagctgatcttcaccttgttaaaaggtgaaacaatttttttaatcaacattttttgcttcttagtctttccaaaatcagtcatgaaactagagtgaagaattattctgtgttgataacctcaatagagtaaagaattggtctgtgttagcactggtctgtaaaggctacctataagtagtttggttttatcagtgtgactagtttctttaaagtagattagagatgaagtttagatacaacacatattgaatcacacagatttgttgtttacttccaatacttatttattaggtaaaaataaacctataagagatcttcttcaagagtatttgcatcccacattccaacactattcaaagccttattttcctagagatcttggaggtggactagaggtacttgtgacttatgtgatgatgtatttttttgcttatagattaatccactggggtttgtgcgatagatacatgtcccctattctgaaagaaacacacacacacattaatttcattgagtctttctttacattcatatttgctgagttgcacaactccaggttgcatcatttataatacactttgataacggtgcattctagaattgtgcacaatggctacccc

SEQ ID NO: 135248 - DNA, 1506 bp, Homo sapiens
ccaacatggagaaaccctgactctactaaaaatacaaaattagctgggtgtggtggttcatgcctgtaatcccagctactcggaaggttgaggcaggagatcacttgaacccgggaggcggaggttgtggtgagtcaagatcatgccattgcactccagcctgggcaacaagagtgaaactccatctcaaaaaaaagaaaaaaaaattcaattctagctataatagatcagctgaactatatggaaatgggaaacgtgcaaatactactgatatcttccctgcttgtaagaagagggtttagatatagatatgggcaaagcttcatttatgaatagatttatatatcttcagtgtacatatatatccagtgttttatatatatataaaactggtgttttatgtatatatacacaatgtaaccctgtactcttcacttttaagtttattttagttagaatcttttaatacgaaaacttagaatatgaaatagcaaaatactacaaaagttgaaaacaactctgagcttttttgtgaatattatctttttttctgccacatttaattagttatcttttttgtatttcccatgtaaattttatttcacattcttggaggattaatatggaatttgtatagattttggaaaagaaattttaaaaaaccccaaagaaatctattcctattcattgtttctttcacctggatctcctagtacctataaatgggtgcatgaaaacgtttgcactgcactgaattgaagtttttactgtgggattgaaagaagcactgtgaaaaagatgaagaaacaattgaccacactggatctgtagcccaagctattagtttagtcttagtgtagtctactctgaattttgacttactggatatttaaggtctctggttattcctaacagactggttggctttgcttcacccaaatagattgtggtgtgaaacaagacacttgataccgagattaaggaatgtctcatgacagtgcttgtttctattcagcactcccctccactttaaaattaactgtttagggcttaaatgaaatgggttttaaaagcaagacaaaactttgttctcgctccctcactaataaacctgtagcatctcacagtagaaaaaagtatagtgggacttactggcaccatggtgcacagcattgaagaatttcatattgtgacaacacatcaaaataaattgctgtcaacagaccaaaacaccaagtgctgtgattctgtctgacgtgtgaagattcagacaggctgtcttgacaagttgtggtggagcacctgcatttgacagaagacagtgatataaatctgatttgcctgatacgaagcacctagatatagttaatgctggtgacagtaagtctgcataaaatttccaagctgcaagtctgactttattttgcctctattaagtagtagtatttttttggtcacattttgattctcacttattttctatttgtatttgtagtgtggccttga

SEQ ID NO: 135249 - DNA, 2204 bp, Homo sapiens
gattaatttttaaaaatggaaatgaagacaagatcatattaattgtgttattttttacttttctgtagtaactaacttgttggtagtatttcatggtaagatttgttattgtctaaataaagaaatctatttggttttcccagatctcaaagatgctactatttcttaccgaatttattgcttaactcatttgaagattagtttcattttatcaccaattgttgctctggtggttcccctgtgaaacacagtgaaataattcaaggattctcaaatttgagaaattttgaaattagctctgtccactatatagttttaaaaagtacaaattatttgtttcaagttactattcattcttgactgtattgttgttttaccccttaaaggctgctaatgagaaatagagcctcattatgattttaaggatgagagaggaaggcttttaattaatgatatgtaaatggtcttgaattgattatgttagaatatcaagagagatgggtagaagctgtggtgtaatatattttaattaagaattaattaaaaatgatggcaatttcataaagcctcacagaaaatagtggaatttactttctgtcaggagtaaattagcctgtgattaaataaagggcctgcattaatagtggagttatttttaaactgtgctatgaagaattatgtaatttttcctaaataagtaaaattaaaatttaatatttaaaggtgggtagtaaatggtggcagagagctaacttatttttatgactcaaatatattgtttcttctttataaaattttgtgtaaatatttttaacctcagcatatacagcatatagctttaaaagaatggactttgtctgttctattgcccatttggcattggggataaggaatgctcttacacgtagccatggcagtggttttcctcttgtacacaagatctgggaaagatctttactgatgactgaaaattatttttaaaggaggtactcttctttttttccctgttctccagagtttaaaaacgtttcttccttagatgtggtttttcattgtaaataatactctttctttagaaactctaaaatgtgtatatttctttacgttgaaacctgaaatttccctgagcataccgtttattcagactcagactacactatttttataaacatttttttccactagtttagagaaatgttttaaaaggaaacttgtctttgagttcaacttggattgtaatttgaatgtagaagaaaggctgcataatccaatcaaagcatatatttcattaatgttttttgtacattaatacagggtatctcagtatagtagcttattatattgagttattatttaaaaccccacataatacattatgataccctcaaccttaattcagtacttcatacttgtgaaacaccccataatgagtagttgaattttgggattttatggatcatccatatcaatagttatataacttgtggggttttttagtttttttgttttgtttgctaagtagctaaaaaaaaaaaaaagatgtgagttttactttgtcagaacctcccaccattcattaattctcctaactcacctatgtttgcctatttagcaagtatgcctcttgtatgtgtaagtttgtggtatggtcatatttgatgacgcttctgtggttcttgaaactccaaaatacagttgtgggaaaagtggagaaacgaacattctctggttccctctgcaaatgctgaccattgctgttgattattgacattttcaaatttacttcagtcactgtaatatataaaaataagcatcacaaataaaagttgtcatgaccctgtgaggaaattgttgttgatgtgctatttaacttttatttacctgtacatgctgctcagaaaatggtttttatgtaccagtgtgtgttatgctgttcattgaagtattaccatagcaacagtaatatctcttgctttcatcttaatgctgatttcaagatacaaagatagtttttaaaagactgaatttaacatatataatgttaatatggtcctttttaaggaggataaattacttttttttttggtaatagtgttaaataaagttttaaaggctaaatagtctgttagtgcctcaatgaaatttctgtgttagctactttggatcagtctccttttttaaaaaaagaaagaaagaaagattaa

SEQ ID NO: 135250 - DNA, 1051 bp, Homo sapiens
agtacagatccaatgggaaacagttaaaagatttggaacgtgttttgactagagaaaagtaggctaggctgggcgcggtggctcatgtctgtaatcccagcactttgggaggctgaggtgggtgaatgacttgaggtcaggagttcgagaccagcttggccaacatggtgaaaccccatctctaccaaaaatgcaaaaattagccaggcatggtggcccgcacctgtagtcccagccactcaggaggctgaggcaggagaattgcttgaacctgggagtcagaggtcgcagtgagctgagatcgtgccactgcactccagcctgggtgacagagcaagactttgtctcaaaaaaaaaaaaaaaatgtaggctaaagggttaaaggatttttatgagcttgatgccaggtgtttgacctctgtatacaactactattattatttttagctttatcaataaaggatgaaacataaggaagtgtcctgaaagtgaaagtaagaaagattgtggtttgatttgtagaggggctacgtaaccactagagtgaaaaatgactggtccgtttgtgagtctctgtacctgttgatctgtcttgggtgtgtgctagatatgcctggaatgaagaatcttaaccagaagcatgctcaagggcctgtccacagttccgttattccatgatgccttattgatccagtatttcaaaggaaagtatacctttctttattatgagaatgcatatttaattaatttgttgtgcacaggacacttaggcttctcattgctgttttccaggtgtctcaaaggacaagataactctagtctccaaggtatattgtaagtctagtcctaggccttcctagtttataaggaagttaacagggtctagaaagatacagtctttcagactaacaggttcttattgattgtattagaatttaaattagaatctatatgatgaattacatttgatgaatcagttggcttttttttttttttaaatactcattgcttactagacagtgggggacaacaaagtctccagaaatggctg

SEQ ID NO: 135251 - DNA, 1021 bp, Homo sapiens
ctagaatgtcctggaaggaagtctgtttaattttgcattgggagatactttataaatgttagctgtgggtggcagttttcaaccagttaaattctaccattatctttgagaaaggcaataacgttaatatttaactagttccagaagttaggatagaacatttaattccaggagaaaacagctaaaattgcctgtagtgaatagagattctcgcctagtaaattcctttatttaccacaatcttaccaggttcttttgaggcatgatttttacctgttttaacatttttcatggctcaattattttacatataggattctttgaaaaagaagtgcttcctaactttaaattcaaataatttatttactattctcatatcttgattatttgtcacaaatgatatagtaataaccttcctttctcttcaaaatgtttttatgtgaagttcaaacagaattgaaaatcagataatataagtcttgtcgactctagcttgtctggaatattcacaaattaatgaagggtcattggtgattatgggattttttcctttgaaaatatatctaatgaatacataagatatatttcataaacataatatggtaatgtcactactaagtatttagacagttcagcttattgggtgatgacacacactttttttctttgaaaatatatgcataagatatattaaatatttgaaaaatataataaaggtaatgtcagtactaagtatttagatggttcaacttattgtgtgatgactttattcagaagagtggattgctctgacccttaattatggacatattttttaattgacacataatattttctatatttatggtgtacatgtgatattttgttgcatgcatagaatgtgtaatgatcaagtcagagtatttaaggtatccatcaccttaagtatttattatttctctgtgtttggtaacatttcaagttctttcttctagctactttgaaatataccacacattcttgctaactgtagtcactctac

SEQ ID NO: 135252 - DNA, 1021 bp, Homo sapiens
ttcacttgacaactttactcaattctaggcaacagtggctatgctctggcctgcagagacagtgaatccattctggctctgacactcaattttattgtaaaacacattcatgttgacatcatatcagttttctgaactattacatgcataaaagaattcacccctttccattcagtctttttcagccttccggttaggagaaatctgcacacccagtgttttcattttgcatttaatgtggtctagtccagaaaatagcagcttcagttaaaaaaatgtttttcttgaggcacctttcagagtgtgttagcttaatggcattcattagtaggagaggactaaggagaaatgcacaaggcagtttttaggagagaacagttgaagtttagggtaaaacaagtcagtattgacccaagattatggggtttagttgctcgagttcttttgcatgcaactgctgtttgaaggattccttgctgggcctcatccatgcccaattttgtgggctttgcctcctacttgatctttttggttgtgttgtttttgtgaagtcctttgattgctgatttttttgtttacttgttttacttacattggaatttgctagttttgcatttggagtttgtttcaaatataattcaaatcttcatctttagtttatgggggaaatgttttttctttacaaaattaagctcttttatttttatgtcagttctagctttgtactgagttttgctgaggctatccttggttttcacgataaagaaatttcaccttttcactttttacagggcttgattgacttacttggtttcctgatcctaaatattaagatgttttattttccttcttctctgtgaatacaggtctccctaaaatatccacaaacctatttggggaatttaataaggttttccttgttatttggttctactgttctgagactgcccattgggaatttcatttacccataagagactgacattcttacatggagtgattgcaaattttgtttttaaac

SEQ ID NO: 135253 - DNA, 3177 bp, Homo sapiens
agaaaaagtcctaggtatatatattttgatatatttataatggattcatcacattatcttttcaggcattaaaatatactatataaaatgtcaaaatattaccataatgtaagctagcattctttgagtgggtattttggttctgaaaagtatgcttaaatattacaggtgtttaaattaaaaatgtcaaaccatgaaggcataatggaagtaatcatttttacatagttttaagcagtacagggttgaaaaagctttgcatgccagactattgtgaatgagtggagttcataagaattcaaaggacaaaagagatcattatgctttgttacctcagctagttcattaccttaattgctgagtgtaatccagtcttggaagaaaactctggggctttaagaagatcaacaccagcaccttatggcacagaaaatggaaaccctttcctgtaccattgctactccaggaacactaaaccttgatcaaaggctgaacttttcttaaggtcggccatgtgaacatcccctggagctgtaccattcgctgaaccataatgaagtttagtaggttcagcaccatttctctctgactgtgaccgtcctggatcactggctagcaatagcatattatcagcctttcagataggtgaggtttaaacataattatggttagtagtataatatgcttttttaaaaatactgctttcatattatggaaactgaacaaactactgtcactatttaactacgttagtcaggaagcattaatttttttccttccttttgaagggattgctatgtctccgtacctaaatctttcggaaaaccttggaaattccctaaccggtatacttttcccgaaaagtcctttactatgcagtgtggatgcaactgtgaaatggttgactcatctgaagcatttttatgtatatatttttctcacctgtgcagcaatttagcttggctttgaagatagttttctttttaggatgcatacagttgcatacattacgctttgaaaaaattacgctaaaacaaaaaatatgacctttaaaagcatggttgagttgcattcattttataaccatcaaagcaactctgtactgttgtaaggtagaaaaatcaatgatgcaatctttttccttttgcctcgtgcaatccgtaattgaaatggaaaatcaaatgaacggctaacagataattgttttatcaatattccctgcctgccctacaagggtcagcatagaatgatcatgagccagggatatgatgaggacaaaatgtgaaattgaacagcaaggaggcaataaatcagccttgacaagaaagagtgaccagcatgtagctgttgtaggcagctttggggacagtttttgtctcaggtgtctgccctgatttaaaaatgtgagtttataatatttgaagctttgccaccactaagcttggctattttggggttatatatgctactaaagaaaatctgagtagtaatctgactgtaatttatcttaaaagacaaatgttgaaataaataaatttccacaaattcagatattctatatggtatgattaagaaagtaaatgtataaaaatattttattgtattgttgcatttatgcaataggccttgactctaaagtgaaaatgattcactgaattagtttttaaaaaatatattctgtaaagtttgtaaaaaataaagtgaatattagtttctcttgcctaaattatgagatttatgtgggttgaagatgtcatttgaggaaggaggatccaaacaaaaattaagactcatctactcatgttttaattttctttattttcctattagctagaaattattatataaatgacagaaaaacacagttataaatgctcagtagtagtaccatgtaatgtgtaggattgtgggataagtgttattgttcatgtccacattaaaatgaaataacttcagacattgccaaaatatggttgctgggagttaagtttattcacataagacataaaattatgttggtgaatgtatagggaaattttcaggtcattttagaaaaatattttgagagcttaaaaagatttattttcaaataatttacctaattaggaattcatactgaggaaatagagacatttgtaaagataaacacatgaagatggttaccactgcaatattctccccacctccttctctcttaaatttttattagggtgaattttgagtcacatcacagaagacagaatattacagcaccaaacagcaaacacagccaacttatggccaatcctgccccattgtcacctccatcagctttctccttctacattttaaaaagtaaatccaagacatattatttcacctgtaaatatttcatcatgtacccctaagaaatctttaaaaaaccataaaatttcactgtatcattattacaccaaaatatgaaccataattccttgatatcatatatccaaattgtttgtttgaacagaatgcaggtaaggtctactcattgcagttggttgatatatcttttacgtctttttaaatttaaagcttcttttccattttttttttaaccctttgtacttttttgttgaaaaaattgggttgcttgtcctgtaagttcccagtctgtattttgctgattgcatccccatggtatagtttaacatgttcttctgttctttgtatttcctacaagttgagagttggatctgtaggcttagtaaaattcaggtttaattatttattttcctggaagaattgcttcataggttgtgttatattcttatattaggtggctcatattgtctgcttttctctttattggtaatgttggcggctattggtgatcaatgcttacatctattagtttatttggggtagcaaaatagaaatattctattatttcttttcaatttatttcttatactaatttgtgaagagaaaatttcctatatctactacttagttactgaggggtctagtttgcagcattattcctaaaaggacaaattggaaacagttgaaatgtccaacaataggtgaattgattaaattatgttatagctgtgtgatagaattctacataattattttgaatcatgttttagaagaatacccaatgatatggaaaaagtccaatgtattaaatttataaagcagcaataaatagta

SEQ ID NO: 135254 - DNA, 1038 bp, Homo sapiens
atgctttgccttttgaaaacatagtaattatgatgttatatatattaattttcagtgtttcctacatattatttaaatatccaaaccacagaaaacattatttttaagtagtagtctttaagtaaggtaggatgcaattggtataagtatgaatttacattaagaaattagaaattttaaagatttagtaagaataaagtcagtattgtactgaaaaattataatttgtaaagcttctccccttgttttatgcagaagtctaaataagcacatgaattaagtttgtaagccttataaaaactaaagataaaactgtttgagaaaatcaacattttaaatcatgctaaatctcttcctatttttactcatcctcttgcagagcattgacaaaaatatgaaattgatttggttgaagggtgttaaagagccgacagccaaatgtcacaaacaatgaatggctgcagtgttgaaaaaatcaataggaaggttaagctggtcttgtgaaagacttggcagactgctctgttccaggaagatatctgtcttctggccttggttgcatgatcaaaaggaaaacttgataggtttaatgaaggaagatactgtaaaactgacagtagaaatatagacactgtggtaaaccatagtgcacatcagtgagtggagctattagatatatttttcagcctgaaaaaatacttatgggtagagatgtcaaaaatattaacattcttttactttttcatcagttcctctatcagctaataaatttgccttaagtaaacaaaggtttgcatcttaaagtgcgagacacaataattgctgtgttaattagtaaaagaatttcccaaatctgttgattatgtttaaaatctaaatcaacattatatctttgccattcgcagattgtgtccaaggtattaagaaagatcgacagcctaggtaaaaaagacagccattgacttatcaatgaaaatagaaagtccgtcattgaaaaccaaggtgggatttatgattcattagtacaccccacaggcc

SEQ ID NO: 135255 - DNA, 1133 bp, Homo sapiens
caaattaacatttcttctctagttatctaaatacacctttgtaatttttagtgaatgaatgtgtttcattcatcttactcagatagctttagctaattcagttgtctcagattttccaagagactaaaatgtcattgctttctttccccattttcatagtcatattcatttgtacttaagacttataagcattgcaatcattgtcatttaggacaattgaaagggaacttgggttgaaagagtttgtgttttggttatcaagttgccatgggttccaaactcccagttttgctatttattacagttatggctttaaactagttactggacttttctgagatttggttttctcattataaaaaatgtagataatatctgtttgtaagggtgttatgaaaagagcttgggaaaaagtgagtactctgtaaatagtagatatttttatcatcagtaagcaagattgtatcagcatgagatgactaagtcaaattaagtcagtttagttttatctttctggcttatctgcatggagtgctcttgacatgaattctgtctttcaatggttgattcacttcagccatactgcattatttgcagatcaggaaaagttagagatctcatctgcaagaacttaaaacaaaactaagcagaatggaatcaacttcagtttcattttagttgagaatcagtccaagaatgaataactgtaatatatttaattttatagattgagtttaggatatttttattaacttttttttacagtgacctagtttttcagtttccttataccaaataatttaaaaattatttgtaagttatttataaatctagtaacatatttacagaatttatacagtactttaatatattcctataaacttcttctaatatgtagtattagtgcttcctattggtatatgttttattctaattgatcttgacttactttcttcaaggtaaagatttttttctttttaaaaaaattccttcaaatgataaatatcccttcatcaaattttagatgtcatgttgacagtatatcaaaactatgcttttgctagggcacattattacttttggttaagtgtgtgggttttgttgtgattttgctttcattctaattctatagg

SEQ ID NO: 135256 - DNA, 1096 bp, Homo sapiens
gtttaaatctatatgatttttttaaataaaaaaatttacaacataatatcatgtcatacaatttttatggacatataatataaataggcccaaaccatagccttattggaaaaaaataactataaaaatatattttaatgcttagtgcattaaacatttttgctatagaaacaatggacttggtaaagtaatttaatgaatgtcataaatacgaacaatctcagatgagagatattaacaaataaatatattaataaaagatatattatctggtttctctgtgtcccaagtggggcctctttttgaatcaatgtaaaatactctgtatagagctagtgttctgaactggaagagtatgagaaaaatgttgctttctgcgctgctttatttctgtcacaggtcaggcttaaaatgctgtgtgatacagttattgactctaatctgggcataaacacaagtcctcaagcaccagcccaattaataatttgcataattaacacgcatattaaatagggactggccttgcatctgtatttgcagtgatcggggtaatgagggctaacggagcggcgcctcgggcctgggttagcagacgtgtggcagtagtaatttttgcttggattgacaactgctagacaagcagtcccagcataaaactaaaccccgtttggcagtattaatcgttgacaaactgctcttaaagctgtaacattgtttctgtcagttgtttggtttgatgtcactgttagacataataaatcaatagtgtcagaatttgggaatgtttgtagctagcaatgtttattatttcatatgactgtcatgtacaaatagtggttatcatggttgcctctaaattatcaaagacagaatattgctttgaatatacttctgtaattcttgtttcaatgaattctttgccatctggaaatgcttttggttggtatgcctgcccaattctattgtaatattcattgtaatattggtgccatatgtcctgttccatgatttttaaaggaatatacagtttaatttcttgaaagttcatttagctataaatgaagaagatatacctagcttattcagctttatcttc

SEQ ID NO: 135257 - DNA, 1051 bp, Homo sapiens
gagcataagaagtgcattagttttaaaaagatgtagtcaattggagtaaggctgcccttagcttgtcataagaatattttcacctaaaagaggccatgcataaattcagaaaattattagagtccataggtagaaaaacatgaaattatgagcattaacagcattaaggctgggtgtggtggctcactcctataatcccagcactttgggaggccaaagcgggaggatcacatgagcctaggagttcaagaccagcctgggcaatatagggagaccccatcactagaaaaaaattaaaaaattatctgagcgtagtgttgcatgcttgtagtcctagctacttgggaggctgaagagcatttagtaaggcatttgatgaaaagcaagtgtggtctgctcattatacctctcgtttgtatattgttatgctataattttaaagcttatttcccatttattgtatatctgtacatgtgcatatcgtatacatatgatagcataatgctaaatggcagccatatgtaaaaggtaacaaggggattttcaggatataaatgaaatgtcgtaagtaatatgactgtttcttaaaaatcaatacactggaatcagtgaatttaaatgaatggggttccattcaaaagtggtatttccagaaagtaaatgcatatttcacttttggggaccctacttttgaaagactttggtccatttttttttttttttttttcaagatgaagtttcactcttgttgcccaggctggagtgcaatggcacgatctcggctcactgcaacctccgcctcctgggttcaagctattctcctgcctcagcctcccgagtagctgagattacaggcacctgccaccatgcccggctaatttttgtatttttagtagagacagggtttcaccacgttagccaggctggtcttgaactccggatgtcaggcaatccaccatcctttgccttgcaaagtgctaggattacaggcatgagccaccgcgcctggccaactttggcccattcttttaattatctttaatagtggtaa

SEQ ID NO: 135258 - DNA, 1021 bp, Homo sapiens
ataataataatgataaaagagcagataataacaagtgttggtgaagatgtgtagaatttgaaatcctcctacacagctggtgggaaaggaaaatggaaaatagtctgtcagttcttccaaaggctaactgtataattaccatatgacccagcaattttatgcctaggtatatacccaagagaaatgaaaatatatctgcagaaaaaaaatcacagatgttcatagcagcattactcataatagccaagaaataaaacaacccaaactgattaatggataaacaaattatggtatatccatacaatggaatattattcagccatagcaaggaatgaagtattgatacatgctacaacatgtatgaaccttgccaacattttgtcaagtgagagaaaccatttatcaaggaccacatattgtaagattacatttatatgaaatgtcctgaaaaggcaaatctaatagagaaagaaagtagattagtggttgccagggactgaagcaagggacatagggtgatgaggagtgactaatggggaattttgagagagggtgatgaaaatgttggaaaatgattgtgattgttgcacaactctgtgaatatactgaaaactattgaattgtatactttaggtatattgtataataagtgaattgtatctcaacaaagtttttataaaaaatagcctgggggaatataaggagacatatcatttcattgatactaaaatgcactttaaataaacattttcacatttctgaaatcaggatgccttttacagacaatggtgtcttaacagttgctgccagccagttggtagtcttgttgtggttgcattgcctgtgtatacaagaacttggtgtttttcctggtggcgttactaggtatatgtagcctcttgatgtttcagtcaacaaaccatttgatgactgttgcctggttgtgcttgaaaaccttcttgtgacatatggtaagagcaaccagcatcaaaatttcttacatatggtaagaacaccagca

SEQ ID NO: 135259 - DNA, 1047 bp, Homo sapiens
ccaccacactcagctatttctttgttttttgtatttttagtagagatggggtttcaccatgttggccaggattgtctcgatctcttgaccttgtgatctgcccaccttggcctcccaaagtgctgggattacaggcgtgagccaccatgtctggccctgacatatgatttttaaaattggtgtttaaaaagtctaaaaggccttttcagtaagtatagtagatactttctaagagttaagaaacattgtaccctagtgtaattgacagagtttagattctatgaaatgctatagtaacaggttaatacattgtgggaagattagatgaagtgatgaagaaacacctaagaaaccagcatttcttatcactggttactagatgtttcttcatcactctttttttctatctcacacaattttccctgttcttaatacttagctttgccccgtgtttttatttccttctctttttactaatcatacctgagcaattttttttctaattatgtaattccccagttaagaaccttttagttccaaagtgggtgttattcttgaaatttgagaagcccctgtctccttagagaagcccctgtctccttagagaagcaggcaacgatggggagaatggcttataagccagtagagggtgttccaaagtgtgttccatggaacaattgaaggataatgaggaaggagaataaactgtccagggtcagagtgaacttgagaaatgctagactaaacagaatattgcagaacttctcagagcatttaaaatgatgatatactttgggattccccatgagagtaatataataggcagcatttcttaaaattttgtgacttggaaccattaaaagaaaatctgattagtatcctgagggaccagcatcaagataacacactctttttgagaagaattttgggagtcaattattagagtgtactgcctggctgtccagcatctcctagatcagcactccccaacgtttttggcactagggagtggtttcatggaagacaatttttccatgaatgggggtg

SEQ ID NO: 135260 - DNA, 1098 bp, Homo sapiens
ataaaaatataataataaacatttctagagataaagagggacactatatcttgataaatggtccaattagacaggagaagtgtaacaatactagatacgtaggcttaaaaacagcttcaaactataaagcaaaaattgacagaatttcggctgggcgcggtggctcacgtctgtaatcccagcactttgggagaccgaggcgggtggatcatgaggtcaggagttcaagaccagcctgtccaacactgtgaaaccccgtctctactaaaaaaaatacaaaaattagccaggcgtggtggcaggcacctgtaatcccagctactcagcaggctgaggcaggagaaggcggaggttgcagtgagccaagattgcgccactgcactccagcctgggcgacagagcgagactctgtctcaaaaaaacaaaacaaaacaaaacaaaacaaaaattgacagaatttcaaggagaaatagattcctaattgtggggagatttatcatatccctgttggcaactgatagaataatcagacaaaaatctgtaaatatacggaaaaatttaataatacaattaacaaacttgactcagtggacatgtggagaatatatcaccagcaactatagaatatgcattttttcctcaagaatatgtaggaacactgaaaaaaacttaactatgagtcaaactttaacaaattggaaagaatcagcatgacacataccatattctcttatgacaaaacaagtggttataaatgaacaaatgtaactaaaaaataagtaattcctacaacatttggaagtttaaaatgttttctaaatcattctcaagtcaaagaaattgtggagaaattgtcaaattctttaactgattaaaaatgataaaagtatagtttacaccaacacttaggaaatatgactaaagctttatattatttttagcttcaaatgtttacattataaagatttttaaagtcttcaagttaattagctaaaatccaatagaacctaaaagaacagctagataaacccaaaggaaaatagaaaaaagggaataataaaaacttgaagatgagttaaagaaaaagaaaacaaagat

SEQ ID NO: 135261 - DNA, 1004 bp, Homo sapiens
gaaatcttaagcactgctgtcaaaacttttccagtgaatgttgcttttacaaagacatgctattcttttttttttttttttttgagatggagtctcactctgtcgcccaggctggagtgcagtggtgcaatcttagctcactgcaacctctgcctcctgggttcaagtgattctcctgcctcagcctcctgagtagctgggactacaggtgcactccaccacgcccggctaatttttgtattttgtagtagagatgggatttcaccatattggccaacctgatctcgatcgaactcctgacctcgtgatcagcgcacctcggcctcccaaagttctgggattacaggcgtgagccaccgtgcccggccaaagacatgctattctttattagaaggtatatgaacacataagtttgcttttaatatgatagcccataggaaaggtcttttttcattccaaaatcttttctgtttactgaaaaagttgattaatttcaaacttgtggcaagtgggttgaaagtactaaaagaagttagaatcataaaacagaaatatagggctgacttcaggacaatctttaaattgtagaacctaagttatcacaaattattagaagaataaatgccatattttgttgattaaaaggacattaagaaagggaagggaagattgaggattattgatgtaccagtttcaccaatattaagctattacttcaatagatcctttgaggaacaccacatagatgtgaacactagttatttttatttttaataccttttattatttaataccttttattatttccaaatatgcttttggaagatagagtttttctggtatagctaaatgattatcagtctgaaaatggtttgaatactttctctgggaaagtccttagatgttttatatgttacctaacttctgttagttaccagacttcaggtaatatacataaaagctctttgtaagctataaagaactataaaaatgtaaatagtaat

SEQ ID NO: 135262 - DNA, 1033 bp, Homo sapiens
tttcaatattaattatctgacttttctcttcatcacctggtgctgcaaatagcagtgtctccagctgacagtaatgttcttgtaaagaaagttctggagggtgttggaaacactctgattactacagaaatcatgctttttctaaattaatttcagtcttaactgacattaaagataggcatctgaaatctagtattctaagtctgtatattcaaaaaatcttttgctgtaatttgtggtaatcatttaaaaatcaaacggttatcttttagaaaaaattttaatatatccaaaatgttaatgaaaatgtcatttttctcacttaaatcgtgtcatgattttcaaatgctggattttcttttagagtttccttactaaaaattaaaagcaaggtgtacattttttgtgcaataaagtagaaataaaaaactgtcttattgaatagaactagttttttaaaaacagagttatgctttcttgaactgcatttaggtgtattgtgcattttactgctatagagcaatgttctcaatgtgttagttaatgtttttctcattaagtcttttcaaaacttaagggtttcactttgacaggaaattctggatctttcccagtgataaaataaacttgacacttgttccatgaaggcatctcttccttgcttatcagctcttcaatttatggctgtgctttgaaatttgtgcctgtgactctcatctttgtatttactccaattaacacataaaccctaattagccagatcaagggacttgggagtccataaatggaaagtgacatggcagagcttggcagctggcatcaaggcaaggtgacaaaaatagggaagtatcaattagatgacattgattgtaaagctgtgtgttgggatggtagattttaacagctctctgtgtcactggctgctgactctaggataggagtataggaattagttggtaaattgacagctaagttaaagtactgaacttctggcagaatttaaaaacaataataactcatcaccaatttaatt

SEQ ID NO: 135263 - DNA, 1342 bp, Homo sapiens
taaaataaaaataaaaataaaaaaatagccaggtgtggtggcacatgcttgtaatcctagctactatggaggatgaggtgggagggttgcttgaacccaggagcttgaggctgcagtgagctgtgatcactgcattgcagcatgggggacagggagaccctgtctcacaattttttttttttactaaattccagactacagtttttggattacagatgtaattcagcaatgaaaaagtttagaactttgtaaacattatttcagttttagaaatctaatgttacagagaaagacttgtgtctcaaatgaagagttttatcaggctttgtgtatctctcattacttgagacggcagtagacgttaaatatataaaagctgagctgcttctctggttttgtagtttcagctgcctggtatttaacattggttctattttttaagtgggtggttgggtatttgtaaagaaggcgctataggttattggaaacacgctctcttatcactacagaaatcatgcatacttcaacagatttagaattgaatttagaaccaaagaatgaaggagtttattctttcctcttaagacttggttgaaattgtgttgtaaatacatgttgtcaattggatattagatggtagaagttatatattgagtttcttcattttggatagccaatggctctgtaagcctagttggtattttgcctgcatgtagatatggtctgtagttattcaagcagtgtattttaaacttaggttttaaactgaaattattttagtcgctatataccccccgtttcaaatactgcagaaaatggggaaaagaactctgaaatgatgtatttgaaaagttgttgttttagagaagtatttgcaacattagaaatctgacagaaggtccatttacataaatgtttaactgaagacacacaaacatgtaacaaaatgaaaatgtttcatacattaatttgctgcagaaggaactaacataacaattagaataacattctgcctacttagatttaaatttcctagggcagcgataatacatagtgttgatgtagtttaagtcttttaatatatacaatcatttattctgttgttaaaatgaattctagtgttttaaaacattcaaacacggtaaacttagataactagaaaaaggtgttaggcttacaatttttagagatttgtaagttctctcatcagctcagagtctatcagaaatacttaaacagtttcttttctagcttggcaaagaaatgatgtctgtattttgtgattgtgaaaataccagatactgtcatgaaaacagtgaacctaagtaatacaaaagtaatc

SEQ ID NO: 135264 - DNA, 1032 bp, Homo sapiens
tttccccttgaaataagcaacacattcattttaatatgtagaatcagtttgctagcagggcgacagtttaaaaaggcttccaactgtgacacaagtgcaaccatattgcttcctattactcgcgaaggtagttgtttagaagagagaatgttctccctggaaatgtttaaagtgctgtaattttatttaggataatgaggatttataaccattttgccatatgaaaacctgcctttagacagagtgaaataggctgttttggttattgaacgttcttaactgtaggggatgtgtgtgtgtgtgtgtgtgttagttttacagcaataagtgtttacattggggattgtgctggtttattctatatgttggcctgtgttaaatattaaaatattaaatgataccatttaggtttggcccatgtaaatgtttacatttctttgtacatgggatttctctgtattgaaatgtaactaaacagaaagtctttgttcttgtttataaaaataatgttaatagtgactgctaggtatccctggggccctgagtctttgcaactttgctcatgtaagttgtactggaggaagttattttgagtgatgggtagatagtgcatggggaaacagttgtgattaaaaagtgtatagcaggatctatgtttttaatattaagtgtgacattaatgtagtgtatattatcattaaaaactattctagaaaatgtaaatttgacttattttgttaatgctatattctatagcactgtctcaaaacccactgtggaatagtttatataggcctctgcctctgatatgggagggggaagaaaggaacacaacagttaagagatttttatcaggtttttatctcctcactgaaaatcttagttctcaaaacatttctaatttccctcatttgaaggttcaaacagtttcaaattactgcccatggattgttcttgacatcccgaatggtaaatttgagctgtggaaatgctggaatgtgtttttgtgcttttcctgaacaagggaattca

SEQ ID NO: 135265 - DNA, 1069 bp, Homo sapiens
gcggctccgcgctgcgagaacaatgggcgcgcccgacgcccgcccgcgctcgcgctgcccggcgcgccccgaaagccgcggggcagagcgccctgagcggtcccccgcgccggcggccccggctgcgccccgctgtagcagctgaccttagccggctgcggccgagagaacgcgcgttgcccgccgaccttgtgccctggggtcagcacccactgcaagtcagaacctctccgtggtcccaaagttagtgcttttccaatccaaaccagaaacttgatttgaggcctggcgatggtagaggatgcattttcttgatttcaaacatctgggctgctgccgactccggtttctcagaggaggactgcataaccaccatgtgaacattttcaacagataggaaaaaattcccaaccagcttcaaaacaatggtggttgagaaaaaaataactaagccttcaccataagtatgaaacatcatctgggaggttttcccacggtaattggctctgaagtatcctaacttaatggttgtgtttttcaacgggagactgaattccaaagggaattccacagggaatttaaatgtacaaacattttttgagtacctactatgtcctaggtgatgggaaattattacctcattattactggttggaaaacattccagaaaaccaaaattattgctctttccaggatttaaatacggacaccatagaaagattgctgttgtcaccactgccttcccccatcccacccccagtgacttggctctagtcaagaaatattggggatggtggggaggataaatgtgctttctctattctttttatacttttaaagaatatcagcaaagattattgtgcagtatttctacaatgtagtgtatgcatctaattgtgtgggagtagaattgtatgtttgcaaggaatgactagccaaatatcagagccagcagaacaacagagcactgagatttgaaaagattaaaaaaagaagccttgcccctttttagattaacaaaacagttccatggtaatattttgtgcttttctttaaaataaaggattgt

SEQ ID NO: 135266 - DNA, 1026 bp, Homo sapiens
ctatctaaaatgaatgccaaatcattagaagttgatatctgaccatttgtgacttagaaaatggcagttccgtgaggttcagtcaaatggacagtattggtaacaggaaaatgaaatgaaaaagcagagaggaaagtacttaggtacttacagccattgtgtaaaaatgtatggatgtacaaaagattgcaatgtgatgttacacaaatagaataaaatgtttatagagttaattttttctcctactacgttgcttgaactcacaatgaaagaaaaattcaaaagtttgttttcttttaagccttaggaaaaacatctctattctttaaaaatgacaaagttaaaaacatataccaaatttagccatttaaccatgagcccttggaattttaaccatgtgtatctatgtatcattatctgtacatatcctaagtatgtagtcccagaattttgtattttgactctgtttctattctatttaagagttaagggactactattatgtgcatttcatctttaattttacccgtatgtaaagggagcttccgaaattaggcctacctgttcaatcagcattttattttattttattaatttttttgagacggagtctcactctgtccccaaggctggatgcattggcgtgatctcggctcactgcaacctctgtctcccagattcaagcaattctcctgccccggcctcccgagtagctgggattacaggcacttaccaccatgcccggctaatttttgtattttttttagtagagatgaggtttcactatgttggtcaggctgatctccaactcctgacttcaagtgatttgcccaccaaggcctcccaaagtgctgggattagaggcatgagccaccactcctggcctcaatcagcattttaattggaactgtatttacaactatggctcaactttttttctacccattcagaacagtttgtatcgtaatatcatttacataatggtttgcttttgatgctatcatctgtgagatttttatctctgag

SEQ ID NO: 135267 - DNA, 1032 bp, Homo sapiens
agcagaagtgataaattatgaatatatttattttaaaaatatttaaataagatacccaccaaaaaaatcatattcttacatggtatcattagctttgacatcactgtatggtgccagattatagtgatatgaagcttatgatactatttcacatttttatgcactaaataaaacctgccctgtgttttattacaaagtaggtggcctgaaggaaaaatatatgtattctttccttttggtataaaatatgcatttgggcttctcatttcatccccaatctgtgttattccttaaaaatgcagaactgcctgaagtcctctttaatatttaattcaacaactttttaatctgtcattatgctgtgatgaagtaagcatcaagtgtcgctgaaagagattaaattatacttggaaataggaattgaaatgatttaggtttggaggctgaatatttgctttgcacaagtaataataatagtagcttgggtgaagaagggctttggtttggctttaatgtctttgcctcgctgtgctcccctgtggctccccctgatttacgctagcattacagagctttattttatttaaatggaggtagaaagtggaaattactacactacaatacattaattactccatactatttctttgtactgatttcccttttttctgtaaacatcataaacaatggtgcaacctacccaatggatagcagctgtaagcaatcctgtagttcttgttaacaagcttattttagagaggaaaagcagtaataattaatatcagtctataccaatagtgagaagcaaagaacatttatgctttccctttcatagggaatgatgtcctacataagaataagttgtgacagtatatgttaatattttaactgttgcattttacttcttgcttttaaaatcgagactttaatctgtggactcttttgcacttagagacaaaggtataaactttcagacttcttaggggttcttgagttgctcaacaggtgatgaataaaggctaaactctttgg

SEQ ID NO: 135268 - DNA, 1048 bp, Homo sapiens
tttttttttttttttttttttcctgtgcaaacatgacattcattcgcattagaatttttttcctgttaggctaacatttcttaactaggttgcagattagcattggaatgataggacattttgcaaatgtatcttaaaatatgaattcattaatttgtggaagactaattcatttagaatagcttcttgagggcaaaaaacattcgtaagacagtttgcttgttatgccatccaatcaaactgaagaacttattaagagtaccagaaagaatagagtacattttggattggcaaatgatctgagtgtgaagtgatgaagccttttctggattctcaaaattatcactattatctcattctggccaatgttaattacaatttttctttaaaatatttgcatcattctcaacaaattagttagaagactaaaccattctaaaatgtcacacacaccagcaaaatgtattcacatgtctaaaaaaccacatactaaaatttattgtacttctagtttatatagggaaaactgctatttgagggcatctgatttaaaagtattggattgcagtaagaaacagcattaaagtttatgggagctttccatagaagtgcatgtttgctctgtattagacatggccagaattatcattctcatagcgtcctgtaactacatgaatatatatttaccactagccgacttaactaagccctaattaaggactgagtgttttaataaaatttaaagtatacttatttcacttagtcattcttaaaataattaagatactaatgcgacttactttaattgaagaattacccaatatactacaaaatacatccttctttaacggatatggccatttaaatatagtaatctacacataagaattctaacttgagcctcaagtcaacagtaaataattatgatggaattgataaataatgaggtccctgcttgccctttagttctttggacctgtggtctcttagctagaaaaaacagatttgagctcatgaagcagtggttttgcatttttagaataaaatt

SEQ ID NO: 135269 - DNA, 1065 bp, Homo sapiens
ttggagctggagtgggatgggctttggggccatgagttgtgatgggcaactagatcacctgccatttcctcataatcttttaaaaattggttattttacagttgttttctattgatgtctacaaaataacatgactatttctttcattacaagcttcatctttagacctaaggaggagagtgtgaaattcaggtgcaaatattccagatctttctctggaagtgttgatatcattctgttggcctttttttcattttcagtcagtccttacttaagggtctgcctttcctggacttggcttcttagcccactctctagtccacccactgtttaactgagaaccttaccctcccaaccccaaatactttagtttagacagtgatgccttgagggtttttcagtgtctttcaccactgtttccaaattatatcccagttttcacaaccaaaagtaattgtttcaaatgagatctcatgaccatggggcttgtgaccttcatttcatttccagatgtcctgcctcctattttgactgcatcttacttaaggatttcagatagaaaattattttaccttttttatgtttggggagaaaagtagcaacacgtctgtcttaatctttcttcttcatctatagtttgggttacacttctcaaactgtggctgacttgatttttaaatgaagaaagcacagaaaataaagtaggtatttttactaattagctttgtgacttctgaccactatcctgcatgttactttaaaataacagacacaaaagaaaagctatgaaaaattataagaataacagaaaacattaatattaaaattgtcgcttatttcaaagcagtcaagaattcagggcctgctgaaaatatctcatctggccttgttttacatggcactctgctaaaacatttttctctgagctaagactgtggtgtggtagttgaatgaatcaaaaaacaagtccatcagaaaacaaaattacagcgacgtcgtaggcctaagcttatgaataatttggggcctaaatttatggtatgctcattaggagaaaaaaaaatc

SEQ ID NO: 135270 - DNA, 1044 bp, Homo sapiens
gccacaaagcttagttagtgcactgtgttgtttgcacctcattcactcaggtcaagccttcattgtgttacagtgttcttctgttagaaaggctcctactgtacaatctagccaatgcagatttctaatctgcttatttataattcaaaagcttgcctatatattaatgaacccttaatgagctgttgaaaatgcctgaattacagtcagattattaaactcaaacagccccgtaatcataccatttgagtgggctttaggtacttttcacatctgcagcttagaattgtgaagggtatgcgtttattcggagaaagctttgtaataattttgacccgtaatttatttattgccctccaaatgcagtcgtctatgcagatgctctctcccattatctgtggggcaggtgcacagcatgttgaaagacagctaattaggatttgctgaaagatatgcaaaaactgtaggcttataacaaagccaagttcattgttaaacaatgttttactgtgtttgtatgatttgtctaaatcttagggatacggaaatgaatgttgtgattataagtagattgcaaatagggtttattttttaaactttataatgttgtgatgaccaaagaacctagatgtaaacctttataaacctctgtatgtttcattatacatacattttggattaaaaacaagtacaatcaaattttaaatgattgttttaccatgtttcaatttgaagatatcaagatattttgataaccacacagtctgattcattctggcccttgcaaatttagacccattaaaatgtttataggtgcccagaggagtaggtattatgactaaaagccagtgtaactctagaaagttagtaaactaagtaatagtgagtggctaggtaggtaggatgaggaataaaatggtaactaaatgtttttaagtaagaaaataaatagaaatattcaaattgaaagtaattttggaaaccaggtattagtatttaaagatcccataatcattactttgcttaataaagaaaagaaaccga

SEQ ID NO: 135271 - DNA, 1026 bp, Homo sapiens
aacacacaaaactgtgggcaaaaattcagttgaaaatggagaaacttgagaagtcctcaaacaagaataaaaaattaaacaattcaaagtgcagcataagagattgctcagtaagctctcattgcatgccaaatgcacaaaaaacttgctatgtgaactacaagcatgtacaggtcgtgagatttttaacatttaacacagtgaattaaaagagaggaaaattaaagatttaaattaaaaatgcaaacttaaccaatacatggcagttctagaacaatattaggcagtcccttttagttatagaagaaacagcaaatacgtttgcctatttttaattatcagcagtgtgttggtacgcattttatgagttatctttttgctctcctaaatgaatatattgtcttagtatattatagttttcaaaccttatttgcctctgaatagacaacagataaaattttaaattatggtgagttagttttattatccagttgaaattattctgaagtataattttaaatgaaagtgacagctttaaagtgttttggggaagaaattaaagttttgcatttgtgttaaggcaaccaagagctctgtcatgccatggatgtaattcagggcatctaggaatgaaatctgttcttaaaagaattgacggtagctttaggttagcatataaaatcagagttggtgatcagttgagtacttggcagcttatagatgttatgtcatgtaagttacactagacacaaagtgtgtaccactgtggataaacaacaacaggcacagactcaaaagagaatccaaatacaaacaagcaaggtgccaacttccttttcccctcttccccaagaagccttgtaactagtgtagggaacctgctttgaagcagatttacagaggttaattgggctgggatgttttagattatgttacacattaatgaaaatgctgattttgagctgtcatgactccaatgctttttataccatgataattattttaaaactttgtcttctgtgttgt

SEQ ID NO: 135272 - DNA, 1018 bp, Homo sapiens
aggaagagtagaaaaatttgtatagctttaagttaaaaagtagtgtaaattaatattataaggtgttttctatttttggaataggattttctgagatctaaaattgtatgtctagtctcatttgtaagaataacttcttgtggaaaatgtacaaataagaattttggaaaaattatcgtgtgtatgtatgtaaaaatcccactttctgatttgacatatgaataattgagagtaaacaaaataagtcatggttgaaaaggttgcccctgagcataaacagtagaaaatgactcttatttgtagtataatcctaattgtataactttatgctaaaataactataactacttactagataaacactaccagtcaccttgcatggaaagagatataatattagaggccaaatggcctgagttttttggctgaggaattaaggtgattccttactacctcttgccatgtgtctttacacctgcctccttactttctccatacactctggtggaagttgtgtgaagctggtgtcagtcaatgacaaggtcctgagtctcactgttttagaaatatcctacaaaattttccatgagattttatgtaactttagccccagcttataccagcatcaaatcaccagggtttttttttattgttttgttttgtttttggcttttaaaatatacatgtatatgcatgttcttcatacatttatctctttttgtttgtttgtttttttaaattgaagatcaaattgggaagcactgagtttaaaaatatattcatgaattatttgtggatataatcagtagcctaataacgatctaaatatatagttcctttttcattttaatactttcagatggaaaaatatagatatataaaatctgtacagtagggacaaatgaatagatggggtatgaagactagttggcagattcagcagaattttaatttacacattttctcctgtaggtttggaattgttttagaagtgatgtagcagcacttaattctttta

SEQ ID NO: 135273 - DNA, 1030 bp, Homo sapiens
tacattttttctcaccaaaggccaggcctgcatcttgctcatttctgtgttccttatagcactggcaagagtttgaactttgtagttgttcagtaagcatttgttgattaaatgtaaaactccagagaaaataggtggtacttagtattaacaattaacatatatttttacttgtatatgggaattgatagggagcatcctcgaatgggaaaacatcattttggaactggacaggggtgggtgggaagagtagttgaatgctgtctccttgcacgtctgaccatgcacggtttcagaattcttgctgccttaactactattactaccattttacaagtgtcttagttttcattttaccctacacactgtataatgctattggtgaatgcaaatgaggtgtaaattcagatgagtgaatgtcttcgtgtgatagtagatagtttccaaaggagtgatttttttttcccattacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccaggtatgtgaagccataaatctattgcatggctttcccccgtctgtcactccttgtgtattattttctgtaaaactgaccagttggtcttagattcttttggccatatgagtcttttgtacaatggacaggtaattcaactcatggttcctgtgctgtcaagctttcctgtctgggaatggtaatgtgggttagctgccagtttagtgactcaggaaatgaataggattagtgtctctgctaatgactttaggaatatgtagcctttccattctgatgctaaaaggtatttttaaggatagttttctgcatataactgttttaacaaggggtattttgtaagaatttcttaatgttacacgggttgt

SEQ ID NO: 135274 - DNA, 1012 bp, Homo sapiens
cacacctcagcaacccctaccccagtgaagaagccaaagaggagctggccaagaaatgcagcatcacagtgtcacaggtgagaaaggacccatgggtctgtcttgttccctgtggagacaggaacctcattccttcctcagggcattattatcaaatttcatatccaaatgttctatcatcaaaaaagatataaggaaaatgtagatatttccacagttttaggcaagattttaaaccttagataattttgaaaaactgtaagtggcgaagaatcaagaccaccaccacccccattccccagtgtaaatcttctctagagaggacataaacatgccatggggagagacgcagtttacacttaagtgactctccagtaaatggcatgtattcctggtttccctgatttagatgactgacctaagcttctaccagcaagaaaccaatttatttgttgccaaaaggaaatttaatataactctttggtgaaagctttgaggaattcaccaggccctttcttggtaacatactacaatgtttgaatcccaaggatttctttgcttccttattatccattaaacacaagaattaaattcatgctttcagggtttctgattttggggtttttaaaaaaatgtttatttataataatttctgaccctgaagttagttgtcatcttctaacaaaaatacatttagttttagtcagatagactggtatttggactgaggattggaaacaaataaattaacaaacaagtgtacctctttagaacataaatatatcgtattagcattacctctaaaatacaattttgtataaatgttcatattattgttaatagattgacatttgaagagcatttctttatagcatgcaaaagcagtagtttaccaaccagtttttgtagtgaaacttaaggaaaaactgacgcttgtcaaaaatttcagtgttcactaggggtcacatgaaaccacttttaaaagtagtttctaaataaatacttgtactgt

SEQ ID NO: 135275 - DNA, 1042 bp, Homo sapiens
aataaacatttattgaataatgctgattatgtgccaaatactgtgctagggatgaaagagacatcagtgaacttaaccagacagacccatgtcctacctgatagaaatgtgtacacatactcaccaaaagatatgtataggaatatccttagtaacagtatttgtaatagccaaaactagaaacaatgcaaacgtccatcaagaggaaaataggtaaaccagtatggtatatttatgtatatttggaatgttatttaacaatgagaatgaatgaactataactatatgtaactacataatgctaagtaaaagaagtgcttgatttcatttataaaaaatggaaaaacttgatttcatttataaaaaatagaaaaacaagagaaattaaccttgggggttagaaatcagattaatagttatttttgggggaatggtgattggaaggaggaagaactatttcttgatctaagtgttagttccatgggtatgttcactttatgaaaattcattaaactctatacctatgatgtgtggcccttttttgtatatttttattttatttgactaaaaagtttactttcataacaaaaacaagcctgccttcatggaacttacatttttgtgggagtatacatataagtaaacaagacagtcagttacaaagtgatagttgctcttgacaaatgaaggagggaagtggttagaggatgcaatttttaatagggtggtaaagaaagcccctcctgaggaagtatcttttggttagtttgaaggagatgaaggacaagtcatgtggataatcagtgaggaacattctagcagagggaacagcaagtacggaggccctgaggtagaagtgccctgagcaagggagcaagtagtaggagatgaagttaaagatgctggggaccaaataaatggttcatgggccttctaggccatggtgatgacttgggctttcactgtgagatggggaactgaggagtgacatggatctgacttaagttttataggatcaccatggcagctgtactgacattag

SEQ ID NO: 135276 - DNA, 1043 bp, Homo sapiens
ttaaaataataattagagcaggaaaaaagaagatgactatcaaattacagtactttttttcagctatacataaaggccttttcagttgctttggcagtagacagaaggcagaagtagattcctactgcaagtatgcagttggtaaaccagaaacaagttgaaggaaaaggcagctattttgttaaaacggttctttcacatgtcttaaaagaaggctacagaccctctgttctaaaagctctgattgtgtatcccagtggaggtgggacatcattaaacagtgcgcagagaataaaagagcaggttgtaaaaaatgggagctttgaggatgctatagcatgaagtacagatgaggcatatctgcaagatttaaagaaaacagggaagcttctgatttttttgttgctgttgttctctacaaacaatcagtaccatgattggtgtggtgcttaaagcttgctccagtgatgtcaggtattatatttattttagaattgactattttgaggaaatctctaacactcagttgatacgatacccaaacaaggataaagagacaattttcaggctgggcacagtggctcacacctgtaatcccagtgctttgggaggctgaggcgggtggatcgcctgagctcaggagttcaagaccacctgggcaacctcgtctctactaaaatacaaaaaattagccgggcgtggtggcacacgcctgtagtcccagctactcgggaggctgagggatgagaatcacttgagcctagaggtggaggttgcagtgagccaagatcatgccattgcactccagcttgggctgcagagtgagactgtctcaaaaaaaaaaaaaaaaaaaaaaaaaaaaaaaaaaaaaaaaaaaaaaagaaaggagagagaatttgcagcttagatttagggtttttgagtttccctatacctggaagaagtcataatcagaactgtggttcctccatttttgtcccctttgccttcttttacctattccttctcttcttctttccaattgagtattcttatcagttttt

SEQ ID NO: 135277 - DNA, 1417 bp, Homo sapiens
aactgtggcaaagaaaggtcagtaagatagggttcttctccccaagaaatactgaatttgttgggggaaacagacagatgtgttactgacagaatataaaagttacctgaagaagcacacaggcacaaatggatgccatgtgtggaatatagtacaaagaggggtttactttctattgagaggatcaggaaagaccttctagagaagatgatgtgtagaacctggagaaggatgaataagactttgggagaaaggatattctaagcagaggaaactcagaagcaaaaaacagatatgttaggagaacagtttaataagtctggagcctgtgttattatgtggggggtgggggattttattataagacttaaggctacagactgtgaagactcagacaagcctgaactaaaaccccaactcctccccagtttattagctcagtgaccttgggcaagtcattttacctcactgtgcctccttttctcaagtgtgtagttgggataaaaatagcatgtactggctgggcatggtggctcacacctgtaatcccagcactttgggaagctgaggcgggcggattgcttgaggtcaggagttcaataccagtctggccaacatggtgaaaccctctctctactaaaaatacaaaaaattagctgggcatggtggcgcatgccggtggttctagctactcaggaggctgaggcaggagaattgcttgaatccaggaggcggagtttgcagtgagccgagattatgccagtgcactccagcctgggcagaagagtgaggctctgtctcaaaaagaaaaaaaaaaaaatagcatgtacttcctagggttgtgggagtttcagtaagataaagcacgtgtaaagcacctagcagagtgcctatcacagagtaagtgaagatataatagtaattattgttacgcagtttctcctgcttggaattgtttatccctgccccctgccaaacacatagagatgtcttattaatttctactccttcaaagctcacttcaaatgtcagctcttcaagaaggctttccttgatacctctagttcctatcctccattgtatattctcataacttcttttccccatgattgtaactgaacaatgatttgttaaatgctgttcccctgatagatggtaaactcgattttggccagaactgctatcttattcacccttatattctcaaggcctagcacagtgtgtccagcacatagacatttactgaagatgatgatattattaactgatacaggaaacacataaggaaaagctgttttgatggaggggacattaaagcttggcagcagttatgctaggttcacattgccttcagatctgttgggaaatgttcagtttggaaatataactcagaagaaaggtcaaggttaaagataca

SEQ ID NO: 135278 - DNA, 1062 bp, Homo sapiens
aataaataagcgtttcccttaaacaagaggcgtgactataggatttcttttcataggacactgaatgcatgttgatgttcttatttacagggattagatttacgtgaaacttgtcaggacaaaaagtctggcccatcattatttggagtgctctgtgcattcattctgggatgcggctgtgttgcctgggagatggctccacctttcagtgtagctgatgggaggcatttccacagttgtgatgtcagtgtttcaaaatctgtcaaagaggctctccatagagcctaggaaggaaaactattgagttgtatacctaccacatttttttttctaatgagaaaaataattttaaagaaaaaaaaactcttaactgtaaatgttgtctgtggtaatttagaggcacccctcagcacgtgttttagggagctgaacagtgtcatccattttctatgtactgtggccgcaaggctgacgttttatacacttttgcagatgaacctctttgtgaatgtcatgagcagttatcagtctatcatgcagagtagaaagggcaaagctgaactgtaagggcgtcagcacattatggcaataaaatttttcacagcctcagataaaaaaatactgtacttgacaagtgaatctgttttaaattatttcaaatgctatggaaactgaatttctatttgttcggttctcccattaaaagtgggatgttttccaaaagttggttttcaagtcagttgttataaatttgcaacttcttttttttttttttgagactgagtcttgctctgttgcccaggctggaggtgcagtggcctgattttggctcactgcaacctccacctcccaggttctcccacagttctcctgcctcagcctcctgagtagctgggactacaggtatgcaccaccatgcctggctaatttttgtatttttagtagagacggggtttcaccatgttggccaggctggtctcaaactcctgacctcaggtgatccacccacttctgcttcccaaagtgttgggattacaggtgtgagccactgcgcctggccaa

SEQ ID NO: 135279 - DNA, 1114 bp, Homo sapiens
ttgccttgatattaaagattaagaagtattgggactagcagaataaaaacgatctgatgtcaagcaaatccacttgctaaagcttccccaggctgctggtgatattaaaattttactgtgagaattaaataaacctttattagtgatgactgttgtttgattggtccaggggtatgcataaacagaggattcttacatatctagagatgagaccttcgatggtacagagattcctcaattatgaaactgttaataaagctgtaatctgattttccaggctaggtttcattaatgtattatagcttctctgattgtcaaggtaatattaactacaaagtactgaatccaacagagaattgtttggaagaagagaattctaagatgggcctttgttgctaaattcagagttggggaattttcattaattatgcttaagaaataccaaattccctctcaaccaagactatcctcctttgcactatagatatgttcaatatttaactctttctaaggcctgacagtcttagtcagaaacgctagagtgataattatgtattaaaagagctttttgcaagccaactctaggtctgtctcctgagctgagagcatgcattgggaaacatgaggtaaggtcaaagagaacatgctttaagaagcgtaatcagaacccatacctttatagtccttttccaatcttgatttagaacttttctgtttttagaatcacataattctggtatggattctaatggtcactgaggatttgtcctggtgcagaaattcctcccaaatatctgtctccatcctgctcaaggcctgggcaccacacctgcatcgtctctggcttgtccctctccactgaccccagagctagtcagtggccagattctgtctgttcctcctccataatatgtgccctctccactcctactgctctgcctggctcaggccctcatggcttcctcgcttatatactctcctaacttcctcctgttgccacatcctatgcagttataatgcacacctgctgtgagcatatggggctcaaggaagggaaggccaagaaggctaatagtaggatggagaggtcccttggggctgagcctgaaggcct

SEQ ID NO: 135280 - DNA, 1025 bp, Homo sapiens
ataggagcctcagccacagataattggaatacagattttaacagtgtgtgctgctctgcggctcatgcattttcattctggaagatcctatttggagggaaattctggccttcactttccaagggttacagtagctggctgtcaggcgtgtatggaaaaagggtgggcaactgcttctctatggaaatgatgattaagccggggtgaagtttagacttcatggagccctgggtttcgctgaggcattgcattgagcttctccactgctcccttctgaagagatttctttttgagtcactttagttttaccagcagatcaaaggccgagctcgatgccagcatgggcctcgctgaagcccttcttcggcgtgttgatttattgccaagactttacttgatgggatggatttgttttacatgcatttaatcccactttaacacatgctgccaactcctgccacagtgggtttagaaaatacattttgctaatgcatctctgctctcatgttgtcatccgggtgttttaaattggggagtagaattaatatgtagacgtgcacccgttgaactgtgtttctcctttcaggctaatggaggctggcaggacgcaacaactccatcttctgtgacttctcctacagaaggcccaggaagtgtgcactcggatacctctaactaatctctggccacacttttccctgagctacatgccttgataagtgcattcagagcaataggaggaaaaggaaagcgtttttgtagcccaccatctacagctttactgtaaaaccttgtcttattcgagaacttggtaaatctgttttttaaggaatcataatcatttgtatttatacttaaaaacacacaatgttaaaaaaaataaagcactttatccaattaggccaagatttaacattgttgacagtcctgtagctattttatcataatttattatcaatattttacattaatggtttcacagttgccaattacttggccttaagggtaaaaagtacaatatacac

SEQ ID NO: 135281 - DNA, 1085 bp, Homo sapiens
gacacgcttctggcgagatgcagagcttgtccaggcagaaatgtgagagccctgtgggcctggagcccaggggttgcacatagtagctttgtggctcatacttcccttaggactggagggccatcttgttggacctgtggcaggagtcaacatgagtttgttctttctttctttacacacacacacacacacacatacacacacacttaaaaaaaacagattctaatcagcagagcagaatattcaaaagaatatcccctgatcctttagaagagagaaataaatgagtttgtaatgcactaaatatgcctgtggtgttgatgaaaatgcagattctaggacctcatactcagactttattgagtcagaatctctggggaacgggacctggaatctgcagtcttaacagacaccttgggttatacttcttcttactgaaattagagacctacagttcttgatgctttctaaaaaagtgttaaatacacgtaacataaaattgaccatcctactcatctttaagtgcacagatcggtggcattatgcacattcacactgtggtgcaactaagctccagaacttttcatcttgcaaaaccgaaacgctgtgctcataaaacaactttgcatttccccctttcctgacccctggcaaccaccattctgctttgtgtttctgtgagtttgactaccctaggtagtcaaactgtgtgatcctagtggatcatacagtatttgtctttttgtgactggcttgtttagtttagcatactgtcctcaaggttcatcatgttgtagcatatttcagaatttccttcctttttaaggctgaataatactccattgaatatgtggaccatattttgttcattcatccatagatggatgcttgggttgcttctgtcttttggctattgtgaataatgttgctctgaacatgggtctacaattctctttgagaccccgatttaaattcttttgtgtagatacccagaagtggaattgctggatcatatggtaattctatttataattttctgcggaaccaccacactgttttccataacatagtggctgtgccatttt

SEQ ID NO: 135282 - DNA, 1033 bp, Homo sapiens
cagctgggatggcacaagtttccccattttgcttccccctcctcctgattggccctgcaacttccagttggtaatggagcccctctgagctgtcgatcctgctcgcaccgtgccatagatcaacctattccctcctgtgcggtgcttggatctccctcattaggcctaaatttacctccatcctacacaaacatggccttagctcatttttattgttgtaaattatttatgaggggaatgttgaatcttgaaactgaggtgtgaggaaaattaatcccgtgttacttttatccttctgtactttttcccccttgcttgacttattgagctgtggctagagaaagaaaagctttggcattttaaaatataattagtgttgaaactgctttctcaattggatgggatattggtgcctctctgcctagtacaatagaaaacagaccagacctagggaggaagaccagccgtcccattcctggaaggtgacccggccacctcccaggtttgatgtgagcctcaactgggaaggagcctgagaaagcttctggagagctgcaaagcgctgtccaaatgcaacagacctgttagtgtgttttgcgggcagtttgggctttgagatacagatggatgctggatgaggagctgttgatacaacctggggttgttgccagtaggcctccggatttgatgtgagagggcccgcatgaatggcctcctcgagtccttagccgcggggccatccttcctggcttgaggctccgcgcggcctgggaaatgtggagcgctagttaataaatggccttttgttaggaaggtcaattgaagtgccggtagagacgcagttaaaagtaatttgcagtcagaaaatatgtaattcagggcaagcggctttgagtgatggcccctgccatggatatcttgggcgtttctcattaaaagctgccttggctggtgatggcgcttcctggatgggtcgactgcagcccgcgcggcccggagccatttgtccatatttcacaaaggccgcctccgt

SEQ ID NO: 135283 - DNA, 1087 bp, Homo sapiens
ctttcatttacatccactgtctttgactctcttggtcctcacagcagctctgcaagggtcagtatcatgacctccttttatagctgagaaaatgaagggtccaggaggttaaattgcttactcaaagtcaccagctagtcagtcatggagcctggactccaacaccattccttcacctgagcccagaacacttatttctgtgtttgcaacattccttgcttctttgcaaagctctgcgtgctgaaggcctaaccttggctgtgggtttggaagtctaggcctccgtaggagagattgcaagggagagagaggaaaggtgttgttaagcttagccgtgtctgacatgtcttcagagcagctactggtatctgttcagaaatcaagcagctggatggcggagttaagaatgacgtgctcttgggtttgagtcaagctcacctcctgagagtagagacaagctctcatcttagctcagtgttcaaagctaacctgagaagagtgggaaacagaggtgatttgaattcttgacctggggaaagggtcacatagggtcaggactcattcaaccagtacaggtatgtgaaactcagggtatttgccccaagattctggttctgtttgagactttatattattcacataaatgctatgtttgaattttgtgttttctttttcctttgctgaaccaggaccagtccaccatgcctgaagtcaaagacctctcagaagccttgccagaaacgtcaatggatcccatcacgggagtcggggtggtggcttctcggaaccgagccccgacaggctatgacgtagtaagtcaagatactagtttgtacattttgctcactgattctacaagtatttatctcctgtgtccaagaccttctggcccttgcgtgtaagatgtgcttcttccctctaggaacttaatccagggagggcgtggagagcatcctggtttgggagtcagaagacctgagcccatctgggccgtttcctggccttgaccacctctgtgatggtcattttcaccttctgtaaaattaaggagttagattcattgattttcaacttctggttgtgacat

SEQ ID NO: 135284 - DNA, 1051 bp, Homo sapiens
tcaggtgaaggctttcatgtggctgtgtttttattcctctgggataaatatccaggaatgcatttgctgggtcacatggtagttgcatgtttagtttttaaataaaatgttaaactactttttggtgtagctgtaatgaatatatgaggatccagtttctcgacatcttttccagcatttgttatcgtcagtatttttttgttttagccattctgacacgtgcatagtgataattcatttggtttcacactgtatttccctagtggttaatgaatgatgttgaacatcttttcatgtgcttatttgccatctgtatgtcttccatgaaaatttcttcatgccctttactcattttctcattggattgtttgttttttttactgttgagttttaagagctctttgtgtattctagctatgagtcctttgttggatatgtggtttccaaatatttctcctagtctttacctgccttttcatcttaacagggcctttcacagagcaaatgtttttaattttgatgaagtccaatttattactttttctatctgtgaatcatgttttggtgtcaagtctgagaactctctgcctagctctagatcctgaagattatctcctgttttctcctacaacttttatagttttacattaacacttacgtctgtgatccattttttccttaatttctggaggctgggaagtccaagttcaagaggcacatctggtgagggccttcttgcttggtgaagattcagcagagtcccaaaacagtgcaggtcatctcatggcgaggagactcagagtgctaacatgctagctcagatctcttcctctttttataaagccaccagttctgctcccatgataaccaatcaatccattaatccaatgaatgagccctcatgatccaatcacctcttaaaggccccacctctcaatactgctacaatggggattaagtatccacaggattttttgaggggacgttcaaactatagcaggtagaatgattccttctactttattctcctttccaaaatgattttagctat

SEQ ID NO: 135285 - DNA, 1103 bp, Homo sapiens
tggcattttctttcagtactttaaagatgttgctacaaatacaaaaaattagctgggtgtgatggtgcacacctgtaatcccagcagctcaggaggttcaggtgggagaatcacccgagcccgggaagtcaaggctgcagtgagctgtgattgcgttactgcactccagcctgagcaacagagtgaaactctggaaaaaaaaaaaaaaaaaaaaagatgttgctccattatcttatggcttgcattgtttcttataagaagtctgctgtcattcttacatttgtttctctgtacatagagggtttcaggctgtctttaagattttctctttatcactggttttaagcattttgattatgatataccttggtgtagttttcttaatgtttattctgctcaaggctcattgatcttcttgaatttgtgggtttacagttttcatcaaatttgtaatatttctgtttattattaaagtatttcttgttcagttctccctttctgggactccagtgacatgtatattgaaccactagatattgtcccacagcttaaatagctagaaaaacacatggaaggaaataacaaagatataatcagaaattaaaagtaagagaaaaggagggagagatgttaattaagaattgagtctttgtaaaaagcataatagataaacttctggcaaatctaatagtaaaataaaataatataaagataaggaaaatttatttgggaaaaggaaagtaagaatataggaaatttcaaaattataaaagaagatgatgtgtagctcttatgtactgccatgtgtgactgaaattgaaaatcctgatgagttagataatttctactgctatctaagaacaaatcctaaaaagcctgtatccaaggaagaaattggaaatgttgttagagaattatttacaacaaaagcactaggcccaaattgctttaaagtaacattctctcaaattaccaaggaacagttaatttttacatcgtacaaactatcctaaagctttgaaaaaagattggacgcttcttcatttgttttacagagctaatttaccaaggtcagttttacaattgaccttgctaatgtaaat

SEQ ID NO: 135286 - DNA, 1031 bp, Homo sapiens
ggccctgtagtccaaaccaagactttgcagaccatcattttttacaactgtaaaggagggatgtggggtctcaagactggacagattcttaattagctgacttgagactcccaatgtaggagttttgggagactcctttggaacccaaattcctttcccccaataatgctattaatacagaaatctggctttggagtgacattgcttcctggggaaggatcgagattaattgcacttttcatgccctgtactttctgcattacctgtaataataatgtacatagattaggtagggaggatattaaacagaaggatttatgaacatttgaatattaagttggttatctgtggctaccttaaatgcaaggttgtcaaaaataattacagtatactagcaaatactggctaccagagacaatataaataccctgagtcagtgcatattgggcttttggcatgaatcatttgctcaacaaggattgggaatacgttcttcatatttatgaggaggaaatgaaagagagaacagatgggggaggggagaggaacaggcaaaattaatggtgtcgcagacccactgtattaaacccagtacagtggcagccctgtgtgaggagggaccacagttgggctgtggggagctctgacagtgcagcctcccattttgtatgcatgcaagggttttttgatgctttgtttttaatggccacaccactgatgttcaggttttatgatcagggacattggtagagtgtgtggagggtgaggtcactaagtggtttgcagttgacttctgtaaaacccaacttgtcaagcagaagacatttgagaaggatattgatgaatgcccatccatctgcggggcaggaaaacatgcctagttgttaatttctcaatgcagaaagcagtgatgacatggaaaagcaactgccatgaaaaaaaattatgatagattagaccaggcgactctgaaagcagctgatgtttgcaagttaggttaacagttcaaacccttcctacacggtcagaga

SEQ ID NO: 135287 - DNA, 1085 bp, Homo sapiens
tcccctcattctgttcctcaatttgaatgtgctgttgaatgtcttacttcctgccacagaattgcaaggtcttgaaacccaataccaagcacaggcataaattacatgctagaggcttacttgtcaataatgacggtaagatcccacacagctgttctttactgagcacttactgtgtgccaggcactgggctaagtggatcatatgtgttggcacagtgcatccaacccacatccctgtggggtgggtttcattaactcccttttacagtttaccaagactcagagaaattaagtaacttgcctgaggtcacagtgccaggaaatgttggtgttgggatttcaacccagatctgtctgactcgtgtattaaatggccgcagttggttgaaactcaggtttaaaagcacaaacaaacacacacctcccgttggtcagcactggaggttgctagagcaccaactccttactctaaggcttgataagtaagagaaaagaatcacgtgcttatcctttttttcctatacaaaacttatttcagggagaccaaatagttgatgaaggaaagttattttttacatatagaaggattctagctaaaaaatgcagaaggaggccaggcgcggtggctcacgcctgtaaccccagcactttgggaggccaaggagggtggatcacgaggtcaggagttcaagaccagcctgaccaacatggtgaaacaccatctctactaaaaatacaaaaatgagccaggcatggtaacacgcatctcagctactcaggaggctggggcaggagaatcacttgaaccccggaggtggaggttgcagtgagccaagatcatgccactgcactccagcctgggtgacagagtgagactccatctcaaaaaaaaaaaaaaaaaagagcagaaggaatgacagagttcaaaaatcaccattgtgaacctttaataaaacatggatcttagcaacagtcatcagagggtgagaaagtgctcagaggatggcagttggggaactgtgtgaccgaggtcctgggccgacgccagcagagctcagcaagaatggcccagccagactctgg

SEQ ID NO: 135288 - DNA, 1024 bp, Homo sapiens
ttggtataaggattgtaacttaagaaactgaaaactcccatgctttaaaggagtataggctttgatatttttctgcggaagcattttcttcactcatttaaatcttcctaggctgagattaagcattcatcctgaaatgtacacttgaatagtttgaaattcaacacaagtgtatatttttagtgaagacattttctcttgggttatcagtggtcagtgatgtagtggtggttttgcttgaccccagggtatttacagaagcctaggatctgagcaaatatctagcccaaccccaagttgggactaggtctcacttattggtacagcacacctaatgttttatgcctttcacccaaaaagcgtttttacggccaggatgtgcccgtagtcaccaacagtaactgctgggagacacgtcagggagaggtagctgtggtcactgccttgtacaacagccaaaagcccaaagcaggagggaccctggccttctcccagcacacaacgagtgggagctctgtgtgctggccggcatttcctgtcacgttcaataggacacgttcactcttcatacttcttcaattctaaatttcagaagtaatttgtcactttagaggagggcgtcattaataaccattatttagaactgtcgagtcttcctctctgtgagtgtctgagttaagcatccccaaaattggccttgttggtggcaagcagtgcccccacactgacagattgagactaccccacccccaccgacgccctcacaacccagttcttccccgtctgcctttaatcaccgcgaggggggcgacagggaatggctacggcatgtcctcctggaattcattagcgttattaccaaagaccgtgttgtaaattgagattttttttaactgctaggaaaaaatttctccttaactatttcattttattgtacttaaaaaaaagaaagaaagatttttctcatcaaacttttggagcagaatggttcagaaacctgacttcagatcccactgggtgtgga

SEQ ID NO: 135289 - DNA, 1011 bp, Homo sapiens
acctccttccacacgttctctgtcttctcgtgggatctgtctgccttacctctcttttcttccctgcaggggacctgttccctgcagggaccaggccttccctttcctttgtgtcgccacagcacttagagaagggccaaatactcagcatgttttgaaactaatgatgaaaaacaatgtgtggatttcacagggttgaagggaggtttccagagaatactcgccacattgttcacctgccagacccgggcaggcttcccacggggcctcgggagcagcgccgagctgagccctggtcggctcaccctcccatatccaagtctgtcctcacctctcatttctcacagccaggtttgtggccagcgggtacactggcggtctcccctcacacccctggagcatgagtctgtggtttctgaactcggccttgaaattgatagtgttaccttggcaggaacttcatcagtcctagttttccttttcaccttcacccagggaggggaaaacttacaagccttattacagaattgagattcattaggtgcttggcagcacaggtgacttgctaagagccgaggaaacccacaaactcgcctccgattatcctgggccgccagtgaggggtgtttgtgtataaggggaaagtggcaaatcagtgccacttaccagcacacacccttaatggtgagtgacattttgaacacaggaacatggcattcattcatgttccataatgaatcggttatttaaaaggtaatcttttttctaaaaattgcaactacaggttactaaatagatgaaatagaacaatggcataattcttgtcagtattagtttttctcgttatgatcactccctaataggtttggaagtataagcaaaagccagttgttccatttctgggtgacattcctgctgagaaggggaggaacagggatgttcttaagcccccatccctggctccactgcaggagccaggctctccaaggggagagggaacgtgtttgtcta

SEQ ID NO: 135290 - DNA, 1027 bp, Homo sapiens
tcagtggctgcaagcaccaaattgctctgccagggtccaggactgctttgttgtgttgctgccagaaataccctgcaggacctgctggctccataaggcctgcaagctcagcactgggcaactatggtacaactgggaaggctgcccgcccacccactggcagcctgcctgcgagtcattctggctagaagggagcagagaccacctcccttacccccatatgaacagtatttggcactgagtggcctatctcagtttggtattgtgaagttagggtttccaatggtttcttccaaaaacagttaaggcaaagtgtgccccaggccctagcccttgcccagtacccatgccttgatagctggagttctgctgataatgaaatgaatcatcaaaccgttctgcctctgaactggccctggcacaggttcactgcagacttcaggagctgagcctttggtgcagactcctggcgggctctgtgtccctcctgaagacattcgattactgctcccttagtgttccatcccttcctaagataagtaggtttcaaaacagtgtaattagaaatttgaaaaacagcccacacttaatgtgtatgtatggttgttaaagtatattaacttttaaatgttttctcagtggcatacctgctagtagattccttttcctgtatctttcactaagacagttggctcccatcatgcctgctaagggtgagacgtggcacagagttgcaagagacaccagtggagacgatatgtagtcccatccctggcacaaagcagtgctcatgatgtggtcatggaaggaaggaagagacgaagggaatcatttagcctcctgtctgccttgcacaggagtaccctcccaaaaccctgggccaggtagtcatcctgattttgctgcttgaatgcctgtggtgtctgggaccaccacctcctaccagcccacccatccctgtgagatccttcctcgttaagcagggctctatcttcctgttctttcacatccactcagcaatttgaga

SEQ ID NO: 135291 - DNA, 1634 bp, Homo sapiens
ttgcagaagtacaaaattgctgttctttgtcctccagctctggagctgagctgccgtgtgggtgggtttctcgagccttcccattgttttagggtgaacaggcaagtctgaaaagtccagcccagcccaggagtggcatgctgtatttgtttgcttgcgtaaactccatagtttaattttttttaataggaagctgctatgtagttcggatatttaaacagttattaaccgaatgacaattaacagattgcatagacagattttcttttgaaaacctctgaaattgagtacagtttgcaaaactatcacggcatagtaatgacaatgaattttgatttcccggaactgatattagactccttattaaactatgtgcatctgcttttaatttactccaaataattggaaaatgcaatgaagctttccaattaaagcacggctttatgctgtttaataatacccccataatattatagcttatgaagtgacaggtgagttggtgtatgaataaaacataaaggcagcaataagggacagaaaaccggagacagttgtggggattttaaatgctggatgtaatttgcatatattaatctcttcttttcagccttatcaggcgttcttcagtatttgaagttaaaatagcgttgacaggcgggagtacgcttagttttttcaaggatttattacttgtataatttctgatctttaataagcagatatgactgatcctcatagttctatagaaatcagttaattgttccagatggcgtgtactgattatgcaaaattacttttcacaccattttttttgtgatggagtttggagtaaaattaaattttttatagccttcttatcatgctgttttacagtggtttttccacagaagttgaatttaatctactatattacattgaccaacacagttattctaatgtagcattttgtgatttgacagagaataatagaacacattgctcattgttcattactgtgtccctaataaaaaggaactcctgtgtatagaacatagctgttatttatgaagaatgcctaattcatacagttaaaaatgcaaaattgtattatgaagtagttccttttggggagagaatatctggaaaaagcaaatggaaataggcttgttgctgcagattctacatgctaagggaggagccttcttttaatgaccagcgtgtttaaattgtgctactttctcctttgaagaaggaaaaacccagataatcttattctattaacagaggtgtcactggttgacttgtcttgatttacataatcccaaaagtctttcataattgaatagcatttataaaaggtggttacactttagtgtaaagtatccaaaaaaaaaaagtctaaaggtgtcaatgataattcgtctctaacattttccaaagtgtctgtttatcaccaaggcccttgtgttggtgtcggatccaagtccaggtggtgtgtacccctaggtaacattcatgtaggctgatcctcgtccaggttctcagataacactctctctatggctcagctgctagtgggatatgaagtactcagccgactcactccaaaatgggactgagggactgtcaccttgatgcaggagtggatgcagttt

SEQ ID NO: 135292 - DNA, 2675 bp, Homo sapiens
atgggtgtgctttcatctttcaggcattcatcctagctgaaatacatgtaataaagtagtcctgctaattcaacatcagaaagaaaaaaaaagcccaacaggaatctccgtgagcccctcacacgcgtgaaacagttgttctccaggccccacttctaaacgtgtagcaaaaaaaatctgttttggtatttccctctttcagagaaatattgaaaagtacattttttttttgtttcaattattttaagggaggaaaaaaaagaaccagtgagttcagagacttttctaattactaaattggtttgttataaaaagataatagcaaatttcttcttttcataattggacatttcttccctgtaggctaatgcaggcacagcccgtgcatgcacaataagttatgcttttgaaagccataactagctaataacagctacagtgtcatcagagagtaatggtgtgctgattagcataattaatgacaaatggtggtgcggaattggtggattggtttagcggatgatgaatgcggcgaggcctgggctgaggcctgccaactaggcctcgctggctgtcagcccttctgttctcccgatgcagccctcattagtcacgatgggaggtgccagtttgtattccgtttggagcacagaaaacttaataatccaagcaaatgtggctatccctttttcctctgtatttactcacaaaaccctctcactcattcccattgtggctgaaccattaagacacagctatttccagattcctctgcgaggcttgaaggcgaaacaaaagggagcataatagagagaggcacggatcccagagctttcatctgaccatcaatgaattactctcactaggaagacttctgtttggtgaaccctgtttatctgtgtactttataaggggaaaagagatgaactcagtaagcgatacattctgtcctaaaataagactagcatatttatctttgacttgattaatcagacctaatttgcattcgcaaatgagactgataaaaatggatttaccttttaacctttagaggaggaaaggtatttctctgcaagatttctggggctatcgtttcttaaccgataagaagccactcctttatcaataaagatgaaaatccgcaatttgcattagtgaatgggactgattattatatagttaattagcatctggaaatgaggattatcttaattacaaagcacaatttccctaatagctacaaaactgtaagtttgatccatgtggaaattggtaacattattatgtaattagtgataacattaatagtgtagaatatttagatgtaatttgcatatgcaaatgtgatttacctgagccaaacaagtggaccattaatgattagagcatgatgtagctgactgaaagttctagatagctgaatggtacctattatgcagaataactaaattatatagtggtagagtcagcaaggaccttttatatttaggtggtcagggtggattttgctttaagaattagtagctgctgggtttcataatggagctaactgcttggagaaatagctagcccataatcatctccttgactttgattttttcatgcttccctatatcccttgaatctgagatgtactttccctatgtattttaacaattctgaattttggatctgtcttacaattgatgtgtacttttaaagcagtaacacacataaagaataatggtgcagtttacagttcttcaggggagaatcagacctttctgaattttatccgcagggccctagaggctcctcccatcagaaatggttctttgtatcttctggggttctatctaacttcctccctcaggctgacatatgcttcccaaagccatgtactcatggtggggtggattttagagtagacatggatgaccttttgaaaactgtcattcataatagcttatcagtggatatcattgttcagaatgggactaaagtcagtgtattgatcagtctttgcttggttatcatgccagtaacaaacacccctccagatcacaatggcttacagtttcactgttttgtaaaatggaacttggaaatgtaaattggaacttgagtgacatatatcaccatgtcactcaagttccaatttggtgaccgtggattggctggaaccctgctccttgtgtctttgcactctgggacccaggctgaaagagcaggtcccaactgtaacttgctatttttatagtagagggaagagtgagacctggaagaaacaaccagtggctcttaaagcttctggccatggtggcaaggcctacagccggccaacatgagttgggcagaagtgtatcctcttcccccaatgtgcctttcacacggcagtgggcagatggtcatactgttacagggaagtgggaacacatactcgggaatggtgacactacccactggaggaagctattttgagtttaaaatgtgagtgtgtgctgtaaaaatataaagtcagtaattatactggaaaaaaataagtgaatctgagacatcaggcaccttcctagagtctagaaaacactggtggccgataatgtctgtagcttttccctgtgcagaattttatcttcaacccatcaagagtttgtgtcctcctggggtgtttgggagagctcagggattttgatggg

SEQ ID NO: 135293 - DNA, 1046 bp, Homo sapiens
tcaccagtgagaggcagttcttcactcccaaatactaataaggtctttaaaacatcagaggcagaaagtctggggaatgaatggtgagtgggttctgcaggggagcaattgccagggcctgtgcacagtacctgggcgtgcagagaggactctgctgtggaccctgctgtctgtctagcaggcaagagaagctgtggaagagatggatgtgggcagagagtgggaagtgaggaccatgacaggtgaagagtgggcttcgggactttactggggaggtcaagtagcctgtactatccagagctttggggccactgctgcctacctttgtgaccccagcaagcaccgacttctcagagcctctgcttcccaatctctaaaatgatcggaagtgttacgagtgcccggcccatctcagcagcactaggaagggcatggaagtcaggtcaggcagatggtggtgggagctggcacacctcttcctggatatccggtgggacttgactctgcccttctctagaaggctttgtggctcttccagactcctttattcattgctgaactttttcatctgtgaagcagcatacacgcataggtacttagagttcacacacaggtctgcacgcgggatgtactgaacgagattgaggcccaaatgcgggacgtactgagtgagattgtttggggccttcccctcaccccactttctggggaagtgttgcctgttcgggacttttgtcccatctcttccgtcagctcacagcaggttgccagcaccacctgaaatgggagaaggcctctgaccaggagtctctgtctaagtccagcagccacactgggcagcggcccttccaagagaggagggcgcggggaatgcagcgactgccgccacctgtgctgtgtctttttcttcatgctgatccaagaaggtttcgtttctttccttccctaaaataaagtgtgagcagagttctatgatgttttatccctgtatgaacgtagcatgagccattcggcttttcttgctgattgggaggatccgttccagg

SEQ ID NO: 135294 - DNA, 1076 bp, Homo sapiens
gatgcgagtcaacgagtcgtcctggcacgaggagtgtttgcagtgcgcggcgtgtcagcaagccctcaccaccagctgctacttccgggatcggaaactgtactgcaaacaagactaccaacagtaagcgcttctcgtcctccttccccgccaccgcccggcactcgagcccggtcagccccctgccgggcccggcccgcgcccgctctgccgccggctctgtgcgcggctgggccgggcagctccaagggttccgagagctgcgcgtcttggggctggggcggaccagcccagcccagcgggcactgatggggtcctgggagcctccggacggcccccagttgccatccgttgtcccggaatcctgcgctgggccggccgagggatttggtgcctgggtcctgggatatagggtctggcgctacggaggcctgaattgggaacccaaaattgatttccaaaggaaaataatgttttagggagccaggcctggcggactgcttcaagggcctggtgtgtgggggtttgggattcctggagcctggagccaggagccaggaggtggagtgctgggacactgaacggcctgagcggcaagggaggccccctttctgccaggctcactgctgcacttttagtccctgatggagagaaaagaatgtccatattccccaaaccgttccatgcgggaattttgcacttgcagttttctttggttggagaagcactctaggaagaggatctcaaaaggtggcaagttacaatttggggctcccaatgggagtgaggagctgactgagtcagcccttcccacaaggcctcctttctggtagtgtgtattgaggagggagatggcccgctctgccctggtataacccaaacctcagggctgaggccagagatgtgggttgagcccttcttgctaactagtttttagctgagactggatttgtatggccggggttggggacagacaacaggacatgcaggctttttcttttgacctcctgggttttctgcctggcactgcaattgggagggaggcagtgaggagccacaactgaaagaggggtgtg

SEQ ID NO: 135295 - DNA, 1063 bp, Homo sapiens
cagagagggctgtgtatgcccaagcctccagggaaggaaaagctgggctgccggcgcctcgtggtgagtgcaacctacctgttctgcccagggattgtccccagtccagggcctagtggaaagcagcgcagcccaactgtttaactgaggcctggaaacagtgcaggccagagccctagagagggcatcggattctaccccaaaaggctctggctgtgcctggtggtctgggggctgagcctgagctgctttttgcacctagctctttcttccggctgagggatctttgggtagggattggagtccattcagaggttcagctgttttgctggtcccagagtgcagctgaggccttcctctcagtaggaagcaccccagatttaggcacactgccgtaggtcggctttgtgctgtgctctgaactaatatgattctagttccgggagagggagacgccagtccgttcagtcacagcccaagcatagagcagcacaaattgaatggggaaaatagtttggggtagatgtggctgtgggctctgggctggctagaggagcccctctgtagggtgcaccagcctctagccccctccccaccacgccctgcacccctggcctcactctgcttgcctgatcccgagctctggcagtgccacttacacccagctcagccaccagcctttacgacaacacatgggggaagggggcccaggaaactaaaaccggcctccaaatcatttgcacagcttaaaaaaaagaaaaaaacttgttaatatattgaaaagacttatgaatcgcgtgtacatattctgccctccccccactccccataattatttacggagcttctctttaaaaaaaaaaaggaaaggataacccctggttcttcaggcacagaatggtaaagtcacgaaatttcagctggatgttgccttagagatgagcggctcaccccctcatcttacaaaacaattaaacgttaagcatttgctactgctttgtccaaagtatatttgttttaaaaagaaaaggaaagagtcacctaacagccagcttcttcagtg

SEQ ID NO: 135296 - DNA, 1186 bp, Homo sapiens
ctcaccatgagcatggcagggaataccttgtctccaaggacacacaccacactgccaacaggttctctacccaggttccatggtacacagggtttaccatgagcctctccatgcagggaggatgaggagcaccctggggaagccattgcctttcccttcgtaggacactgtaaaagtcttgccttcctcagccatgaaaagagctttagactcggagtcagacctgagttcacctcccagccccaagtcttagcagctgtgtgatcttcgctaagtggttgcccatctctgagctggggcctcatcaacaaactgggggtgatgatgtgactttgcagggtggttgtgaggattacacaggcacctggtggaactttaataaatattccattctccgggggatccattatcctctcctgcacctcaagagaggtggaaaacctgattgtgtgggtgcgcacaggtgccaactgcattatcagaaagggccacaacagggtggccagctgtgctgggctctttctcctttgggggcagacgggtgtgctgtgctctttctccctgggggcagacggagggtggccgggtgtcctgtgctctttctccttgggggcagacggagggtggccgggtgtgctggctctttttcctttggtggcaaacagagggtggtccagagcaacagtatttccaccgggaaacaattggcatctccagggcctccatatagcttggaaaagcttaataattcatatttgaagaactgtttgtacttactgttttgtgattgaagccacagaaaataaagctcagccaatggagaagggggtaggtggaggagaggtctgggggatttgtctatttctcagaaggaagatgaggtttaaaaggtggagaaacaccattccaggaactcagaaggcccctccagctcgggctctgtggccttgtgaggtttccacccatgggtggctggcgatgcttctccaaggagccgcctttgtcctgaggctctggagtttctaaaaaataaagaaaaggaagaggaaaaaaaccagtcctactttggcatcagttaggctgaaggatggaggatactctcaccgacatgagttataacttccaatttgttggacaccacagtcaagcctcagccaggggagggaggaagggagggatagtctac

SEQ ID NO: 135297 - DNA, 1061 bp, Homo sapiens
ctctcttgggctggggtcggggtgccccgccaggtggggccttacgcggtccagaaagagccagtgattctccttggagccactgcaggctcccgctggagggagtaagactggcggggagagctggcattttcattccttgttgagcacagccctcgcccctccccaagccctcctgccgaccccctcgggctggccaaaagcagcaagttcgggaggtttgtttattgagagaacagaaaattaggggttgcgggggagaatctaagacccttttcccgcctgagaaacgtgcgaagtccctcagctcctggaggcaaccaggcggcccgaaagccgagttcccggcgcggatgctagggccgaccccagccccctccctcctgcgccccagcccgagggcggcgagtggcaggtttttttttatcttgtttttttttttttggatttggtttgcaggggggaaatgtggttgtatcaatccacaaatatttactcttaacagacttgtatctgtggagatttcgaacaaagacagtttagggggattacaaaaaccctaaaccccgtttttctcccggacttggtgctttaaatgccaattataggcgagccatatccaacagcaacggggaaaggcgagcaggctccggggagggaggtggggggagagtccggccattaaatgtaacttttcattatgaaaaggatttcgccggttttatcttctaataagattatgtcacgaacacaagtacctaggatggtgctgagtgacagggctctgtcgtttaatcagaggctgtgccgctcaaaccgcggggccctttgtcccacggagtgaacgacggaaacttgccatcctaatccccttattcatgtcaagcacagaaaagaagccgagcaccttacaaccgtgtcccctccaccccttccgaggacggcgggaagagggggctccggccctgtagccccctgacgcttttcgtttccgagcgcgcttgggcctcaggagccggagcgttgccgtgggggcgggggaaggggtggttttgcgggtg

SEQ ID NO: 135298 - DNA, 1714 bp, Homo sapiens
gtggctcttgagattaagacaaaaatcctttaaatggcccacaagaccgtcaacagggcatgggttaaataagttagggtttgccctgtaatagaggatcaggcagctgtaaaatcaggtgctgttgttccaacgtagagtcatctccagtcatggggtgggggtggcggttgtagagcatattagcgtttgtataaaaaagaaagtggaaaaaaatcccaatcagtcctcattaccaaaacaaaacaaaacccccccaaaatacacccaaaaccaggccgggaggggaatgacagatgcactcggcttggtgtatgtgggcttgtgtatgtgtgatacgtctctggaggagggtcaaatgaaagacctggattgcctctggggaggggaccgatggctaggcatggggtagaggaggatgcagagaacgcccttttgtatttgaacatttcagtattaaattatggaatgcattacctcttcaaaaacaaattcaataatttttaagataaaaaatgttggccgggtgcggtggctcacgcctgtaatcccagcactttgggaggccgaggcgggcggatcacaaggtcaagagatcaagaccatcctggccaacatggtgaaaccccgtctctattaaaagtacaaaaattagctgggcgtagtggcacacgcctgtaatcccagctactcaggaggctgaggcaggagaattgcttgaacccgggaggcagaggttgcggtgagccgggattgtgccactgcactccagcctggcgacagagcaagactccatctcaaaaaaaaaattaaaaaaaaaaaaaagataaaaaatgttcagtaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcacctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaatgttcagtagacagtgtgtaagaccctgcacactcaggcaggctcctgtactccccagcttcctcttgctccaggcacccgcccttccctcgcaaccctctgcaccttttatttctcattgattctccttgtttctcaggacctttgcacacagtgtttctctcctgcctggcctctccgtcacctcccatccttgcctggctgatcgccctcctctccccgtctcagcccaaatctctgtcttccgaaaagtggccttctctgacttgctccccaccacagtccccaggatgggctgtctcccagtggcttgttcgctgctgtccccagcacccagcaccgcacctggcacacaataagcaccgcatcagtatttgggggaatggatgaagtggcaggaagaggaggataccctgggaactccatgccatggggcttgggacgtgcccacctggcctttgaaggatgagaagcattttgccagactcacagcgggacagtattccaagtagagcatggacaaggtacagagaccaggtggctggctttctctagcaacctgtctgctaccc

SEQ ID NO: 135299 - DNA, 1117 bp, Homo sapiens
ttactgggcacctggctctgggcctggcctattctggccatgcagggccccggagagaaatccaaaggcctctgcctcccgtggcccggggtttctcaccttccacgtgcgttgtcagccctctggactgtgggcgccatcatccccccataaccctggtgcccccagcccaggccagaggcccagcagctccgtgctgatgaagcaagtgcagagttgttttgggaggtggccagggcagatgaggttaaagcaggaaagggcttcaagaacagggaggtccaggaaaccaagcacagagactgggaggatgagcaggagctgggaggcccagtgtgccaggctcaaaccccagctcagacactaagcagctgtgtaccctctgcaagcagcactttcctctctagcaaagagagtgatgttgcctacctcgcaggggtcttacagaggaggagtccatgggcaaataaagcccagagcttgctatgtgggcaacagtcaatacatcttagtaagcaataataatgataataatgaatgttggatttggcaaccaggagctgctgacctcagtgagaatgggggaaggtacctgggactagctcaaaaaggtacctgggactagctcagtttgatgagcaggtgggaggaggaggttcctactgcagaccaggagagggcctggctcatggtaggtgccgggtaaacgttagatgaatgggtgaatcaccaaatcatcaaatgtattgaattcactagtgaaggggcagaaagaagggggaagagggtgaactcaaaggtcatgaaatagtacaggtaaagcccttcgcacagtgcctggcacatcatagctcgcagcctccctgatgcccggttggtccaggatttcctgtggctcttctagcctggactagagtcccaagttcagccagaaacgatgcagggaaggatggtcagagggatgtgatgctccacctcctacctgcacctgacctgtctcgacaatggcaggagggctcctgcctgtcaccagggaaggtctggtccccacagaagcctcaatatccccaccacccatcggaagtcagagccccaaaggtgggaaaccagttgtcag

SEQ ID NO: 135300 - DNA, 1041 bp, Homo sapiens
atgtcaccgttaactaaggaaggactgcggtaacttaccctgcagggctgtaggttgcctgcaggcgctccaggcccccagcctgttgattccgatttctaggtctcatcttcctctggtcccttttggccactactttaaaagcttgcccaaagggatcccctccattctagtgggcatttgctgaactaacctgcccctaaggctggcttctaaccaccggggaaagctgcttagcctccagggctccctccttgagaggctcacacacccccaagctgctgtggagtgaatttgagacggagcagaagctgcaaagctgtgctttccctggggaaggggatgtgctgcggcctcctgggtgggcgtggagagggcgccatcacaacgagtccaggtttttgcttttggaaggtctctgataatttaggggtgctggaaaccagcactgtgttatccccaatccctcctgtgccaccagttttgtgatttaggttgctttagtgggtgactaacttttgttcagtgaaaccagggtttgtttggggtttttttctttgctacttacatatttaaaggtacaagtttcttatttcaaatctctactgatagtgccctatggggagatgctggaacacattttgcaaatgtgacttttttttttttttttaatttttgcttgaagcctgtgtcatgttagttgctgctgccttctttccttttgtgaggttcccaatgtttcgtccagaaaagtactttatttatgcaagtcaggtgactcttaggccacaaaaccatttgatgataaacagattatcattaggtgcatatcttattgatattttgtgaaatgttatgcctatgttgcaaaagttgaatagttttgtctttatatattgctgtcttcagtgtacagcatggttttacttaattgaatgttaatgtttaatattttcttcttatagaagagatcatgcccttttgtatgacatgttttaataaatgttatctgtcaactttgtaaaagttttgtttttcact

SEQ ID NO: 135301 - DNA, 1023 bp, Homo sapiens
tatttgcagtgtggaggataataaaatccaatgaactgtaaacgaaaatggaacgaagtagaaaaatgtgcagcacctagtaactgcttagtacattttcattattgttattgtcattattgggtgtacatttatcaaggtggagaaatgataagctgctgaactgtgtacctactgagttttggatttctgcaccgctgtgtccccccacttttgccttccatttgaagcacttgtctaaaatgtcagtaccatgaatctagttacgttttattcccgttaatgttcatgttactttagtttaaattctgcttaatgtttttcaaacttcttaattgtgtctatttaatgttttgtagctgacaaactgctgaatttagcttagtgaaggtcatcaactgaacgcagttaaatttctaatggttattttctggttgatgttgatggcaaggaaaacctcatggaagaatgcaagtcaaggtgagcttttctaatccttttgtcataagaggcaggacttaatgtattttccagggccagtgcccctgaaatgctagccagcagtaagcagataagatgctgtgccttactattttttagttatttgccttaagaaagcttattttatctgaaacaaatcctctcaattaatgattaaaatatgaaacatcttttttcctacttcactgacagaagtaaaaataagggacattttgcaaagaaatgactgcaaaccacttgaagtacaacatattgtgaccccttaatcatcacagtgtcagacccagcctgactttgtctgtgtggtggaacatccttaaatgagaattctctttctactcggagttgatcagtaagaatccagcaccaataaaaatcctgcatctcaccagtatgcctggattaaaatcttactcttataagagataagagttctgagtctgagactgacaaatctaggtccaaatcctggctcagccagtcattagctgagtgaccttgggtaagtttctcagcctctct

SEQ ID NO: 135302 - DNA, 1037 bp, Homo sapiens
ggattctgtagcttttttgagtgggatcttgcgaagatgtcaagcagcattacttaccaagcctgtcgtcatatggtctcgcatcagaccttaattttcttttcagcgcatccatgcctgcttatttccagagcccccgctttggctttggacttcaggtctgtgggaggagtgtcccaggatggctcgtgcggtcatttccaggcagtgccgctctccctgtggcttgtacccacagtgcctcactgtgtgagtgtcctcctgctctggttgcccagccggccatcactccacagcgtgtgttcatttctcccaaagctgctcgccttcagctgtgctcacctttgcagtgtggcttccatgtctgccgtcctctggtgctttcagacttggcttcgtcactgcttggtcagtcctggagggcccctcacagtttgctgttgctttcagggcgccggtctcaatgctgctttgaattctgttgaacttgggctgaaccctgtgtcttcttggcagcatctgctctctgtgactttcaccttcaaacaccaaaaggaccggtttacttgagccctagatctgtggtttctaattaattgaggctttcgcatgtaaagatagctttttatttaaagcaagtagagtgagccagggtccggggctctgaggaggaaagggggatcaaagctgtgaatatggagggcatgatacacggtggccgcggggcccacctggaacattcttctcctcataacccttctgctagtgattctggtctagaaaagagggagattttgctctacaaagagggtgcttcactaaactcctacagctgaaattgcttggtcacagcgaatatgcagatgtaatcttgatggatattactaaaatgccctcatttgcccttctctattctgggcagcaatagggaggatgtttgcccacccccaccccccaccccatctccatccctttccttgacactgtcctagggcaggaatgtaacacaggtccagctcgctagggataaggggttg

SEQ ID NO: 135303 - DNA, 1052 bp, Homo sapiens
tgtgggggcggctgggtgcctggaagtaggagaatgtcggtcctgcccacatcagaggtggtccttcccagaagctacctgggagaccagtggtggccttgtgtggtcacggcagaggctgtgtgtgaggtgaaagctattccacaggtgtgaaattattctctttctttgtaagaaagtaagattttggaagtaagaaattaaagaaattgaaagagcagaaagattgtctttccattgattgagtgaacagaagagacctgtgaagaagttgaggaggtgacaattttgaacttaccaaaaaaccatttcaacaaagttctatccatgtgtattttttaaaagaagtatctcacattctttttccagagtatagtttttataaacaaaaacagaatttttgttaaaatacgtatcgatactgaaaataaatccagcttgtatgtgcttgttttttaaattaaaataatagcagtgtaaatgtctaatttgggtgtggtttttttgcctagaataatgtgacagaaacacctatgattaatctcctgaattaaagagttctggttctgatggttttagtgagtggaataatcaaattcatttttgttttctgaggcagctgcaaacttaatctaaatgaaaaactaatataaatcactactctgcattatcaaaaatgaattccattcccatctctctctgagtggggaggaatctgcattaagcctctatcaaactgcaagactgggacttgtattcatctttgaattccctttggttttctgtatgtaagagattgatattgagtgaatatttcctataaatgtaggaaaaataatttaaattcccagtcagtgtgccatttagtgattgcaattaaatctaatacttgcagcgcatgacaaaaggctaatttccttaatttgcgaagagctctgacaaatcaataaaaaaggcaaataagggcaaaggatatgagtaggcagttcaaagacaaacttagacaaattgccattaaacatgagaaaagatatcaacctcatttataatta

SEQ ID NO: 135304 - DNA, 1554 bp, Homo sapiens
ccaagcagtgttgtggttttttttgtttttgttttttttctttctcttttcaaacagccagttcaggtgcacagcaactttttctacatgcagttcccagggaaactgcagaacttagaatttgtactttttgtaaagctatactctatgggaattgcaagcaatatatctatcttagtattgtgtgtgctaatgagagcctcagtggctcccccactctctcagtgtttcctgcttaaagaaccaacagtttaaaagccctctaagatactctgtgtgtcaccaaatctgtgtgtcaccattttttggtcatgtggtgctatttttgttaagtgtctttttaggtcagtatagttgtagaaaatgtgaaatctgatggtaataatgaattataattgttttcctctcttgagttcatagcttgaaaagagacctcaaaagcatgtgctggcaaacacgttactgtatgaaaacatacctgagtccatttgaataatgttttattagtactttcggaaatgtcttcagttctgtattgtgttcacatacacaaacaggctttacaagattgcttcggtactgtaaactctggcagagagtaattttgtaggcagtttggtggtgagtttgtgctgcaggctgcctgtgggatgtcagcgttctggtatctgcctgagaacctgggctctgagacgcacaaccagtgcacctccataggagaacagtgcagccacctaaaagaaaaacgaacgaaggaccagcctcagaggctagaagttaaaggaatacagaattagatgtttgctggttttctgtgcttttttggctcctaaaataccaatggtggatttgtttttgtttttgttttttgttttgagaaataaaaagtcattcaagccctttgtgtgtaatagcccccaggggtggcagctgtgcagtcgcatctctttggcacacaggatctgttcacgtgtgaactgctgcgctacacatcagtgttaactccctacagattacactctaatcccgctgctcccgaggagcggctttgctaaatcgggtatatagtatatgcctttttcctcgtcaaactgcctaagtaggggttcgttctctccctgaagcacttgttcaactcctgttaaagccgcgtgcctcaaggggaggctggaccccaagtgtttacccacttaaatatgttctggggtttcaggtaaatgtttgtgggtttttttttccttacatgaataagtttggttttgatttttttttaattgaatgcaaaaaatttgtgttgtgatacaaattaagtttgtgacaagaaatgcccaaatccaaggacataagaggtcaagctcagggaaggaacctccttttcactcaggcttggggcctccagcgaggtttccagagcattccatggtatgagagacagtgaggagggagggcacctggcgcgggcacttccagcgtcctggctcttggcattgtccgtcttaaccttatttacatggagttctttgtatttgtgaatctgtttaactggtttgagtt

SEQ ID NO: 135305 - DNA, 1606 bp, Homo sapiens
catgcttcccaggggtgtgactggtgagagattaactccattcagatcgggcagcagcaattaattgtgccttgccgcatgaggatgtgtcaggaggattaacatgaccacagaaccgaaacattctctccctgaagttcacttcacgtctccgcagacgaagtacgctgtgtaactccttagagcaactctttttggaaagcaaagtccctatttctgtacagttttaggttaggtgtttcatttataacagatgcagaaatcaattaagataaagtgatatgtgaagaaatcttttacagtaaaatatatcctgaattcatataggcttgttcataattgagtctcttcttgagctaccttttcaatattagacaatgtgaagacagtgacagcgtccttttctagagatatttagcctgttattacaaactgtgaagacaaagaattttatacttttactaatgtttgtggttttaaacagttattttcattctaatcagttctctaccctctaatttctactaaagctgtaaatacatttagaaattatatttgtaaatacagtatatggagacaagttaattttttggtcagtggaaaaagcctcccaaccaattggccctgccttggcagttgtgttttttgttgttgttgttgttgttttagtttagtttttttttttaaacagcagaaaggatactgtcggttcactgttgagcagaatatactgtagaacgaaaatgataatttttaaatcttccagagcatgagtaaatgtcttttctaatgatagcaaatataaccaactctttgtttttcccttagcccagaccatatagacctgcgtattttgtgtgtggttttgtttttatttttgttcttacagcctagaccctaggaaaaatttgcaggaacacgaaacaagggctggggggaaaatcatctatgtgaatgagctttactttaaagagatcaatgtattttattttatcaactttttctcttagttactgtgatttttgttgttgttgtcctcgttattgttaaattctgtaatggtttcctgtgaagcctccactgaaagggactcaaatatgcaacacctaaactattttccaagggcacatgccccttgaatggtgcttctagactggtcagggttatttattaaattttatatatgaaagtattggggaattatgtaaattctttatatgaaactatctagttcataaatcatagatttcatattactcagtgcaactgaactaaaagttcagaaaagtcattcacattgttccaaatttgtaatggttgtcacatgtcacatgcgtctttttcagtaagtgccagagtgttcccactgtttctgcccagtgcttgacttctcggcccggaagagaacctgctttctctggtttccttcctgagtctggcacagacggggctattgtagttcttgatcaagtcctggagtcagccttgcctggctctccttgtagcagattcagtccacagacctcttgctgcccctcagtgacaagtatgctgtgaattcaacctttggacttgctgcccaagcctttggttgctgccctgacta

SEQ ID NO: 135306 - DNA, 1054 bp, Homo sapiens
ggattagtcctctgtgcatctgtttattttttccttctaggcaccatatctctaacactttcagtccactagcatttatagattgctctcctactgggctcccacaactctctcactgtgtgccctgccttagcatatagtacaattgtgcccaccagtgactccctcatgacctttctctagactttacagagtgagagtccacatttgttcttgcgtattcagggcctaccccagggctggtacaaggcagccagaatggtctgagcatgccattccctttgcttaaaagcctccagtggcttctaatttctgtcagaaaaaagaccacatcattagcatggccggtgaggtgtaagaatatgctttctagggtaattgctggatatgtctgtctctcctggtgcagtacagtcccatcaggtcatgggccgtgactgttttgcccaccagcaggtcctcagtgcctagcctagcatccggcctgtagtagatgctccttaagtgtttattggatgaacaaatggagtaaatagtgggctcccagtgactgatctgaatctataaaatgagaaggttgttagatcggaggttctgtccattatacaatatctcaaccctttacaacacttaaaaaggtctcttcacactttttattccagccttatgttgattctgcaggtagctagggcaggttttgatgtgcatagaagacaatggaagcttagagaggttaaacacattgcccaagatgtagctgtgagagaagctgagggtcctaacgcctcaagtgcctgttctcatgctcctggctgcctcaaggtgtggcttctgacacactcattgtagaagtcgcaggtgagataaggtgacagggcttcattggaaaaaggtacttataatagtttttcttggttttagatatttcagtttccagataattgaatttgaggagttgagttaaatttggaatgatgggtttaaggtcttgtttcatgcttatgggtcagaaaatactgaactttcctgtaaatggctaaagtatagtaatgct

SEQ ID NO: 135307 - DNA, 1022 bp, Homo sapiens
gggcctttgttgaatctgcagtgtgactgtataggaaaaggatgcaaacttgacttagcccacagctccaatatctagtccagtgttggtggctagttaagaaaagacagtgcctgttgtggtctgttaacatgataatcatttcagggggttcttaaggactaagagattcttggaacctagttttatcaatatagccagtagtacttgttgaacagagaagcagcctggtatatagaaagatcaatgaatatgaagtcagaatgccaaatgtgtccatttgctttgagactcccactttccatgtaaacaggaatatctttggtgtgcatgcatcctttttcagtaggaaagccccagttttaatatctgagattgtgttatgaggcttaagtcagaacaaagagagctggatgatgataaaggattgtaccaataactgaaggtagtcttattccttattcttccctgtcctccgtaactacttgcctactagcccatctggccatccatccatccatgcagttcttgtccagggtctactgagtgccagtgctatgccaagtgtgaggccacagtggtgaaaaaaagacaggccgggcgtggtggctgacgcctgtaatcccagcactttgggaggccgaggcgggtggatcacctgaggtcgggagttcaagactagcctgaccaacgtggagaaaccccgtctctactaaaagtacaaaaaattagctgggcatggtggcacatgcctgtaatcccagctactgaggaggctgaggcaggagaatcgctttaacctgggaggtggaggttgcggtgagccgagatcgcaccattgcactccaacctgggaagcaagagtgaaactccatctcaaaaataaataaataaataaataaataaatataaaaataaaaatacagatctggtccttgctgtcctttagcttacagtctagtagcaaggttaaataacaaaaataataacaagtacatataaaggtaattacaggggctgga

SEQ ID NO: 135308 - DNA, 1037 bp, Homo sapiens
ttgtcgctctaaatttgccttttctggacatttcctaaaaatggaatcacacagtacattccttttcatctgtcttctttccccgagcatgtgttttaaggtttgttggtgaagtggctgtatcagtgcgtcacctctctgttttgctggatagtgctccatcctgcggtgtgtcgactgaattctctgtccgtttaccaggtgataaacatttggagggtttgtagcttttggcttttatgaataatggtgctataagcattcatgttcatgtctttgtgtggacatatgttttctttttttaggtagatacctaggagtagaattactgggtcatgtgataaatttatatttaactttttaagagaataccaaacgatctttcaaagtgcctgtgccattctgccttcccaccagcaacgcgtgagggttctgtctctgcacatttttgccaatacttgttatggcctgttgttgttgttttcttttgtttttaattatagccatcctggtaggtgtgatgtggtatctcattatggtttcatttgtgtttccctgatggcatttctcttgttagccattcatgtatcttcttcttcttttttttttttttttgaggtggagtctcactctgttgctcaggctggaatgtagtgtgcaatctctgctcactgcaacctccgcttcttgggttcaggcgattcccctgcctcagcctcctaagtagctgggattacaggcatgtgccaccacatctgactgatttttgtctttttaatagagatggggtttcatcatgttggccaggctggtctcaaactcctgacctcaggtggtctgcccactttggcctcccaaactgctgggattacaggtgtgagccactgtgcctggcccatatatcttcttttgtgaaatgtctgttcaaatcttttgtggagctgctttttaaagctgcaccagctgtggatctgtggttcttggtgatggcaaacgtggcttctctcaggacaaaaatgactatcaaatgagacttc

SEQ ID NO: 135309 - DNA, 1040 bp, Homo sapiens
tgcaactagggtgtgaattccagaatactcttaacttaatgcctttcttcttacagaactgttaagacttgacaaagagcatatcttaacacaaagtcacagtgttcaagccttccgagagctggcacctagtctactaaaaattaggaggaaactagtaccactagctttgttcagcatttatgtgaagacgtggcagttatttgtattattgtattattatgtgtgtgtgtgtgtgtgtgtgtgtgtgtgtgtgcttgtgtctgtgtgttcattagggttggggaacagagctttgtttgctttttttgaattggctgacttccattctttttctgttttgttctaatgtggtatgatccattatttctaatcaaaaacaacatcaaatcactgcctcttgaagccctttggtagaataggtgtgtgatggttgccttagttctcagctgaagctgtttctgattatgttctctgcttagctctgatctggagcagtttagacatttagggctttattcttcatccgaacatcaaggagggcagcccacctgccgtgagccctgaacctgcatgtgcccaggagactgggatccttgccaggctgctggaaggagggaggcgggtgggggcttcttcctcttcagaggcatagccaaggccagaccaagacttttccccagggtgctgcagtttggaaggtacctcatcaacacataccttagttcaagttgtgacaagacgttagagtggagatgttttgttttcaagactgtagtttgtagcagtggttcttaatcgtggctgcacatcagaatcacctggacagtcttggaaacatgagggtacccagagtcccctccccaacactcccccacagaccattgaatctgaacttaaatctcttgatgggggtctgaaacctaatcagccctattttgtaaaagtttcccaggtaattctgaggcagagtgaggattcagaactagttgctttaaggtatctggagaaaccccagacttgaacattttggatctata

SEQ ID NO: 135310 - DNA, 1127 bp, Homo sapiens
tcttcagagaggacttgtcaccactccccagtctcctttcccaaggccttacgtgatggactccagacacggtcagggttgggcctgtctcagctcacctcaaggcgtctgactcccagacccctaagcacaaaaccggcagctagtggagtgagcctcatggtggggtggcccagagcagctttgcaggggcagctgaaaccagtgttgattcttgctttcacctaggaatgcttacaggtgggggtattaagactaagtttttttgcacagttagggattatttccacagtgtctttgtgataaacattcttctttgactgtcagatgaatgtctaaatgaattttttgttgttaacgtgttttttatttaaggcagctggtcagatacccctttggttctgggcccactgattttgagttgtctgtggatgccaaagaaggtatggccaggaggcacctggctatcttggacgggagctcaggagagaaacttgggctggacacagacatgtagttgaagccacaacagtcagtatatgtgatcttctagggagaaatatagaagaatgtagaagatgaccttggacaagttgaggtggagattgtgtcagaaaagaaaagagcagccggaaaataagactaagagtgaggggcccgaaaggtggggagacaacaggagaacacagtgtgcaaaggcaaggcagaggacaacaaatatggtggaggctaagagcggccggtgaaggggcgctaatttcctagttgggaagttgtcttaggggaaggaacagttacaggggagcagagagcagggaaggcaggtaggagaggggagtgagtttaagtcgttctcttgcaagggagaagagtgagcaggagctggaggggacagggtctgggagaggtgttttttattgttattaatattaatgggagaagcttaatgcatgttaaaatgctagcaggaaggagaaattggagaggaagacgtggaaggtacagggatgacagagggcatcagagtaaggtctctgagaaggcagaggggtgggatgggggcaggaagagagcgaaagaagcccctctttcattaaagccagaaggagggagaggatgcaaggaca

SEQ ID NO: 135311 - DNA, 1763 bp, Homo sapiens
ggaatgctacagaatgagtcttctaagacagggctaaaaaagagtcctttgattttagcagcaaggacagttttgcagggatgtagcaggttgagtggtagatgtgaggcaatgaagagagcaggtgtaagtgattcttacaacactggctccaaggggagctgagaagggagtggctggagagtggaggagtcaaaaaagtcctgggaggtggttgcatgcttttttcttctttgaagtgagcagatccttaaggatgtgaaggagccagtggacctggaaaagttaaagatgaggagagggaggaagtacttaatgaggtaaagtctcagaaaaggtggaagaagccaagacctgggtgcctcttcagtgtaagagatgagtcagcagaaaggaaaggggcagatgtagacccatttgtaggtgcaatacaaggagagtgatggcttttcttcgtcagtgaaatgggagggaaagggggaaggagtggggcgagaagattgatgggtttggggaaagcttgaaaaaagctgctacacaggaaaggagagagagctgactctggaaatacagcaagactcttgggcagtgatggtggcccagatgaaatagagattgtgattttctaagtggccccagtgcatgtaggtagtaggtggttttctctagttgcacttctcagcctaggagtaggtgcatggaagagcaaatggttagacccatccccttaggggttggcaaagcagattttttggaagggtcaagatgcaagggaagttaaactagtgtcaaagaaaaggctgaagtaggccgggcatggtggctcaagcctggaatcccagcactttgggaggccaaggcaggtggatcatctgaggtcaggagttcaagaccagcctggcctacatggcaaaatcccatctctactaaaaatacaaaaattagctgggcatggtggtgcacacctgcagtccaagctacttgggaggctgaggcaggagaatcacttgcactcgagggggcggaggttgcagtgagccgagatctcaccactgcactccagcctgggcgacagagtgaaacgctgtctcagaagaaaagaaaaggctgaagtgacaaatgataggggattggtctgcttaagaggaaaaggatgccaaggaaaagggctgccagggaatccaggacatggtgagaggaaaggtctgacacagtgggggtcaaggagagagtaaggactagaatgtttaaagattgtagccccagatggaaccgaaattttctgacatagagcaggtctgggaaatcaagaagaaagaggtggctgaggtggtagggaggtctagttgctaaagttgaagtgctcaagggatctgaggccagggtcatttgcagtgatgttgaagttgcccaaggaagaaggcaggattggtgtggaggggaagatagcaatccagatcctgatctgtttaccatctctaccgtggaatcataaacatgtagccttttcacacggacttttttcacttagcgatatgtagttaacattcatccatgtctttatattactttatatgtcttgacagctcttttgtatgtgtatattccattgtatggatttaccatccatggtttgttcatccattcacttactgaaggacatctcagttacttagttacttccagttttcacaactatgaataaagctgctacaaacatttgtgtgtgtgtgtgtgtgtgtgtgtgtgtgtgtgtatgtact

SEQ ID NO: 135312 - DNA, 1052 bp, Homo sapiens
atggttcgcagctgccctgggtcactagccataccgctaagtttctctggagaaacctgtgacccccgtgtaggaaaaaacggatttttttcctaaggccctggataatttcagctcagaggtggagtctgatagttacataattgagtctgtaggaaagtttttctgctgtaaaaatactttaaaaatatctcagacctctttatgctccttcgcttggcatagtgcctgacatgggggaagtaattgctatttccatagctcattagcattcacctcctggcctgcctgatctggggtctctcacagccacacagcgcaagccttttaagacctgtttatatcccacggaactgacaaaaactgtatggaattgtcagatgtgcttctgcaactcatttccgaactgctttctgccagtctgtggggctgggctctgtttcctacttggctggttcaagggcttttaaaatactcagggattatgttgtaggtgatcgaaaatgagccttgtttctttaaattgctgtttccatagatctagtcctcgcaaagtagagtgagaagttttagcccagtgtcagaaaactgggtttgcattcaggtgccattcagagcatgacttctgtgcgacttattttctcatatcaactcggggaggttggcctagattcttggttttccatcagtgcttcgtggagtcccaggggttccttagagttgccttgggtgccgccaggggctgagagagtggagagatgctgccaagcaggcagtttgggcactatttccaccagagcagctctgtttgtatcagttttatgtactggacttctgggtgaatttcaactgagcaatggctttggaggtcgaaagcaagtttggaagccaccggtcttagcagttgctgccagccctgtgattccaagtccatctgaccagtgaggctttttttcaaaagttgcttggagattctttttcaaatgaattttccatcacttagatgctgttattgttttttggactgccgggagctatgtgaggacccagca

SEQ ID NO: 135313 - DNA, 1082 bp, Homo sapiens
cctctctatatagctttccttgacacttccttttcccataattcatttataataataataattattttacagacagggtcttgctctgtcacccaggctggagtacggtggcgcaatcaagactcactacagactcactacagcctcaacctcctggacttaagcaatcttcctgcttcagtctcccaagtagctcatttattatttgtctgggttatcagtctctgtttacttaccacattgctatactatatctctctcctgtgttgaatcaagttccccaaagatatttggaaaagttacttaatacttgtgattatgaactggaaatggaggtaaaagtccttgctccatttttaccactgggctttgtgaagattagatgagttatatattacagtgtcttacaaacagcaagtagaagatggtgtttttccctgtccattttagcagaccagttaagcagccattgtcctgagcatctgtgtagcatccccacactgagatgtcctgaattccctagtgggaaaagaaaagttcacttttattcttcaacttcttcagcaccagaaccttcctttcagcatattcttctgcctctccttaccgaagttcgtaagctatcactgctcctgtgcaagtgggctgtcttatggctgcatcctctgtggtcccagaggctgaagatgaaggaaccaggcagggcctgcccaaagcagcccagggctccctaatgcaccagacatggcctgagtttgggaattgcagaccaggtctcaggaactgcactgcttccccaggtgctaggcagtcattttcccactcctctccattgcacaatggggcttttgaacactggcctacgtcagtctgatggacatggtgggtctcttgttctaggttcttgcacagagcatcaaggtctgaagaacttggccaaagggactccaaccctggggcttctgtttattcatgctcttgggcttagccattgacctccaatcccagaagcactaggccctggcagctagactcacaggtgctgccagcatcagcctcatgctttgcctcagccacccctc

SEQ ID NO: 135314 - DNA, 1177 bp, Homo sapiens
tccactctttagcttcttctggtttacttattttgctatattttcttctcattctagcttttaaatcgaaaagacaagactacctttgagaaattggactacctgatgtcgaaagaagataattacaagcggacacgggaatatatccgaagcctgaagatggttccaagtattccctatctaggtaggagtttgaattggcttatttttttttaagaaacctactcggtgccaaataagatgtttttacagtttctacctgaaaaatttccaggaagcgacatggcccgtagataaagaggcaattggttggctctttgggttggaacaggctgttggtacttcccaaggttggaaacctggattagggtgatatacaagtgatgttctgctttttatataaaagacctgtgggccccagggttccccaggctgcagcccagatgggtcacaatgagagtgataagactcgtactggttcatccacatcctcctgaactggggcatgtcaggcacaaaccctctgttctggttctctgggcattattagtatatttcatatttgtacaaataaaattatagtaatgtttatttttctggttagaaaataatgcatgttaattgtaaggaattagagaaaaaagttaatatcttttgttatctcacctaaagatatttgcttcatatcttattgatttgggcatatctaaaatatgtatgcttactctatcctaaaaatgttatttttatcttaaaaattttatctacttttcgatgctatgactcattcccatcagatggatttgtcaaactcgaatctgctctccaatattgaccatttaaggcagcagccctcaacctttttggcaccagggaccagtttcctggaagacagtttttccacggatggagagtgggcttaggagagtggtttcaggatgaagctgttccacctcagatgattactctgaggaggagcacacaacctggatccctcacatgtgcagttcacagtagggttcgcgctcctatgagaatctaatgctgccactgatctgacagtgggtggagctcaggcagtaatgcttgctagcccatcgctcacctcttgctgtatggcccagttcctaataaggagttgggaacccctgatttaaggtatttctacatttttgct

SEQ ID NO: 135315 - DNA, 1365 bp, Homo sapiens
gattttaattttttattttattattattatttttttgagactcagtttcacccttgttgcccaggctggagtgcagtggcgccgtctcggctcactgcaacctctgcctcccgggttcaagcaattctccttcctcagccttccgagtagctgggattacaggtgcctgccaccatgccccgctaagttttgtatttttggtagagacggggtttcaccatgttggccaggctggtctcgaactcctgacctcaggtgatctgcctgcctcagcctcccaaagttctgggattacaggcatgagccatggtgcctggccgagattttaatattttaagttgccttgatttagtcatgattcttgcaaacagcatttagttggaccgtgcatgagaagccttgccttttagtaggggaatataccactttcatatttgtttcaccttatgccatagattgaattctatttatttctttttttcatgcttttgcatctttccttgttttcttctttggcttaccataaactgcagtgtctttctacttggttactggcaaatccccatctcaggtctgcagatggaaggcatgttgctgtgcagagctcccaagtccatttccatcacacctgaggctcatcaattgagagacaacgttgatggtactaccgtgagggtagcctagtgcagcccacgggttccactagcagaggtgttccagggtcattaaggatggcctcttttctcgaataaggatgatcatgagagctgctgtgcattgtttgctttctctgtgcctagcactttgctaggcatttgaatgcatcatttcactgaatgcgcacaatagcccagtgaataagcaggcagtgagaggttgcctaaggtcacataactggaaagtaacagagccaggactgggcccagatggcctggctataagccctaagctcttgacactgccctctcctgattccccaccctattcaggttattattttcctacacacccttgtggttaccacctgtgtcctctggctatttatgacttgtgggtggcccccatcaggcactgtgtgaagggtataaattattgctcctgtttcttgtgacattccctattgtgggaccacaaagcagtgcagtcttgggcttccaagggcattggtcagcctgtgccagccttcaggcctcttgcccctcagagtttctagacagatgcagccccccatgtccttgatcacctcatctcagctgctgcttcctggcaggtgcttcccaagaggctccatggaggcctccatcctcctgcattcttcctgcttctgactctaagcgagtccagctgaactgctgtggtcttatc

SEQ ID NO: 135316 - DNA, 1041 bp, Homo sapiens
aaatctaaaacattttgagagtcaacatgatgctcaaagaaaagcctcactggaatattgtggatttcagattttcagattaggtttgctcaacaggtaagtataatgcagatattccaaaatctgaaaaagtctgaaatctggaacatttctggtcccaagcattttggataagggatgctcagcctgtagtgcagtggggagcatccttatctgtgtgtctttatcctcctgttaaagtacttctgaaacactgagtgctggaagtggaattgctggggcaaaaactctttgcaactttacagtgcctactgctggaatgccctctgaaatgcttgcagttatatttctgcaaacaggatatgagtatgcctattttttccactcttaccaacactagatattatccaccgtgttttatttatgctaaaatgataggcacaaaatggcatttttttttaaatatacatttctctgcccaccaattctcttgggctctaagataggtagccaggccttcaggcctcctacccaactgatcagccaccctctgcccttgcctctgcttcctgaatatctatccttattccatctccctgtgttcctaccacaggcctgcactgccctgattgatgaggaaaggctgccttgctgttgggttcctgtggagaggaggctgacctaaatccatgccctgcacacttgcctgggcattagtcaaccttccaggcttggagaaggctgtgtgcttcttttaatcgttttcccttgttgagatgacgagggcgtaggcctctgtcatcacatggccccagaagggaattctaattccactccctccacattaactatccttctaggctctgggccattcccagctctgttgaggctcagggcaaatgtggcctgtctttcctcctccaaggagccctctcctggtactgtgagcccttcagcttcaggatgtgctgcagcagtggggagggaacattccttgaccagcccttggagctggatttattaatatcatgaccatcagca

SEQ ID NO: 135317 - DNA, 1017 bp, Homo sapiens
ggaagggcagcgtacccaggaagaggcccatctgggcacagccaggtgtcatgttagttagccacctgggcttagaagggttggatgtgatttccgggatagtgcaggggtcagcagcaggaagggctggggaataggatcccatctgatgagtaatgtctggctggcaaaatatggtcctggagaggatggggaccaataacatctggagtgtagtctagacacctttttggatagacacccagcctgtgacccctccttctctgggaacctacttccgctgcttctcccttggcactgcacgccagcagcagtgttccttccacctagctctgctccacgggcagagcccatagagttggggtggatacccagcctgaactgggccagttggatcctctatctgggagccagcattggaacatagatatgctggcactcagatcaggaggacgtgaactgaaaaatgccatctggtgccatgtgccaggacaactgcagagaatagtccacagatggatgcttgatgagaagcagagaaagagaccctgcaggaaagggaaaaggaaagagcaagggagaggggctgagaaagttgctgccttgcatcttgaaggctttccaggcaatttctggttcctggcccttgtgaggcccagctgtgtccctgcccatggacttggggagatacctcgtgtccttatgtaaccagcttattaaatgagctggactcaatcaggtgtaagaagaaaccaaactcattttttccccagtgtccttttgagcctactctgtggacttttcttttcccagtcaaagctgagaacttagcaggtcctttggtctttgaggtgctaggcatgaagcagcccaatccattctaacacttcctcattccagacagtccagtgtagtaattgcaagtctggactcctaaagctgaccagctgtggaggtctggagtgggggaagacagatggtcagcttgtttgtttgtttgtttgttttgagacaggg

SEQ ID NO: 135318 - DNA, 1045 bp, Homo sapiens
tgggcacgccataaccagcctcctctttgccagcggaggtcccacacacctccagggacaaggaccttgccagctactgattttgctgctggctagatctgagtttggatcatagaatacactttccgctccctaaggaggtggccctccagaaaggctgtagcagcccctgtgtcccagggtctgaccagctctgaaggttatccttctgccctgctcttctagaagcctcggcagcccctactgcttcagaatgagggcctgttcctcttccagggccccttcgggccaggccagttcagtgtcagtgggcggacagaggtgtctgtgtgatacagggatgggcaggtcatgtccctcctgtcccctgatgttgggagaattacccttcagaatgtggctgctatggggacctggcatgaggatcccctccaccttagtatgtaggttccagggcctgcctgaagtacaggccatttgtaggacagtcttgagagctcgcttctcaagtgggagggagtagccttctgaccaagaccacataggaaatggaggcaggaggggactgggtttgcccttgagagcagacagcctgagcctggaggcagcatcggccgtcaggtggtgccagcctcagggaggagcatggcagactgagaggccttcatctcaagaaactgggtgttggccctggggaggcattaactgtgtgggaggctgatatctggactcagggccagaccatatctctgtttcttctgattttctgtttttttctcttgttttttgtttaataaagacttcttagtaaagacctagatttgaagcatgtgatcttagacaaatcactttctctctcctatctgctttcctcttaatagcttcctctcagcactgcactagcattacatgcagtaacagtgaccatgaagaaagccagtttgtatggagccctcgctatgtgccaaatcctagacaaagcactttaggtacattctctctacccttctccctactctgcaatgtagttcttgtccttacttcc

SEQ ID NO: 135319 - DNA, 1182 bp, Homo sapiens
atgtaaaggagtcacccgcattgccatggtagcgccccagccgcagcttataatactcgctctcaggttccaggcggaaactggcgtattctgcaaagactttgcggccggaccagtcctccatggtcaccaggagtttgtagttgccttggttcgtcagccagtaaatgttctccaggcccagccagtattcgccgtcaatgttcccaaacccttgctggggaaaacccaggagagtgttaatgtggagcctgcagcacctgcagccagcaggcttggctgtcagacactcagccctggatagaggggcctgggaaacaagcagagcatgaagcagacctggttcagacccctactccacctcttaatctctccatgactcacacattattcaaaaatatgtagagtgcctaccctgtgccaggcatcatgtgaaccccagattccttgttcttacatcagggaggctatattaccttccccacaggcttgctgcaggaacacgtgtgctgtggcaggtggagggcctggcactaagtaggcacgcagcaggcattcctcagacaaatctctgaccttcactgagcttcacctccttctctggagatgagctgtgtgtgagggtcacgtgtaagctgtaacgcaccagacgggtgtgagctgtgacgcatgtgtcccatccaccggcgctcccctctaggtctaaaacccagtggttttgtggttattgtttttttttgcatgtggttttggggtcagcagctgagttacggccactaaagtcttgggaatcggtgattcattaatacaataattatttagtattgagcgcttgtgatgtgctggcactgttttaagaactttacataggttgttttactaatcctcatgtcaactcgaagaactaagtgctatcattatcctccctagtatggatgaactgaggcccagagaggctcagggtctcagaatgcctgagggtgaaccaggatttgaaccaagaacccagtcttaatcattgcactgtattgcctctaagaaaggaggagtctcccgctcctaatgtaggtggaagaggagaaaaaagcagagacacaggctgttcaggaggtggggtgggggacaaccaggacaggagactcaagaaggggcatggcagagccatgtgtgcaaggcatcatg

SEQ ID NO: 135320 - DNA, 1177 bp, Homo sapiens
aacagaggttgtgcctgcttggggtgcagctgggggtgcggcctggtgacaggcaggtctgtgatgtatatgcatgtctgtgtccccaggcccatggagagactgcctgcaggccctggaggatggccacgacaccagctccatctacctggtgaagccggagaacaccaaccgcctcatgcaggtgtggtgcgaccagagacacgaccccgggggctggaccgtcatccagagacgcctggatggctctgttaacttcttcaggaactgggagacgtacaaggtgagactcggcaggggatgtctgtgctgcccacaaggtgactggcccaccccaagagaggcctgagcaaccaatagaagagcccactcagaggtacatgctgaccaagcccaggcctgtgcggccccaacaacacatatacctgaggcgagaaggatgcagacagggccattttgcaaacccaccaggggtagtgaggaccagcgcctcctctgcctgctgctagaaactgctgcaggacaagagtcagtagaccagaccaccacagccccacaggacagggtgagagtttagaaacgctggtatgggggcccaggggtgaggagcatttcactcccaagtggggtttccatggggaaagacccgctctcaaagcccagaaggcgcaagtcccaagaggctcccagttcctgggagaatcccccaaaaagtcctggtagggagttgtggcaatgctcaagtcctaattccaggctcatcctctgggctccctggttcccagggagttgaaatgctcatctgtgtagcagggaaagttgccaggactcagtcatacatcgttcttccccctctaaacagaggtagtactaaggaaggcaagagtggctctgtttgctgagtgcccaacccgtgccagcaccatgctaagggctttcgtgcattattttgtttaatctcgtatcaacctcctgagggaggttctgttatggacccagcttacagatgaaagtgtggagtaatttgctcagggttgcaaagccaggaattggcccagtagtgactgcagctgaggcctctgacactgaagctcacaaactacctgaagccatgatgccttgcacacatggctctgccatgccccttcttgagtctcctgtcctggttgtcccccac

SEQ ID NO: 135321 - DNA, 1042 bp, Homo sapiens
ggctcttctattggttgctcaggcctctcttggggtgggccagtcaccttgtgggcagcacagacatcccctgccgagtctcaccttgtacgtctcccagttcctgaagaagttaacagagccatccaggcgtctctggatgacggtccagcccccggggtcgtgtctctggtcgcaccacacctgcatgaggcggttggtgttctccggcttcaccaggtagatggagctggtgtcgtggccatcctccagggcctgcaggcagtctctccatgggcctggggacacagacatgcatatacatcacagacctgcctgtcaccaggccgcacccccagctgcaccccaagcaggcacaacctctgttgaggctccagctgggagccacaggcccacggtctgaggtaaccaatttttgttttgcgagtttaataagtaattataaagacaagagcctcggaccaggggtcaggatgcccatactccaagctcactttctcctctcacccgcctcacagtttgacttttggcagacttcttcattctcccagcccccagtttcttctgattgtagaaggaagatcagatttccctcatatagtgttgtcaggattactgagatcatttgggggaagttgctggagtgatctttttcgtgttcattatattaggaaaaagagatgtggacctactaaacgtggcaacatcagtcagtgcctgcaggctctgatggctttgcttctgcaaggaaactcagttccactggattactgtttctgggggccaagtacagttggcacccttcaattctgactccacgtctgcccttccagtgacagtgcttcgtgatgactgctgcagcttttactaaatgaacttccacagtcacaggggcctaggccatgcccagaatttggccatgtagccagagactttgggatatttctgcaattcattcactgctcttcaagtgtgtttttagggggccaggttccctttcagctgaatctgtgtgttttccaaaggaagctcagtgagggcc

SEQ ID NO: 135322 - DNA, 1128 bp, Homo sapiens
catgtggtcccaagggaaggtcatgtctactgacatttatacagtcagggctaacatttaaagaaatcagaacttcacacttagctatatgttgaaagacttagctatacattgaaatgctgagtagaaggaaccccagaggatatgtccagatttgataaaaattaaaaattagacttcagttgggtccatttgctgggagtcaggtgcacgttgtactttctactggggagcttggctggttcctgctaggcctagggagggggagcatgatgttggtgggttggtagcgacagtgttttgtgtcattggaaccatgttctaataacaaatctaccacctttgttcccagagctcattttaaggaactgtttggaacgtggtaccaggaagtagagctagaaggtcaggaagtagagatagaaggtcaggtccctgtggcagctggggccaaatcagacattcacggggtgatttttacaccagttcccctccagccttcccgtggaagtgtgcaatatccagagtagttaaaacatactttggtttgagccttggccaagccacttactagctgtgtacccttggctaagttacttgacctctatgaacctcaatatcctgcaaggtacaagtcccagggtcgatctctgctctgccaccaacaggctctgttacaggaaggccatgctaggggatctgagaggcccctaatagttccagtatttcatggttttatggccccttcttcttcactcattgagaaataaagtgaactggttgtattctctttctcaggagagaaaacagctaaaagtgctcactccttttggtctttaaagattagtttctgacaaagcccgtctgtggcagctgctgttggcgctgtcctttcctccctgatcagtctctgggatgggcactgtgcaggagggctggcaaatgtgtggctctgccttgggtggcctgagaaacagtaccaggcctcccagaacccaggtgcctgctctatcctttgcctcttagagaatgacccctggagccttcctcttctaatagcagcagcaggataggtggggcagaggaccacagatagggccatttggcccaggcctcatcacagaatca

SEQ ID NO: 135323 - DNA, 1622 bp, Homo sapiens
acagactcatctccatcagggacccactagtcacttgggttcccaactcccaggtctgcctggtaaaatcttacaaatccttcaagatgcaacaaagaagtgccacgtctatctaatctctcccttccctctaggcagaattagtcatgccaccttactgtcccccagggcacttagcacaccagggtatcaccacagtgatcagacagcccagttttcactgcattcctgattttagaaattttggcctcgacggatactccctcccagagaaatccattgtcagatctgatgtgctgatgttagggactagaaatcatgggcattggacggatcccagatgcattcatgcacctgccgtctaccccagactgagtttctggaggtcagggaccacaattgtcacctacttccccaagtctagtgctgcgactagcatgtagtaggggctcagcaaatgttggctttactacatgacataatgtttcatgcttgattgtattgtatccacagcataacactgtgaggttatgacccttgtccccattttacagaggagaaaattgaggctcagaagagttaaataactatctcatgagcgaacagctaaccaaggggtagagcatggatgcaaacccaggtcttattcctatactatgtatctgccagcttagttcaagcccaggaatgtcctgaaatgttttgagttagaaaccagagacacttaggccagaggagatctgttgagtaaccattgagtccagcctgtctccagtcagggttataacaacattcaactgagcctttgtttggtgcccaagggcacgttttaccctctcggtattctatcaagacaaattaacacaccctgccctctctttcagagcttctgatttaaagcagacacgtgtacagatggaacgccagagctaaaaaagggactgtttatttcagtctccttgttttaagatgaaaagacctagatcaaaggaggcttgtagtttaccgtggacccagcattgtgctaaacatgttttttgcagtatttcgtttcctaaagtgacaggcactattttaatctatcctcaattaacagatgaggaaaccgagcctcagggggacaaagtgacttgcctaatgtcccagagctaatcagtggtggaaaccggatttaaatccaagccagcctactccaaagcgcctgctctcaatcctgcacccaggccaggtctttcctttgaggtgctgcagtggatgctcactttgcatttagctcacctcacccaccccatctgaaaacaatgctgcccttgtcctctgcactggccaccctcctgcactcaggttcagcccctctttggaattagcaagaagctgctattcccagtactggtggttatttttaaaagtgtgaaataagtgtaaagcaggatattttcagtaaaaatctctccctgcctatacaatgaaatggtaccgaaagcactgacttggagtagatacatggttcatttatgcagagatgaatatagttctcatatggcagcccactgggaaggctcaggtgttctggatgaacaaggggctgagcttcaggggactggatgtgtgctgacattctg

SEQ ID NO: 135324 - DNA, 1162 bp, Homo sapiens
agaaaactacaggctctgggttctttcctgtcagaaaccagagagtgtttgccctcttctgaaactccattttttggtaatatctttgaggatccatctaaggaatgtggttcccctgccacccgtcaccctgctggctccagcagctcagcccaagggattgctgggggattgtgcatgtctttggcctggcttcaactggccatggcttttccccatttgtggacacagccaagggaagcctggtgcctggctctgagacccacatgtaacacgatcccagaagcacttacccgacggcttgtcggtggaagatgggaggctggtgagagtgggcatagtgggcagagggggtggcagcaccttcaggttctggtcactctggatctcgttggtagagatctggttgatgatgcggttgtaggtgggtggttggtagacccggggcggggcagcggggggtggctgggggacgggcctggccgagggcaccctctggcagtgctcctcaagctgcgcgatgatctctgattggttgtgggccagtgtggccaggtgctggtacttgtgctccaggtccttgtacttgctggccagctgcagcatgtcggctgtctggttcaggatcctgttctccagctgggagagctccaacgcgttgtcccgcttgcggatgatctcgtgcaggagctgcatgtagagctgcgtgacccgcgagttcatgttgcggctctccttgcgcagcagcttcacctcgctcacaatgccgccgtccacctccaccagctgctgcagcgtctcgatctgccgcttctgcttgagcagctcattgttgagcagctctagctcctgcttatgcactcggttctccagaagcacctcaggctccttggagttgacgcagatggcacccgtgacccgctgctggggcacaatgaaggtgtaggtgcacttgtcctgggactcgcccgcccgcttgtacctgtttaggtaaatgaactctcttggcgagccctcctcagtgccctcaaaaccgtcctcctggcctgcaacagctcccatggcagccagcagtccgagccaccagcatgtcacgcacagtggcctcatggtccttgcaaaatggtggttattctttgtgaatagaatctatgaaagcctg

SEQ ID NO: 135325 - DNA, 1142 bp, Homo sapiens
cgccaggcaggcagagctttccaaaaactctgcttcaggatgctgggttatattctcttggagtcagagaacaggcagccattctggaagcaagaggagacaggcaagccccagcagaggtagaagggaagagggagggtctcagggcatctgaaggcaggaggccatggccctgctactcccagagccagctccaatgcccgcagcccccttgctgaactcctggcctagagcctgagaatcgtatccaggcagcttcaggctggggaggggaggcagagggagggttttctggtctctctcttctgctacctttggttcctcagactgttgagtctccctattctatactttcacaccccctgaactttccccttgtaatacccatcaccgctgtgctgaatagcagttctgtttgatcttctctgttggattctaactccatgagggcatgtcgtctgtctgattcaaccctgtattcccaggatattgcactttgggcaaatatttgataaacaaatgaatcgttagacatgttatggaatacattcagggtttagtggacaatatcagtggaaggatgtgtccagttacgtggctctggtcactgtgttagctaagctacagagccaaaacaggaacaaacaactgagctcttctgaatccaaatatttgcagtagccagtgacagcacagtcctgaccactgcaacgtgattaagttagaagggagcagaacacagaatgtgtctccagatttgcttcacttctattcttggaccattcatcctttcaccagatgttgattgaacacctgtgatttgctggacagcatgctagtggctagggatacagctaccaacaggatggagccagtccctgccctcatggggctttcacatcattatgccattcccaaatgccagaaagcacaactgtcacatgctgtaaaggagtattacagggaattgacctagagggtcaggaatgcttccctgagaaagtgccctttacactgacccttgaggaatgagtaggagttaaatgggccaagagggaggggaggacacgtgctagatcccttctcttgcccactcgagggccttgctccagcagtcctcaccgtctccccaacatcaggat

SEQ ID NO: 135326 - DNA, 1006 bp, Homo sapiens
cgaccctgggctagggcaggcctgctgggccaacgccttcttcaggctgctcacctgaggcagtgggtgacagacacctctctgtgcccatgtgggcgcagggctccactgtggccaagaaactgccagaggcccaggaggcaacctggctgcaagacaaggttggtttccaagccttcctggacctccagatttgatttgcactatttatggttgagttctatcctctcccaaacatgggctctcacagctccccgacagagttcttgccattgcacttgagacctcaaaggctgagtcttttctgtgaaatgggatgatccaacccaccttgcacactaggtgagcagcatggaagtgcatcagaagcgggagattggaataatgtgttagcaatacgatagcaagaacaacaaagctgaaacaaaaccaacaacagtgaggatgctgggtgtgggccaggcagtgtgccaagcactcacaccatctccttgactaatgcttgcacagggctttagggcttccagacccttcacatcaacattctctcatctaatcattccaacactcagagtgacttactagtgttatgcccatttctaggctgaggaaactgaagctcaaaaaggtgtaggggtagctgactttgaggtcatgttgcgagcagtgggacctcttgtaactacattgattctgagtcctactgttacacctctgtggggcctaggcttagtgggggtgactcagaactgattgggttacaggaaggaagggaaggaacagggcactgtgctgggcgcctgacatacattgtcccaggtaatccggtgggttgttattcacccctgttttatcaacggagacattgcaacccaaacaggctcagtgatttgcccaggaacacacggcagataacagccaaaggtgactgagcctaggacttgggtcaacctgataccaagggccatgctccttgggcttctctttgagcctcagagtcatttat

SEQ ID NO: 135327 - DNA, 1034 bp, Homo sapiens
gtggtggggccacacatcatgtgtccgcatccctctcaccactgtggtgccacagcccaagcaaggggccactttgtgggaagagctgtcattttcatcagatggagctgtgtgttctgccctgcagcagaagctgccggcctgggatcctcttttgagttcaccccaaaggttagaaatgagaaaagttccagcaattaaaagaataacaacaataaattgtcactatggctcaagcactttatatacattatctcacttaatcttcccaacagccctcggaaggcggcctgttatttgagggccgccatgcatggtggccccacttgagcactgtgctactctaggggacacaactcacattcatagtctttatgttttttatatttatattgtagcaattttctgatgcccacaaagatacttttaaggctaacagcaaagctgacatttatccctatttgcagttgaggaaactattgagatttgaggatcgtgagtcatttgcccaaatcacaaattaataagtagtagagccactaacagatcccaaaataacccccaaagataccatactgtgaataaagagaaaccaaagtgccaaagtgactggaaacccaaaagaggttgttctctgaccctctaggcaggacgacgacaggagtgctcttgccgtcattaggcctgcagatcccagggaagcctccaaattaaatccggatctcaggagttgattcatcatcagtccaggttgtagtcctgcctggaggacttacagaaccaccccctcaccacccgtcctctggtcagcactgcccattggtctgtgatcacagatgaaggccaataatgggtccacgccataagaggcatcccagcactgcaggaggcctgagaagcgggcctctgccaaggcagtcagggaatctggaactgccagctggcccctgacgtcggggttctgggaagctagaagcctgagctgtgcttgagtgagtctggtggacctgagcatgaatcaagtttgtgaaact

SEQ ID NO: 135328 - DNA, 1120 bp, Homo sapiens
agtagtattgctaataatggctgtcgtttgttgtgaatttgggtgcccagctgtactctatctcattggctcttaatagctctatgagtaggggaccatacatcctggttggccccagttgaggtctgttgtcttacgtaattattattattattattattattttgagatggagtttcgctcttgtcacccaggctggagtgcaatggcaccatctcagctcactgcaacctctgcctcccgctttcaagcagttctcctgcctcaacctcctgagcagctaggattacaggtgcctgtcaccacacctggctaatttttgtatttttagtagagacagggtttcgccatgctggttgcggtcttatgtagttattaatagcacccccttttcactctcaatattgtcctgactgagcaacaaactatatgatcccattacctaagagaaaggtattatatctgcatttggcagtagaggaaacccaagtctagaaaggttaggtcgcttgttcaagatcacttggaagtaaatatcacaactgggatttagctgtcaactgctaggtccaaaccctgccttgcatcaagattgtctcttcaaccagtatgaataaaaggtgcttgtttgtttaatggctgagatgcagcttgcatgttactcactgttgactgaataagtagaaatagctttcaggtcagcacaagggtgtgttttgttggatgttggaaagagctgcttgatcacgcaagtggtaagaccccaaaatgggcatctgggatgagcagtgacaccctcaccttggagaacctggtgaaaggactgtgcattgtttgtcctggatgattcaccatcagcccggaggccagggagggcatatccagatctccagctgccctcccctcctggctgaggatgctatgaatgattccccaccagaaggcacctggggagtctggagtcaattcccaaacccttctagttcagctctcataagaccattgaatgaaccatttatccatccatccagccctccatcacccacccatttagccttcccatgcagctagccattgtgcattgctactacctgtcatgggtgatgggagccatgagtca

SEQ ID NO: 135329 - DNA, 1028 bp, Homo sapiens
cccctgcctcaaagagctaccgggatcagtgaggcagacacaaacattggttgtcccagtgtttgaggaacaagtccatccaaacagccaaggtggccctggtgccaacttctcagcctggtccagaaaagcagccccaggcaaggcctggacttcccaagaaagtcaccctggggcagtgctgtccacccagcccttgacttctccctcttgtctagggctttcccagttgtagggctccagagcacactaggcactgccggaaatgcagcagccaactcagaagctggactctgaaatggcttctgcagactcttccccgcctctgctctgttggccaaggctcctggcacagaggcctcagtgcacagactttgggggaatctcaaaatggttcccaaataacgcactgtgaaaaagtaacagcagtgtccttgtcccccggaaaaggcaaccagctcccccactccctaaccacatccccctctaccctatgatctcatggtgtgaccacaacccgcctcctccatgaactcttcctggagccagcaattcaccaatggcaggagcacaagagcccaaagcatcaggcagattcgaacccccagtgctactcctccaggcaaatctgtcttaccctgcttctctgactcatggctcccatcacccatgacaggtagtagcaatgcacaatggctagctgcatgggaaggctaaatgggtgggtgatggagggctggatggatggataaatggttcattcaatggtcttatgagagctgaactagaagggtttgggaattgactccagactccccaggtgccttctggtggggaatcattcatagcatcctcagccaggaggggagggcagctggagatctggatatgccctccctggcctccgggctgatggtgaatcatccaggacaaacaatgcacagtcctttcaccaggttctccaaggtgagggtgtcactgctcatcccagatgcccattttggggtcttaccacttgcgtgatcaag

SEQ ID NO: 135330 - DNA, 1370 bp, Homo sapiens
acctcagggggccacagcacagaagctcctctcctgggctaagatgtatcagtgttgtctggtgtaagatccaccagacatggccaccatagtgccagacttggtgatggccattccttgcctcttcctctgcaactccggggcaaacctgactatggatcctcctgattttgtgagcttcccacagcactaaggtagctgcattttcttatccactatggttctgctggggagatcaataggcagacaggcagtgcccatgtgggaagcaggatgcccttcctcctgtaaggttggtattagatccttttgttaatatgtctgcactttttcttagtatggacttctaggatgcaggcatgctgcaggtggccccaaacccaaaccccagacataaagcccccctctcctcaggctcctggaaagccctccagtgtgggcagtgatagtagccacagtattatctctgtctcgtgggattttctgaaaaccctagcaggatatgtccagaacagggaaagaatttgggtctctggccgggtgcagtggctcacgcctgcaatcccagcacttcgggaggccgaggtgggcggatcacgaggtcaggagatcgagaccatcctggctaacgtggtgaaacccgtctctactgaaaatacacacacacaaaattagctgggcgtggtggtgggcacctgtagccccagctactcgggaggctgaggcaggagaatggcgtgaacccagcaggcggagtttgcagtgagccgagatcatgccactgcactccagcctgggtgacagagcgagactccatctcaaaaaaaaaaaaaaagaattcgtgtctctgctcttcccttccctctgtgccagtcctgattgttgtggtttgtaatcatcagtgaccaaggtttgctcagggtttgctgtgcaccaggcactaagccaaggccttcctaggcatgggcgcctagctttctcctagaaagcagtagggtgtggttgagtggctccggagccacaccactgggttcaagtcctggtcctggcacttactagccatgtagccatgggcacattactttacctcagtttcctcacctataaaacagggatgaataataatgcctgtgctatagggtggtcatgaggattctacaagttgagtctggcatagagtaagtgcaatataagtgttagctgttactctctggccattgttaccacctgggcagtattatcccatttcacagataagaaaactgaggtttagaaaggctaagtgttctgccagagccattggctagtaggtagaagagctgggatttgaagccagctcatgaggactgccctactctgcctccatttgg

SEQ ID NO: 135331 - DNA, 1034 bp, Homo sapiens
tcactccctgctatcgcttggagccaaacgaggcatgtccggggcagaacctgtggacatttggtggtgtttgggggcacatgatcatgggctggcatctcgaggacttcatgagtaagcctcactctcctcttttggacaaagagcctttggggtgccggccggcagctcccggcacggcagagcagctgggagtgtgcgtgtgtgtaggtgtgtgcttagagggcagcgtactgaagagctgcagaaggcaggggtggcccaaggacttgggtagtcactttgaagctttggattcctatgcccccaggccgggacaatgtgaggcaaaggcaagcgctgtgctgaggcgctgggagcccctgctcggagagttacaggagctgggctgcctctgctcacaccctccagctggcgaggagagcagaggcacccagcacgggaacggacgcatcacccaggggctgctgcactggatggtaccccgggtctccaactgagtggatgtggccaagatacagggaggatgcggcttccctggtacccccgcaaggggacagcaggggctccacataccaagtcgcctgaaagcactcagtattagataacatttccaaacaaattcttcactgatccttcccttctccttctatgatatgtgtgtcatgggtcagctcttgcctctgctgtaggattatgagagctcccagaggccagttcagttacttggaaaagcatctcctttcaccccactctctggggaaaattgagaatgccacttccaaagccggccaaatgctccccacatgtatttttccaaatggaggcagagtagggcagtcctcatgagctggcttcaaatcccagctcttctacctactagccaatggctctggcagaacacttagcctttctaaacctcagttttcttatctgtgaaatgggataatactgcccaggtggtaacaatggccagagagtaacagctaacacttatattgcacttactctatgccagactcaacttgtagaat

SEQ ID NO: 135332 - DNA, 1010 bp, Homo sapiens
agtgttgacctttggccagtctggcacccagaagcctgccctttcaacctcttcgttatctgcctatgtgatggagaaggctcagctctccaggccctggggaccatgtcattttagacaattgaattggctagaaagctacagggttatctctttcaacatacagtgttttaaaatttgtatttattcttgttatgtttctgcacagacccacacatgcatatgtgcactcgcctccataaacttggctaattacactattggccgctccttggtgactcagtcgtcttgaatagactagcttgactgtgggctgtgggggtggagggcaatgttgacaggagccctgtaagccccaggcagccgtgtttgttggtactttcctagcagcctctcatccctctcctgatttgttgcttctcacccagctgagattccagaaagctgacaagagttatttgtaaataaaaataactggtcactaaactagtctaaagggctctcctgtgagtaaagtaactgagactcactgcctggacttgattacatcaatattgggtactcacaggcctttgaagcttgcaagacctctgttcttatgtaacagccaacagccgccatctgttacacactcaccacatgcctggcactggggaggcctcctgtgtggattacgtcattgagttctcaaaaacggagcctctcaggagaagttctctttgtccgtcttccattttaactgatgaggtagctcaggctcagagtggtgagggagtctacatctacgcagccagtaagcagcgaagtcaggattagacatgggcctgtttgacccggagtccacactcttaacagacttcagtctctacagcttcccagcagtgtgaggttgggcaacttagggaggctcctgaccctcgtgtcttcatctgtaggatcatcctgtttatgtccagaactattgtgaaggttcctggaggtgtgtgcttgagatatgcatagcaggcacc

SEQ ID NO: 135333 - DNA, 1028 bp, Homo sapiens
tgcccggtgccccggaccctcagccccagtccccaaggggagagaagggcagcctagcagagagtgagagtgggtaaagaaagatcctcaggcttctgacactggaaaccccctcttcctggcagcccttggaagcgcagctcagtcttcactgtgagttgacagactcagctggttttgtttactcagcgagcttgagagcatgccgaggtggcgtccccgtctgcagagccgcctttgcctgcaaatatcaccccctttctgctacctgccagccagggctgtgggtggggtggacccagtagggacaagccccaccctgccacccactcacccaccggcctgcccttgcctttcttcctctgccaggctctttctgggcagccccaggtttggccctccttcccggcattgtcagagaagcttccaacacctcaaaatccaccctagggggaccctctccattttctttaacatggaaccaaaactctcctggtttctatgtgtgcagaaacgtttggtaaacagaatgcttaagccgtgacttgctggaaggggcaaatcccagctgacaccccagacactcggcctattttgggcctggtctctgtggtcagagtgtttatctttgggcccccagcacccactgtgggtgtcagatgctcctttcctgactgagtgttggccctgcctggtcccctgcccctgcctcctaggctgctccggataatgcccagtatccccttagtaaatgctcttgtcctcgctcccccccccgtgaatgctgtgattcagcacacacagagaggagcttcacgtaagaaagaaaatattcacggccgccatccagctgcagcaggcgccgggagacagctgccggctcctgcctggccacgatgggatggctgcccaccctccacacacagggggggtctctcctcctttgtttttttaaagacccacagtctcttttggttgctacactaaatgcaatttaaatctgtattccgaacacctctgataagcag

SEQ ID NO: 135334 - DNA, 1070 bp, Homo sapiens
ttcctgcccttgaggcgttaggcctgatggggagtcagatttgaaatacacaaatgatgcaaacaagtgtctgtgtgcggttgtggggtgtgccaactacatgtagagctcagcactgtgcctgacatggtacaagtggaaggtggttattcttacgatttcattatagtttaggcttatacatatctctgttgtggactaatacagtactgaaaagatttctgtggatttgtgcagcgttaactgtaggagacttgctgcttgtgctgtggttttcattgtgggagtgaaaggctgtttatagggaagttctttctaggcattgcctaggctcaaggtctccccacatcactggagccaggaggcttccttttgaggggtgctctacccagtccgcagcaggtatggccttggctcacactcctgggtcttgaggagtaggcaggtgtgggcatctgcacgttttgtagaggggaattatgaactctgtgggcctcagtttgcagagcaccactcagggatccacttccaggaacccaagaggaggcccagtgtccggcacctgttctcacagggcagcacagggtgcacctttcatgttgagggtgttacttgagaaaaggcaactccctctgtgtttctgatgaccagtggatgggaacatgggtgcagcagcctgatagacctgggttcaaattccatcacccttgctgtgaggccttgggcaggtttcttaatctctttgagctttagttttctcctcctactttccagggttggtggcaggatcccatgagacaggagggaagtttctgtcttggatttgatacccagggagcaagttgcctttccccccatcctgctctccagtttctctgcttctaggctgagctttcactctgccactctgagccagctgggccgaagtctgcacattgcgtctggaataaagctgccctatgtcccacatctcttcactccctgccatgcactagaggatgctttttgttgtggttgaagcagtaatagcatttttcaggattgccgttgctgacgcttcagggtggtaa

SEQ ID NO: 135335 - DNA, 1023 bp, Homo sapiens
ctgctacaagctgctacgtggtgccacacctcccctagcccgttgacctgctcaagccactctccccactctctggtgccaggccaacctctgtaacagctcctgctggacacaggaccacagagcccatagggccagtgtggcagcctctcatgagccccacccagtaaggctctgccctgattcccaggggggactccgggctgcttgccttttccagcctctcctggctgcattggacaagccagaccctgcctccagcacccctgggggcctctgatatcttagagagacatgctggttgattctcggggtctccggaaatgctattgtctatacctcaagacagtcctggcagaagcttgattttcacagggtttccataagcccagtattaaaatatctcttgcagtcttccaaatccattgccttccatatgtggcaggtgacccccagcaaaggtggccagaaggaaagctcctagtgctggtcttgtctctactttgtcatttctgccattctagaacaccttccccctcggtcagcattgctccttttaggtgcgcagtcacctacaactgacctgtgggggacgaggagggagcagggcagggttcctatcagaagactgtaggagacagcagttgttaagagctacagaaggaatgctagcaaagactagcctattgcatcgggagatagtgccagaattctggagcaaaatgaaagtggtggtctgtccttccgagtcccctccaaattagtgtgaataagaggcctgtttggcctttgcagcctcttcagttcaatagccttcacaggatgagccacatccctggacttctttaaatgccaagaagtctccatgccacacttgctgtccttcagacagctctggaatacccatctcccggtgccccttcctgctgcctgattccatgctggagccactgagcagggagaggtgggagagcccagggtcaggcacaggatggtgttcgccttggtgtgagccaactctgc

SEQ ID NO: 135336 - DNA, 1053 bp, Homo sapiens
tcctgatgagcagatgccagttgccccttggccaccggcctccatctccatcctgcactgcttcttacattccctgaaataatccacactcgcaaaagcaaaggagcattctggaccttcctggagagtccacaggagagtcggaggggaagattgacctcttgcagcttgaaaatcttcattgcctgtggctctcttctttcagttactcaccttcatgctctttcctgggtcttctctattcctgaccttcatgggcccgatgcttagctcctccaggtcctccctccactcccagctctcacccaggccaaatcctcctactctaatggggagcagactccctctccctcagaagactgagtgtcagcctgcctgggcccagaggccagcacctgccctgaaagagcttcccctcctcggagaccccacgagctgttccctgcagatgccgtaagaacacagctttctctgcaggccgcaccgctcgagcagacagaggccgtggagccagagccaagggtgcaggggaggcctgggccacgcagagaagtgaggtgtgagagaggagagggggaggcttggccgtggtgggggagacagcatttcgccccacagctctgaagcgcaggggccacactcttctattgaagattgccaccagccccctgcccctcaaccctggtaataagcctgcccaggctaggaagagaaatagagccagatgccaagacgaaagccaggaagaccccaggccagttcctccacaccacacacacctctggtgggttgagggcacaccttcatcactaagaatgccactgtcagcaggcaggcaggagtttctattgtctggccaggggtgagactctgcatgcccgtctggtgaatttgccttccctgagtttatgcacatagatgtctcctctttgggtagtagccagagttcaggctgcagatgcccagtaggtccccatagtgttcggccataaagagcttccacacgggagctggagcccactgaggcctgcggagctgctgtactgccctcgg

SEQ ID NO: 135337 - DNA, 1111 bp, Homo sapiens
gagaagtgctgagcaaaagggggaagagccccttagaaaaccatcagatcttgtgagaactcactcactatcatgagaacagcagcatgggggtaaccacccccatgattcagttacctcgcactgggtccctcccatgacacgtggagattatgggaactacaattcaagatgagatttgggtggggacacagccaaaccatatcagggagggatcctacttctactaagaccaagattaccaaggcctcaacataattattttctggggaggttgctctccaacctcctagcccagaaacagggacttagggctttatgaaatgtaagccccaggatacctacaacctaatgtgtacctagaaaatgatggagtgaagatggcctttcagacctgcttgactagtctgaattctcatgatgctgttggctcaggaagtgccctggccacttccacctcaatagcaccacctactctgcctcttcccagtgtcgtgatcttgggcaagtgactctacgtctccaagcatcaggttctttatctataaggtggggataataatagtgcctacctcacagtgttatatgaataaatgagatgctgagcgaatcctgcttagcacattgcctggcacccattgtctcatcaccaccaccaccgttaccaccatcaccatcctcatttcatcctcccacttttactgtcaccaccaccaccaccatcatcgttatcccatcatctcattgtcccatcattatcatcatcccatgaccccatcctcctgctcatcatcaccttgtacaccccttgggactgaagtgttctactttgttgccagtcgatgtcttccccagacccaggttcccacaagctcctggtctgggcaagcctcaattgcctgttgcagtcctccttctgactccacctaagatccctgagagggatcttagtcaaacggccttcctaggacactgtgttcagccacaggttctcagaatgacactgggaaaggtgtctgtggttctgggctatgagcccctatgtcagttaccaaaaaacaaacaaacaaacaaacaaaaactatgatttctggggttcctctgataccac

SEQ ID NO: 135338 - DNA, 1021 bp, Homo sapiens
ggagactgctccactggggccaccaagggaccaggagacctggaggtggccctattctgggagatccccaagcctaagaatcttgtggtcattcggtctcagacactgacaaatcccaggcagcgtgagtgcaggtggggacccacaagtagaggtgcctctgagaggataatgccagaaagggcccccacagtgggtccagtcccaatgacagaccccaccatgtttatgctgccgcctctcccttatcctgaaaggctttatctcacagtgtggtgaggaacttgggctgcagagtcagacagtcctgggttcaagtcctagcttacaaggctcatgccttggtcaagcagattcacatcactgagcctcagtttcctcattgtggggacggtaagggtgctttacacaaagcttcggtggcagcgcgagtgcactcgatgaagttgcaggagcatcagagcatgtgagcactcactacctagtgactgcttgatctgtcaagagcccacccagagacccctggtgtccctgtgctccccgccagtccactcctcactccttgagggaggacatgaggaaaggctgcttacgaggctagcctgcttggaagatgctcgtttcaagctctccatcaacagatgtcagttccttcaaacatctgtgaaatacaaagccacgcactgtctcacgcaaagggagagaatgatgggaagaaggtagccacgctggccaccatgccctgtctcaggtactgtgggaattccggacagtccactggcatcacattctcctcaggtagcggggaaaaagactcacgagaagaaaagtggcaaaggggccagagggccctgctctgggaagggggactccatcctcaactcccaacagtcagcagctcagagctggaatccagcccaggtgaggaggaaacatccctggatagcagacaaagccacaaaggatctcactgcaagaaagtccattgtcagaccctgctcagaagaaatccccggtgatt

SEQ ID NO: 135339 - DNA, 1068 bp, Homo sapiens
gtgcagtatcggaccgtactagatctgtttttagtgctttaatatagaagcacctatagaattatactgctggtttgttttttagttgtttaataactgtatttgagtattatcgatttcctttgtattttatacatttggaaacattattctgaggattgtccacaggcttaaccagacagccaaaggcaccatggccccaaaatggttacaagccatggtccaaagagaccactggagggagccctggaggctgctttctctgcatgttccagctcacctggggccgaccttcccactttagttacccgtgtttacatttctctttatgccagtcaccagctgaccctcctacgtggccctcttcttaactcatggtttctctacccatcaggcaatgtttacaagtttcagactggttcccgatttcatgcaatactgtggcacaagcatttggatgatgcatgtaaaagcaacaggcctcaggtaaagtcatcaaaatcctgcttgtcacctgaaatatcctctcccacccttggaactaagggtctttagaaaacagggttcccttcttctttcagagcccattagccacactctcagataccctcttctgatcagcatcttcccttgagacaaggcacccccttgctcagcttagaactaagcccagctccagaccagaactttgaatctggttcctgtgtctttcccacaataggaaatgccacagaaacacccactgggggatgattatgagcagctgtgatatcaccccaggatcaggttctagcatctatttaggtcatccctgccaagagctgacttcatgggaatactccagactcactaaagggcctccctgccccacaacccttgggaataatgcggctagctaacttactgacagccagccatggaccacgcaaagctgctggtgaaagggggtccctagcttctcagtgtgtttgagccagcaggatctgtcttgacataggccctctctggcctggctcatggtatggccccctcccctggtcgcccccagccgtcccacgaagggtgtta

SEQ ID NO: 135340 - DNA, 1110 bp, Homo sapiens
cagctccaaccgacgtgctcatagtgatcagctgtgcaggagccatgaggcaccaacctctccccgcagggcaaagcctgtgcccccatcatctcactcctttgcctgcactgccagggtggggcccaccaagattcctgatcatgacgggaagctgagtgaccctgaggccttaagcttccccagtcttggccccaaatgcagtcaccagcaagttttccattttccaagtccaagggcacaattgttgatgaccgtgtgacaatagagcgaagccccggggagtgaacggtccaacctctgcattcagttaggagctcttcacatgaatcacatccttatctgtcaccttgtgtcacattttaaagtgacttttattttgcacaaataatttttattcagaataataaatcactctttatcatagtatcttctcttccctcttcccctttagtttggatagcctaactctgagaagttaacccttaaacagttttctggaagagactgaatttctgggtccttgcagctgtgatggtttcagagctcagactgatcaggcatcaagctaccctcaagagtttctgggctggatgtttcagaacaacatctacaccagtaaagtgtaataggtcagtttcaaaacgaccaaaagacccaccactgtattttgaccaaataatgacaacttctttagaaatttgaatggcttggtgaggaaagtagttgtcaccagggcctcattttgtagttgagccttacaatgcttagtagttcatcttctttttgagcaaagactagaatactttcctcctaagagaaactcccaggtgataaaagttgatgccatcaaaccttgacaccgggtgctctgcacacccacgcggatgttgcacctcattctcccgatgactattcaaatcagcatctagaggctgaatgacaatgccaaacactccacctctgatcagaaccatgcagtgttaacactttaacctacattgaatctgattctacctgttaacttttaaaaagtcgtaagtttggatgaaagtgcaagatgtggaacatcaactacctattttccttgggtttttccactctgcaaac

SEQ ID NO: 135341 - DNA, 1366 bp, Homo sapiens
cctgatcctcccacctcagcctcctgagtaactaggactaaactttttgtagacaaggtctcactatgttgcccttgctggtcttgaactcctggcctcagttccccctgcttcggcctctcaaagtgctgggattacaggtgtgagcctccacacgaccctagtgtgctattcttttggttgctcctcaacatttctttgctgcttgagcagaaattcctagtgctttgagcaggctctcttttattctaaaagacaacattcctatgtattccagtaaaaatatgcagtctctttttgttgcccactggaggttatccattactcctgccagaagaagaaatttgtgccctactctgcgctctgcacagggtcatttaaactgttaagctcacaatccaatctgacagacactaaaaaaggcatatcagttagtaatctgttgcagacaacagaatccactctacccaatataagcagtaagggatgttgtactgatccagggaattaagtgtgtacaagtttgttggaagggctggagagccgactgctgtctgagctcccaggaccactctgttctgctgtcttcaggaaaggaaagctgccgcatcatgtcaagaagctgatcaatcaagaagcaaggagatcctggcaccttgactaactacagacccatgctgccgactctgcctggatccccagagccaccactgctacttcagaaagctggagaatcaagaagctgctgactctagaaccatgatactcttgtcactgtctgtaaaaccagaacaatgcttatatcctctcttttgcaccactgactcagttccaagtcagagtctctcatgagtgcatctgacttgtggaatctaaatcacgtccagaactctactacaaaggagttgagaacatttaagttttagctttccaacttttgcacagtggaaggggactgaagtgggtattgagcaagtcattccacagtatctgccacagacagtatttttctccaatcataacaaaaataaatgagacatattgatggaaagttggtcacatagtagccaaaggttccctgtacatgggtgtgctgttgcatagctggcatgcccatgtgggaaccaccttattgggtgaagaggtaaaaatgggcaatccagcctcagttgggtgcttgaggtagactttccaaccataagtgtcagcgattgcatagtttcagcacaaatggaagtaaggacataaatatctgtcttgcattttatgaccagagaaaaaagtgtctctagaagcactgccagccactaagtattccccagtgtcagttccatagatcaagcccgggttgatgttttgcagatgg

SEQ ID NO: 135342 - DNA, 1006 bp, Homo sapiens
tggcagagtgagaccctgtctcaaaaaaattttttttaattaaaatcattctaacagtgtatttatatcattcaacatgtaatcagtgtgaaaaactattaatgagatgttttgaattcatttttatttgtactaagtcttcaaaacccagtgtgtaacacacttcacttgggatgtccctatttcagttgctcagtagtggctagtggctacccagtcggacagctcagcgtcagtcacatggaagctgttcctccgcagggctctgcctgaaactgaagtctcactgggtttcttctcgttccctgtcctgcttcctccactccctcatcggtatcttgagagcactgcttaataaatcttttgcatacaagtattatctttgtaattaaaataaatctgggaggttcaaaagaaaaaaaaaagaaaatgtctctcatcctgaagccctgatttgttatttatttgttggtgtatcactaaggtagccgtaaactctagtgacactgggttttagaagactcagggctcctttgggtaaagaacaactgataacagaaccctggtttcttgcgctttgtcatgagtgggtgacttgagcctttgatgtctatctagttgctgccaagataagtggcctgaagccagcctagggtgagattacctagaagtctgggtcaggtatgcagcatgtggcctgctgggcccaggaaaggcaatgggggaagccaggtcatcatttataagaggaataccagagggacctgacaagagagaagacaaaggggacaggtaggaggttatgtgagtcttgaatccttcctgcattaggcacaggtcattagagtgacttttttgaggttttttgtttgtttgtttgtttgttttgttttgttttgtttgagacagtcttgctctgtcacccaggctgaagtgcagtggtgcaatctcggctcactgcaacctctacctcctgggttcaagtgattcctttgcctcagcctcc

SEQ ID NO: 135343 - DNA, 1041 bp, Homo sapiens
cttgtcatcagtgggcttgcagcacataggacagatagccattactcaaataatcacacaaataaatactagcaatttgtaataagctctatgaaatgtgctgccttgattcaataaacatttacagaatgccttctctgtgccagcaacctactggggatattagagaataatacattttacctaccttttgaatataaatagtatatggaagcaaaaacattacaatgtaatacaaaataaattttaataataactagaatagaattaatacatcagtagactctaaggcctatagggtggtaactgtgtttttatatttactcctgaatccccaggcctttgttatggtgtatgataatactcggatgaatgaataagtaaatgaataaagatgatacaagagaggggtacttagttttccagggggaatcaaaggcagccagatgcaacaacacggttgacttcaaaacaaatgagatgcttcatcaattcaatgcaacaaatatttgtatgcttgtttactgtacccagtgcttttgtgaagcgagttcctagataaggacatggatcagaatcaccagtgggactttaaaaatcatttatgcctgagacctgccccttgagattctgactcagtggatctgaggtgggtgaaggaagacactttgtctgccctcaaggaactccctacttatccagggagacagacaagtcaccaggtcacaccagtgatgctggagaagcagcgtgaataacgtgctaaaggaagccatcacctgctggaggacagggaagagaagggataacagttgagcttggccttgtaggatgagcattgatcaggcaagagagagggaagaagacctctttaaaacaaggatgccacaaagcaaaggctcacatgcatgaggctgtgttgataggcagtaaaccaacagttgttaaaccgggttgcacgtgaaaattacccagggtagctttaaaaacatagaagtctgccctgcccctccaaaattctgagatctagggtgggacata

SEQ ID NO: 135344 - DNA, 1050 bp, Homo sapiens
caggactttgagaggccaaggtgggtggatcacctgaggtcaggagtttgagaccagcctggccaacaaggtgaaaccccgtctctactaaaaatacaaaaaatcagccaggtggggtgacatgtgcctgtagtcccagctacgtgggaggctgaggcaggagaatcactttagcccaggaggcggggattgcagtgagccgagattgcatcacagcactccagcctgggcaacagagtgagactctgcctcaaaaaaaaaattgctgtcagggctgaagaagggtacagtaacatctttgggaacaggaggcatttaggaaagtcttcttggagagaaggtgaaatggaccttgagaaaggagttgaccttccttctttttttttttttttttttttgcgtcaatgttaataggcagagattggggaggagaggattctagatggcgagattggcatggcaaaggcacaaagcagggacactctttcagcgcatttttgaggaataacagctgtcttagtttgcctcttgtgtggtgaagtagtgaaagtctggaaagtcaaattgagggacatattgtgcaagatgttgtactgaatcctggagtcattgggaggtgctgaatggcttttgagacaggcaagtggtggtttgatgtctgctttagaaaattagtttcactgttgtgtacactgaagagcccagttacgggctggactagtgaggcgcttgttggttgtaagtgacagaaacccaactcaaattagcttaggccaaaaagagaatatatgggttcatggaacccaaactaagaaaagggacggatctggcttcagggctgattagatccagggcctcaatgctgtcaagtcagatggttgtctcctattcctttacctccttttctctctttccccgtgcttcttgatgcttgccagcctccctgtctcctactgtccatagtttagtttttgatcttttgagcaaagttgccatgtgtttgagtttgtcaccaaggcattaaacaaatattaggcaattttgttattt

SEQ ID NO: 135345 - DNA, 1015 bp, Homo sapiens
tactaggtcttactcatcctttctattttttcgtactcattaattaaagcttaccactaccccctgtcccctactatccttcccagcctctggtagccctcctcctactctctatctccatgagttcaattattttaatatttagttccacaaataagtgaaaacatgtgaagtttgtattttagaccctttttaatagccttcagaagctttgaaatacctagtttgctcctaagtgtagggctactgtattttaaaacaagtgccagaaagtaagcttttagtttactgttaggaggaattctattcccctgccgttgtgtttccattaagaaacttctgctttactcccatggagaagagaggttggaagggcggctgactcgtcccctgccccatttcctctctcccttttgggatctggttgcccacagagcttgtgtattacttcgcctcctgtttctatgtaggaaaacacacccaagtcttctagaggtaggcgtgggggcccatctgtttccattcccctgttgaaatagtcctgagactatttcccttgcagctgacctggcaggtgcctgcctgtctgcagatcagactctcccacaggagggttgccccagggtgtaaacttgtgggaagtagtaggaagcccatttgcttttggactcagctttgtttgtcaatgaaacactgacagcaaggaaatttcttattttcttctgcttttttcttttcttttttttttttttttttttttttttgttgagacagggtctcactccattgtccaagctggagtgcagtggtgtgatctcggttcactgcagcctccatttcctgggctcaagtgatcctcccacctcagcctcctgattagctaggaccacaggtgtgcgccaccatgcccagttaatgtttttgtatttttggtagagacatggtttcgccatgttgcccgggctggtcttgaactcctgaactcaaagagatctgcctgcctcagcctcccaaa

SEQ ID NO: 135346 - DNA, 1034 bp, Homo sapiens
cctttgtcaaaatagtatataagccccccagtgtaagtgcctttttggatttttatttgttttctgtggaacctccctgcatgtaaaattaaacataacacttgtatactttttctcttgtcaatttgtctttttccagttaaatttgcaggcctcagggaaagaactaagagggtagaggaaaagtttttcttccctcatggttatgttcctaaagcaacaaaattgtagactacagcaaattctggcttgcccctagccatctacagagaccttttttcttctctgttgttgatgagaagcatggatacacagcctgtttattcaaatatttattgtgtaagctggacaccacaataagtgcttcatacgtcttttttcattaaatccaatgggaaggcactatgatgataaatatttgttgagttaatttattaatcaaaccatcaaaccccattatatagttgtaggaactgaggtccatgaaggcgatgtttattgcctaagatcaagcagtgagttagtggtgactcagacacggctaagtagataccaagcaacatttatgcacatataatttctctacacatgtagatatttatttaagtttaagttcaagttctatattttctgtatgtgatctttgttttggaattttttgttaagctataatttacatgcaataaaatgcagatatcttaaatatacagtgggatgaattttgacagttgtagctgattgattttttaatgttatggtgtcagtcagttccacttaattgcattatctatgtattgagaaacatcaatctctagacatggggaatgtcatcgtgaactgacagctagtgagccatgtcacaatctattcattatgattgctcccatagtattttctttgttcacttatattagtggcattgtattaacctctgaaatgaattttttgagatgaacctgaggcaacatttatagcatttttatgtctgactcaaaaacaaatttcatgaatatgctgtataaggcagttcactt

SEQ ID NO: 135347 - DNA, 1121 bp, Homo sapiens
tgctggccctgagtgtgaccagtaggatctcctgcccacctactgccctcccacccatgctctcctcaggcaggtcctgccagcatgagctcagggtgttggtgtgaacctgcatggtttgattaagttactgcccaaccgactttccccagcctgtggtgcttccggttatctggcctgcccttcactttggcctttccttcatgatagagctggtagaatttctttgacatttcttgcatgattaatgaaccttctctgctttccagggccagtataggtcttacccctgtttttatatccctttggccatttgcaatagaaatttggcattcatctattcccatatttcttgtttatgaatatttaatgagaccgatactgtgtcaggtgttatgcttagctctggagatgcagtggtgagaacaagtaaatgtagttgctgtcttttgaagtttgctggagagcggagagagcgcctgaggaaagacaggtgggaaccaaataatcatgcagagaaatgtaaatcacaactctgcagagtgccccaagaactgacaacagggtcatcttcccaggcagtgggtcagggaaggtatacagaaggagggggactttggtagaactgaaggatgagtagtagggttttttaggggaaggtgagaaaggagggccttccaagccaggaagtcccaagcatgtgtccttcggtgagaagaagtggggatgctggaatagaggtgggattgtggcacagtcatatttgcagtttgcataatcacccaggctgcaggcttcgttgtgaggagccgcttggagaggagcagtggtagatgggtgtatagactcagtaggaggtggttgtggtcatcaaggtgacagatgatggtgacttgaatgaagatggggatggtgaaatggtaacggtgatagtcaaacccattagcatgagctctgtctttatggatttcatgagttcaaagggagctgaatttctttttaccatcaaatcgttaaatttgttcttcctttttttcttgaactttttaagcaagacaagcaatatgcttcctgttctaaactcaacaaatgaaaagagcattattacgtatgcctgtgtc

SEQ ID NO: 135348 - DNA, 1024 bp, Homo sapiens
ctttgacaaagaaatttaacttctaagaattatcctaaagaaataattgaataagtaagtatgcaaacgtggaattagaagatgataaattttatttacaataacaaaaattggaagcagcctaattgtccagtattattagttgtatctatataataaaagagtatagagccaataacacaggattatatttattgacatgtaaaatagttattggcaaagcaagccacaaaactgtatattcaatataatttcatcttattaagaaaaatacgtatgtatatgcatggggaaaaaaaaaaacagaaaaaacctaccaaaacatggattaattctagatgaattgtgcctgttacaggggtaacaaaaagaagggggttcctctagggggcaccaactcccaaatactgtggaagtttcagcccagaaaggagaggtacttggtacccattttaggaatagctgaactcaccggttcactggttatttttcctacaccccaaaggcctcctggatgcttccacgatgtgaatttagactgggtgtcttttctaatgagaacatgcagccacagcccttgggtgtatgcttttaacaatgatttttctggttctttggccgctggttcattgccaggttcatgtttactttctgaataagcctcttaatgtcacaactttgttccattacagaatgcaactgccctgcctggtacttggcgaagaacagacgtgcacttagagaacccagaataccacaccagatggtatttcaaatattttttaggacaaggtaattatgctattgtggtggtagggaagaaagggtattcaaaatggaagttagtgttcatataacttctggtatcctatatgagtgaaactagccattttaggaacactaacatcagggcatttcacttcaaggtcagtagtaagctttgtaggctaaaagattcagagtctcagccctaagagtttttgctcatagtttcctttttttatggacagtcatttttatccct

SEQ ID NO: 135349 - DNA, 1066 bp, Homo sapiens
cacatccgctatgagctataggtcagatgtgaggaggcaggaccattgccataggcctgtgtgtgtcatacttctggtcattaacatttgcagccactgagttgctacccttctccaagttcaaaccaggtgctgcctggacttaagattcccgtgcaaggccatgcccgggaaggggcctctggttcaaatgctctgaggtgcctccaggtcttcccttgacagatttacagcatcccacaatgccttcaaagcctgtccttggcatgggggcatcaagagccctggcatccacctcttggctggcctttcttccttcaccccttccttcctccctccctccccctccttcaccctccccctccctccctccctccaaggcaggagagggtgggtttcccccttcttctacttttctggaatggactttctcaatgtccatatcttcttcctccaggaagtagcaatcacatcctcactgagatggctgccatgtatgaggagagacagagtgggacaaatgcagggggaacatttgcttattttaatttccaaagatactgtctatatgacattataagttgtgataagcactctgaagacagagaatgacagagcatgctacaggagccccacttagatgagacagtttagggaaagcctcctgaggcggcgcccaggaaacagaggcctgaagatggaagggagccagtcatttgacgagtagaaggggaatcagagagtgttccaggtagaaggagcaacaaatgtgagacaaacaagggttactcatacctggtattagagaagccaaggaggtggaatttaaatcccaggactgctgtgaaggcagcataggggcagggcatgatgagaagtgccagtgccttcacccaacacctcttcccttggccttcagttatgtgccaaggacaatgagagggttctcagctgttgatggaagtgctgaagggagggaggaactgagaaatcaaaactgagcattggcacaaggggtcagttattaagcccctcttggcctgaaactagtgctagaggctatggg

SEQ ID NO: 135350 - DNA, 1047 bp, Homo sapiens
tcgttattatttttaactttcacttataaatattggaatattagctgaaaggaactctagagatctatttcaatctccttgttttacctctataggaacttaggttcaagggaatttacgttgcttgtccaaagtaaaacattttaaaaagtcttgttaaggatggtcttttgccctatgtggcatagaaatttcagttaaatcttaattacattcattacttttagtaaataaaaataagaatctagaagaatagccaaggttacctgaaacagatgttcctgatttctctctccctctcttatgagtatcactaggagccagttatataagtcaagtacatgtggtgttggttactttcatctgtttgttcattgataactcatttgttgatttgtatcttctgagtgtcaggccctttagggaaaacagctgtgattttctagaagctcctttttagcttctctgatgctgcagctcatcctgtccattctatttcagtgccatgaatctggacaaatttgagaaaggccccagggaaatttttcatcctgaaatacaaaaggtaacagaaaattttatgcttcataattgtacaaaattgattacagtgttaggatagaactgacaggtcatcataatccttatcctgggatgcaaagccaaatcacctatgcaactttaaaaaaatcatcatgggagaacctcacacctaaggttctgatttgatgggtctatggtagggcctgggtatctgagtttttcagaagttcctcaagtgattctaatgcgtagccactcctgagaaccgcagaactgtcctcaatccacgaaccaatagggtgtacattcagaaaaatcttattggcttaaaagctaccctttttactgagtaatatagaattgtgtggaacattaaagaattttttttttaatcgaaatggagtttcactcttgtggcccaggctagagtgcaatggtgcgatctcagctcactgcaacctctgcctcctgggttcaagcgattctcctgcctcagcctctagt

SEQ ID NO: 135351 - DNA, 1047 bp, Homo sapiens
ttgtaataagtttacaaacttttatatggggtgactaagaatgaaaaggaaagtaatttaagttgattaaatctccgttgtgtaccaggtcttccacacacgctgacagtgatcttcacaggggttaagacagaaggaaggagagacccaaatagattaaatgacttatgcccaaacacagttaagaatgcgacagcagggattcaaaggattgtttaggtttgctgctccatgctgctcttacgagatggtcttataggggaaaaagatccaagactcgtggcacccacctttgtcatagttgggtttttttcccccaaacaaagctcctataaccaacttttaaaattattttcaaaatgtcagtgtgagcaaaccaaagcttggctttcacagcaagtcaaaatgaaataattactgttatgcctggatgtaacttttaaaactttatttgacaggacttgctggttcttgaagaacaagaggtgagtaattctatggagatatttgcacctgctctgcctccatgtttgtaaatatatttctcctttcactgtgaacccagcctttgctttcagccaaatctccatgtagatttgcacagtgggacacattgcgcggaaagaacttactggcatgtatttttaaggtatattttagaattttctatgcatctagctataaagctatgaaaacaatcaaactacttaaatctgcttggaaacatttaatgtgttaagcttatgatcagggtgagtaatgaggttttaattttcattaaagtagggtgtgtgtgctttattaggatgctcttaatatacaaaatgctgaatttatttgcatgttgccattccctgttgcccccattaaaaatataaatatattggattttctaagtatataactaacatagggaaatatctaaaatattatcaataggcaatggagtaaataaattatggtttatgtatcttatccctctcagtaaatagcagtatcttttgtcttgttgctcaggccaaacttggaaaaatccttaatccatgt

SEQ ID NO: 135352 - DNA, 1009 bp, Homo sapiens
tgaatgtctgagcaagacttacatcctgagaaaaccagtacctgtgaattccctccagcagcacctccctccagggacccaggtctggccttgagaccttgagagctctgaatggctggttaaaatattatctgcgacagtccacttgcaccagatcaaactatcccctcctaaaatatgaaatacctcattataatgagccataccttgatttctggagataggtgaaaactgttagtcatggacataatttgggaagtcctggacaccatattacctaaatgaggctgtataagtaggttcaagtacttaacaagtacttccagtctttctggaatctccacctgaaacaggaggatttcatataatttatcatttaaactgggaccctttgagagtaattactaataacatcaggacaacagataaaacagatataagctagggctgtcttggcaaacttggacacatgatctccctaccttgaagatcctacacccttgggtgcacaggtacttaaaagacccccatcatgcaacccttgctgctttacagactttgctcttgtctgaccctaataacttgtgatgaagacttgacaagaccttgcaaaaccagtctttctggagtctccacctgaagcagaagaggtcctcagcaggggtatggtagcatggtgccagtctcagagcaatcctataaaaccttttaaaagcattggccagtgatcaggtggtagtaggccccatctctgcttgtacatctcagtttcacttgaaacttttcagagaagattatgccatgatactggaaagaatgctggatcaaaagtcagaagacccaagttccagctccggtcctaccgttcacttagttccagccatgcgcaagtccctgtcttccctgagcttccctgtcctgtcttaaaataaaagcatggactcagtggactatagggtcctttctggttttagcaggctgtcagtttatggctcagagttatggtcat

SEQ ID NO: 135353 - DNA, 1105 bp, Homo sapiens
catttgtaccagctactgcttgcttggcttgggcttgctttttttttttttttcacatctgttttgtgacttcttcagattgaatatctttaggaattggggaaaatgagcttttagtataaattgcctataattttcatttctgtgtctaaaagagtccacaatatatcagcctgagattatgttaagctttgaattacaacgaactcttcttcgctgactgggatttggacggttgctcatgggttgattggaagatggtgccaggcctgtgagttcctgtggccatttgttggaaccctgttttgccacagaacagaactggtatcctagagatgccattagtaatgaaattacaaatgaacgaattcataaaagcatacagtctcatctgtaagctataaatacctatcaaaatgaaggaatgattgttgttaacattggtcaataacccagatggatgggaggaagggatcccctgactgtccatcctggtgactgccattgtgctaagtcacgaacagcccatctcaaaactatatacgctgtgatgataaaattaactgtaacaccttttgttattatcctaagggctctgtgaatttcaagtttggggttctttttgccaaagatgggcagctcactgatgatgagatgttcagcaatggtgagtgatctcctcccgctctctgctgccagagaccctgtcctgccttgttgcattcttgccagttggagcttaacttgtctgttgagttggagtctttaatacgaggagatagttttacacaatttcagcgtgaattttgtagggcagttgttgcccagtttcattcatttggcaaatatttattgatcacctcgtttgtacccagtcactgttccgggcactggagagacagaagagcacatgggatttggagaatttggttctacacagtcccaagagcagtggaagatttttctgtgatttttatgagaggaagaattataagatggcgtcatcttcctaatatttagcacttttcgtgttaaatacctgcttattctgaacgcaagcagtaataacatttttgttttgcgatagtaaacacctgtggtccca

SEQ ID NO: 135354 - DNA, 1035 bp, Homo sapiens
agcttgctagccgcacgccctggcagggctgcttggtctatgccctccatgaagatactgctttccagcctcctgccaggtatgctgggcattgcagctgctttgctggctgcctcctgtccccacctgcaactcctccccactacagtctttgcctaagtctgtcactgttgccgtgcagctctgagacatctagaatgcccctctcttcactctgtccgtcctggtcacctggcctcaaggaagcattgactgagcccaaagcctcactgagtcctacgtggacaagtgttacccaacctccaatcttaatcctactccagtactggcccaagccagtccctcaggccagggcaagggacaggcacatgttgtttctcctctgtcttcctgtctccccagtcactccttcacagtcccaaacatgacttctcctgcacagaaacagtgccaagcatgagtgtcagttctagtcaccagaaacatccaagtcctggccaggctgtttggtagcctctcttccataggaaacccctcccttccctttcagagaccttggcatgattccacaactttgtcctggagaacagagacatgaaagacacctttgctgaggctccctctgctttccagctgggctgcctctcttcccagctggaccaccagcgttgttacctcccatactccaacctataccagggtccatgggtgatgtctccctcgacacattagaggcagcagacactgcaaaccatgtgcaacagatgatgattttgtctctccctttccagtatttatactcattatttcaaatgctacaacaaggtcccaaactcagatgcctggagagccaggcagggagcatgagcaagtgaggcgggctgagtggaggacagtcaggagtgctgggagctgtgacacacttgagagcatgtgctcactccatccagctgaggcctttcagagcatgcaccatggccagggttgccagatactctgagttttcaaatcaagccagaaagctgaaattgtatg

SEQ ID NO: 135355 - DNA, 1049 bp, Homo sapiens
gagtttatatcttagctctaccctgtgtaaactttgtgatgacttttaagcctcagtttcctcatctgtaagacagaatagtagctgtacctaccttataagtaggattcaatgagaacagtgcctagcacatgttaagtacacaaatagattagttagcaattattaatactattactgaatcccaggacaggaccagacgacataagggataaagcagaccatactgttgattgcattttgtttaattgtttcctggcctcgaccctttccagtagacagaggcctgagtcttgaggacaggttatgggaaggagatgtcggatgtgacccctggcactcctctcttgtcccttcttccctgtagcacggggctctgcaggagcctggagagggtgccttctctgtaaggagggaatgggcagtggggcttggcatggagctggctgctctgttctcacccctgtctcttgtatcctcaccaaccacacaggagatctgtctgtctgactctcccatggtgatgaccttagtggatgggccagctgaagagagtgacaatctcatctgtgtggcttatcgacaccaatttgatgtggtgaatgagagcacaggagaagccttcaggctgcaccacgtggaggccaacagggtaagccagcggttgtggggacaagtgagaatcagaaaagagtaatcatcgttgtgtattctaaccctgacatgccatgatttggatttctttaaaattatgtactattcatcacatcagtattatgtgattcactatttagactgagccatgtgaagttaccatttttataggtcagaatggttctatctattatcatgtgactgtcccatttgccctgtttagttttcagatctttccttgccattccatccttccgaataaaagagatatgaaaaggccgggcacaatggctcacgcctgtaatcccagcactttgggaggccgaggcaggaggattgcctgagcccaggagttcgagactggtctgggcaacatggcaagaccctgtctgtat

SEQ ID NO: 135356 - DNA, 1044 bp, Homo sapiens
ggttgttctcccagacggaaactccgccccacctgtaccttggaccgctccgccctaggggcggttccagcgcgcttcgctaatcggttctatgctcccattggtctgctttaatgtgaagggcgggtcctagctgattcgctagccccgccttgcgttcctattggctgctcctgctctgcggttccgatcccgcccagcaccgtcccccaccccccgccgcccattggctgcgagaggccggtgcgggccgcactcgcagggcccgtggcggttcaggcgccagagctggccgatcggcgttggccgccgacatgacgcccgaggacccagaggaaacccagccgcttctggggcctcctggcggcaggtgagctccggggaacccgggcccggatgcggcctcgccctcccgcccctccgcgtccgctccgctcaccctcggccctgtccccccagcgcgccccgcggccgccgcgtcttcctcgccgccttcgccgctgccctgggcccactcagcttcggcttcgcgctcggctacagctccccggccatccctagcctgcagcgcgccgcgcccccggccccgcgcctggacgacgccgccgcctcctggttcggggtgaggccccgggctcgctcctcccgccctgggaccccacgccctcctctcgggacgggcatcgggaccctccgccccccacccttcccctcgggacaggcatcgggccccgccgccaccacctttccccacgagacaggcattgggcctctctgccccccatcccttccctcgggacgggcatcgagcccctcagcccccacccctcccctcgggacgagcaccgggcccctcagccccctacccctcccctcgggacgggcgcggggccccggctcttttacctctgagcccgcggggagtgggtggagggggaggatgggctgcggcttcggcgccccctcctcagcagccgcccgcctccaggctgtcgtgaccctgggtgccgcggcggggggagtgctgggcggctggctggtgga

SEQ ID NO: 135357 - DNA, 1834 bp, Homo sapiens
ccttgggtatgatgcttaccttctctgagcccgcttctttggctgaaactggaggagagtaacagcagcttgctcttaagacggatgggagcattaattcagttcatcctgttgctgccttctcacggatggactggcacaggtgtggcccctgtcccggggcttcccagccaacagagagacagttctggggtagatgatctggttgtttgttcagtcatttgtgccctccaggtctcctggcatgtgccatgtccaggcccattcaaggcgccagggagagcaatgaacaagatggacagggtcccctttatgacaaggacgggaaaggccatggcagtggtgggagaatgaaccccagtggggctgggttaggatgtggtggggcgggtcatgaggggccagcctggagtctgtgcagagcttgggacccgcttaggcaggactgcccggggagcacatcgagggggccaggccgatgcctgggggtggagattacttgctgcagctgggaggggatgcgcagcaaaggaaggaggaaaagaagccaagaaggaggtgacaaaggacctaacagtccttttttaggagagaaaatgtccaagaggccaagagaaggccttcgaggagggagagatcgccaggtcccagaggaccaggagctgagaagcacctttttagttctggcacgtgggaggtcacagtggtggtggatggcagggacaggttctgactgaaggccccatgtgctcctggggccatgctcgctttgccctgtctcacccatttccaccacactatgaaagaacccaccgggggcctcagggtggggccaaagctgagggtggagggttggtctgtgggccctggagtcagacctggaacaggagcccagctgtcactggatagcgggtctctggccttgaggcagtcacttcattgctgtgagcctcagtttccccagccatacgacctcggtatcttggacagtgctcggcccaagccaccagactggatgccagactatcctccatgtcccagagctgggtggagataaaatgggtgtggccttgggcagggcaggctggggtcaggggactggaccccctggtggcagagctgtctcagtgatcgcgtggggcttcctgatctctccccgcgtccacccatggcctttcctctctctgcaggaggtcctcaggccctatggagccttctggcttgcctccgctttctgcatcttcagtgtccttttcactttgttctgtgtccctgaaactaaaggaaagactctggaacaaatcacagcccattttgaggggcgatgacagccactcactaggggatggagcaagcctgtgactccaagctgggcccaagcccagagcccctgcctgccccaggggagccagaatccagccccttggagccttggtctgcagggtccctccttcctgtcatgctccctccagcccatgacccggggctaggaggctcactgcctcctgttccagctcctgctgctgctctgaggactcaggaacaccttcgagctttgcagacctgcggtcagccctccatgcgcaagactaaagcagcggaagaggaggtgggcctctaggatctttgtcttctggctggaggtgcttttggaggttgggtgctgggcattcagtcgctcctctcacgcggctgccttatcgggaaggaaatttgtttgccaaataaagactgacacagaaaatcaggtcagtgtctctgggctttgtgcaagctcagtttgaaaagggtttattcccatcactgcccaggacaccctgtggctttacttgct

SEQ ID NO: 135358 - DNA, 1079 bp, Homo sapiens
ggagcagtggctcacgcctgtaatcccagcactttgggatgccgaagccagtggatcacttgaggtcaggagtttgaggccagcttggccaacatggtgaaaccccgtctctactaaaaatacaaaaattagctggacttggtgtcgggcacctgtagtcccagctactcaggaggctgaggcaggagaatcgcttgaacctgggaggcggaggttgcagtgagctgagattgcgccactgcactccagcctcggcgacagagcgagactctgtctcaaaaacaaaacaaaacaaacaaaaaaaaacaaatacaaggacctcttgatcttggggacagcaccaaattctggatgtaaaattgcacttgtagagtaaaagaccaaatacagttgatctaggggtgaacagcagaggtgttggtggttaagacttaaaagaggttgcctgcttacacatttgttctgtaccacattcagggtgctttcaaaagtgttatttcatttgagaattacaattctcagaggtaaacaaagtagttaacattattttgtcctttcttccatggagaaatacaggttaagagacctggctggtacctcacagctttcacaagaacctgtgccttctaactgcaaattcccctgtcctccacaacttcacaatcctactgggctggcctgcccccaaactttcccgggcttccaggcattcctggctgcttcgagaagggctagaaggagaaaagtgacagaggagtccccaggaacccacttctccctactctccactgtcattggtccatctgggcagactggggtacgtggtacaatactcagaaatcacgcagtctgaggtcctcaaacttttttgacccccgaattctttactcaaaaaaggactgtaggggcacatgttctcaggatctcctggggctgtgtcatgggcaaagaaagaaaaaatgattgtctccaactacctgtaggagagataaagagagttctgattcggctcacacagcggcagtcgtgggcaaacgaagcagcagccgatctcttgacaatcgctccctctaccactc

SEQ ID NO: 135359 - DNA, 2541 bp, Homo sapiens
aaggtgcccttaggtacttgagatagcttcctttgttgccaagtgagaagtggtgggcaggtttcaaggctgtggttcacctctggacaccatgttgattacatgcctttatttctagtctccaaaaaaagttggtgatgacattgccaaggcaacgggtgactggaagggcctgaggattacagtgaaactgaccattcagaacagacaggcccaggtatttgcttgtgcttggtttcgggagaggagggtggggggacaggtagcaaccctctgggattcctgaagagtatttctgccaccagtggtgagccgagagtgatttcaccttgttggggaggctttgtcaagagtacggacctagggcaaagacttggacagtgtgtggccatgatttttgagagccagcgtgcatggcagtattcactggaggtggagtattcactcaggaatctcttctgcagattgaggtggtgccttctgcctctgccctgatcatcaaagccctcaaggaaccaccaagagacagaaagaaacagaaaaacagtaagttgtcttttccctagtttggttttggtaatggtttgtgagatgtttgatatatgtggctgtgttttcccttaaaggaaacctggggttgacatgggtattgggtgttgatatggttagggctgctagagccaggtagtatgaaaaagtgccacgtatgctgggtggctcacacctgtaatcccagcactgggaggctgaggcgggtggatcagttgagatcaggagttcgagaccagcctggccaacatggtgaaaccccatctccaccaaaaaatacaaaattagcctggtggtgctcgcctgtagacctggctactcagacggctgaggcaggagaatcactcgaacccaggaggtggaggttgtagcagtgagccaagattgtgccactgcactccagcctgggtaacagtgagactccgtctcaaaaaaaaaaaaaaaagtgccatgtagtccctgtgtggggcaggccccaatcagtgcatgtgggaggaagatgtcagcaataatgacctataatcaggagaccacatacaggtggcaggtactgggcagtttaactccctggcaatttaagcttgtcatttctctaaaacagtttctgccatgtcagatttgtgaaggcttggttttgccctcagccacccgccactgcacctgaccaggtctctgttggctggtgcaatccagtggtgagctgatagtaaaccccagcttaggaaacagggttgttcttcatgtggatgactctgtgccgaaagcatgggaacagcctagaaatgaaatgaaggacacatgatctgctttggcttcagactttaaaagagcttttgctgtttcctcttctgcagttaaacacagtgggaatatcacttttgatgagattgtcaacattgctcgacagatgcggcaccgatccttagccagagaactctctggtaagagcaggacaacatgtaaccgccataactgtagttgtgtttttcactgagtgataacattcttcttacttgaagggtgctcagtgagacccaagatggggtgcagttttctgggactgaaaggatggatcgtaaattggatgtgtttaatctgggcatcaaggacccatggaagctttgcattccgggttatggaactagatggaactctatattctatattaggggagcaggaacctcattccttccattgcctgctatgaaccccttcagtattccccagtatctgcagattgtgagggactgagccagcacctccaatgccaccatttctttacttaaaggaaccattaaagagatcctggggactgcccagtcagtgggctgtaatgttgatggccgccatcctcatgacatcatcgatgacatcaacagtggtgctgtggaatgcccagccgtaagtgacattttcattgttacagtaggggtgaaaggggggccacccagtgtattcacagagataagctgggaagttttggaaatggttactggtggggtgggataatccttttaaactttttactgattttttttttctttcccacagagttaagcacaaaggaaaacatttcaataaaggatcatttgacaactggtggattttctggtgtggcgtcttccttgagggagctagctcctttgtggggtggtcagtggggtcagggtggcagaacctgtggagaagtaacaagcaccttgtggtgggtaacaaaactgccctgtatgggctgggctgagctcagaaaggaagcctttctttcctttttttttttttgagacagagtttcgctcgttgcccaggctggagtgcaatggtgcaatctcggctcaccacaacctctgccttctagattcaagcaattctccagcctcagcctcctaagtagctgggattacaggcacgtgctaaaagacagggtttctccatgttggtcaggtcaactcctgacctcttgatacgcctgcctttggcctcccaaagtgttgg

SEQ ID NO: 135360 - DNA, 1061 bp, Homo sapiens
gtccctcacaatctgcagatactggggaatactgaaggggttcatagcaggcaatggaaggaatgaggttcctgctcccctaatatagaatatagagttccatctagttccataacccggaatgcaaagcttccatgggtccttgatgcccagattaaacacatccaatttacgatccatcctttcagtcccagaaaactgcaccccatcttgggtctcactgagcacccttcaagtaagaagaatgttatcactcagtgaaaaacacaactacagttatggcggttacatgttgtcctgctcttaccagagagttctctggctaaggatcggtgccgcatctgtcgagcaatgttgacaatctcatcaaaagtgatattcccactgtgtttaactgcagaagaggaaacagcaaaagctcttttaaagtctgaagccaaagcagatcatgtgtccttcatttcatttctaggctgttcccatgctttcggcacagagtcatccacatgaagaacaaccctgtttcctaagctggggtttactatcagctcaccactggattgcaccagccaacagagacctggtcaggtgcagtggcgggtggctgagggcaaaaccaagccttcacaaatctgacatggcagaaactgttttagagaaatgacaagcttaaattgccagggagttaaactgcccagtacctgccacctgtatgtggtctcctgattataggtcattattgctgacatcttcctcccacatgcactgattggggcctgccccacacagggactacatggcacttttttttttttttttgagacggagtctcactgttacccaggctggagtgcagtggcacaatcttggctcactgctacaacctccacctcctgggttcgagtgattctcctgcctcagccgtctgagtagccaggtctacaggcgagcaccaccaggctaattttgtattttttggtggagatggggtttcaccatgttggccaggctggtctcgaactcctgatctcaactgatccacccgcctcagcctcccagtg

SEQ ID NO: 135361 - DNA, 1158 bp, Homo sapiens
ccagccgtcagcctcaggcgcctgcccacaacaaacatggcgacaagggcgtctctggaaggccgggcagtgacgacagttctcgcgatagccgcgttttcctgcctatatctggcttgtccgcgcgatttccggcctctcggctttcggctcggaggaggccaaggtgcaacttccttcggtcgtcccgaatccgggttcatccgacaccagccgcctccaccatgccgccgaagttcgaccccaacgagatcaaagtcggtgcgtgctctggttgtggccggggctgcgggatggagcatccctcggccctgccgcgcgtgcaaagctttccccgtatggggctcttaaagccgctgcctcccagagaccttcccggtgttgcgccgccccggccaagcctcagcctttctgggccttagcttcttcacgtgtaggtggggagggaggactggaccacctgtggcggcttgggagcccgcacgccctagggtaaggcttgtctccgggcgtttcgccccattggcctgggttagcgggcgacggggctctctccacgcctccccggtgtgagtttcggagctgcccacacccgagggaggagcgggtggcccgcctcgcgctctgtgctgtttcgagaagaggcagagggtggcgtgtccaaccccggaaagacgctgagagggctgtggctcggggctccctctgcacagacactaactcttcttttcccccagtatacctgaggtgcaccggaggtgaagtcggtgccacttctgccctggcccccaagatcggccccctgggtctggtacgttatcccctccaaggggcatttttttcacatttgtttcactttaagcgccggctcgtggagtcacgcctgtgccagaggtgccctcgtggcttggactgtcaccctcagtaggcctgagccactgaacaagtactaggtaccttaggaaggtcgtgtgtgaaaaatcgaacctggtgcctttaaattgtaattagctccatgtgtctccactgctgctttagtgtacctgaggggtgggcccaagggggagttttgaagttaggactggcttagagacattgggcagccaacatctgtatttcctcgtcaggaagtgggcatggcgttgttgggagattaaa

SEQ ID NO: 135362 - DNA, 1096 bp, Homo sapiens
ccaagaagccgtgtccgtgtgaccctccatcagctctgggccatcctggccgggatccacaggctgccccgcccgggagccattgagcaggagggcagccagtctccgggggtcgctgtaaatggactgacccctgctgggtcagctgtcttcatggtaaccagagacaggctgtctggagggttcctgtggctcctgagagccagggccgtatggccgtatggggaggagggcagctgggccccgagcctcagtcactcatatttataatggtgagtgtagaggactgatggggcgagagctcctaaggagccgcagtaaggttctgagcagtgcttccacctccagcgacgcaccaagcctcctgaggagtccactgggcaggctgagggcagtggtgccatccccagtttacacacgaggaaaacaaggcccgggaaatcaagtgtgacttgctcaagaccaccccgtgggatggtgacagagccaagaccactgcacaggcgccttacccgcaggagcgctctgctcgccacacccagctctctcccttctcctggctgtccttaagcacttcctgcagagtgcctctgtttatcaactgtaacatatgagtaatgagaacaacagtggcgccccattgctcagccattacagcatgaggggccctgtgcggaggacctcacacatcatctacctgaacctccaatctccccgtgttcttataaggctgggtggcagtgtcatccccattttccaggtgagaaaactggcacaaggaggcaaagccagttgtctaaagtctcttggctagtaattggtggagtggggacttgaactggaactccaccttcttgagcctaggaaacctcagagcccaggatctgttgtgtgccctagaggtcagagtggctcccagcgggcatcaggcaggaagctggtgatggggatttggggtgttgagctgtgctattggggtctctgcagacaacaagctgaaggagcttccagacaccgtgggggagcttcgaagcctgcgtaccctcaacatcagtggaaacgagatccagagattgccgcagatgctggctcacgt

SEQ ID NO: 135363 - DNA, 1055 bp, Homo sapiens
gggtgctgaaggtgagcggccccacgccctgccccggaccgtcctaggcgaggccgagccccgagcctcatccccggccaccaccaggattgctgtccctgcaaggaggcgccatggtcctcttgtgcggatgaggactcggaggcttgggtcagaccactggcctcgtcctaccctcagggccaatggagcccactgacctgcagacccccgacccccttgttccctgcagaaatacgactacgacagcagctctgtgcggaagaggttcttccgggaggcgctgctgcagatcagcatcccgttcctgctcaagaagctggcccctacctgcaagtcggtgagcagcccccacctgctccagccgtttgggccctaagttgggggatggagcccacaggcctccctctacccttggccctgacctctcatctctgccgccccacccgggcaggagctgccccggttccaggagctgatcttcgaggactttgccaggttcatcctggtggaaaacacgtacgaggaggtggtgctgcagaccgtcatgaaggacatcctgcagggtgggtgccgtcccggggtggggactgttgccaggaggatgctgggggcgcagctgagaagtggtggcagctgagggggtcagctaaggctcaaagaaaagcccagacttgcacctggggtctgggtgaagcccactcttcgctgtgtggcctccggagcagccttagccttgcgtctctgtgctttagtttcttctcgcgtccttggctttgctgggagggtcagaggagtgattagatgacatgtggtcagcagcctgggcctggagatagcatcacggccttgctgctttcagcaacgaggcctggaatgagtcacatcccaaccacagacccccaaggcgggatgagacgggtcttctttgagcagagtccagcacaggggcggctgtgggatcagtgctgtgtcctgacccttcccctgtggccctgtagctgtgaaggaggccgcggtgcagaggaagcacaacctctaccgggacagcatgg

SEQ ID NO: 135364 - DNA, 1093 bp, Homo sapiens
gtgcctcctcaacctagatcctgagcaacctggtgatggaggagctgggccctgagctgaaggcagagctcggcccgcggctgaaggggaaaccgcaggagcggcagcggcagtggatccaggtgggtgggcctggggccctggagcggggacgggacctgcagctggtgcggtgccctcagccctggtgccaattcagctgctctgcccacagatctcggacgccgtgtaccacatggtgtacgagcaggccaaggcgcgcttcgaggaggtgctgtccaaggtgcagcaggtgcagccggccatgcaggccgtcatccgaactgacatggaccaaattatcacctccaaggagcaccttgccagcaagatccgaggtaggcagccacccccgtgctcgacgggccctccaggggccaaggtggactttctttttatttcatgattcatgtaaatttcacagcaatgacttgctcattgatcatttgtaagaattagagccaaatctgcactgtggtactccaacccctgtgagttgttttgtggctattatttctataagcccagaacttgaagagaaaaatttttgttctggaggttcaagccttcttttcatctctgactcgtcacagatttttaccatgtgtcattttaaagtacatttacgttcagcaagtatagctttcccaggtcagtttattctgtcacccaggctggaatgtagtggtgcgatctcagctcaccacaacctccgcctcccggattcaaacaattctcctgcctcagcctcctgagtagctgggactacaggcacacgcgcgccaccatgcccggctaacttttgtgtatttagtagtgatggggtttcaccatgttggccaggctgatcttgaactcctgacctcgtgatccgctcaccttggcctcccaaagtcctgggattacaggcatgagccactgtgcccagactgtacgcctttctcttcccagccagatgggatcctttcaccagcttggtccccataacacatctgcagagctcagttttagcaattgtcagttgcccatgggacgttctttttattttatttta

SEQ ID NO: 135365 - DNA, 1078 bp, Homo sapiens
tgttccaggcaaagtttgaagggccctgatctagcagtaagggaggaactggggctcgaacaagggtctctgggtgcctctagggccattctgggtggctgcttatgggacgggagcttttagtcctggctctgccactccctgctctgtgaccctgggcccgtggcctgtcccctaacggttgtctcttcatctgtaatcatctgtaaagcaataaggtgaatgatagtgcccaggtcttggggtggttgggaggatttcaggagctaaggaggaggcaagggggctgccttgtcactgttggtggtggggtcattactgcttttgcctatcagatacaaccatgactgctctgatgacgaggaaagtgagggtcccagctgcccctcctgaggtgcatgccatgtgtgtggggggggttttggtcagttctcagttggtcttggtagaggccactgggccatctgctgacctcctctctccctccgtctcctgggcaggaatccctgaggactccaaggtagagggccctgcgttcacagatgccatccgcatgtaccgacagtccaaggagctgtacggcacctgggagatgctgtgtgggaacgaggtgcaggtgaggccagacgggctggtgaggaaacctcagaagtcacccaaggacccagcaggggagggcagggggtggggtacagagatggggctctggggcgctgccggtttggaaggagatgacatgcttagatttggacaagtgcagggccagtgcacgtggagatactcgctgtcttattcatcacttactgggcatctgagcacctaccctggacgaggcactggggtgcagctgggaatgatgtggacaaattcctggccctcagggagctctccgtatagcaggagaaacagacatttggcaaataaatgtacacttccatgtgcaggcaaagcagggagggagtatggtattctaggtagggaaggcagcctgtgcaaaggccctggggctggcccttgagtctgaggatcctacaggacacccaggcagatgagttgggacctgtgggaatggagctca

SEQ ID NO: 135366 - DNA, 1043 bp, Homo sapiens
caaggctctggctgcctggcccagggccctcccgcctccccagcccctggcctggtgccatctctccaggtttccaaggctaacggctgacctggcctggcagggtgggtgacctgcgccagatagggaaggggtgggcacagaacaaggtggggaagggccacctcagtcccccatgtgtgcagtggggatgatgataaacttgagcttgagagatgattgggaagagctggtctgggtggggcacttggccgtgggcctggcacgcacagtgagcactcagtggggaggccatgggggagttcttggttctaaggtgcagtggaccagagggaggcccaggagagctgctgggccagggaatgaaggggtgtcctgtgccaggaaggtgtcctgccgggtggccccttctccccagggcgggagctgacgaggctggtttcaggccttccttccaccctgcggactgtgagaaagttctctgcttcctccgtcttggaggctgggcttggaatttgtgaagcctggaattgctcactccgggggctgccaggaagtggggggtggggggaaggaggccaactgggcggacaccagcggtcccagggaccccttcacatcctgcattcctggagcagctgggggtggcaggaggcagctggggcactggctgtgccgggtcctcagtgttggcctggggtgcagaggtcaaggcttcttcctgtctgaccgtggtccccctctgtctgctgcctgggagtgaggaatgcagtttcctttcttggaaggtctccaggtctggctagagtcagctggtcctgggttcaagccccgctctgccatccactagctgagtagcctcgagcagtaactgcctctctgagcctcagttctttccctgggaaaagtagggcacagtgagctgaggattcaacgagctgatgtgtgtgcagcctcagccagggctggggcctcagtttcccaagactgccataacaaataccacagaccgggcagctacacagcagaaatatgttctctcc

SEQ ID NO: 135367 - DNA, 1463 bp, Homo sapiens
gccacactttggcctccacagccgaaatctgaagggaaacccaagaaggtagtgcttgacccttgaacctgggggctctgaccttgtgttgtttgtgctttacagagtttaaaacctaacccaagagtggggtggatgtgacttattacccactctaagaaatgggtctgcacggatgctggactcaggttttgggctgaggagaacacagccagaaagaaggctgctcccacccccgccggcttgctggtcaccttgggacaggctggccttctctgggcctgagcctgacctcagagctgatgccaagggatcagttctctgacatcctctggtggagggcaaccacagagggcagctgctcatcaggcactgtctccacagggaccacggcaaagtcgggcagtgcccccatcctcaagtgccccacacagttcccgctcatcctctggcatccttatgcgcgtcactactacttctgcatgatgacagaagccgagcaggacaagtggcaggctgtgctgcaggactgcatccggcactgcaacaatggtgagtggcctgtgggtgcagggtcggtgggagggaggggcaggacctgggttattgctgaatggtgacacctagtggctgactatggtgtggcaaccctgctctacaggctgttctaatttcccttctggggttataagaaaccatgtaataccacccttagtcttctttcttgatgaaaacagttttgtgctgctcaggaaaaaagtaggaaattattcacagaggggtgtggttgttgagcccttggaccctgagtcacaaagtcacaatcctgattctgccattttccagctacgtgaccttagggaactgacttacctcttggaggctctgtaaagtggggataatgccttgtgtgtcttaggggggttatgaggatttagagtctacctcatgcttggtaaagattttttttttaattttatatatatatatatatatatatatatatatatatatatatatatatatatatatatatattttttttttttttttttttttttaaaaccaccaacctgcagggtgatttggaaacttcactgcctccctcagggcctcattgctctcatctgtaaacttatggggtgactcttccagctcactcatttattcaacaaacatttttagtgtctactctgaggaggcccagatttaggcactgggtgtgcaacaagggagcaagaaacattccctgccctcctacaattggcagtctggtaggggagacagatgatagacagatgaggatgccagcacgatggctcacagctgtgctgggtgctgggtggagccaacctgggagcctgagggtgtgtgtgtgttgggggaggggtcgatcagggcaggctcccttgaggaggttatggttcagcttcagcagagacctgaaggagaagtcccagacc

SEQ ID NO: 135368 - DNA, 1044 bp, Homo sapiens
caagaagtggagaaaccgcttcagcctcgtgccccacaactacgggctggtgctctacgaaaacaaagcggtgaggcctggccccgggcgccacactgagcctccccgctttctccatgtgtgccccctcccccaactcggaaacttaggccccagacgccaccgtcacagcctgcacgcggtcaccagggccagagcaccacctcagcccctcccctcccccaaactgggctgccctgggtgccctctctggacggcagctcattcttcatctctggggaatatcgctgactccttctgtccctcataaaccaactgtcactcactcctccccatccctcctaatctctcttcagtccctccagctggctccagggcgttcctcctgccacctccttcctcactgggcttcctgcctctcctccgacccctcccaccctcgacagccacagagagctgttggaggcacaatctggccattccttgcggtggcttgcccctgccctacaggtgggtaggtgtccgagaaggacatcctatgggagcattgtgccttatcttttccctgagccctcagggaagccccacctggttgagccacagacctgatttcttcaattgctcatttctccagagcagccagaaggacaggcctgggccctgtatttcacggaagatcaatgttagagcaacataaagtcaagagcaacctcgtgccccagagtagtggttctcaactggtagcacgtccaaatcacctgaagggcttgctgaaagacacggtgctgggctttcccccagagtttgattcaggttgggagccaagatttgcatctcttttttttttctttttttttttttttttgagatgaagtctagctctgtcgccaggctggagtgcagtggcgccatctcagctcactgcaacctccacctccctggctcaagtgattctcctgcctcagcctcaggagtagctgggactacaggcgtgcaccaccattcccagctaatttttgtatttttagtagagactggttttca

SEQ ID NO: 135369 - DNA, 1192 bp, Homo sapiens
gctcttccctgtgtagtatcgggaaagtcacttaacttctcaggagcctcagatcccttatccataaagtgggtttggcagtacgtcccagtgagggttaaatgaaacaatgttgactataatttttagcatatatgggatctgcctctgtgcctggcacagaactaactgttacatgcattagctcatgttgcaattatgattataattttctgcaagtggggaactgaagaacagtgtgatggaggagaggatgggtgagcagggccttgaaagtctggctaagattgtgaactgtggaattgaagggaagggcggtccagccagaggacacaacatggatgaagatgtggaggtaggaaatgtgtaatggaggcgagagacgcccagggtgtggggatgggaaggagagcggggctgaggttgcggatcttggatgtgattctgtgtaacatgcttgtgggcttcagtgtgccaggcctgtggtgacaagttagtccatagtctcttggggccatcagagcccagagagatcctttacaaagtgcttcatgcaaccatcttccagatgtttccacagcccgtggagtctaggttcagccagcctgggctcacaccccagcttggattttggctccctgcttgacagccggctgacctgggacaaggccctggaccttccagcctctgtcttgatcgggggtgattcctgtaccacttcctgcagctgttgtccgggtctatgtcagatggcgtgaggtgtccccagccagcgtgacacccattagcttcggggtaggagggctccctaactgttctgtgcctttttgttcctggtgtggagacagagcctttctccctgggccattttgagagtcgagaatgatctcgcactggaagtccctagctgagggctggctcacgcagggtcacacggctgtcattgtcgggccttggcgtgctgagggatgctgtctttaagggaagaggtttttccttgttaataactggccttggggccaggcacagtggctcacgcctgtaaccccagcactttgggaggctgaggcgggtggatcacctgaggtcaggagttcgaggccagcctggccaacatggtgaaacccccatctctactaaaaatacaaaaaattagccaggtgtgatggtgggtgcctgtaatcccagctac

SEQ ID NO: 135370 - DNA, 1054 bp, Homo sapiens
cgaagaccgattcatctcccagcccaactcttcccgtgctctgcttccgccaacctgggcatttagagggaggctccttcctgccatctctgagcatcgttcggggctagtgggcttgaaggggctgcctgtgtactggggacggggactgatgaccatggcctctgggtgtgtggccatagagtctagcctgcggtgtgtaggaatggatatatattttctgtctgaagacatggttgatagagcagggaggggcagtaatcaggctcggagtgataactgtaaacattagcaacggtttaactgagcacttgctatgtgccaagccttcctttgtctgtatcatcttattgaattcccacctcagtggcaggcctggatcggatagtccaaggccttagctatttaaaccacgttctgctattagtatgtcatccgtggtgcccagactgggcagggggacactgaaaaaggcctccaagagaggtaagctttcggaggcggggagaggaagtgggaggaggagccgagtgggaatagagcagcttgtgtcagtctccctcccataggttgcacaaatctatcccacccgtcattactcagtctgagactcacagcctctgaccagccccattctccgtccctgcgcccccctcctccttccccgcgggcagagctcatgactcactgcaccccgggctcctgcaagcatcatcctgcggttgcagaaattcctgcactgctttttccttcccctgccccaccccatccacttctgtgctggaggaagaagggtattctgtagacgctgctgggcagaggtttaaggaaggagtccgggcagatgcctaggtttaaaacccgtgagggtggagcaaagccattctcttctcctggtagaatcttagggcctgagtcatggaagggtacaatcttttgatctcaaaaattttaaaactggaagaacaggaagtgtccaccccctgggactggtcccatttttttggagctgggctgcttctggcccacgaaggtgaaggggcctgcctggtga

SEQ ID NO: 135371 - DNA, 1211 bp, Homo sapiens
ctattactgcacagtggccacttctcccagggacagctgtccccaaggctcctggggaagccggagctgcagagggggcctgggttccttttccccacagactctggagaacagtgagataggatgaggatctcggctgcctgagaaactcctctctggccgatctctcctggctggtggagctgccctgggtggaatcccagcatttgcttcccagacatctgtcctgtacaccttggttttctcctttttgaaatggggtcagtgatttcttccttattaatgagttgttgggaggcttacgtgaagtaactcatgtggcttgcttagcacagagcctggcataggagaggcacttgtatgtggggtgacggttcaggtgggtcgcccctcgctgtctagtgggccctgagcaccgcgtccgcctgcacttatttttgtgtcctgtagaatttcaccaccgtgttctccacgctcccttgagagcaggaagccctgagagcagtggccaggtgtcctttaactccatgtctccagggccgcacccatgctgggcaccagggaggtgctggggagatctgccaagtgactgtggtcccgggccaagtcccaaggccagagtccctcccttgtgccaggcctggggctggctgggcacaggggtgactggggtgatgtgaaaatgaatcggaccctctctagcctctgaccagcgtggggttaagtcctggaaagcctccttatccgaccaggcctggactgtgggaggaggaagggccagggcggagtcttcctgtcccctccctgtcgcagcaagctcctggggctctgtaacagtccctccattcaggacctcctgttgaggcccctcgaggggcctgggtggggtgtgccttgcattcggtggggtttttcctctccccatactcagtgctgggcctccctgtcttcccgtctcctgggctgagaattgccagcccaccctctctcccctggcatgttacaggggaggggactgagaccacagaaggtgaagtgtcctttactggagagggttggatttattttctggataccaggctgggtggaagaaagttgtgcccactcagagcctgctggtctctctcttctccacacttcagtgctatttataatcctctttaaatgcctcgaattcctggtccagactcacctgaggggagttcctgatg

SEQ ID NO: 135372 - DNA, 1028 bp, Homo sapiens
caggttcctgccaccacgcctggctaattttggtatttttagtagagacggggttttaccatcttggccaggatggtcttgaactcctgacctcgtgatccacccaccccagcttcccaaagtgctgggactacaggcatgagccactgtgctgggcccttttttttttttttttcttttgagatggagtcttgctctgtcgtccaggctggagtgcagtggcgggatctctgctcactgcaacctccacctcccaggctcaagcgattctcctgcctcagcctcctgagtagctgggattacaggcacccgccactatgcctggttaattctggtatttttagtagagacagggtttcaccatattgatcaggctggtctcaaactcctgagctcaggtgatccgcccgccttggctcccacagtgctgggattacaggcgtgagccaccgtgcctggctgtgtgaaacatggatttttttcccgcatcttgccccaccaagcagcattcagccttcaacctcagctaattacccttcatcagagaggacatttctgcaccctgcccccctactaggtcaggcctgccattattatcaccccctccccagtgtcctaaactcctccttcatggcaagcatcacattcaacatgattttgtgtgtgtgcaattatctgtttaaataaatctttctctctgaggaccaggactgtcctccttcgacatgacatcactagcgtcagtcgcaatgggagcttgagggagcacgtatgatgtgcagaacactatcctgggcactggaggggaacgtgacagtgagggacccacctggtccttgggacctcacaggtttgttcatagacctatactgaaacactcatgcctgcagtggccatgacacatcatggggtacaaagtcccttctatagtgcatgtgggcctctgctactgtgcagagcttctgcttgtaaacttccaggaagggggtgccttaccgccttcccaggcacaaattccgtggttggat

SEQ ID NO: 135373 - DNA, 1045 bp, Homo sapiens
cttctacagaaaataagaagctactatatattatttgctgtgacctttgagaaggtccctgaacacggatcccaggccactaagaagtcctggatcctggcatccaggcctaccctgggggctcttcctccagccctacccctcaggctttctcctctctagtcacaatgtcccttctctgttcctggaagagccaaactcctttctgccgctgggtctttgtacctactgtatatctgcctagacactctcccaggtccctcttaccaccgttttcccatctcaggaagccagctctgactgtaccccagccagtccactgggccaggtgccttgctatccactcttacagccccttctccatctgcttcagcacttgtcagaacagtcactcaatgctgtaacaccttgtttcctgtctgtccctcagctagaataccagctccttgaggacagaaattgtctccatcttacccacagcacatggcccagactttggccgcactcaataaacgcttgttgacccactgactggatgagtgacaagaggagcccttggccattcctactccttagctgctaaggaattttccagcttcaaatttatattttcatggcagatacagaaactgtggagtctctgctgatatgtgccagctggcgaaggaggaagcatgtggcattaccagtgcatcctaggtctccccatgtttacacactatctcctcctccaaatacacacaggggctatcaatatgtttcctgggcaaaaggcaaggcccagacatagagagttgacacattaacgcctcctctctctctgaacccatctgaaggttctgttgggggtagattggggtggtggtgagaagatggtcaaatctgcttgacttggggctggcgactgaagtaggacatgtagcctcttgtcctggctcagccaccactggcttctgtgactttggaaaattcctccttagttctcagcaggttttttgttttttgttttttgtttttgctcagtataagataatggttcagaatt

SEQ ID NO: 135374 - DNA, 1069 bp, Homo sapiens
cccaggtgagcctgagtagggggtgcaaaggaaatctgcatcctgtcttattctgagagggtggggtgggacctactaaagagttgaggagggaaggtaccatgctctgaattgccaaatgacaggttagaagtggatgtttactgaatggaaatagtattccatagggcctgccccctgccctcatcttactctccagttgtttctgactttgcttcagccttgtgcctttctttgtgtgcatttcatccttgctctcagtgttcactcctgtcggccgactccttgaataaccactaagtagccaatcagaaacgagcttggaaggagagcgagggtggggagcagaagcatcccatctgctgcgaaggagactgttttttacgtggagataacctcagcttgtcatgtgctgagagagcagatggcagccttcgtcattagccgttaacacttcaggtgccaaatgccaggcccataaagcactcccttggaaacaaacaaaattattaaacaaataaaggtgaagctgattgtgagagaacagacacaacttgtctcggtattttgagagttgttaaaatgtcttctcttaccagacaaggaaacaaaaaccacaggactttgatgcattttacggagctaaaagatgattgtggcatattggatctttacagatcagcttcgagacaccagagagtgacctattcttagagaaggagagatgcataatatatagtgtgaacatttaaaaacaggcttccttctcacttggcctaaagcctgtcacccgcttgggggaaggaatttttttttcttctgtgtgttccatccccacctggatagaacaaaatccagctttagcatattgaacaatcttatatttcagaaattttaagaaagtaaactatttttcgaataccattttttaagattaaggtagtttatataaacgagaatttaagagaatactgataactggaagactcagtcatttaagagagaatcttcaacttctagcatactccaaaaaaaaaaaaagaaacagaaaaagaagagacaaatacgg

SEQ ID NO: 135375 - DNA, 1074 bp, Homo sapiens
gtcattgtagagttaataaatggtatggagtagatggaagaggacagggctggggagagagggaaagctgcttggccttgtggccagtttaccagagctatgcccatcacgtatttttaacttgcatcacattggtaatctctgcctttaaagaactgacttttacccagttcaatcacagtttcccaggaatgtccattgtacaaaagatagataataagactcttgtccaatttgaccttgattcagggtgggggtgggcaggggttgctgagaagccggggggcagatggaaacacagactataggggcagctgctgatggtcctcactcaggcagagtggctggaggggaatcgggatcctcgtgttgtcctcacctatagtgaatctgatgaggtgggggagcaatgtccactaaccctgaggggagaagggccaccatccggcctgtcccattgggtgcatgggggctgtgtgtggtgatcgggtgtcttgtgccctcaggcatcacggaggaaaacctgaacaaactgatccagcacgcccagatacccccggaggatagtgagatcatcaccaacatggctcacctcggcgtgcccatcgtcaccgatgtaagaggccagctcagcttccgggggaggtgggaagggagctggcagatctgtctgcttctgctctgactgacatacagcatctctgatacacactcgtacgtcaagagagagagacacagaatcagagggataaaggtgtaaagctatatataaatcagagacacaaagccaagaacctagacgtcaacagcagtgagtcattcacagttgtgaaagctgagatgtcttggaaccaaaccataacaggggtccccgccattttatctgtcttgtctcagggtctgtctggcctcacctttggacagcttagcctcagtgtcccctgtgaagatgagaatatgacacttagagctagcagtttggccacctttgagtcttctgcactgggttggttcagagccaagtcagggcaggttgtctgggaggcctggaccacgtgatgtgctctagaagag

SEQ ID NO: 135376 - DNA, 1229 bp, Homo sapiens
tccctggcttcacctggagtttaagagtgaattagaaacgcagctgcccatcacctgcagatggctctgcaccctgatggtgaggcagctcgttccttggtgcagcctgggaccctgcctgagccagaggatgtgttttgtttatccacagcccccaaatatctcccaggcctattgcgacgggaccccaaccccaattctgactcccctccctgcttccactatacccagaccagggttggggaggggggtgggtgcagatctgggaatcgagaagcgcaggaaaggaagtgttggaaaccagaactggcaagctcactgtcttctctgcctcctccaggatccacacacatcctcaccccacagaaactgctggacacactgaagaaactgaataaaacagatgaagaaataagcagttaaaaaaataagtcgcccctccaaaacacgcccccatcccacagcgctccgcagcttcccaccaccgcccgcctcagttcctttgcgtctgttgcctccccagccctgcacgccctggctggcactgttgccgctgcattctcgtgttcagtgatgccctcttcttgtttgaaacaaaagaaaataatgcattgtgttttttaaaaagagtatcttatacatgtatcctaaaaagagaagctcatgtgcaattggtgcacagcaggagaaatttctggactgttaggatgaatggacgccttctccccgttatttaagatttgtgaccttgtacataaccctgggtgacgtgcacattgcttgggtatggaacggtagaaatttgggtgtttttaaaaccttgtttggggttgttcctgtccttgttgagaatcatagagatgtctgtgttcttggagtatttcacactgaggactaatctgctatcttcattccagtccctacccctcagtgcctgctctcatccaaataacctgggaggtgacaatcaggatatctcaggaggtccaaggtggaacagacctctttgcctttcccagcgtctcatacccccggtagtgcagctgtgggtggaggctggggtgtctgcacgaagtcaggccagcgtcctcctccacagcctgtcactgccccctccccagcctgtgtccacagtgctgtgatcccgagggaagtcctccagtctaagtcacagtgccctgacaggtgagaagcaaactcccgctggaagcctccatctctttggaaaa

SEQ ID NO: 135377 - DNA, 1167 bp, Homo sapiens
tgtgtggggtcatacatcatcgtgtttgtaagagaagatggtcattttattctctgtataaaacttagctctaaagcagaaactaaagcagcaaatgcaggaaggctgtctcgccatcctcaagactcagcagctctcattctccagtggtgagcacaccatttgtgctgctgctgttgtcgtgaaatataataacagtggaagtcacaaaaatgtcccctgcccagccccctcgccgcccttgacctcctgcaggccatgtgtgtattacttgtctagtgatgtcctctcaaagtgctgtacgcgagctcggcgccacctccgcctccctttcagagcctgctccccgccctctctgctcgctgcattgtggtgttctcttctcaaggctttgaaatctccccttgcactgagattagtcgtcagatctctccccgtctccctcccaacttatacgacctgatttccttaggacggaaccgcaggcacctgcgccgggcgtcttactcccgctgcttgttctgtcccctccctcggaccaaacagtgctcatgcttcaggaccttgtttgtcgaagatgttggtttccctttctctgttatttatataaaaataatttatcaaaaggatattttaaaaaagctagtctgtcttgaaacttgtttaccttaaaattatcagaatctcagtgtttgaaagtactgaagcacaaacatatatcatctctgtaccattctgtactaaagcacttgagtctaataaataaagaaatcagcaccccttcccggtgtccagggggctccagtctggctttcctttgggcaacggaaggagaaagcttttgcagtggttcatcgcagaggaggcgaccacctccggctgtggcatggagtcttctggacccaggtccccgttgcttgcgttagatctgtagccgccttacactggggactagccatggagcttgtcttgggcccctagcagcaacagcgtgctgcctagagatgaggccattcttccaccgtgtttctccttatctagaatgcttttctttctttccttttttttttttttttttttgagatggagtctcactctgttgcccaggctggagtatgcagtggcgagtctcggctccctgcaacctctgtctcccggtttcaagtg

SEQ ID NO: 135378 - DNA, 1027 bp, Homo sapiens
cacgagctagcatcgtgggcccagggttctaggagctgggaaggtggggaaatccatttaccctcaaaatcttgaaacctcccaaaggtacgtatgaggaaatgaggctggggtcgggatggggtctggacatcccaggggaggtcagaacacaggcctaaggccccatggccaaacctgcatgggggccacctgggcatgggcttctgacccagggcaccagactcctgcccgccagcccacgcaccgggctagccggtcctccaggtctcggatctggatgtggtagaactccttcatctccttggccagaggcggctccacggccaccaccggctccttcttgccccctttcttcttgacttcaagctccttgcctgccttgctcacactctttttgggagccatggctgatggcaaccagggctccaggccccaggaagaggccaggtggttgctaaggaagctggtcccgtacatagcaacaggccgagggagtgaggctgggcttaaagggaccctgccctcttcttgctgggtgccggtaccaggtcccactccaaggcagatggcatcagtgaggccccaggcccaggagtcccaggccatggcaggcaggatgcctggctcccagggcaactttttgggcttctggggacaaccctctttctcccacgtggaaataagcgccatggggaaagttcatgtgggtcagggccctggaaatcgccatcctttcctttgtgctgatcagaagatggacgacactaaccctgggcacacaaagcctgttctgcagctgtggcctggggtgacagtgtcctggcatgggtgcattggggcgtccagctgatggggccctggctggcagctgggtgcctctatgagctccatccccagccccaatctcagccagccatgcctgtgtgcctgcctgtgttccccaccagcccaggcactcactccgtgggacagcgggcaggtcctttccatccctgtcatcccagggcttgtcacttagcaagag

SEQ ID NO: 135379 - DNA, 1064 bp, Homo sapiens
agagtaagtgctcaccaaaagctgttagtgagggcacttttgtcatatagaagaaaaaaggagcatggaaaaggcgctttgcaaggtgtaaggttccgcacaagtttttgctgtaattgttacgtcgccctttgtggtcgtgatcctttatttattctttctgagccactacgatggtcccctagttaccgtggccatggaaacgcggcccgccgtcccggattggacggttcgcgggttccccctggaggccaccttctggtcctgctgcggaacgacgggcgggccttggaggcggggagaggagcgtcgggagttgtaggcgatgggcgtggctgctgcggagcggtgcacgccgggagttgcagttcccgggcgaggcagttgactgccccacaacgagctcgggcctcacccggatggcggctgcgacgcgcggctgccggccctggggctcgctcctcgggctgctcgggctggtctcggccgcggccgccgcctgggacctggcttccctgcgctgcaccttgggcgccttttgcgaatgcgacttccggcccgacttgccgggtgaggcgccagggagcccggagcgaggggcgggcggacgcgggcagacgcgggagcgctgggagccctgggagcccggctggcgccggccagagaagctgaggacccagagggtgggaccgaggggcggggcccgcagacttgggagggtggagggtacccgttgaggtccaggaggccctgccaacctggagagaggcctcagccagcagaacccttggtggaagttcttgggcctccccggaatggcctggccgtcaaaggagaagtgcagtgcgccttggggatgggcggggtctgcggctgaccccgttgacagctcgcatttagagctgagtgcaatctagaggaccgcctggtgggggcgctgccgagctgaatcaggcccgaaggtggctcttttccgccacagaccccaaggtttgcgtgccatgtgcataggcagcttggacaaacgtaaggacacaggagtcccagaccaggttccagacatg

SEQ ID NO: 135380 - DNA, 1054 bp, Homo sapiens
ctggtggggaggagcctgaggcccgtggtgggggcggggaggggctgcagagaggcgcccgtgaggggagcgggatctctccaagggacgcccaagtgaggagaagggactgagggaaggaagcagaggctccgaacgagacaggctgccgggtggcggggtagccgcgtgccctgggtacctagcccagccccgcccgggaatctctttgctgctgcccctcctcctgtagtgggggaggggcgggccctgcggaaatggcctgatgagttctcgggtctccctttccgcctgcagggaggtgttcaaggccaggcaccgcaagaccggccagaaggtggctctgaagaaggtgctgatggaaaacgagaaggagggggtgagtacggatcgggcgtgcgggccggccggctaactgcccgggaccccgggtcggttttccaccctgctgcttctgggagtctcaggttgagatttaatttttttgtagtagttcagaaatttccagggaatgtggcttccaccctaaaactaaatgtttcattcttaggcagttatgggtgaggccaggagggggagttgatgcatgcatcgtgtgcactttatttcacgaagttaggaagcctttaaacacctttttttagtgttaaatttcgcttaatgtaaaagaaagattatatatgcatgctttttgaaaggtgtctgatactcaattatttaatgtatttaaaaggagcggtcccttctccaccccatcttagctctagtacaacttcccataaaccttcttttgcgtaatgtgcattagcaaggacatttttaaatcatcatgtttgttgccaacgaaacagccatagagctgaaatttgaagactgaaaccgccgagcgtttagtggctaatagcaaagtattgctgtttcagtttgttgtctcaaaccatcatcttgaagtgtgcatgctactaatatccattttatagacaaggcttctgagacagctggtttcagagcccatgatcttgctctgtctcccaacttggctgtcagtacagac

SEQ ID NO: 135381 - DNA, 1024 bp, Homo sapiens
tgctggcatggcaggcgggcctggtactggccttgttgccctggcttggccactggtctgctggctgtctctgtgcctgtggaccctgagtgagccttaacctactatctgggcactgtggttgccaggatgccgtgcgcatgctcaataccctgcagaccaatgccggctacctggagcaggtgaagcgccagcggggtgaccctcagacacagttggaagccatggaactgtacctggcacggagtgggctgcaggtaaggtagagagggcctgtgaccacctcccacccccatttgtgattcccgtagctgaggcagggaccttgtctgtctgtcccaggtggaggacttggaccggctgaacatcatccacgtcactgggacgaaggggaaggtgaggggcaggaccctggggtagggggtctattaagtggctggtggagtagagcctgcccagacaatcccttttctttcaagggctccacctgtgccttcacggaatgtatcctccgaagctatggcctgaagacgggattctttaggtactggcttgtggggggatgtggtgtctgtgtcccaatggaccctggggggctatggaaccagccagtgcttcaggaccagggtcacccccaggaggtcagctgcatgtctctctgcccagtgtttattcattcaataaacattcagttagcacttaccatattggcccatgtttatggcaacctttaattttttttttttttttgagactgagtctcactctatcgcccaggctggagtacaatggcacgatcttggctcactgcaacccccgcctgccaggttcaagcaattctcctgcttcagcctcccaagtagcttggattacaggcacctgccaccacaccaggctaatttttatatttttagtagagatggggtttcaccatgttggccaggctgttctcgaactcctgacctcaagtgatccgcccacctcggcctcctaaagtgctgggattacaggtgtgagccacggt

SEQ ID NO: 135382 - DNA, 1092 bp, Homo sapiens
aaaaaattggggaaggggcagcaactttaatgtataaactaaatatgtagcaggaggtccagtgtggtggctcatgcctataatcccagcactttgggcagctgacatgggaggatcacctgagtctggggaggtcaaggctgcagttagcagtgatcatgccattgcacatcagcctgggcgacagagcaaactgctatcttaaaaaaaaaaaagaaaattacatagctggaatagtcagatggtcagatgtctctttaataacttaaagtccaggttgagtgtggtggctcacaactgtaatcctagcactttgggaggccaaggtgggaggatcactggagctcaggagtttgagaccagcttgggcaacgtagtgagacttcatctctattaaaaaaaaaatgaaaagaaaaaattttaaagtccatatataactttaaaatcacatagagatatttatcaattagtatgtctttagagtaaggagaaaattgccttgcaagggcttaaacgataagggtggcttgtgccatccacgttaaggtctcctaggcgggctgcagataggagcccttctgcttggccactctccactgtggctttgccctggggcagcgccccctcttggtctcacttgtctagacttacacaagaggatggccaggtggaaccgggatcactcttcctgtgccacgcatgtcttctaagcccatcaccacgaacttctgaaatcagctgcctaaggtcatttcaagccgatatgttttccctaaacagttcttgttcaaataaagagatggagaggaggacttactacctgagtagctttgaggattgaaacataaggcaccaacctgtcttctaaaatcactttttgggccaggcgtggtggctcatgcctgtaatcccagcactttgggaggccgaagcaggcagatcacttgaggccaggagttcaagagcagcctggccaacatggcgaaaccctatctctactaaaaataccaaaaaattggctgggcacggtggctcatgcctgtaatcccagcactttgggaggctgaggtgggtggatcaccagaggtcagg

SEQ ID NO: 135383 - DNA, 1121 bp, Homo sapiens
aggccactagccgagactgctggcctgatgacgtaaaaggcttggtgcgaagcaggtgctcacggtgcacccgcccctttctccacccctgtcccttactccctctccccttcgctgataggcctttctctgtgccccacagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtagccaaggcccggggttggaggtgggagcttcccacacctgcctgcgttctccccatgaacttacatactaggtgccttttgtttttggctttcctggttctgtctagactggcctaggggccagggctttgggatgggaggccgggagaggatgtcttttttaaggctctgtgccttggtctctccttcctcttggctgagatagcagaggggctccccgggtctctcactgttgcagtggcctggccgttcagcctgtctcccccaacaccccgcctgcctcctggctcaggcccagcttattgtgtgcgctgcctggccaggccctgggtcttgccatgtgctgggtggtagatttcctcctcccagtgccttctgggaagggagagggcctctgcctgggacactgcgggacagagggtggctggagtgaattaaagcctttgttttttaaagaaatggcaaagccttcgactgacccttgaccccctgctccctcagcagagacggagggaggggctgctggtggtcagggacctgcactgtgtagagggagcctggctgtgtggc

SEQ ID NO: 135384 - DNA, 1043 bp, Homo sapiens
tgcctccttgataaatattagtttaaaaaaaaaaaaaagggccgggcgcagtggctcacgcctgtaatcgcagcactttgggaggccgaggcgggcagatcacgaggtgaagagattgagaccatcctggctaacatggtgaaaccccgtatctactaaaaatacaaaaaattagccgggcgtggtggcgggcacctgtaatcccagctacttgggaggctgaggtaggagaatggcatgaacccgggaggcggagcttgcagtgagctgagatcgcaccactgcactccagcctgggcgacagagcgagactccgtctcaaaaaaaaaaaaaaagagagtcaggcaactccacagggccatgatgcctgttcctccccacacccctcgccctcctggctggcgccgccagattgaccaagtctccctcccgtcctcccccagaaaaaggtgcactgcctcaacatggacagcctctctttccagctgggcctctacctcagcccacacttcctccaggcctccaacaccatcgagccggggcagcagagctttgtgcaggtacctggcatgcctgtcacccctcgggcctcccagctcctggaacttcctctccgcctttcttcccaccatgactccagaggagatgagactcccagagtcaggagggagacagcctgggtgcacgggagagggagagacagagaaggcattgctcagggacactgacaaggatgtggccctgtcctcctcctctgccccagacaggtccatgtctttctttccactgtgaggactcaggggtgggaactcttaattctagccgatatttgaaggcagcaggtggggtggggtgaagagcagctgcccatgccgcgtggccctacctacccatgcaggtcagagtgtccccatccgtctccgagttcctgctccagttagacagctgccacctggacttggggcctgagggaggcaccgtggaactcatccagggccgggcggccaagggcaactgtgtgagcctgctgtccccaagccccg

SEQ ID NO: 135385 - DNA, 1072 bp, Homo sapiens
tctggcccacacctcaaacttgggcaccaagagtgcaggaggggacacgctgtgccacagttcacatgccacaagccagtgctgccttgggacagtgatggctcctccaccaaatatcagattgaagcatgtggaatatgccaggttctgacctaaaaccccagcattttcatacgatctattgtgcatctactatgtgccaaagccctatcatgctaggcacttggggacacactcaggccctgccttcctggagctgatactgtgatgagggaggtgacaataaacatgtacatgtacacagataaatctataatttcgggtcttgctgggtggtttcggggctgcagcctaacatgtgtcatgggctcatcccttatgttaacacacggaggcccggggacttgcacagggtcacttggcaggtgagtggtggaagggaagttcgaacctaggtcctctgacgcctctccccctctgcagcaccgtcctgcctgccccaccactatctttggctgtgggtgagggcggggctctgttaggtgcagggctgctgagggaagggactgaggtgcgcgtgtctctgcagcccaggggtcactgtccttctgcatgctggaagccagccaggacatgggccgcacgctcgagtggcggccgcgtactccagccttggtccggggctgccacttggaaggcgtggccggccacaaggaggcgcacatcctgagggtcctgccgggccactcggccgggtatggctctcgccccgcccctgacactagtccccaccccgagagaccacccccctgaccccccccgccccctctccggtcccttataaagccccaccccagtcccagccccagccccgccgcagccctgtgagagcacagtcgctttctcctactctaggctacgccccctatgggccccttccctttgggcacaagcctggccccagtcccatccctatcccataaacccacacctggccaggtaagagtgcagccgccgcccacccgacgccaggcctcgctccccgcctggcctgtccgcttcagtgttccat

SEQ ID NO: 135386 - DNA, 1091 bp, Homo sapiens
tatctgtgaccctcagagatccaaaggctgctgccggcctggagacgattctccccaggagacccccactcccagcccaccatcagtttgtctgatacgtctgtcctgaataataacaacacctttgttaagcgctatgtgctagagactgtgctagggccgactctatgccaggaattaagcatctcacatgtattaagcctcccaaggctcatctgccagggtctgttattatccccacttcttggagaaggaaactgaggctggctgagagcgatggagtgacgtgcccagggccagagttcacaccagatccctggggatgccagagccagcctgccacttggttccccacgtggatctcagtgttcaggtggcttctggcctgttggactggagattacacctggttgatgtggcctttggtcccgatactgacttcgccgtgtcagctccgggtaaacttatggccaatctgcccccaaaactgttaagttgccttgcgtttgtgcagtgataagaaagtgctcagaccaccaatatcgggggaccctgctccccaccgccctgccctctacgaggactgtgggctttgataatttccaaatcatagatagtgccaaacacactttgtgtggtttccataggcattgtcatttttttttttcaaatttggtaatgatattcaaaatacgactgcctctgttagttcgcattgtttgttttaatgttcaggtccctgtgcctcctctgggtgactgggatcccccaaccctaattgctcaatactgggccagggtgagaggagggcccctaggcaggtgtctaggtctatgggagataggtgtgtagatagccagccaggatccaggggactggtgcattctcacggggcacagggccagggcactccagctgctacgggattaggcatggcttgttacggccacaccatcctgaacacatccgacctcatctgatcttggaagctaaggagacttgggcctggaggaagaaacatcatggatgtccaggagctcaccaaggaaggaggtggtgtggaagagcacagaatagagtgaatgcggagg

SEQ ID NO: 135387 - DNA, 1047 bp, Homo sapiens
aaaagggcatctcaatggcatgggtgggtggggagtcagtcatgtcactgaaattgaatgggggaggcccaatgaggtggctcatgcctgtaatcccagcactttgggaagctgaggcaggaggatcccctgaggtcaggagttcgagagcagcctggccaacatggcaaaaccccttatttactaaaaatacaaaaattagccgggcatggtggcatgtgcctgtattcccagctactcatgaggctgaggcaggagaatggcgtgaacccgggaggtggagcttgcaatgagccaagattgcgccactgcactccagcctgggtgacagagcaagactccgtctcaaaaaaaaaaaaaaaaaaaaagaaattgaattgggggagtcatggtcaggggtgagacctgaaggacctccccctgtgtggccctggacacagcccaccctctgtgagccgtttccaattctaaaacagactcaatgtccccctcacccccacctcaaggtcaggatgagaacacactgagtgaggagtggacgctgtccattgccacggccatgagggctggagaccagaacagcatggcccgaagcgtgcggggccccggatgacttggggacaccccagaatcccctggggagaacccttcctgcgcgctttcattttttgacctcatcactgagaaaggctcaatttggtgctcacgtgtccttaacacctgatctggcccaagctgggctccctttaagccaagagagcctcttgtggaccccgcctgcccgaatgaaatccgaacagttggggctgttcatggcaagtggggctggtttttcatttccattggttatttaaagtttcctttaaaataaacgattttaagttataaaaggtgaatctattgaaagaagaacatgaaagaaataaacaggagttcagcggagctagcagaagacaaggcatgtagggggagccattctgtcccagggaagttgtggagggtaggggctgtgtggaggcctctgcagctggtcctcggttttccgca

SEQ ID NO: 135388 - DNA, 1032 bp, Homo sapiens
caatcatagtcactcagcctgcccaactgtgacccagctccccaggagacagttcatttctagcatgccctgttcccattcttcccctcaaaggagctccctccacacccctcacctctgcctggacagccctctgccacatgccatgctcccatcagcgaggctggacttggggtaaccaaagtgggagtggggccctgatgagtggatgggaggagttccagggaactccacgtgggtgaccctgggtcacctgctcccatctctccctgcatgtgccctcatcgtgacccctctccatccccagggagaagtctcattcgtggttgagcacaggctggtttaccatggtgatcgcggtggagttgtgtgaccacgtgcatgtctatggcatggtcccccccaactactgcaggtgagccctccttgccagcgccctcccaggacaacacccaggcactggccgcaggatggagctctaggggctggaaaccttggctgaaggtgcctttgagggcctctgcttcattgttttcaaactgttcttcagagatctaggcttcttctccttcctcaggggcctccactccaagctccgccagagtttatttattaataataactattagtagtagcatcatatgaaaagcccactaggggacagctatactttactgaatactgaccaggtaccaagcatggccacatgtagtctctcacttactcctcacagcaaccttacgggataagaactgttattcttcccattaattaaatgagaaaaactgaggagtatgttttatgagtagccaaaggtcctccaaacagtaggaagaggggccaggctccagtgctcacagccctcaccactgctccacactgccgccttcttagggaaaggaaaaagtgccactgcatttaaaaaaaaaaaaaaaattggtggttacacacctagtctaccctgcacccattttatggatggggaaaccgaggccccaggaggcatggggatttctcctattgaggtcctat

SEQ ID NO: 135389 - DNA, 1679 bp, Homo sapiens
gggtgtgaatggggctcctactgcgtggaggtcaggtcctccagcaggggagccagctttggccctgccagctgccttggtgtgggaaggcccctgcttagggaggagaatgggcagggctctgccgccaccaggctgtgtgacctcaggcagattcctggcctttctggccctcagtgtctccgtctgcaaaagggatacagtcctgagccttaaagttctgggtgcatagaagaactagtgcggggcagagaaggtgtagcctttggcttgctggacccaaaggaccgaagccataataaccctttctggtggcttgcaggtgtgaacccacatccctgcccccagggccacctgcaggacgccgacacctacccctcagcagacgccggagagaaatgagtagcaacaaagtaagtctgccttcatttcttaaccccattgagcctctcacttccctccatggaacgggttcctttggacctgtctcagaccccagccaccacgagtctcttcttccccgcaagaagctgcccatgcctgggaggcccagatttaagccctggtttggccactgatcttctgagtggcttagggcaagctcctgcctgttcccgggcccagggtcagctctgccttcccaggcctgacggtctgtctgtgatggtcaaggactagccgaggtgactgtggagtgctgtgcaggagagaggggtgggcaggtggaggtgagcgggaaatggggcaagggtgcactgatcagagtcaaaggtgatacagcccgagcatgaccctgagaatgtcaggattccccatcattctttcattcattcattctttcctaagcacttactacatgactggccctgcatgccccttccctaggatccactgcagccttggtggagcctgaggtttggaagtgggatggggtggttgtattaatttgagtttaatcaggaaaaagaaactacacagtgattaaacggaaaagtttaatgcaaaaaattattgactataataggacactagagtaacaagggattggaattctgaggaatacaggaatagcagatattaatataaggagcacccctgcccccataaaggctgagatctgggccttgctgaagaaggcccagctatggcccactggatggctccagtacagaactggcctggggaggggaagccgccagcctccaggtgctgcaggtggttgagtgtactgtaggagctggacttcggagaagctgtgatcacagcgggagccagaagcaataagcctgacttgctggcactgctggcctctgggcagtgggtaagatgcccttactggagaggccgtgtgcactgaaggagcctccctagcaagcctaccagaaccaagaagcaaatgcttttcctcctgcagtgtctgtccagcaccctctactcacaaagtttaatatgcagctaactgacaagggaaaatatttaaagggcccagatccatttccacagagcagacaaaaaggataaatttggagctagaggcaatacattggagagttactgttgggggaagacctagaccctctcactcagatgtcccacctgtctctagacatcctcttagcagcagctatagggaatcctgacatattcaatccagtccagcaaaccctcccggagaacct

SEQ ID NO: 135390 - DNA, 1067 bp, Homo sapiens
gctcactgcaacctccacctcccgggttcaagcgattctcctgcctcagcctccctagtcgctgggattacaggcacgtgccaccacgcccagctaattttttgtagttttagtagagacggggtttcatcatgttggccaggctggtctggaactcctgacctcaggtgatcctcccgccttggcctccccagggatcagggattacaggtgtgagcaccgcaccagcctatattattatatttcaatattatggaaactaacgagttcacaacaggtcaccgaggtgacaggtgtccctgtgccccagccatggccctggccatacggctggcccccgtgatgctgatggggaggtgggcgtgcagggctggtggctctgtgacatgggaatgaggggctcctccctcaccaggagcccaggaccactagcagggtgcctgcagtctccatctcttgatctacgcacttgttctggaaggcggatgtgaccatctgcgttttacacacgggctcttgaggctcacagcgtccatctctggcccagagtcatccagcttgcaagaggcagagccaggactcgaaccctggctctcgggatctgctactcccctatgtgtcttggcctccccagggatcaggcgtgggtcttcacgagcccatgggcctggcgaggggtggtcaaggtaggcggcagggtgtggccggaggcgagtgggttctgtcccaccccagccctgttccccaccccgcagggagaagagccacccctcagtgccttaccactactttgagaagggccggctagatgagtgtcagatgtacctggcacacgagcaggcgccccgaagcgcccaccgcttcatcactgagaaggcggtcttctcccgctgggccaagaagaggcccatcgtgttcgcccatccgtcctggaggactgagtagcttccgtcgtcctgccagtcgccatgccgttgcgaggcctccgggatgtcccatcccaagccatcacactccacaaaaacatttaatttatggatcctgcctcctgccacgtgctgggtgga

SEQ ID NO: 135391 - DNA, 1089 bp, Homo sapiens
tcatccttcgaggctgccagtcagtaacctctgggtttcctggtgccccaggctttttggactccaatgacctgtctacctctttcctgccccaaccccatcatcactctgctcacacctcagtcaccctcttgtcaccctggcttctaattcctgcacctctctctctcatggcttcctagggatggggactgtgtctccatcattactgcacatctagaacaggctgtggcactgaggctgtgctcagaaagtcatttggatgagtcagtcaacagccgggtgcctggatgatgggtggatggatgggtgggtgggtgaggtgtaggaggaggtgggtaggtatgtaggtggacagacaagtggttgaccgggtgatcgatagatgggtggatcttgttccccttggaatctgaaacactaaatgcagcatcttgcttgaggcaggcactcagttggtgtttgttgagtgaatgtgagtagacatatgccttgacgaatgactagggagataagcaggttccctggaggatggttgggtaggttcacagccctgtgtgtgggtggctctgctgtgtcatgccctggcctcccagcagccctgagcttagatcttatgtggcctttctggtctgtgtatcccaggactgttcatctcctatgtgatgctgaagaccaagagagtgaccaagaaggctcagtgaaggtcccgcagggatgaggctgccagccccttctctgcttcccctccagcacagggaccaagtgggggagcctgcagaacctgtccaggcacagtggctcctcaagcctgcctgtcctgcagagtccccatggcatggagcttacacctgactgactggagccccctccccgactcccacttccagaagctaggagggagggatacctggaagactccggtcacctccttcttgctcagggcctaaaagatgctggtcctcccaacctcactctcagactccctgccaccttttcccctgggttctgccgtcttgcctcacttcccctcctgtcacatgctgacgttggacttagcaggttctaaggccacatgtgtgacctctc

SEQ ID NO: 135392 - DNA, 1083 bp, Homo sapiens
ggcagtggagccacgtggcctggttgccaggtggagaaggttcaggggcctgacctgcacccagggaaggacaatgggagttggctggcaggtactgctggcctggcggtagcaggcagaggagcaggcagattggagagagggctggcaggcagagtgggcaagtgggcttcctcaaccgcagggctggcatcatgcctagtacttagtaagtgccgggagatggatgggggcacagtggccaaatgtagccagggtttgtcgacccctgcagtgcgccagtcatttgtgattgcatgaaaatcagatttcccatttgttttaagttggaagatctggcagcagtgctgtgtggcggcgtttggctcaaggggctttacagctgcctcttgacgtgggctgcccacttgagttcccctgaccccgcagcatgccttggatgtctgatgtgtgctgccttaggccagcctggtcccctgggtgccgtagaaggccttccaggtgcaggtcgggggcacaaggaggcagagtggcctgtggagagaagccctgctggcagaagtgggcagggctgggtggcctcagaggccagcccgggcagcgaggctgtggtaccaggccatctgctggttccgcgaggtcagactatactgctggtggctgcggggaagcctgaagctgccgtgactgtgcctggccttggtgtctgctccttggacctagcctttgctgccagctggctgcactgttggcaggtgccaccctggcagcccctgctgcctacctgccagcctggcagcagccctgacccgagatgatctggcttcgtggagccaggctatttcctgaggcctgttccttgcttcaagctccgtcctgggagctgctctggccagaggctcttagcagcaaccacattatgtgcctgagggccctgcttgtccaggggtggcaggggggccctgagtccctttgaaccctgcttgttcagtacctgggagtcctgacttgcatttgggaggccctacttgcaccttgggatggctgctggcatgtctgctaaggggtcaggagccgactgac

SEQ ID NO: 135393 - DNA, 1205 bp, Homo sapiens
gatcctggacccagatcaatagcatatttcccccacccccaggaacccccgagatggcccagagacctggtggtggcagcatgggtggtgtcagtgaagcaggcccaaggccccacccctacagcacctgccgtcctggctggagtatttccctgtgtgctgggtgccttggcaacagctgggtacaccgctcgcctgacccaatttgagcaggtagagcaggtggtgcatcaggctgttgctcagcctcatcttcctgaggcctccttgagagcagcgatcctcacgctgctgtgctctgagctcctgcactctgtgccaggcagggtgctgactgttttgcaactggtatttccatgaatcctctcagccatccagagaggcaccaaagccagagaggtgagtgccagaggtcacccaggtggtaaatggcaattcggaaattaacacttttatcgttctataaagcgcccttgattgtacgcattctgtatgctaggggcttgcctagcccctcaaatagatgattatttgaggccctgcagtcacctaccccatgggctgatggcattaccccacttacaggtgaggaagctggggtcaggacaactgaagtgactgggtctgtgctactcagcttgaaattgcagagatgggatttgaatttgggcaggtccagctctaaggccctgtcttgccttgatggcagtgggccggaagcagctgcagacccgtgtgacagccccagacctttgagaaaggctccattccatggattgggtagttcaggaaagtccagagctgagcagttaggaggcaccatggtaggtttcgtgaggtccaaggaaaagtgtccccaggacctttcagggggtggggctgaagtcactgctgtggatttggggccaggcctgggctggcactggggcatggtgagcatttgtattctcccaggcatatgtatccacataggggggcctgggaggctttcccaggggtcccgggagggaggaagaggtcctagccaagtctggtgagtcggggagctgccatcctgtccaaggcagcccttgggcaggaagaatctcaaacacccaagagatctctgcttgcagctggcaccagtcctgtgtctgcctcatgcacgtggctggtggtgccaggggagaggagtacaagggaggcactgacttacctcatagcaa

SEQ ID NO: 135394 - DNA, 1090 bp, Homo sapiens
tcagggattacaggcgcgagcaactgcaccaggcagtatagactgtatttctactacttttttggcttttgaacaaattcagttgttatacagctttgagatcagaaataatttattagctcattacctgtaaaggagcacaagttagtcctgtggggaacgtttgaagtcttggagagaagatctgcctttttgtaaataactgggcaacaggaagacatcctgcctcttgtacccccataccacttcctgttgaattagcattagtattaactgcctacagaaaaagcagtgctgaggctttgcagaactagcaggagccgaaagagaactgtggggccctttgggtcaaaatgggtcatctgccatgggaatagatgttgaagaacacatcaaactttggaaggtgcttcctatggcccatatgaaaccagtgtgagatgctggggtttgcacgggaatcagctgtgagtgcttatcagggggtgatgggtaaacccaggccatgtgacttcacaaagcctcttcttagcttataacagtctgggtcaagttttctttaaaagtaaaccagcaagttttgccatctgcctttgtttgagaagagatgggacactcataaaaattgcttaaaatggaagtgggcagagaaaccgttggcagccagccagggaaattttctttgtaaagggcatgtaagcgagaagcttgttctgggacaaaaaaagggaagagttcattaaagaagaaagaaaaaagatgacgacaacagtagtgactttgggagatgagactcagccagagctaattatagattgcctatttaaggcattttcatgtgaccaaatacaatctgtgtcttaaaacaaatttaaaacataggttagaactcaggcagccaattagaggaagaaagcaagctgtattctgtgtaaacagttgtctctccagctgaggctttggggctcttgtaaggggctggtgtttattgcaggtgaggttctagatgagctgcagtttgctcatttagagactggcatccacaccatctcttttgagccccacaaaaatttgttaagtaagcaagtca

SEQ ID NO: 135395 - DNA, 1114 bp, Homo sapiens
gtgttttattttaggaagcttctattgctgtgtcttcaagtttattaatattttcttctgcagtgtctgatctgttaaaatcatttttcatctgagacattgtagtttttacctagagtttgaggtggagctttttaatctgcggagtctctacttgacacacttgatctttccttactttcttgtgcataggaagtacaattatgataattttgaatgtccctgtgtactaagtctatcatacatgtcatttctgctcagtctttattgatttctgtcctcattatgggtcaccttttcctgcttctttgtagttcctattcgttttttactggattttaccctcttgggtgctggttattagtgtattcctatgaatattcttgagctttatcttggagtagtttgacccttgcagggcttgctttgttgggcggaacaaggacagcatttagcctagggctggctttgcctcactgtagaggcaaaaccctctgagcactctttctgaacctccctgtattctgaggttttccactctggctgacaggaacgggaactattcctagccctgtaatcctttgggatggttctttccccatgctcaggtaggttcctcccacccatgcgctgtgactccctggggacccttgggggagctcactccctgtgcagctctctcctctccggcgctttgtctggcacactctagctgccctggcctggcctccccagcctctcagccccatctcttgaacatcaggaggctgctgggttccacctggcttctctgctctgcacctagactggaagctccaggcaggaagctggggcaatgggaggcgctcctggcttcgtttgtatacattgtatacatttctcaggaatcagtgtccttagcctgttgtccagcggctgggaaagattgttttctatgttttgtttgcacttgtagttataggcaggaaggtgacttagtccctgttactcctatctttgccggaagcccttgaactcataactcagttctgtggtaggaggaagtgcattaaatcaaaaagcggtaatctactaaataagggatttctcttatgtgtgtagatgggaggccaaa

SEQ ID NO: 135396 - DNA, 1074 bp, Homo sapiens
gtggcattggcagatttgctgtgagaagatgctcaggagaggaactgctactttatagattaattgcaatctgatgccactgaatcctaagggacctagtgttgctgtcactgtttccgaatactagtcataggaatggacatcggaggagctgaaacagatgagggtctgtgccacaaagtcagaataataaagagcagcgaggcatcgcacacaatgcgcgttgtgcccagatcttggagtgtcaagaaggccggtgtgaagcatcagggctgaaacccgaggcctgctttagttcctccataatctagttctcacagaggcattcagaagctgtgacacaaacaccgtttttggttgtatttagctagggctcaacttgctcaagttacacctttcccacacacctgccgccttccagtatgaggtatcacctactgtctggcttaccggcatcctttgggaactgaatactaaaatctgttttgggtgctgtttgaagtggatgttgtaacaagaaccctgggtgcaaggccctgccctgcccttgacaggctttgggaattgggcaaatcaggtcgcctctcccaggcctgtttgctcaactcggagattaagggatgatcccagagcccctctgggcccccacagtctgcagttccaggaatacagcagttgtcctggacactagcacctagagatgggcttatttgggtagaactctccatttttatatgaacatggagtcttgagttacctgtgaaactcagtaggatggatgatttaaaaaaccaaatgccaattgaagtttatccaatgaagacattccatgagactcagtcacagcagcaaataagttagaacccttttaaaaattagctgggtgtgctcgtgggcacctgtagtcccagctactcgggaggctgaggcaggagaatcgcttgaacccaggaggtggaggttgtagtgagccaagatcgcgccactgcactccagcctgggcgacagagcaagactccatcttaggaaagacaaagaaaaaagaagaagaatacaggtttcacttttatttag

SEQ ID NO: 135397 - DNA, 1176 bp, Homo sapiens
cagggcctcaatccccaggcaccacccctgcaccaacagggagagaattagagctggggtggggttgggctcttattgttcaaggggatgctgagtgccaggctgttagctccagagacggcccagagaggccgagtgcatcacgcagggtcacagagcacactaatactgtctcagccagagctggggaagtagctgctggccaggagcataccatgtagggaggagaccctgaccttacctgcaccttctgtatccagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttggctgtgcagttcccaccagtacttctgtctgggtggataggggaaggggggcaccccagccaactctcagccagcacccagcctctctgggccatgtggtggcagaaacagaaggccagacaggctccctgggaaccagggactctggatcatgaggcacttcacctgtctgaacttgggtatccctcttttaaaaaaatttttaggcggggcgtggtggctcacacctgtaatcccagcactttgggaggctgagacgggtggatcacctgaggtcaggagttcaaaaccagcctggccaacatggcaaaaccgtctccactaaaaaatacaaaaattagctgggtgttgtggcgggcgcctgtaatcccagctactcgggaggctgaggcagggagaattgcttgaacccgggaggtggaggttgcagtgagccgagatcgtgcctgtgcactccagcttgggcaaaagagtgagactccatctcaaaaaaaaaaattttaatttttgagccaggcggggtggctcatgcctataatcccagtactttgggaggctgaggtgggcgggtcacctgaggtc

SEQ ID NO: 135398 - DNA, 1047 bp, Homo sapiens
cttgctgttgtgctgtcttcacatccgtcccttccagcctgcccatccccaagccagagccccagtctcctcgcatgggtaatgttgctctcgtggagagagcacagagtggaagcctctctgtgggatttgggtcccagctctgcgtaactgtgggcaaaccctttccctcctgagtctgtttccccatctgtcatacaaggggtgggatgagtggtactttaggccgacctgggttcgcatcctgactgcagtgctttctagctgtgcaagctggggtagtcagctaacagctcagagcctcagtttccctatcatcaggaagatctgatgagacaacgttggcagatgttgaatgctgggctggcccactataagtacacagttgatggaagttcagttcctactccccatgcaggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggtactgatacaggagataagggtggggaggggtggggcctgcgtggaatgcccagcctgccctcccaagaatgcctcaggctgcaatgggccctgccccaagcagccatgcatttgcttgggaaacatttcctgacctgccaagaaggcaggttttggtggttttgttttttgttttgagacagggtcttactctgcctcccaggttggagtgcagtggcatgatctcagctcactgcagcctctacctcttgggctcaagcaggtttttagagtcagtcagacctggttcatatcggctctgagtagctgggagaccttggaaagcgaattccaccctgtgcctgtttcctcttgcatcagacaaaggaaagtttagggtcgggcacagtggctcacgcctgtaatcccagcactttgggaggctgaggt

SEQ ID NO: 135399 - DNA, 1119 bp, Homo sapiens
ttctctgcttttctacacagatggagtttgatgagaaggaactccgaagggagatcagctatgctatcaagaatatccatggcattaggcacgtattggggcctgggagggtggctgaaccccagaagtagggggtctgggacagaggcacagggagtgatgaagtgggcctccctcaggaaggactgaaagctctgttccccagtcctctcgaccccaactttctggctccctgcatgacaggctccagcttggggaggtggacccgggccaccccgcctactgcaacttgctgggccaactgggcacagcccagggcgcaggtggccggggaaacaccctctggggctgggcccatccccagggtgagatagctcccccagtgccacccaggtaaccggacaaagatgtccaaaccactacgagggcctggggtggagcatctaagtatgaggctgtgtccttttatgacggccggggactttgcaatcctccacaccctcctgtattcacagtagcccagagtcagtcccattccaccccaccgccctccttctaggcaacccgtggagtaggaaacaggattgggaggtggaatctgttccttaaaagcttagatccccttcagggacccagatctatgctgtgttcatccaacaaatccactgggccggaaaatttaaagcacctaccctatgccaagcagtgaacaagacccagtgtccccttgctctcatgcaggttcatttccaagatttggcatggaatttacttcctgataactgcactggccaattcacagaaaaaagatctctttcctagtcttaaaacaaaacactctattcctggaaaggctcttatggagaaccacgtttggcaattttcaagccatttctggccatagaacttcctatatgcacagacccttacgaggaagcaggacttacatatcagatactcaaccaccttgtcttgccccaaagagcctcattagggccgggcgcggtggctcacgcctgtaatcccagcactttggaaggccgaggcaggcggatcatgaggtcaggagatcgagaccatcctggctaacacggtgaaaccctgtctctactaaaaata

SEQ ID NO: 135400 - DNA, 1389 bp, Homo sapiens
ctctctctctttatctgtgtcgatgtctctctctcttcccccgtgcccgtgccatcctctccacccctggattcctgtctctgcttggctttcacccacttctcctccccacccacggctgctcctcctcctgtccccacctcctccccgggtgcaggacgggcctcttcacacctgacctcgcttttgaagccacagtgaaaaagcaggtgcagaagctcaaagagcccagtatcaagtgtgtggatatggtagtcagtgagctcacagccaccatcagaaagtgtagcgaaaaggtatgacggccgcctgggcggggctgggcctggccgtccattccttgtggccacagcctcccgtgggcagaaggatctgctgagccggcctcacggctacccgcagggacccagccctagtgtttcctgccagtttctaaccctgggtacttgcactcatgacccctccaggcccccatcccagaagacttgactccaacccaagcctccttggtggcacctatgctagtgatgaagatgatgttaaggagatggcagctgtttactgagcacctactatgtgccaagcacacgctaagtgcttgcccttactatctgactcagtcctctcaaccaccctaagacgtgggtagtgttgttattcccattttgcagatggcaaaacagagtctcagaaaagagaagcagagtgtgattcagttttaggaaggacagaggaaggggtctgaggtcagggcctcctgggcagggggagctgtcctagttcctcaaaaccaatttgcctgaaagcatattggattactcactttacagtaatccgtgcgtgagagacaggggcggtctcttttgagttgtctgtgactttttagatgcctttttcctatttgtctgcttttgggcattttgaggatttttagccaggttgtctaaagcagttcttcccaggggagtgcgagagaatcagttgcctgcaggagcttctccagcaggctaaatcagaggtgccaggggtgagcccagcctcacctatatctgaaggacttccctatgctggtgggtggaggcacatccaccttagcattgagtttcaaataagcatcaatcatctccattcctttttttttttttttttttttttgagatggaatcttgctctgtcgcccaggctggagtgcagtggcaccatcttggctcactgcaacctctgcctcctgggttcaagtattctcctgcctcagcctcccgggtggctgggattactagcatgtaccaccacacctggctaatttttgtatttttagtagagatggggttttgccacgttggccaggctggtcttgaacccctgaccggaggtgatccacctgcctcg

SEQ ID NO: 135401 - DNA, 1010 bp, Homo sapiens
tcctcccctcgagttttctaaggttatcaagtcactcctgccagaagtttaatgagtgttaataagtgaactctcattactgccagccctgctgggattagacttgccatctctgagtgaaatgaagagtttaatgttgggcatgggatgtgctgctcagttctctcaacaactctaggagggaaggtgtcattactaccccattttccacatggagaaactgaggcccagagaggtctggtcatttttctaaggagagtcagcggacagcggctggctttgaacccagggctgaatggctccaggggctgtgtccctgactgctaacccggtgggctccaggctgatcgccccctcagccaagggctgagaggggaacgttccttttgaaaagctggcggaacatcctggaaatgttcagaggcagccagaatggaaaaagatgctcaaaggggacagaacttctcaaaggggtggaggctgccctgccatgggtgacacgtggaaaacttgagacatgtgacatccaggcggttagtgggagaattggtcatgctctttggcaaattgcgccctcctcctccctccttctccctgctcctccaaactctaccctgggagggagcacttgggaccacctcagaggaggcctggtggctgtgacccagtcccaaatgtctgcccagacttggagactgcaaagagcgggagcccttccttgagcctcaggagcagtggggttcacagggcccctctagtcaccgtttttaagcccctggtctcagactgcccctccctcaggtctcctgagcttagccacatcatccacgcccttggcacagccacgggatgatgggtgtgatgcgggcatccctcgtgttggcatcctggaccgatatccagggccctgctttctccccatcctcctgcctctcccatgcccctcctcaaaactccttggcctccatcctgccctcagaatcaccacctgtgactcaggcacaccaatc

SEQ ID NO: 135402 - DNA, 1039 bp, Homo sapiens
ggcaggggcatgcaagggagacagagctgaatggattccaccaagagggccagggcccagccaggccccgcggggtactgctcatgctgctggcccccgccttgcatgtcccccagccctcgcatgcttttgcttgtgtttcctgcatgtcctctggtgtgactgctggttttcccctgaaccccctccccagctctgacaaggagcattgcctgtcccagcctgactcaggaggccaactggcaccttgggccctgtcctcccccgattcctcctggataggaatccagaggctgtcccctgcctgattccccatctagctgtccctccacgcctttaggaaggcacagggtagccctgagtatgagggaacaccttgggagctaacggtccccagaggccttaacctaaccagtctgcggggcaggctcattcccatggcctttctcccacgggaaccacccctctgccctgaagttgcccaggtaggccagtgaagagggcccggaaccaggaagacccttgaatcaccatttggaacccacacttgggggaaaggggtggccgtggcttggtgccatcagcgtcctgggaccctaggtctctcttccccgcgttgtgggcattctgtgtgtgcctcccaccctgcgccgcggatccctggactcgtggggtgtgggtgctccctgcccgtgccctctgtgtacgtggctttctgccctcctgcccttccccagctccagcagtacccgcggctacgggaggagatggagcgcatcgtgaccacccacatccgggagcgcgagggccgcactaaggagcaggtgagccccgcagcacccggcctggccgcgccttccttccactcctggccgcctgcgccttccactcctggccctggggttgcttccttcttgttttgtctcttctgtctcagtcttcctctgtctcatactgactctctgcttctctctcttttttattgcagtaaaatacacataacataccactttagccatgtttaagcgcacagttcagt

SEQ ID NO: 135403 - DNA, 1896 bp, Homo sapiens
caacctgtactcgtgtggggaccagaacacgctgatggaggagtcggcggagcaggcacagcggcgcgacgagatgctgcgcatgtaccacgcactgaaggaggcgctcagcatcatcggcgacatcaacacgaccaccgtcagcacgcccatgcccccgcccgtggacgactcctggctgcaggtgcagagcgtaccggccggacgcaggtaccagggccggcccccacggccccaaagccccccagcccggggcccgcgggaggaatgccgggaccgggcagtggcgcgcccgcgtcaccggggtggctcccacctggagcgaggggcggagcttagagagggcggggcttgtcgcggggcggggcttgccgtggagagctggctgcaaggctgggtggagctggggcgttggcgccgctgggggcggggcttaagctccggcgaccgccttaggggtgcggcagggaggggcttgcgtgcatgggcgtggccagcactgggctggggcggggcctctgggtgggcggagctgctcatctcgcctctccttgttcctcgctccctgtcgccctcaggtcgcccacgtccagccccacgccgcagcgccgagcccccgccgtgcccccagcccggcccgggtcgcggggccctgctcctgggcctccgcctgctgggtccgccctggggggggcgccccccgtgccctccaggccgggggcttcccctgaccctttcggccctccccctcaggtgccctcgcgccccaaccgcgccccgcccggggtccccaggtgagtaggggctgaatgcggctggagaggctgccggacgggcgtggccgggagggaaatggggctggattccagagcatcggacctggccgccagaaccggccgtttctatcccaggcaatcggactctgggtgccggagccacgccacgtgtggccgagggctggcggagcctgcccccgagggagcgctgagtcccggaggtggtcgtttctggggagggggctgtggggctcgtcccacctgcccccttctttccagcacttgcatggcgcttccctctattttcactcttggcggccgcccacacgttgcattcctcctcctttcttcttcttgctgtcctccatcctccattccgtccaattcctctcccagcccctggggagcctaccttaggtctgactctgaaccccgatctgctctgagtgtgtggatttccttcagctaccctgatgtccccacttcccagccctgactcctttgagccatcccagggggtgtccagccactggcccacaggagcagaggccaggctgtgactgtgtgactagaaaggtgtgtgatgtgtgtgtgggcgtgcacacgagtgtgagagtgtaagcatggcacccaggcccgggctaggacaggagcagctggggaagcagcctgggccgtgggcaaactgatggcttttttcctccccccaaccaccccctccgcgacttctggccctacccagtctaaaccaatgtggtaggggtggcggcaggggcagggatgggagtgcttgaagcctgcttcattcccaaagatttctagggaaaagctttctactacatcctttggcttgaccttcttgacccatgactctctttcaaggaagttcactccaattcccagtctgccctgtttccactggccacattctctaaggaagaacacagcagaacaatagcatctgttttgtttctgcatggctggagggtagggctgtcggtctagcacccataaaccaaaatgaggcagggattggggcttgccctatgatgctctgatgaccaaagcagatgcgtagaggcaagcagcatggtattgggcaagaggactggactgggag

SEQ ID NO: 135404 - DNA, 1049 bp, Homo sapiens
aacttatttattgatagcataggacagaggaaggaggcggggatggggtcgtggcgccctggtgatgcgactcctgtttattttgctttttatttcggaataaatggatttagccatactgctctgcctgatgtgttcctgtttctctcactgggtcctggagtttgtgccactgaacagggagccccagagtgtctgagcatgtgcagctgggctgttgggaccttccaggcttgttacctgtatgctgcctggtgacatcttggggattacacggggactaccatggtacctatggggacagtttggccccgatggccaacaggctcagaagcctgatctagcggtggccaggaagacaggatgccagcacccaagggcactgacttccatccagcccaggtgtcttccattctgtccccctgcctccctcgcctgcctgagcctggtggcctgttctgtctgtccctccagaatgccagccgccctgccggcgccctccaggctgagttaatggccctgccccctagtggccagagcccgcttcacaggatgagagccccctaagctccaggggctttccaggaaaaatgtcccttggaaaagatgtggtcttttcaccacccccagcagcaccctagtaatggcttagcccttcccctcccctgagctccagagagaacacaaccagcagaggagacattccccatcatccagaaatgggttttattctcagccgagggacagcaggactggtagaaactgtcaggccacacggctgcctgcacagcacccccatgcttggtagggggtgggagggatggcgggggctggctgtccacaggccgggcatgacaaggaggctcactggaggtggcacactttggagtgggatgtcgggggacagcgttctctggtagttgggccacaagactccacaaggatagcacagtgactgattcccagcgctagaggcgaggcggttggccatgtgtaggtgtgtatatatatgagtatttatagatatttatagaacagggcaagggcat

SEQ ID NO: 135405 - DNA, 1394 bp, Homo sapiens
cagcccatgccaagcatcccggaggacctggagagccgggaagccatggtgaggctgactccccctccccaacctttgctgcctccctctgtggtccctcccagacccccttctgctcttggtttcccggccttctgatttcttcggaccctcacccctttcctgggagccagtggtgagacaccatttcacttgggaccaacaagtgcaccctctgaggccccaagggaagggctgctctctacctccctgccctgttcatcctatatatcctcctacaagaatgcacccctcttgcctgcaggtggcatttttcaactcagctgtagccagtgccgaggaggagcaggcaaggctacgtgggcagctgaaggagcaaagggtgcgctgccggcgcctggctcacctgctggcctcggcccagaaggagcctgaggcagcagccccagccccagggaccgggggtgattctgtgtgtggggagacccaccgggccctgcagggggccatggagaagctgcaggtgaatgagtctctcctggcatgggtcaagaagggtgggggcggggcaggtcgctgccgatatatgactccattattttggttccagagccgctttatggagctcatgcaggagaaggcagacctgaaggagagggtagaggaactggaacatcgctgcatccagctttctggagagacagacaccattggtgagtgggaggccagggcacggcaggaggagctgcacagcggtcggagggaacccagcatctgagccctgtcctcccgcaggagagtacattgcactgtaccagagccagagggcagtgctgaaggagcggcaccgggagaaggaggagtacatcagcaggctggcccaagacaaggaggagatgaaggtagggtgtggaacatctctgggggtggaggtgggcacgggcatgggcatggcagcttagcacccctccctccaggtgaagctgctggagctgcaggagctggtcttacggcttgtgggcgaccgcaacgagtggcatggcagattcctggcagctgcccagaaccctgctgatgagcccacttcaggggccccagccccccaggaacttggggctgccaaccagcagggtggtgagtagagccctcgggaggggtgggcaggcaggagtaagggagggctcgcgtggcactcagagccctgcctctctctctccaaagatctttgcgaggtgagcctcgccggcagtgtggagcctgcccaaggagaggccagggagggttctccccgtgacaaccccactgcacagcagatcatgcagctgcttcgtgagatgcagaacccccgggagcgcccaggcttgggcagcaacccctgcattccttttttttac

SEQ ID NO: 135406 - DNA, 1038 bp, Homo sapiens
gtgcctcaggagtggcagagactctggccatggtcctgccatcggagtggggctggggctgggtcggggggccgcgacccggtgcactttacctttttcttcgctgcggccaatttgctctgtcgggtttcttccgacatcgcggggcggggagggaggcggggttggggccacatcagcgcgatcccggcaaccactgcggaagtcagtcagccaccgcgcagctgtgcgacggagccagaggaggcgtaaccagggcgatactggagcgcagaatgggggcgtggcctcaaagatcaaagcccattggtcaatgagaaatatgaagcggaagggggcgtggctatgcagcggcgtggccagagggacctgtggcgtcacaacaaaagctgcgcacgcaaccgctgtccccgcccacctcgggagaggggcggggccggctttccttgggtgcgcgcgcagctttctgtgcgccagttcacactccgggtcagagttcctggcccggtgcacctgagaggtcgctctccgactcccgcgctggaccctcttgcgccattgaaccccctgatccgggggcctcggaccccagggctcaggaggtgggcgaggaacggactccacagtttctttcctgactcctcacagccctgccccagactctcccttcccagaaatcacctccaaagactcccatccagtgctccagacaacccccgtctcagaacgcccccttcctagagggtctctaccctgatcctgagagcgtgtctgccccctttccagatggatccagtccctggcgctcctacttcccaactgctcctcctcccgcatccccacagtaccccgtcctcacagcgggctgtgggtccaatcagactttcccctcggattcctctctaggactgaaccaagacttacccgaagttgccgcggggccttccgatcccctgtgagtatttcttcccccacaccccctttcccatcctcgaccttcccttgtgcgctcccggccccactccccatcccaacagc

SEQ ID NO: 135407 - DNA, 1064 bp, Homo sapiens
catgcctgtaatcccagcactttgggagaccgaggtgggcagatcacgaggtcaggagttcgagaccagcctggccaatatggtgaaaccccatctctactaaaaaattagccgggcatggtggcgcatgcctgtagtcccagctactcgggaggctgagacaggagaatcacttgaacctgggaggcggaggttgcagtgagccaagatcaggttactgcactccagtctgggcaacagagcgagactccgtctcaaaaaaaaaaaaaaaaaaaatcccagatgattaagttctacttgctggaacttagtcatagggccacatctaattccaaggaaggcttggaaatgcagtcttattgagggggttagggtgcctattagcaagcagaagcagggagtgactactgggggacatgtaggctgtgaattgtggataactggtcagtctggctgatgactttttctgcctctcagaggccattgcccaagtctggccaggctgatgggaccagcgaggagtctctgcaccttgacattcagaaactgaaggagaagagggacatgctggacaaggagatctcccagttcgtatctgagtaagtttcattgggttccccatcatggttaagataactttgggctaggcatagtggttcacgcctgtaatcccagcactttgggaggctgaggtgggtggatcacttgaggtcaggagtttgagaccagcctggccaacatggcaaaaccctgtctctactaaaaatacaaaaaatagctgggcacagtggtacgcgcatgtagtcccagctacttgggaggctgaggcagaagaatcgcttaaacctgggagatggaggttgcagtcagctgagatcacgccactgcactccagcctgggcgatggagtgagaatctgtctttaaaaaaaaaaaaaaaaaaaaaaaaggtttaactctctaactgcccagtaactgaaaaacccagtcgcactggcctagcatagaaatacgactgtgcgctactcaggaggctgaggcaggagaatcgcttgaacctggcag

SEQ ID NO: 135408 - DNA, 1001 bp, Homo sapiens
agaggaggaatagcatcatggaggctgcagaggggcaaactcgagcagtgggccatactgaggagtctggaatgttcagcaggcacagcatacaatcagcttacatttgaagcagatgaatccagcagctctgtgtggagaatggaatcgaggaagctctgtttcattcctctgcaaaatggggtgagggtccaaggagtccttgtaggtccattgttgaatacagtggctggcacatggcagagctccagcgtggccaggtggggcccgtgggggacagcctggaaggagtagcagggagcttaccttggccagttaggcaaggcacaagtgtggggactggcttgaagccagaggtggtcctgggtgggtcagggcagtgacactggctcggggcattggctgtactccctcccacctctccccactgcacattcagcctgccttccttcctttcagctgtgatccgaggtgtcaccaccaaagagttgtatccagagtttgggctggacatgaatgactgagcaggctcatcgccccttgtccacagctcccagggacagaagggtgtggacatgataaacactgagagcccaaccagcacacctacagagtttccagcgagacaatgccagaagcacttttctagagagcccaagcccaatcaggaggaggctagagaagaggcgggcagggaggaaggggcgttcccagctccaaggttcctgaaatgtcgcagtgatacttgtgtaggggtacatgtactttatttgtcaataaacgtatctgtacactgattccctcttctccaatagcccccgatagtacctgggataaagagagcgtgcctttgattagaacaggcttacatgagccaggcattgtgctaagtgctttatatccattgtctctgatgcttaaaatcatcctgtgaggaattagcataattatccccatcttacagatgaagacgttgaggctcagagaggagacaaagtgac

SEQ ID NO: 135409 - DNA, 1020 bp, Homo sapiens
cattttacagatagggaaaccgagtcttagtaaaaggcaggttctaacctgggcaagatggcgagaccctgtctctacaaaaaataaaaaattagccagttgtgatggctcagaacgtcccagctactccggaggctgaggcaggtggatcatgtgagcctaggaggtcaaggctgcagtgatctgttatcacaccactgcactccagcctgggtgatggaatgagaccctgttgccaaaaaagggcagattctgacttggcaggtcccggtggggcctgaggttctgcaagtcttaacacatttcaggtggcacccacagggcaggtcctctgaatagcacaacctggagagcttaggggtcttgctaaggttgttacacacctaggaggtatccaaggggtgtgcgttcacaaccacacactagaggctgtgctctcaccaccatgtctgtcattgtgtgtccctggcagaggtgcagtgcatgcatgagacgcagaaagagctgcggaagttggttcatgaaatcggcctggaactaaagaccactgctgtctgcacccaagtgcggcgcacgcgcgacggcttcttcacgctagacagtgccctcctgaggacccagtgggacctaaccaacatccaggatgctatccgggctgctacccctcaggtagctgcagagctggagaagagcttgagcccggggctggacaccaagcagctccccagtccgggatggtcctgggactcccagggcccgagctctaccttggggctggagaggggtgcggggcagtgaatgcccaggcagctcctggggcagtggatggataaatagaagaactgctatgagctggacctgatagctgtgcagaaagtgagagcaggggcaccttttctacgtaagacacaaaactcaagctgtaacagaaaggtcaatggacttgacccaactgagaaggaaaaacttctgtatggaggaaaagacagtaaacatgacagactgatagaaagtattggc

SEQ ID NO: 135410 - DNA, 1006 bp, Homo sapiens
gctgccagtgctggttgtcatggaaaccagccagcagtcttgtaggaagcctgctgactgggagccaggtaccatgtcctgctgaatccaggcagcagtactgtgagactggccctgttactgtccccaggtgacaggagagcttgaatacaaagagagcaagagctgctgaaggccacatgacagagctggtgcccttcctcctggggctgtggagcagctgggcaggggctgggcacatgagcttcctgagggagacctgaggaccccccacccccagcttctggggcaggggctactagggcttagaatggggtcactgacggatctttacctccctgtccttgaaggattacacagtgcgtggcctcctgggcaaagctacagatgacttccgtgaggacgggaggctggtagagaagacaacctatggtgagaaccggaagtggctgccgctgcctccctccgcatttgctttccctgagtcctctccccgccctaggccacgctggccccttctcagttccactgcacacactaggcttgggctgaggctttggccacgggatctgtgctccaggagcatcctctactcccctgcttgcctagctcaaatgtaacgtcacttccaaagactctagtttctctccatctcgtcagtctttgaccttttccttttcttttctttttttttttttttttttgagacggagtctcgctctgtcgcccaggctggagtgcagtggcacgatctcagctcgctgcaagcaccacctcccgggttcacgccattctcctgcctcagcctccctagtagctgggactacaggcgcccgccaccacgcccggcttttttttttttgtatttttagtagagatgggagacggggtttcaccatgttagccaagatggtctggatctcctgacctcatgatccgccctccttggcctcccaaagtgctgggattacaggcatgagccaccgcgcccagcctttccttttct

SEQ ID NO: 135411 - DNA, 3019 bp, Homo sapiens
ttacaggtgtgagccactgcgcccagccgaaagagtgatttttttactgaataaagttgcccaacaatggaactggttctggtaatgtgtccccatcactagatgtgattaaggcatgtgtcagggaatctagaggtttgaccagaaacctcaaaaacccgttggacttgtgatattcaatgactctattatatggtaacaataagaagtataatgtattgagtcgccactctgtactaggcattgtgttaagcttcccccaagtacaatcctcattgatatcaccacagtgctgtgagatgggtcctattttcatttcacaagggagaaaactgaggctcagtgttgacatttagtaacatggcctggattcaataggcccttaactaccctggactcttcccctagattcctcttaatctgtagaagtgtaaacacttctggctcattcctgcatttattctttcagtagttctttcctgagcagctagtgagttgacacacccaggttctgccttaaggagctcacagcctccattttcctccagggactcttcctcagtagagctgggcagggaaccccgcactcttgaccttcagtgttacgccagtcttcttagagcctctcactgggagactgatgataggcagagtaagaggcatcttgggctgccctttggatcccagggcactgaggatacagttcagggtcccagattccatgacggggaagcctgagagtctggcctgatgctagtttgggctccatgaggcccattctgagaacgaggtcaacatgcagcccaaagccatcctggggtggcatttagttgagaaaatggaccttgtttgtttctttccagtatgtggaccagcattcgcccatctcaaggttggcgtgggacatcggttggatgcccaggcttctggagtacttggtaggtgatgtgagaagcctgggggtacagtgataaggcttgagaaaagatcctgaagctaccaggagcccagcccacttcttacctggcacccacgtcccaccactcctctcctgccctgattcctgccccaaggctgatcagctggggagtggataggtgggacggaggtaatcacaggttaataccacagtcacccacctttattcagtgattcccacacatgacatagttcgaggccctttatgcacatttatttaccacaacaactttattaggtagatactatatgattttatggaagaagaaagtaggatttaggtgacttgttctgggtcccatggccagtgaatacccctggtccggagaaggaaaaccatcattgcatcatggggcagccaggcgcgtgactctggacctaatggccagggcctgcatgtggctgggtctggacacacaaagccctagtcatgagccatctgtgtccccagggtcaggtggtgcccacatcctccagccgcgacagtcacagtccccttgtcttgcttcctgaggcacaggcaggcagacatgatctcatgccccctctccctgttctgtctccccacgagtgaatgcagagttattctgtccctcagccagagggagaaacagaccgggagaaaggcaggaagtgaccacagtggccaccgtttattgggcccttcctctgtgccgactgcacagcacccacaggaatcagtattttttttttttcctgagacagagtcttgctctgtctcccaggctggagtgcaatggcatgatctcggctcactggaacctccgcctcctgggttcaagcaattctccctgccttagcctcccgagtaggtgggattacaggtgcccgccaccacgcctggctaattttttttttttttttttgtgagacggagtctcactcttgttgcccaagctggagtgtagtgtagcaccacacctggttaattttgtattttttggtagagatggggtttcaccatgttggccaagctggtctcaaactcctgacctcaggtgatccacctgcctcggcctcccaaagttctgggattacaggcatgagccactgcgcctggccttcagacagtatttttacccccattttactgatggggaacttgacgctcaaagaggctaaagattatactcagagctgtccctgatttgagtgcaggtttgtgtgactaggccagggatctcttcctctcaggtgtcagaatcctgtggagagcttggcagggatcctaggccccctccaaccatgagtcagattcagtgcatatgggtaaggcccagcaatctgcatgtgatatatacccagaggggtgcacctgccccctgtagaagatctttttgccttcttgttgcctttggcagcatcagaaaagggagtattctgatggtgggggtaggggtggggatacttaggggaatgggaagggggtcccaggtgtgagatgacgctggctgcttttcagtgctcggcgtgggacatggatgcaggctcctcaccgatatgtacaatgctcatcttaccaaggtacgagggtctggggacagcctgcttctcccttggtcctttcctgggggtcaccagcaggattctgaagcttagaggattccgtgggggaacacccaagccataagcaagcatttttttgatgatcgtgtgctgtgcaggggctgtaataataataacaataataactaccagtgttagtgtatgccgactactctgtgctgagcactgtacgtggattcctttagggaagcctcacagcctccctgtaaagtggaatctgttgttagccacatttcacagatgagagaactgaggctcagagaggagatgttacttacctaggtcatgtagttgttagggctttaagagctgggatttgaacctaggtctctccaacaccagagcttgatcatgatgccattccctattctgtcccaagactgagaggtagatgtcagcatcctacccacagggagcttaccatccagaggtggggtcggggctatggagtctg

SEQ ID NO: 135412 - DNA, 1697 bp, Homo sapiens
cgcagcagagtcgccatggcagcgggcgtccgcggaggatgggcgggtacgaagaacgccgcgattctgtcaggcgacggagcgtcggaggggtcaaaactcactgaaaaaccgattctgacggcgtagcctacggcctttcgaggggaaacatcgcttcacgggcagaaggcatgtaggccaagtaggcgaaggaaacgcacgcgaactgtctaccgtctacgtccaccgatccaagactctcgccatgtcacctcgccccagaaagtgtctgcaaaggacacgcaaccacgctcactcagcgccgggccctatttccttctccacagccggttttccccgaagactataaaatgcgaacctcttccggctgtggaacatggcggcgcccgtggaaaggaccacatttgggggcggggcctggcggtacttccgtccaggtccagcgggtgctgtgatcttcaagtatggggtctgctggcttgtcgcggctgcatgggcttttcgcggtctataagcccccggggctaaaatggaagcacctgcgggatacagtggagctacaacttctgaagggtgagtgcctcgaaccagacccacgttcccgctctcgttctcttggaagtccatctccgcttctggtccttaccccaaaacaaaatcacgtgacctattcacctgggcagagcgctttcccaaacgcctgttctctgtgctttcttactcctcactttcctctgttttccgagggggaaactgactcagtattgttccttgtcacacggttactacgttgtagagtctgtttgaatccgcctgtttcttaactactgctatactgccctctgcaccatgggcttctgctttgtcttctacatcatacttccctgttgtctaatcccccaagtgtttggacagaacaagatattcctggtcagcatcgtggtgcacgcctgtaatcccagctactctggaggctgaggcaggaggatcgcttgagcccaagagtttgacgttacagtgagctatgatggcgccattgcacttcagcctgggctacagaacgaggccctgtctcttaaaaaatattttatatgtacatatatttgtatgtatgtgtgtatatattatctctgtgtgttcaggtctcaatgccaggaagcctcccgctcctaaacagcgtgttcgcttcttgctgggccccatggaaggcagcgaagagaaggagctgaccctcacagccaccagcgtaccctctttcatcaaccatccactgggtaaggcagatttaagcaggatcctgtgtgtcacttcccaggaaatccctgagccgagtcagtgtcccagtgctcagattcctgtgccaggcccttgaaggtccacagaggagtgaggtattagaccaggaattggcagatttccttggaaagggccagatactgaatgttttagttttcaggccatgtgatttccgttggaactgctcaactctgccaatgtagtgccaaacagctatagacagtatctaaaggaatgagcctagctgtattccaatagaactttatgaatattcatatttgaacttcaggtaattttcacgtgtcactaagtacagttgcctctgagtccatgagttccacatcccatgatccagcttcagattggcagtatttgggaagaaaaacacaaagttccaa

SEQ ID NO: 135413 - DNA, 1106 bp, Homo sapiens
gagctgaggaggagcattctgagtagagggaatggcaagggcaaaggccccttgtgtttaggaaaaggaaggttgaccagtgtggccgcagaggagggagtagcagggagacagtgagtgggctggaaggggagccagggctgcgccctgtaggccaccagaaggaggagtctgtattttgtaataggagcagtaggaaacttgtggaaggttttgagcaggacagtaaagtgacctgatttgtaaaggaccttaggatccagttggcccatcttccctgtccctgtcccatcttccctccctcctgcaacacagatacatcccatcaaggcacccctgccaaatggcgagccagtctggctgatggaggtgaggggtctccaaaggttgccctagaacagtttctcaagccgggcatgttaatgtttaggctggatcactctttgttgtgggggcggtcctgagcctggtaggatgtttagtggcatccctggcttctacccactggatgccaggagcacccccccgtcaagttgtgacaaccacagatgtctccagagattacagatgttccctggtgggcagttgagaaccactgctctgaatggttattgtccccgagacgatgttctgttcctcacagtctcctgcacagctaccttgacggggcgatcacctgcactattttaaaccatctctctcagatttcaccaggatgcaagtcatttcatcagtgggaaactcaccagggtgacctgcctcaagtgctacacagggagggacagtctgaatttcccccagtctttagccctgtcgctgtggaggggagggggtagcagggacaggactgctaggacaccttgctcagccacagccccacttgtaaccgcgctggcgattgtgacacttgtagagcaaggaaatcagcagctcatggaatgtgaaggagcacctttgtccccagagagatttagataaaggttcaaggtgaggctaccctcccctccctgaggctgattttggtgagaggtgtggtcatcttgtagtatcaagactacaggcatgggcttgagaattaggaggagcctgagtgagaatcctggctc

SEQ ID NO: 135414 - DNA, 1403 bp, Homo sapiens
cagagcgagactccgtctcaaaaaaaaaaaaaaaagttgttttaaattgaaaaaaggatgagcacaccagcctcacagtgtgtgtggcagtgtcccacggggcatctgggcctgtctcatttcagtttgtttccacagatatgcatggcattgctgcttgtttgtaggggcttaagggaagacagcttgaataaatatagctcctgccctccaggtgcttagagtcgggtgtatatgtgagtgtaggagagaggcagggagcaagagggcagcaccagggaagagcctggtgatggaagccggggaggcttcttggaggaggtcacccaaggcaggcagatgtgaggtgcagaagcctgcagggcagcacaagcctgcctggctggatggcagtatcactgatttggggccggggagggtcttcatctcgctgaccctcaggggccatccctctgcctccaggaaacatcgtgggaatcggccagtgcctgctgcatggcatgacggtggtgattcggaagaagttctcagcctcccggttctgggacgattgtatcaagtacaactgcacggtgagcgagagcgggaagggtgagctgtccctttcccctagttaccctcttcccaactacactccggggcatctgtcttatagctgaggtggccagtcattccaaagggctcatttgtggcaaagttcccattgttcagatgggaaggctgagacccggagagggaaaggatggcatggccagcccctggggagagtaggggcttgagggatcaggagaatcctagtgtagtgagggcagcctctggagcctcgaatcacaccaagttcacccccagattgtgcagtacattggtgaactgtgccgctacctcctgaaccagccaccgcgggaggcagaaaaccagcaccaggttcgcatggcactaggcaatggcctccggcagtccatctggaccaacttttccagccgcttccacataccccaggtggctgagttctacggggccacagagtgcaactgtagcctgggcaacttcgacagccaggtgcggccaggttggggatgggcgaggctgctgcagggatggcccacagaaggcactggatgcagaggggagggcagagttcgagcgtgagagtgtgggtgctggagtcccacttccccctcattgtccagttttgggcccatggtgagagagcccaggcccaagtcttggccttcgcaggtgggggcctgtggtttcaatagccgcatcctgtccttcgtgtaccccatccggttggtacgtgtcaacgaggacaccatggagctgatccgggggcccgacggcgtctgcattccctgccagccaggtctgccacttcggggtcagagagggaggggttggcc

SEQ ID NO: 135415 - DNA, 1006 bp, Homo sapiens
gggaccaggcctaccttactggtgggtccccagcccttcacagccccttcctgagggttgggggaggaggggaccttctcccacctccagaggacaccttcccaggactcccccagtcctggcccttgtggtcaaacaaatccttgggctccagcaaagcctccctggcttgagccctggtctcagagctggccaggcccagccctgcctcatccggcccctccctaggtgatgtgctggtgatggacgagctgggctacctgtacttccgagaccgcactggggacacgttccgctggaaaggtgagaacgtgtccaccaccgaggtggaaggcacactcagccgcctgctggacatggctgacgtggccgtgtatggtgtcgaggtgccaggtatgtgcaggcaggcgcgaggtgtgggtagggaggcaccacccaggggcaccaccagctactcagtgtctaccctgccacccccaggaaccgagggccgggccggaatggctgctgtggccagccccactggcaactgtgacctggagcgctttgctcaggtcttggagaaggaactgcccctgtatgcgcgccccatcttcctgcgcctcctgcctgagctgcacaaaacaggtgtgtccctcccctgctccagctctcggatcccaggtcccttcccgtttccttctggagagacccggttggctgttacttgacctctgcacacagcctggccgggcagttggtaaagtgacctgcctgtgtagaggtgagcagacggggctggcagagaagacacacattgttccttagtagaacacatattaggtgccaggcacagcgctaagcctcgggatacggctggtgagctctggatgttttgccttcttggagttttagagcaggagagaggctggcctaggacaaggcattccaaaggtaaagaatcgaccacataatctgtcatgagattagagttaaacagataaaaagaaaaatgaaccacagagca

SEQ ID NO: 135416 - DNA, 1033 bp, Homo sapiens
gcaagcacgtccgtgttagaatccagagaatacggttgagcacctgccttatggggctgatgtacagatgaaataagctcacactgttacctggtaggtactcaaagggagacatcacagtcagaagacctccgttctggtccccactctgctgtcactcagcatgtgacactaggcaaatagcctcccttctccaggcctgttttcccatctgcaaagtaggggtgggtgggtaactagcagctgtccccatgccccaactttgccacagctgctgtatgaccattctttgcaaactgtaaagggctgtgcctcctcccccacttccctcccctgtttgtcctccagccctgctccctgccttcctcagtactggtggttgggaagctgggagctcgggcccctgccctgcactgagtcttcttccctgctctcccaggaacctacaagttccagaagacagagctacggaaggagggctttgacccggctattgtgaaagacccgctgttctatctagatgcccagaagggccgctacgtcccgctggaccaagaggcctacagccgcatccaggcaggcgaggagaagctgtgattccccccatccctctgagggccggcggatgctggatccggagccccaggttccgccccagagcggtcctggacaaggccagaccaaagcaagcagggcctggcacctccatcctgaggtgctgcccctccatccaaaactgccaagtgactcattgccttcccaacccttccagaggctttctgtgaaagtctcatgtccaagttccgtcttctgggctgggcaggccctctggttcccaggctgagactgacgggttttctcaggatgatgtcttgggtgagggtagggagaggacaaggggtcaccgagcccttcccagagagcagggagcttataaatggaaccagagcagaagtccccagactcaggaagtcaacagagtgggcagggacagtggtagcatccatctggtggccaaagagaatcgtagccc

SEQ ID NO: 135417 - DNA, 1052 bp, Homo sapiens
agactggcctctcagactctcctaggcgggtagcgtagctcacagcgggcactgggacacccagtgattcggccgtgtcaggccccacggcagaaggaaaggaattctgggcccgacgacttcaatccatccccacggcgccccagctctgtgactcacccgaactccacctccactgacaagggcgcagccatgttgaggaagccgagctcgcaggaaactcccctcaacttccggcgcgcccgcaaatttccgggcgtctccgggtgccgcggacggaagaggcggtgcccagggatccagcttcgtcagctgttggaggaagtcatcgaggggaggggaggggaggggagggcagcggagggaaaggggtggcagagggactatcaccggcgctgttggggctgtgaatcggtctccttccgtctttcaccgactgggctcagagacccagggtgggaagcgccttgtacgggaccacaagcaggcggaggagagcccccaggttttttgcgacgtgaccgtgagccacgtagctgcttatcttgcatgagttagaatctcttcagtctacacaccgcttgggccagcccatctactcgtctggttggaattataaatgactcccagatctttatttccgacccagaatctctcctgagcgggcgactcgctatccagccgccccctttgctgtcgatttggaagtcactcgttcaacagctgttcattgcgcctccctgtgccaggcattttgatcggtgctagtggtaaaggggatgggcaaggttcctgcctttagggcactcacagtctagcggggagactaactgtaatcaaataagcatactaagacatgtacaacctcaaacttaaataaaggaactgaagttataggaacttcaaaaagaaaactgagtagactggacttgctgggctctaaaacctgagtaaactaggtggctgtgaggggagagaaacctctaggagcattccagtgaggaggacaaaaggcccagaggctctgggtgagaacatgctggaacatggag

SEQ ID NO: 135418 - DNA, 1006 bp, Homo sapiens
caggacaacattcctccacccacccacccacccacccaccttctatcacctcctgtcacagcacagcgttccatgaaaattgcagcattctcaggaatgcccaacatgatgctcaacccaggttccttctctctttgtccttgtgttgatgcacgtttttgccctgacctttctttcatttcctatgtatcttagcagacatgattcacccttatccagaactggagcaaatttgcaaaggctaacacgcccttcattttctctcttttgtcccttagtggccccactcccactccagttctggaagggtctccctcctgagcagatgtagtcctcttggccccaccagctcctccagagaccctctggaaggcctctaacaccttccttcttgtcagtgaccacgtctgccaccctttgtcttccccctgaattgttctcagcagagcgttttctcaggtcacgcaggattcaaagtatgtaatatagttgtgttttgtgtccctgtggtccatgttgtaaaggcccagatatggagttctctccgtcccacccctcttcctccttcccaagttggggaggtattggcaaaaggagggaatgtcattgaggtcagagaagaactgggagaaatgggcatttcctttcctttagcagatatttgttgagtgtctaccatgtgccaggccctgttttaggcagagcttgcagcccagcaggtggagaggaagtaaataaacaaaatatatatatacgtgtatatgtatgtgtatatacagaagattaaaagatgaagatacatcagaaaaggtgaaggtggttttgagaatatctatacctgtcactggtatctacaaacacatccaccaagaattgggggggttgaaggaagatggagatatgtcagttgagtttgaatagcagatcttataagacataagagagtctggccttggtctctcctgggctagaacaggccccttgtctgcctccctgaatcactctt

SEQ ID NO: 135419 - DNA, 1023 bp, Homo sapiens
gatcctgtcagccaagggcagtcccccttcctggagcctctcccctctggcatctctgtacccccagggcactgggatcgaaggccacaacccctggtctgtagacaccagaacagggaggagtccctggctgaggttgggggtaaactgagaaaaatgacaagccaccctcttcaacacaccacagttgggctgggggggtggagccctggcctggggaggccgcccacaattaccacagtttgggagtttgttagttcccacccctgtaagacttgacacgtagtcttcatttctggggaattggcttaaaggggcagcatcacccaaaacctgggcacttggctaaacccccacctctgttatgggggccccttccccaggagaggggaggctgtgccccatgacagcagagcttggacccatctgcattcttagggacgcttagagcatggtttggtccttattacaacctgggggtggaggaaagcagcagctcttctgtctagtccccattcagagagggacaggggctggcctgtggtcacacagccacaggtcacataggtaggtatctgcccacctaacgaaggtaaccagggaatgcaccaggtgtgatccttaaagtcgaggtacttttcatctttcaaaatgcattcgttggccaggtgtggtggctcacgcctgtaatttcagcactttgggaggccgaagtgggcagatcacctgaggtgaggagttcaagaccagcctggctaacatggtgaaaccccatctctactaaacaaacaaaaattagccgggcatggtggtgcacacctgtaatcccaggtactcaggaggctgaggcaggagaatcacttgaacccgggaggcggaggttgcagtgagtcgagatcataccactgcactacagcctgggcgacagagcaagattccatctcaaaaaaaatgcattattcttctcttatctttgtccatgacataagcaggacagcttaagttatagagggaggacgtgaa

SEQ ID NO: 135420 - DNA, 1095 bp, Homo sapiens
gatcttagaagcactaggtgagggctggggaactgttccacccacctgctgccggggctccctgcctccccacggtgcccctttccctaggccctggacggagcgggcattggccttggggttccagctttgtccctaactcgttccatgactctgagaaagtccctttccctgttgggccttagtctagcatccctacaatgggggcaggtggatcctgtgatctctgaggtcccgtcctgtggggtgttctgccaaagggggcaggaatgaggctgggggctaggacttcagggtgactgctaacaggagtcagtagggactcgtgcttggggtgtgcttccctttgcagtggacggcccccgcatgcaggcctcagctcatgtgactcggccctctaagaggcccagcaagatagggtttgacgaggtaagtcccccagcctgtgggctcgctgttaggaggtggatgggccctcctcttccgctcccttgcacttaccgcccacccccctgcctcctccaggtctttgtcatcagcctggctcgcaggcctgaccgtcgggaacgcatgctcgcctcgctctgggagatggagatctctgggagggtggtggacgctgtggatggctggtgagcctgcctggtggggggggccctgtgcgcttggggaagcagtgtggtccatctcctagcccgctaggactgggaaaagcagacaggttgaatgagtttcctgtcccatgtagtatccaaatagggtctgagtaatatcctctcagggagttccggagcagacacacgtgggagaagatgccctcctgctgctcaccagaggaggagagcacagtggctgaggctccagggcctgggttccagctctaccagttactgaatgtgtgacctccagccagctacccccatctctcagcccgtttgtataaacagcagataactgtgcccttctcttagggttttgtgagtttagtgaagttagccagggccgggcacatagtttccaaaggcttaggtgtctcccttattattactctccatcctggacttgagctactgatgcgtggggattaggaaaggc

SEQ ID NO: 135421 - DNA, 1050 bp, Homo sapiens
ctcatgcctgtaatcccagcactttgggaggctgaggtgggtggatcacctgaggtcaggagttcgagaccagcctggccaacatggtgaaaccccatctctactaaaaaaaaaaaaaaaacattagctgggcacctgtaatctcagctacttgtgaggctgaggcaggaaaatcacttgaacctgggaggtagaggtttcagtgagctgagatggtgccactgcactccagcctgggcaacaggggctccagttccccaggtccagtcccttgacagcttcaggtcacacaaaggagttacaaggcagaaaccttcttcaaacccgactccagtgtgactgtccccaacatgcacaggcctggcccctctggaggggtctctggcaggcacccctcaccccgccacacctgtgtccctcaggatgctcaacagcagtgccatcaggaacctcggcgtagacctgctcccgggctaccaggacccttactcgggccgcactctgaccaagggcgaggtgggctgcttcctcagccattactccatctgggaagaggtgagggtgcctgcttcctccatccacagccttcggggagaacggggccagtttgttctattcactgctctgtgaacgagtgagtgaatgaagacattcatcaaaacctggccagcagctttcaatctcctctgtgttcaacaccccagtgggcaccactaagcggtgcttgttttcattctgcagtctctcttgagcatctactatgtgctaggagatattctgctctgagaacacagaggaggacaggaacaatgcatgtctgctccttcctgcaataaagggatccccctggggctcagggaccagagcgggattatggaaatcaaaaccaagcttgcagtggaggggagaggtatgggccactttgagaggtgcctcgtgtgggagggggtcagaatggacctcaccattgaggggccgggagaagaggcttctaggcagaagagaacagtgggtgccaaggccctgaggcaggaaggtgtttaggagcag

SEQ ID NO: 135422 - DNA, 1371 bp, Homo sapiens
catttcactccagtctgggcaacaagagtgaaacttcgtctcaaaaaaaaaggaaaattgcaggaggccaaagtgacaagctgggccctggtgttcagcagatgcgggttcatatcccagctctgccacttcctggctgtgtgtccttggacaggcagtttcccatccctgcatgtccacctccttcctgcgattgaggatcatcatctcctgcctcctgagggcccctgcagatacgcagtggcacagccctggggcacagtagcactcagggaatgtagcaagggccacggttaccatcatgattctatctggagatcctcaaatgccagagcgaggttgggatttccggtcccaggcagtggggcccccagcaggctttggggcaactgcatgatgtggccaggccaactgaggccaggcagaggctgtgagcttcagcgtggagggaggggggttgtttaactccgaagagccatctcccaccccattgtatgccacaggtggttgccaggggcctggcccgggtcctggtgtttgaggatgacgtgcgctttgagagcaacttcagggggcggctggagcggctgatggaggatgtggaggcagagaaactgtcttgggacctgatgtaggcagcctgcaccctcagggacaagggggcagggtgggcctccggagtctgccttttcctgcttgggaccctggccggcccatcccctgagagcctggccctgtaggagcgggtgtgggagggtcccatgacacccaggacctaagtgactcctgggccccttggtgtcacttacagctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaagtgaggctctgatgggggccgggcatggcagggcagaggcgtcccctccaggaactcacctcagtcagcaggaagtcccctcacctggcagatggggagactgggactggcaaggccaagccacttggcccaggtcaccaaggagtggctcagcctagccttagagtcagtccattctcggtgtgtactttgcacagtgcatgcaggcttttttttgaaatggagtcttgctctgttgcccaggctagaatgcagtggcatgattttgactcactgcaccttctgcctcccaggttcaagcaattctgctgcctcagcctcctgagtagctgggattacagggaagtgccaccaca

SEQ ID NO: 135423 - DNA, 1086 bp, Homo sapiens
cccaccctccctgccaccccctggtcgctccagcctctctgatctccccccactttggggggccaggtgcggtggctcatgcctgtgcaatcctagcactttgagaggccaaggtgggtggatcacctgaggtcaggagtttgagaccagcctgaccaacatggtgaaaccccgtctttactagaaacataaaaaattagctgggcatggtggcacacgcctgtaatcccagctactcaggagcctggggcaggagaattggagaattgcttgaagccaggaggcagaggttgcagtaagccaagattgggccactgcactccagcctgggcgacagagcgagactctatctcaaaaaaaaaaaaaaaaaaaaggccaggagatggatcagatggttattccaaggcccttcccatcctggactttttggatatactgctgaaagattttggagcaaatagacttttgctctctctcttttttttttttttatttggctgtctttgcagatctggtgatggagctgtacagtatatgtgtaagcaaggtgaattagacatggcattaaaaaaaaatcccctgctgcttgagagcttaaaggatagcaagtggaatattttgggaactagatacttttttattctcttaggggaatatttgagccttaatttgatgagtgtgcgtcacagtgacctctcgtgcctgagcctaatgctctttgaaaaaatttttttttcttttttgttgttgttttgaaacggggtctccctctgccacctaggctggagtgcagtggcgtggttacggctcactgcagcctccacctcccaggcttaattgattctcccacctcagcctcccgagtagctgggactacagacacacgccaccacgccaagctaatttttgtatgttttgtagagatggggtcttgccatgttgcccaggctggtctcaaactcctgggctcaagcaatctgcctgccttggcctccaaaagtgctgggattacaggcatgagacatggcttgtggccactaatgctctatttttgtcactcactcactgcatctttctccagggccg

SEQ ID NO: 135424 - DNA, 1556 bp, Homo sapiens
cctggcatgcagcctgtgtagttctcaattggaaggctccttatttttttgtttttgtttttttttttttgagatggagtctcactcttgtccgcccaggctggagtgcagtgggcacgatctcggctcactgcaacctctggctcctgggttcaggcgactctcttgcttcagcttccagagtagctgggatcacaggcatgtgccaccacatctggctaatttttgtattttcagtagagatggggtttcaccatgttggtcaggctggtctcgaactcctgaccaaaagtgacctacccaccttggcctcccaaagtgctgggattacaggcgtgagccaccacgcccggccggggccttattttggtccaaagcattgagcctagcaatgtggcatagaggaaggacctcccttcagtggcccctgcctgggtccccctgctcaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatgtaaggtggctcctgctctgtccccgctgatctattcctccctaccaggctgccttgagccctgggcaataatggaaagcaacgtaggaggtgggcacaggcactgtgcctgtgccctggagcctgttcaacagtcacacaattaattacagttaattacctggttgtgcttatgatttgtactatgagggaaagggaggaccccgtggattgtggtgtgggactgggtagcagggaactgtttctggaacaagtgatatttaaggggtgtcctgcaggatggttaagcattcggcaggtgggtgctagggaagaaagcacgctactcagtgggaacatcttatgcgaaggccccaaggtgggaaagtgtttgtagctgagaaatggaaggcaggccagagtgggtgggcagaggataagggggccacataggttggcagggggctggctctcagcagccactttgaggcatttgcattgagggcatttggaagccatggaaaggatttattttatttaattaatttatttggccgggcgtggtggctcacgcctgtaatcccagccctttgggagccaaggcgggcaaatcacaaggtcaggagttcgagaccagcctggccaacatggtgaaaccctgtctctactaaaaatacaaaaattaagccgggcgtcgcggcgggcgcctataatcctagctactctggaggctgaggcaggagaactgcttgatcctgggaggcatctcaaaatttttgagatggagtctcgctctgtcatccaggctggagtgcagtggcgtgatcctggctcactgcaatgtccgcctccttgactaaagtaatcctcctgcctcagcctcccaagtaactggaattacaggtgcccactaccatgcccggctaacttttgtatttttagtagagatggggttttagctgttggc

SEQ ID NO: 135425 - DNA, 1103 bp, Homo sapiens
tagcattcactattttatagtgagaatatattcacattacttttcaaattagaactacagttttttgggccaggtgtggtggctcacacctgtaatcccagcacttggggaggccaaagcaggcagattgtttgaacccaggagttcaagaccagcctgggcaaacagggagaccctccaactctacaaataataataatgtttaaaaagttgggcatggtagtgcatgcttgttgttccagctactttggaggctgagatgggaggatggcttgagcccagaaggaccaggctgcagtgagccatgattgcaccactgcactccagcctgggcaacagagtaagactctaaaaaaaaaaaaaaatacaatttttggaaaaggtaaagaatcaataaaatgtagacatctgggtttattgcttaatgacttgactttttcctttgcctttctttgaaggattctgaaagactaatggagcaacaaggagcactgctgaaacggctggcggaggccgactcagagaaagcggtaactaaggctgcccttgtctactctagtgggtacaggtggcaagagcgtcgttccactacaaagtgtagaggtgcttggatcaaggcaggagggctggagcatttcgctaggtcttagtttcacgatctgtaaaatgggctgatgtcctcctgtcacgcttgttctgataggcttgtctagttagttacttgagaccttgagccacaaagctggacaccaacatagagagggtaatgatgatgttggatttgtaaatcatccgtgtctgttaaagctggatttccatcaaattagtattatggattcaaagccatcaaaaagtacacacctttggactcagtaatcctaattctaggaatctctcccaaagcagcatgttccaaagtctgttcatggaaccctaagttcctcaagatgttaatgagtgcaagaaaccgaaggggaggttccatagccagttaaatttgggaaaccataggctggcctgaacatgaagttcaacagcttctttcaagacttttttggagtgtctgctgtattaatgcttttgtaagtctccaagagagggga

SEQ ID NO: 135426 - DNA, 1050 bp, Homo sapiens
gctcaagaacccttgttaagttatgatatacatcagtaacttgaaccgtcaagcagctctttcaaaagacacagaagatttaatcacattatggtaaacatgagcttttaggctatggaacgaagtaggcatatgactttttttttttaacggtgctgagcatatgagtttcaatgtgcattaactggttatctctgcatggggggttacggggtttctttggaggatttttttggtgtgttctcaatgttttctacagttaacattgctgttcttaaattgcaaaataaatacatgttcattgttttaaaaaaatgttttaatgcatatgttaggtgcttcctaccagaatctctgacatgggccaatgtatgtaggaccttgggccccagtggccaggtactcacaaatctctgtcctccctgggccgggcctctttgcccttcccaggggcacctgacagcctgtgttctctcccagcgcctgctgttactgctgcaagacaaggacaaggaggtggaagagctccttcaggaaatacaatgtgagaaggtagtgtgctttttttttttttttttttagacggagtctcgctctgtcgccaggctggagtgcaatggcgcgatctcagctcgctgcaacctctgcctcccggatttgagtgattctcctgcctcagcctcccgagtagctgggactacaggcgtgcgccaccacgcccagctaatttttgtatttttagtagagacggggtttcaccatgttggccaggatggtcttgatctcttgacctcgtgatctgcctgcctcggcctcccaaagtgctggattacaggcatgagccactgcgcccagccgcagttgtgcatttttatgagccagtagaatataatggatatgcagagagctgggttcaaatcctgtctttgggccgggtgcagtagctcatgtctggcactttttcgagaccagcctaggccactccctagcactttgggaggccaatgcaggaggactcattgaggccaggagtttgagactgtcctgggc

SEQ ID NO: 135427 - DNA, 2483 bp, Homo sapiens
tgctgagatgggaggatcacttgagcctgggagactgaggctgcaatgagtcatggtcacgccactgcactccagccttggcaacagtgataccctgtctcaaaaaaaaaaaaaaaaattattgaccatgcgcggtggctcacgcctgtaatcccagcactttgggaggccgaggcaggtggatcacttgaggtcaggagatcgagaccagtctggccaacatggtgaaaccctgtctctactaaaaatacaaaaaactagccggttttgatggcacgtgactgtaaccccagctactcaggaggctgaggcgggagaatcgctggagcccaagaggtggaggttgcagtgagctgagattgcgccactgcactccagcctgggaaacggagcaagactccgtatgaaaaaaacaaacaaaaaattgtgcctccatcactttttccgtctctccacaggctcaagcaaagacagcctctgagctttctaaatccatggagtccatgcgtgggcatttgcaggcacagcttcggtccaaagaggctgagaacagtcgcctgtgcatgcagattaaggtacctattggccccacaagtggggaaagaggaggcaagggcctgccaatttgatggtagcggcctggcccagatatcacactcaggaagtgtgcctccaaaggtttctgaggcagctgatgacaaaatactcaggcctcagagacattccaggacagtggcaagagcaatggacagagacccaggaggtgttgggcatccttcccaacagtgacggggttgcgtgccatgccccccaggcctatcacttaatcccctaggccctcagttctcctcattacccaagggaaagggatggtctctttgtagcccaggggtcctctgaggtcatactctgctgagtgaccaaggaactatctctgaccacaaggctgggagttcagggaaggattccagagcagttctgacctaatatcaagaccccatgggctgagagatccagggaggtgtcgtggggagctgggagggactgtgtctctggtccgagttaggggagcctctcacacagctaagcacttttttctgtcttcctcgtttcctctttgctcttgccttttcctccctttctccttcaccctctgctttgccttcccacaacctccttgtctctcttctccctctctttctcaccccttcccccttccagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggtcgcaggcccgcggtgcccagctcctcacctgccctgaggagggctgggtgatggcagaggggtggtcagccagatgggtagcggggaggggtgggtggatgagggatggtagtggtggaaaggatagatggctggggaggagggagagggagttaaggggatcaaatgggtaaaagctggagggatgggtggctggagatgattggaggctttgtaggagagttcagccacatcagctttgtgggtgagaataatggttaaggaaggatttacaaacaggatgcatttgattgctagaaatctgggagcactagctgggctcccactgttgcttccagcgccctctagaaaggtgaattccagaatgaggtttaggttaccagggtgagaaaccacctaggatgagcccgctcccagctcctggcagcctcaccactgacactaggctaacaggcccttttgtcccgtgttcccaggatctttatgtcgctgaagctttatccactctggaatcctggaggagccgctacaaccaagttgtaaaagaaaagggagaccttgagctggaaattattgtcctgaatgagtacgtcttagagtaggagagggaatgtggcgctgttgagggacttgggtgtgcaggtgggaggggcctagtggctcagggaaggccacgtggctgctgtttgtactctccgggttgggggctgcactgggctgtgatgtgggtagccctgagctgggctttctggttggagctggggtgcaagctctggccctagtcctggggtcctaccctactgtcaggcactggctaggggccgggtctttctggtcagaggtgtgggtctgacttcatcacctgggcctgatcctgtcctcagtctacacagcatttgaaatgggcaccgtggtgtcctcattcctattggggaatggggcagatggtgacccgagtgtcttctctctgttgtctgtccagggacagcagctgtttgccagtgcctgccagtcagtaggtcagtggtatggcatgggagtagggggcaaaagtggcctcaatttgcaagtgac

SEQ ID NO: 135428 - DNA, 1050 bp, Homo sapiens
caggcaggcagtatattgagtgatgagaacgctgggtcccacaccacacaaagacctgggttctttagaacctgtgtaattggccgggtgcggtggctcacacctgtaatcccagcattttgggaggccgaggcgggcagatcacgaggtcaggagatcgagaccatcctggctaacacggtgaaaccccgtctctactaaaaatacaagaacttagccgggcgtggcggtgggcgcctgtagtcccagctactcgggaggctgaggcaggagaatggcatgaacacgggaggcggagcttgcagtgagccaagatcgcgccactgcactccagcctaggtgacagagcgagactccgtctaaaaaaacaaacaaacaaaacacacacacacacacacacacacacacacaaacaaacctgtgtaattgattctctctgtctgctttcactttgtgatcttccagccgggtaacagatcttgtaaaccaacaacaaaccctggaggagaagatgcgggaagaccgggatagcctggtggagagactacaccgtcagactgctgagtattccgcattcaagctggagaatgagaggctgaaggttcgcagtgagagctggggaccaggcagctggatggggcccagcgagctgatgaggggtcttgtcttacgtgggcctgggggcatcttgactaagagggagtcagaaaagcctggatttgaccaggcatggtggcttaggcctgtaatcccaacactttgggaggccaaggcaggtggatcacttgagcctagttcgagaccagcctgggcaacatggcaaaatcctgtgtctgcaaaacatacaaaaagtagccaggcgtggaggcatgcgcctgtagtcccagctactcgggaggctgagttgggagaatcgcttgagcctgggaggttgaggctgtggtgagccgagatcgccccactgcactccagcctggaaaacagagagagactctgtgtcaaaaaagaaaagaaagcctggattcaagtccttactctgctgcttcctgg

SEQ ID NO: 135429 - DNA, 5495 bp, Homo sapiens
cccatggtggggaaaaactatgttacatagcagtaagtatagtatagtctcattctttttgacagaaacgaaaaagttatgcagctatagatatatagccatatccaagtcattaagcattaggattagtgtgtcttggttttatccccattttcttttttttttttttttttgagacggagtcttgctctgtcgcccaggctggagtgcaggggcacgatctcaccttactgcaagctccgctttcgggttcatgccatcctcctgcctcagcctcccgagtagctgggactacaggcgcccgccaccacgcccggctaattttttgtacctttagtagagacaggatttcactgtgttagccaggatggtcttgatctcctaaccttgtgatccgcccacctcggcctcccaaagtgctgggattataggcgtgagccaccgcgcccggcctggttttatccccattttctttaatgattatatattgcttttggattaagaaaaaacagaagtcatttatttgcatctctattcacttgaggtggtaacattaggagtcttacctgcttctcggtgcttctctcagggaaagtgctctgtgggttagagtagggggcctttccttttctggttctttggatagagttgagggtaggaggtccacctgaagcagaaccttcctgtgggttactcatgagccatcccttccaggccagctttgctccaatggaggacaaactcaaccaggcacacctcgaggtccagcagctgaaggcctcagtgaagaactatgaggggatgattgacaactataagagtcaggtaggcctcactggggccctggcccttctgagcagtgccctccctgcccccatcagactgggggctccctaccaggccactcccagggagggttgggtatggaagatggttttcatcaaaacgtggctctacctaagatgaaccacagtgttgttggtccctaggtgatgaagaccagattggaggctgatgaagtagctgcccagctagaacgctgtgacaaagagaacaagatccttaaagatgagatgaacaaagagattgaggcggtactgctttccttccttgttttcttctcctacccaattccatatctaactcaatgactgtgagtctgttccccttgtttgcctttgaccctacctgatttgggcaacaaaggtgagctcattttctcattggtgggctcatccactctaccctgtgcctctctctcctttgtctctttcttgtttcctctcttctctctctcatgctgctgctttgtcttttttttttttttctcttggttttcttctacctccttttcaattttcttaaaataacaacaacaaaaaaactctcctggctgggcacggtctctcacacctgtaatcccagcactttgggagactgaggcaggcaggtcaactgaggttgggagttcaagaccagcctgaccaacatggtgaaacccctgtctctactaaaaatacaaaattagccgggtctggtggcgcatgcctgtaatcccagctactcggaaggctgaggcaggagaatcgcttgaacccaggaggtggaggtagcagtgagccgtcattgtgccactacgctctagcctgggcaacaagagtaaatactctgtctcaaaacaaacaaacaaacaaacaaaaaacctcatgcttggagcatccaagtagacagaaatctacagttatgccaggtctttggcatgcctatttcattctatatggtgtccttattttgtaccagccagaaaatatgtctcccatcctcttcccaaagagccttattcttctacagatggtttggctgattagagcagcgggattatcttaatggttaccttggagatgggctgagtccaggctcagccactaatttgtttcataaccttgggcaagtcaagcccctctctggtcctcagtctccgtgttaagtacaaggatggacttagaccagatatttctccctttccctctgacctgtagcattgtgactgctttcctaggggctttagagttagacttttaaaatttattttattttttttgagacagagtcttgctgtgtcacccaggctggagtgcagtggtgtgatctcagctcactgcaacctccacctcccgggttcaagtgattctcctgcctcagcgtcccaagtagctgggactacaggcgtgtgccaccattcccagctaatttttgtatttttagtagagacagggtttcaccttgttggccagggtggtgtcgaactcctgacctcaaataatctgcgccccttggctttccagagtgctagattacaggtgtgagccactgcacctggcttggagttagactagactttaatcctgtgtttaccagtttttagctgaatgaccttgggcaaatgacttagctctcttgatgcttactatacttgtatggggacagcatcacctattttacaggttgtctgaattaaatgagcaagtgtgcagagagcccctggtacaatgcctgggtcttggtgtttactgtgtggttgccattgttacgggataactaaatgaatggcaagccacctgctcaatggccagcggggagtgtaggccacacttctgctgtggattttgcaggatcctccactggggactgtgtcagccctgccctaactctaaaggactctgcctggctccactaggagccaggtctttcctaactgtgggtctttccttcctgtgggtctttccttcctgtttcaggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccgggtaagggactggcagaaagggtcccacgaactgacccgagcaggggcccgcataccaagatgagctgcacgccccccaagggaggactacttcctttttcttggctgctgctttttaaaaggagtgagctatcatcagtgctgtgaaataaaagtctggtgtgccaaatgccatgtgtttgcacaaagtgattgtagttataggagccgtcacttgcgtggagtcactgggccctcctgctgttgcccccacccaagactgctgcctctgcctgtgtgctccgcagctgtcctcagctccacacccacagctgggagatgccagcagacaccgagccgtagaatttctttttttctcttgctttagctgcttctcctgactctttaacagatgcactgcctgagattctgtcctgaaagaagcaagcatccctttctcccagaagcagtctgtctctgggttactggaaccatgcctacggcctgcagtgtccaagaaattatataccactcatttgcagcgtgaccttgggcaaggcccctttcccactcttgacgtgtgtacttgtgataattagaaaaggggctaccattttttgagcacctcttctgtgttcctgcattctctcatttaattccatcaggaactctgtgaggtgcatgtgttattttccccattttacagaaagcagcccaaggcatagagaggagaagtaattccccaccatcacagagctagtacctagtaagcagggattggaacccagccagctctgtctggttcccaagcccacattctcagtactgtaaccttacattgcctgccttctccgttgaacctgagcattctcagggactttgagccttgatagctgaggcttctgcataaaacagccctctgggtaaattctcaaacttgccaactcaaaaggattgacagatttcctgttgtcttgcctgcacttgtccccagttaagaggaggttgagatcaatagtaccagcaacataacaggtaaagctctgtggttggtttgtatgggccagttagccctgccagctgtttctgccttctcatgtctgtcctggatcctagctgggtctctctgagtggcctcccctgatcgagaaagcatctttgtcattctttagcatcaaacctggtttctcccagtgtggggagagccttttgtctttggagttgggcctaacctgtccctgctgtcctttctcctctaggttgtgcgttgagacttggacacctgctgagggcactgtgcccctttcctgggtgtggacaacaggtcatagggaaaggggagggctctagcgggaaattcctttgtaaaccagtctgtgttcctgtcattttagatcgaacaccagggggacaagctggagatggcgagagagaaacatcaggcttcccagaaggaaaataaacagctgagtctgaaggtggatgaactggagaggttagaggcacttggtcccatctctgtcctcttcctaggacctgagactttcagccacttagctgttttttgcttagtgtgcggaagtgttgagggactcgaggccctggaaggtactaggcagacctcagaggaaaagctgcttccatttcagtggtaagcattgtgggagagagcaagggggcctctcagcctggggagacactccatgacagcatgatcaggatctgcccacctgtaggcaccacctgtcccaaaaggcatgcctggtccaggcctgccaggagggcccagtttgaatggagcagccagtatactgtggtgggggcacttccccactcttttctgccctttcttgccagtcacccttcccaagacctttctgatctgaccgttctctgttatttacggattgttggaggcagtcagaggtgaagggtacggctttgggaatcagaagccctggccttggggcccagctctgccacttaccagcattgtgatcttgagcaaatcatttaattcctttgaagctcaatttcctccttttgaggaaagggtcaaggtagagtttatctatctatctatctatctatctatcatctatctatcatgtcactctgtcacccaggctggagtgcagtggtgcaatctcagctcactgcaacctcgacctcctgggctcaagcaattctcctgccacagcctcccaagtagctgggactacaggcgtatgccaccatgcctggctaatttttgtattttttgtagagatggggtttcgccgtgttgcccaggctggtcctgaactcctgggttcaagtgatccacccacctaggcctcctagagtgctgggagtacaggcgggagccaccacacctggctgataataatcttttcatggtggtggtgtgagtcttcaatgatataatcctggtaaaggtcctagcatgttacctggcatagagaagcgctcagtatagcttagaacatgttattagttagctggtattatcccagttttaaatatgaggaaactgagcttggggaggagttaagtgact

SEQ ID NO: 135430 - DNA, 1049 bp, Homo sapiens
tcagtcccgatttcatgaatgactagctctgtgaccttgggcaaatcacctaaactctcagcttatttctccatctgaaaaatgggcacacagtagtacccgcttcatgaattagttgtaaggatcacattttcatcgtagagggctcagcacttgatatctgatgattgctcatttactcactaccctcttgagcctcacataggcttaccacatcttaggtggtgactcctggagcactggcaaagctgggtggcaggcatagtccccatagttagttcctgccccagcgttctagagaacacagtccacaatgatgtgcaagtgctgtctgcaagaccagatagtgggcccagccttctctttgccaagtgttccccatgtccggtaaaccagtctcatgtctgggcctttgaatgtgcaggtggaacaaaccaaggagcacgcactctccaaggagcgagcagcccagaacaaaatcctggaccttgagacccagctgagcagaaccaaaacggaattgagccagctgcggcggagccgtgatgatgtgagtcaggctggtgggccgggctaggagagtgggcagcagacctagcttctgtggggcctgtgggccaaggtgttttgttgttactgtttttgtgaatatgacatggttttatttttctccaatcactttctatcccttaaggatatcctgggtagatatttatttatttatttagagacggagtctccctgtgtcacccaggctggaatgcagtggtacgatctcagctcactgcaacctctgcctcctggtttcatatgatccccaccccaccctcagcctcccaagtagctgggattacaagtatgtgccaccatccctggctacttttttgtgtgtatttttagtagagatggggtttcgccatgttggccaggctggtcttcaactcgtgatctcaaatgatctgcccatcatggcctcccaaagtgctgggattacaggtgtgagccactgcacccagactcacgttttgttttgttttgttttgttttgt

SEQ ID NO: 135431 - DNA, 1289 bp, Homo sapiens
tcactgcagcttcaaactcctggggtcaagtagtcctcccaccccagcctcctgagcagctaggactacaggcgcacaccatcacacccagctaatttttgtattttttgtagagatagagtctcactatgttgcccatgctggtcttgaactcctaggctccagtgatcattccgtcctgacctcccgaagtgttgggattataggcatgagccactgtgcctggtcttagaatattttcagaaagaaaccccatacccattagaagtcactccacactcgcctccccaaacctcctggcaactcctaagaaagtccctatgtctctatggatttctattttggacactgcacagcgggcccatgctctgtttctcctcgttaggcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggttttttctgacctaaaccagcaggaagtcgtcctgggctgtaagcaccatcacttgctttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagttatttaaggctc

SEQ ID NO: 135432 - DNA, 1137 bp, Homo sapiens
tgtatatcataggtgtgattcatgtgtctttctctccctgtagaattgaagctatcacaagctcaggacagatgggctccttcatacgcctcaagcagttcttggaggtaagatgcccttagaccaacatgccccacactgttgttgggctggaatgcacctatgtctgacaagtcttggaccttccgatgctctgattgcactctcttccttagttcttccaaacccttctttttgttcctaattccctcttaacctttggagtaagggctgccatttcctcttctttatatgtatcattctctatactgcctgtgagaaagctatgctgagatgagtaaaatatatttagtgtatctcctctcattaatatatattttttttgcatgttggccaaggttattttcttagtctcaggtctggggaattggtaagtgtcatcacttttctccatgagatcaaactgcactttcagttggactcttcccctacttccaagtgccaagagattgtaaaaggttaattttgacaaagaatttagaacactatagtgggtttgccaagatagcctgctgacttttcagcttctcaaagctcgattgtgaaaatagtgattgtgaaagatgaggttagcctgtagggagacaagagtgggacaggaataataagagcatttcatttgttgtctggagcagatcatgcagaagtggacatcttatacagaaccatcagtcttactggctttttcctttttgttcactgttccatagggctgaaatatggtgttcctcaaagcttcttttaaccattaagtgttgggaacactgttatcagaaactcattctgttttcttcatctttccctgaccagaaatgtttgcaacacaaggacattcctgtccccaagggctttctgacttcctccttctggcgctcctgatgtcactccatcacccaccatcaccgctgctgcaaagaggcaataataaaggaactgaagacagctgtatttgggagaagtcatgtcagattcagaaatttgccattatgtatttttatgtatttatgccttgtgactaggagaggagattttcatgggtcacaaaattcttggaggtcccttagtagatttggtagt

SEQ ID NO: 135433 - DNA, 1060 bp, Homo sapiens
tggctcaaatcaaataacttaatagcttagcgttcttgtttgtgtgtgtgtttcctgggactgggtctttcgagtcgagatacagtgtcaaaaattctaccataccactgttgaatgatagaacagtcttttgtttgaaagctgtccctgagaatttgattagacgcttcccctagaacatcgctttcaaaagtctctgatgtactagagtaaaatatattttaaataagcgccttgttaaaagttgaatatgttttaaatgaaaagcctaaatagctcagaaagctgggttgagatgatgcttgaactgttccaacatctaatcagatctcttttatataatagatcctaaaatatttaagccctttgttctgtcttcatcatgttattttagaaaaacttaccatcatggctgttcgggaagaacaggagagaggccatatgaagtattttcataatgtgttgagaaattgcgtcgtcatagcaattggccttaagtaaaacagaatgtatcaaagatggaagggtgggggtgtcttggagccaggaaacagaaaatcttggaaatagcaggaggaacactcagctatatgaagccattgagtcaaggttccgactccttaactagtcgtttattttccctttcattgcagctaactaatgtcttagattttgaaaggtcaaattgaatgtgctgcggaggaaaaaaaaagtgctgcagtaaaggcctctgtgcaggaaattaacaataagccttttttagtaactgggccaataattactcaaagggaccctcaaagtgtgttaactgttatccagggaccttgatggagagactggaaaggaggatttttgcttcatcctggacaagtgtgaagcagttcttatggcaaaccatcagcctagtaactgattctctgatatgctttggtcttggcagtgtgttttgtagtcatctaataattggagaaatctggtatgtcacaggctgcagtgtaagcctgtcaagcaatatgatgaagaggtgcacatggggagagctgttttaagtatgtctttt

SEQ ID NO: 135434 - DNA, 1043 bp, Homo sapiens
ttattactttaacaagtggggaaattgaggccccaaggagaatgagacttgaccagggcagcatatctagaaagtaactgccaagacctgggaaccttggttctccttccacattttaaatcccttgtgggatttagacgctatacagaatgtcagagagaagacactgaaaaaatatctgaaattggatttttaatctgtattcatattttttaaataatctgttttcttcatgattttgttccgtttgcccttagaagcttgttatcttgctcttccccctccctctttagactccacattcctccatcatgttgtcatcgtttcgtaaacgcagagtccaggtatttgacgagcatgcagaaaacgggttgcctttttggttttgcctggcttgcagtgaaggcatattcgtgtcaaagaggttgaatgatccaaagaaagggggaaaaaaaccctgcctgcatgacgtttctgttaaacaaattggttaggatttgtttggggttttttggtgttaaattatcagaagtattagtaaatttacttgaaaatttgcaaagcctttttttttttttttttttttttaacctccctctctttctctttaaggcatgaatatattaatttcttaccaccattctggtgtttgcatgtagtgtttgctgactttttattggtggctacttggtttttaagaaccaagggactaaacatattatcctagatatttggagaaaataatctgaaaatacatagtaaaaattgtgtttttaaaatttgacaaatattgtaaacttgggtttgtttcctgttgcattgacttcttccaccacaatttctataatagagcttaccttttcatgtttaaaaaatagctctcgggctgggtgcggtggctcatgcctgtaatcccagcgctttgggaggctaaggtgggtggatcacttggtcaggagttcaagaccagcctggccaacatagtgaaaccccatctctactaaaaatacaaaaaattagccgggtgttgtggtgggcccctg

SEQ ID NO: 135435 - DNA, 1051 bp, Homo sapiens
cctttttcacaaaaaaaaaatttagtatcttgatatcccaaaataaaaaatataaacattggaaatttctagtgtttataggtgataaatccaaggcaggcctttttataaatcagatgagttatttacttaaatgaggtttataaaaatgggccacattataaccatttcctgttttgagtcatagtaacaataaggaacttaaatacctctcatctgaattttgcaggttaaaaggtaagtagcagcaagatagtatttgggaagcaatcagaagtaagttttctcaatattgctctgcatttctggattttgatgcaatgcagtatgaatcttttgctttcttaaagctaagtccctgctcacctctgcaaaattgcgctaacaagttgaaatgaattaatcagtttgaaggctgacatgctgatccacaatcctgattggaatgtggtttaagcaaaaatatttgttgtttttatttatggtgttcagtcatcctttatgtattattgacctctctgcttaccatcaaatctgccactaaaatctgcagctaagctggttttgagttaattttgtttgatctgagaatcaactggtatacaattttatgagtgctaatcaattctttggtggtttgttcttagggaagcccttccacatccatggatatagttctcttgctttgcaaatctgaaatttggtaataggctggcatcctaagccacggaaaaaagacattgttggttctgcacatttgggttctgactaagcaacaaaagcaactgatgaatggtttctatgatcttttgctttgggtgatgtttatgaatttttccataaccaaatgaccaaacgacccgttcatcctgttagtccctaaaaatccctttcttgcaaaactgtatgtctagtggtgtcctgcctgagaatcagaattcattttgtagtattccaaatgtctcttacatccagtgcattcaacttgctgaaagaatggcaatcccaatgctttgtttttaatagagactcctttcagcttcactataat

SEQ ID NO: 135436 - DNA, 1042 bp, Homo sapiens
ttcctctgaatccttgaagcctttgtagaattgacagtacaaaccatagttctcccattcacagttttcatttggtttccttgccgtgtgtgggttaggcatcttctgagggccctatgtaggtaggtgttgcaggggaatggatggccgtttttaataaagaaataggatctgggcttcattgttcctaagaaggggctgtcttctcaattcatttgtctcctgggtttatctgataattatttctttccttcagagaggctaattacttttcatctattttggtgcctattggtacttatctcagcgcattttgtcatttcagaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcaggtacgtctgatctcctgggattcctgccaaaattcaagagcccaaatgttcttacccaaaaatcagacgaggaaagttacttaattatgaccttgagagattggacaagaagaatataataaggaaggacaaactcattgttttcctgtattagtgagggtgaatgtggaatcttagaggtattaattgtcttttctggatgctttaaactgatggttctcaaacctctgccttgatactactggtgagctttaaacatttttcagggaagttctgggttaatctcttggaatgaggttttttgttttgttttgttttgtttttgttttttgaggcagagttgcgctcatgtcgcccaggctggagtgcaatggtgtgatcttggcttactgcaacctccacctcccaggttcgagtgattctccagcctcagcctcccaggttgctgggattacaggcgcctgccactgtgcccag

SEQ ID NO: 135437 - DNA, 1064 bp, Homo sapiens
taggcagggtcaaagagtctggcctctaaagcaagtgaaagaaagtctcatgtgtgagtgaatatggatggatttttcaagagtaagcactgaatgttgagaaaactgttggtatggttctgtatttctagaagggactggatgttcacataaaggctaattttctgatagcaaaaacaaaaaattattaataggatattttgtagcatcttccattgacaatgttagttctcaatggtgagtgaggaccattgatggccctcgctggccaggctttcagaggaccaggagaaatgcagtcagagtatttgaggaattgagcaggtaagagaatgggcaaggtgccaaatgatgtatccctaactagagggagcaggattgaggaggggaggaacacggggaacagcggggacaaaatgctgatgctgtgtggttgcgtctgaggctcacttcaaggtccgccaacagggaaagcttcagaagcatcaagcatttgaagctgaagtgcaggccaactcaggagccattgttaagctggatgaaactggaaacctgatgatctcagaagggcattttgcatctgaaaccatacgggtgagtatgagtagctcgtggagtggatggcttcatctgggtggagcattgtagattcatgcatacatgtcagtttgggttcccaaaaagatagacttttccagcttttaaaagaatttatgaagtctccttaagaagttacccgaatcctgcctttgtaatatgacagcatgaatgcaagcgtttgtatactcagtgaggaaattaatattccttttgcagagcaaattagaatgtgattatactttaaagaaaactgtgaatttaacatttataagtggcagtgagatggcagagcatattagtgaaattggcaaatttaaggactcagatgcaaagataaatagaaacaagcacagacactataaagaaggttatctgtgggaaagcttgctgtcttgaatcttggcttgccctgggaggggtttacgtctaggcagcaagcctgttaaagctccagctctaaggaa

SEQ ID NO: 135438 - DNA, 1125 bp, Homo sapiens
catgtttatgaagtgcacctgcctccctgcccactcacgctctcaaataatagtaagcctgtgaagccagactctctctaacctgcagtatttacaagatcagacacatcagcaatgggacaatggttccagtactgggacaggccttgccctagttctttcttgagggtgtaaaaatgaaatatgtgagatggacaattgacttgaatgtgagaggattttctctagtcttctgtggcctcatttttaatttgagcaggagctctcatttaatcttttactttcatgctcacagttactatggtgatcttggcttggtcatttatttggtcccctaactcagtaccttagtttggcagaaagtggtagcagaggaaggtgggtggcatgtgagggcatgtctgtgtcctggataacctgtctgtcactggtttagactttcacaccataccggacagcgtggcgccccatagtcaccgccacccacatcgggtcccacatccgagtaggtggagtattgacttggttgccttttcccccttgctttggagtgcctttcacttctttctcagtggtggggtcacagttttgccaacagtggtggaagtgaattgtgtgagcatgtattcctctgctgctttctcctttcaagtaaaacatccacacttgtttctaagagaatccacccatgttgactgtcacatggttttcaggttttcattttgctaggagtgacatctcaatcatgggtggatcccagacttcttttctgttagtgtttaaaccgctttgtttgttttacttatgtctgtcagtgttgtacagaaactcccagtatcttgggtaggcataatcaaggcattgaggttggattggaataccagaatgcatcatctaagcttgaattgattactaatttcctccaattcttgataagtccttactgggcctgtgttatgagaacccaaagatgctgggaagtgaatacgtttgaccctgtggctgccacttgggtgaagtttggaataaacctcacttgagatgtaccacaaactgtcttttcacagaaggtccaaagttttttctatcagggatcctttttgatagctgatgacttttcaggac

SEQ ID NO: 135439 - DNA, 1560 bp, Homo sapiens
gattaggaattccactctaataatttaataataattaatagtatcaattgtgtacctattattatataatactaaaatatataactatacaatataaatatatcataaatataattataaatgaaatataaagatattattaataatataaatgataatgattttcctgatgtaaactagagtaaatctacctgtgaaagaactagagtagatctacctacttgtaacttgaagaccaccaaaaaaccactgtgaactgtggacttttccctactgccagttaaatttactatttcctctcagtttagggattatcttttaaaaatatttttattcagcgctccataaggtctctaacttgtctaaactctatggaagagccagatcccacagagccagttgtgatctgattaaaactctgatttgaaactttcagacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggcacgttttgggaagaagggtttgctaagctttactcaaagaaaagggaagagactcctctgtgatctgtagtgagacccagtgttagcacagatacggccattttaagtaaaagggtggaagtggggttgctgtctctccagctgctctctaggtgtatgtgctattctgtaactctgaagcctggagtcgctgagacagaaatgccgtgaactcaacctcttaactttctgtgggaggaactaaaatcacaaaccacagacaaaactgtatccattaaagctaacatggctccgtccctaatgtgtctgtttgatgtttctggaagccattgttaacaaatgttggttggtgactctggctctcttatggtccctgaataggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggtaaatagcaaagtgctgtatgcttctcacaacattattatgttaactttttagtatattcaggataaaattttgatgattggtcccctaatttctgagtgagcaagtttttgtaagcatgtctgagagttttgtttagatgtgaggcacaatactgattactcctaaattggaaaatgcttttcaatgtgttgccttgggcaggaagggcagagttcatttgatctgtttcctctacccacttttgggtagggctgggtgaagcttttattggactgctgaagctaggtctcagggtttctcagacgagggtgtggtggtgaatgctaagttagtattggcagatgtccaccaatgcattagggctcttgccttccttttttatttgaagcttccctgggctctcttgggagcctgggagaaccttgtcgtgaataggctctccactctggc

SEQ ID NO: 135440 - DNA, 1050 bp, Homo sapiens
cgctttaacaggtgtcaagccagagtgggctttggggaatgggtctcaacctggaggggagttgtgaagcacagggcatgtgctggtgagctgtcgaggctgactaggccttggtcccatggggtgttcctagttctagggagtcatcattgctgtggattaactggtgcctttgttctgtagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtgggttttacaagcagctgattctgtaaataagttaccaagggtcaggagaatagttctgacggagttcatttctaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggtgcaaataatgctccaggtcttaaccagtatcatttggcttcttttttggaagcaggaatagcagagttaagggtctgttctgtgttctgtgaaagtgtcaggtatcacctacaaatgcaaatcacttcttacctatgttctctctgtttggagactggcaactgtatcatgtgtagtatacgtatggtatttacaacttcataaattcttctattctgcatcactgcattatgattgatagaatgggaatgtccctttaagtatctgagtatcacatgaaatatcttattaaaaccaggattagaaaggaaaagaatccttgctagccaagggttgaacctgggaataacaaggaagttgaaaatgtgggacaggattggggcattatagtgatggagagaacctaagttttaaagggttgatttcagccttctcttgctttccttcacagtctagattgggaaattttcatatttcccagaattag

SEQ ID NO: 135441 - DNA, 2088 bp, Homo sapiens
ggttataatgagttatgatttgcaccactgcactctggcttgagtgacagagtgagaccctgtctctaaaaaaaaataaataaataaaaataaaatatgtatatatatacatattttattttactttttttatatgtgtatatatatacacatatgtatataagttttgaagtatcttcgagtataaaattgcctaggaacattagataaataatgatttatatgatttatatgttttttagtattacatagagtaaagacatttcaaagacttgtcattagtagcttcggagcctaaagtctagggagtttctgaatttattttccatatgttatggagcacccactcagttgacatttcttagtggagagtccctactccatttatactccattaaactccatttatactgcctcacttttaaatggatgccctatttcttctacctgggagtttacttactgtttttacctaaagtcatttgtgatcatttggcaataaattaattctagattaattaaaacaggccatcccttttatattgaacatgcacatacaagtgaatgttgtttttccccttttgcaaatcggaaaaaaggcctgaagattagcactaggattaggaattccaggatagctgttctgtctgcctcggaggcattggggctgacctcatctccctgaccatgtctcctatgcccccaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggtaatctgtgagcaaagccttgccagtggtgggagaagaagggcctgtgttttgcctcctcgggtagtgtgcttgttttgttttaggacatcagtaccatgttagttctgaatccattgaagagggggaattgagcaagcttctctcagctctgccagcatctctccctgctgagattgcaaggccttcagaaaaggccccagcttttcagattagtgtgatgtaaaatgttttattaaagagatttttttcttagaacttagcattgctgggtgcagtggctccctgctgtaatcccagcactttgggaggctgagatgggagtatcccttgagcccaggagctcaaggctgcagcaagctatgatcgtaccaccgcactctagcctgtgcaacagaccgagatcctgtctcacaaaaaaaaaaaaaacaaacaaaaaaaacaaaccttagcattatgtaacatctgaatctaatagaagcaacaaaaactatgtaagagaagtttcaatagaatgtggaataggatttcatgatatggctggattgattttaagaaaatccaaaaggactttagacttcctagaagagatcttagaagtttagcagccataaaatctctttccttctttttatattttggccaaaataccctttgcttcacagtcttagaagatcaaaggaataggacattattctgaacactttgtttcctttggcaaggcgttcctgttgaatgaagacttgggagattccttggatagtgtggaagcgcttcttaagaagcacgaagactttgagaaatcccttagtgcccaggaggaaaagattacagtaagaccccttcttgtcagtgctttcaaatgacccttatagtaagccagagtctttttccctggaaggattccaaacagatttgatgaaagattcatatgcagagtactcctgtgggtgcttaaactttcacaaggatgacatgctatctcgttgaagacataatacaactttatggaaaaatgatttacttaatggaaacctccaaacttctttaagtttgtacccttcattaaaagtaggtcagggttaatattaagaggtactcttcccattgaaaatacatcttagaaataagaatttggaaagctgttaacctgtgtttgacccctgccaggagatcgtgccacaactaatgtctccagtcttgaatggaggtagtgcagtcttatgatatctgactggtgaca

SEQ ID NO: 135442 - DNA, 1129 bp, Homo sapiens
gcgcctggctccgagcctgaatttcttatctgtgaaacggggatgacagcacctctcctgacactgtagtggggagtaagtgaaaccaagtaggaaaagagctgatagagtgcctgcacgtgccagtctcagtaactgagcgctacagtggtactgttactagtctttatgatactatcactaatgccaacttgcgatatctgcttcttagagtctagatagaggtcatggtttgaggaggcaaaaaatgaaacagtccattagagggttagaacctgagcctctcaaaaaaaatggaattatgaaagggcacagctcaccaaaacatagtaatgaaagtgccgtgaacacacagagaaaacttatttttgtccttctgtgatgtgtcaacgtagtttttgttatcctctttccctacccatcttccaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggtaaccaggcgtgggaagcgtctcacctgccagggaagtggaacagggcttgtactgagaaggaagttaggagaagtagtgatgcgcgggaggtgtgcattacagtgattgttttttaaaatgttttggaatccatttttcacttggtttttttttttttttttttttttttggagacagagtctcactcttgcccaggctggactgcaatgttacaattgtggctcactgcagcctcaaactcctgggctcaagcgatcctcctgcctcagcctcccaagtagttggaactataggcaggtaccactacctgcctagctacgctttttaattttaattttatttttagtagagacagggtctcgctatgttgtcccatctggtttcaaactcctggcctcaaacaatcctcctgccaaagcctcccaaaatgctaggatgataggaatgaaccaccccttctggcccatttttcacttttt

SEQ ID NO: 135443 - DNA, 1768 bp, Homo sapiens
tcttctgcctgtgaccctctgcaggtatggcaggtgaggaagggactgaattatcagaccttatagaaagtgattttaatatcattttggaccttttttttttatgagacagagtctcgctctgacgcccaggctggagtgcagtggcgcaatctcagctcactgcaagctctgcctcctgggttcatgccattctcctgcatcagcctcccgagtagctggggctacaggtgcccaccaccatgtccagctaattttttttgtatcttttttagtagagacggggtttcactgtgttggccaggatggtctccatctcctgacctcgtaatccacccgcctcggtctcccaaagtgctgggattataggtgtgagccactgtggccggccgttttggacctcttaaaacaacgctctcgtgtgtgtgtatacacgtgacctccttggattctccctctcagagaaggaatttactttcagttctccctcttttttccttaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagtaaggatgacactgggggccgcaagggctaggcgtcccataggcatactctgttccacatgggccgaagcttaggcgtgtcctgaggctcctggagcccacctgcacgcctcctgctgtctccaccccactttgagcccacagacctccctgtgtgggtctcagacccctgactgatgacttatattgctttgttttttttccaccagtgttcatgagtttttcctaaccagaatttttctaatcattgccatttgccttttggttcgagatgctttttgaaattggattttcagatactctacgcccctacagctctgtccactttgaaaagctgctttcagagcttctctgtctgccatagctttgagttctgagaatggaattttgtaatgaaatggctctgtcctctttcctctagctgagcccccatattgccctgtgtccctcctttagggtatttctgactccactagtggaatcagcagttttggacacttgggaaatatccaggaaatacattcccactagagtttgggtagaatagtgaaatttttgggctccagtgatcctcagtaagatcagagttatttgtccactttatagattctgttactatagagataagaatgggaggttttggtttgtgttctttttttttttttttgagacagattctcgctctgtcatccagactggagtgcagtggtgtgatcttggcttactgcaacctctgcctcctgggttcaagtgattctcctgcctcagcctcccaagtagctgggactgctggcacatgccaccatgcccagctaatttttgtatttttagtagagatggggtttcactgtgttggccaggctggtctcaaactcctgacctcgtgatccgcccgccttggcctcccagagtgctgggattacaggcgtgagccaccacgcctggccttggtttgtattcttaccagtagtctgggtcataaatataagaggaaaaagatcaaatacgtggctaaattgcctgttagcactcagtaaaatttctttctaagggtagtccagtctgttccctgaccttgctctgtgaagttaccagtgttttcagcacaggaaaatct

SEQ ID NO: 135444 - DNA, 1652 bp, Homo sapiens
gattacaggcgtgagccaccgcacccggcctgttttgttttgtttttgagatggagtttcgctcttgttgcacaggctggagtgcaatggcgcaatctcagctcaccgcaacctctgcctaccgggttcaagcgattctcctgcctcagcctcccgagtagctgggattacaggcatggacccccacacccagctaattttgtattttcagtagggacagggtttctccatgttggttaggttggtctcgaactcccgacctcaggtgatccgcccacttgggcctcccaaagtgctgggattacaggcgtgagccaccatgcccccagccatagcttatttttttaatcccccccttttttttttttggtaggcctctgtagaagaatccttatagtttcaagccatagtttgtgactatgtctcctttgactttggcttgctattttgggttttagttattatggcttttgctttaaaggacctgaaggccaatgagtcacggttgaaggacattaacaaggtagctgaagacctggagtctgaaggtctcatggcagaggaggtgcaggctgtgcaacaacaggtaggtgtctccatcttggagtgaggctctgttgctgtaaggatgcagctttgttcctcttgtgtctgtcatagcccaacaagcagtgtttcataacacagaactgtggcttggctgtaggtcaggtcctctatgtgaccaaaaccattttgattaacttctttatacccatatccctcactttcacttggtttggaggggggtgggggcttctgtcttctccgtaagctcattaaatatttaatgtttatatagccattaactaatggtaatttcataagttcctcaaagaaaaagtttatatataaatacttgaagctctgctggacatttggactggcatttccatttgtccttttggaattatctcctgtgtttccaggtttggccataataagtattcttgagagatgtgtatttcttctaataataaaactggtttctctctctccttgtaggaagtgtatggcatgatgcccagggtaagtttcgggtgctgtgtgtggatcttgaacatgagaaggacttaaatcttgggaagaatatcaagccaagaacttcttcatcagaattgctgttcctgaacctcagatgccttttgtgtgtaaagatttgtggaaaactccaaaaattgatttctttttttttgagacggagtctcactctgtcaaccaggctggagtgcagtggtgtgatcttggctcactgcaacctccacctcccaggttcaagcgattctcccatctcagcttcctgagtagctggaattccacgcatgtggcaccacacccagctaatttttgtatttttagtagagatggggtttcaccatgttgtccaggctggtctcgaactcccaacctcaggtgatctgcccacctcagcttcccagagtgctgggattacagacgtgagccaccatgcccagcccagaaattgatttctatttgccattctccaaaagacaaaaaaagttggtttttttttttttcggtcttttgtttgtttgtttgttttttaagagatagggtcttgctttgttgcccagactggaggtcagtggctt

SEQ ID NO: 135445 - DNA, 1906 bp, Homo sapiens
tgacatatctcactctattgggtccaagcatgtcctaagtaaacatcagcacattcatggccgctgggtagcttggtggctttcctggtcaagagcctgccagttctcaacagtggagcaagccttccctctgatttccagtagggcagggagctggaaggagcacagtctcagtaatgcagtgagcggcttccttgccgcctgcagtgcgaggtcctgtggcgtgtcggctcttcccaggcctgctctggcctgagagtctgctgattgggtgttgggaggcagcagactcgctgggatttctccacgcagctgtgacttaggaagcagttgctacctgccaggccccaggctaggaggtgagagtaaggaaaagtcagctgtgtctctcctgctgcctcagagaggatgcctaggtcaggtgtttgtgggtgttgaagctgtcaagcacagctagttttggcttggctcttactggaatattgtatactaatttattcagcgaggaaggttggaaacaggaaattatatatgccctagcatctccttcaaacaaagtcattttcccaaagtctgactgggggcatgacaggagagggagtgcagtggagctgatgttttgctgtcctgcaggagctgaatgagcgctggcggtccctacagcagctggccgaggaacggagccagctcttgggcagcgcccatgaagtacagaggttccacaggtgaggggtcagccctgggctgggagagggagaaacaggtgactgctggtttcctgacagcccccaagcttgctgactgagatcctagagcaactgctggctcttactgatgtttatttgtgacatggggtgggtgctcagtaaatcctgctaagtgaattatttggctttttagagttattggtggtagccacagacaaatatacaaatgtcagctaaataaatttttttaggctgggcgtggtggctcatgcctgtaatcccagcactttgggaggccaaggcaggcagatcacctgaggtcaggagttcaagaccagcctggccaacatggggaaacccacctctactaaaaataaaaaaattagctgggcatggtggtgggcgcctgtaatcctagctacttgggaggttgaggcaggagaatcacttgaacccggtgggggcggaggttgcagtgagctgagattgtgcattgtgctccagcctgggtgacaagaatgaaactccatctcagtaaataaataaataaataaataaataaattttttttagtgtcctgtaatcaaggcagttgtacttggcatttcttaacctgaatgtgtctcgcctttagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtgagaggacccaaagtcatcttctgtctggcatttttgccccagaaagagcagagtcttctgttctgcagagcatacccccttactgcaagctcattcaccactttcttcccataggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccggtacggagccatgttcactcagacttctggaacatagagccttctttgtaggggtcatttttattgtgaaaatagtacatgctcagcagggtacaatggctcacacctataatccaagcac

SEQ ID NO: 135446 - DNA, 1633 bp, Homo sapiens
gtatgcccaggcctagggcttcaagggttaatcctaaagaaaggctttttcttttttttcttttttttttagagacagggttgcaccacattgcccaaactgatcttgaattcctgagctcaagcgatcctcctgcctcagcctcccaaagtgctgggattacaggcatgagccaccacgcctggccaacaaaagctttttcatttgaagctatcaaagacttaattgtagctagaacttgttattctggagggtgaaaagatcttaattataagcctactgacttttcctctgagaaattcggacttttaaaaaaataacaagaagttttttaacactttgcccaaagacctagcctcattcagtagatcagattaacccaagataactttctgaggcaagaattatgtcattctctgttttcctgggcagaagatctccttaccaggtaatataatagctatttttctggggtgctggtttccagggacctcatgtcttggatcaatggaatacgggggttggtgtcctcagatgagctagccaaggatgtcaccggagctgaggcattgctggagcgacaccaggtgggtggacctgcctgctgagtagcaaagacgtggctgctctgcagggccctagaggcctcattcccaccctttgtggtgagtcggtggttgacgtcagagtgggcatctgctgccagttacctaatcccttccctccttttggcaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcaggtgtgtgtgctcctggtttctgaccaagtgtttccttgctgaagggcctcattttctcacctgcctcttgccctctttagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggtgaggcctctggaccatggagttggagtctggatttttcctgattgacatctgtttcttggcttatatagtcactgttatatctccaaggaatacctgcgttgtctaagaaaaatatgtacataaataatctttaaaactttatagattctggtatttctgagattttaataatgggggtgccacaggaaaaaaaaatattatcaaagggatggaaaacaaatgtgtgggtaggtaagggaataatgaacaaacaacaaggaagatgtaaaactgtttgatttatacgtcactttgctgtaaatctgacagcattttcctattatcaggcttaattttgttctgttctgatattctaacacctgccccacctgagtgacctggagacttcttgagttaaactctactctagtaatgaatgaaatcaagctttcttttggcattttacactcttgcttctaaagtgtcagtgt

SEQ ID NO: 135447 - DNA, 1060 bp, Homo sapiens
tctccacggtaagatatgctcatgttggatctcatggtttcactctttcaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccaggtaagctgaagtgactgggtgttggtcttgatgtagccttatgttattgagtagattttgttaaataaagcatttataaaacaatctccttgcacccatgggaagtcagtgagaaatatttcagtaagcccagccagtgggaaagccctagtcaagtttcagagccatttaaaagttgccttcctcatttgtctccattaaaactatttctgctgtaataaaagtctatagaatcccccttctattactgttcccaaatgctgagcttcctgggggaagtatgacaaaatgagtttctatttaatagctgatatgtgtgtccacatcagtgtactgaactcttgttcttttaatctgtttttgtagctttccaagctgctggtaagtttttaatttttttaagagttgtagttaaatgagctccagtatttgtgttactctgcgtagattattgttattattgtggtcacacggtttgctggtgtctcttcatccatccttttcatttctaatcatccattacactccattcaagtgtccctgtgggatgtggctttttctgttgtaattagcctgcaacgccttactcccccttctctcccccagtttatcacttaggcaaattctgtacagtgtttgatttgcggggcagtaattgaccattttctttcaaggagtgcttccttttgaagatggaacatcagcttcagctttttctgtgtagacattggctcagacttgctatgagctcatggtgttcggtggcctgggttggggaggccagtctggtgtgagggttttaatgcatacccactctggcatccagaggtgccagtcaggagagga

SEQ ID NO: 135448 - DNA, 1068 bp, Homo sapiens
tttttggtatttttagagcaagcaccagaagcaccaggcttttgaagcagagctgcatgccaacgctgaccggatccgtggggttatcgacatgggcaactccctcattgaacgtggagcctgtgccggcagtgaggatgctgtcaaggtatggcccaccagctcccggtgcccagggaggaagatgaccaccgtcactgtcaacctgatataataacttggacatacagtcttaagacactaaatggattatagaagactttaggctgaattacagatggggaatgctagtgagaatggctcctatgagtgttttccattctcttctcttagaagttctcaaattgagctttaggagagggacgattcttcatagatttcatctctttttggctcccttctgttccccaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtaacactgagtggttcctcttcctaccagtgggggatttctagtcatttggcacagtgggtccatcagtgcccaaaaccacgaaaaggcagggctcaccagacaccccttttgacagaaacccttattatatatgagttgcatgctgtaagggatttatgagcaaagggagtgaatgttaagagagctgacttgtagtggcacttggactacaggtcactcacatccatagggaaggcaaataggaagagattatgggtagttatatggcatgcagctctaacaagcctatgccaggttagaaaccaagatagtagcatctgggaagccagagtcagtcatgtattctccatggagaatgtttggaaagcacagactataaaaacatagaggttttggccaggtgcagtggctcacgcctgtaatcccaacactttgggaggccgaggcaggcagatcacttgaggtcaggagttcgagaccagcctgaccaacatagtgaaatcctgtctctactaa

SEQ ID NO: 135449 - DNA, 1015 bp, Homo sapiens
cagctactcaggaggctgagcaggagaatcgcttgaacctgggaggtggaggttgcagtgagctgggatcacaccattgcactccagcctgggcaacagagcgagacttcatctcaaaaaaaaaaaatttttttttttaataattgcgtaagtttatcatagagccatgccataatgtaaccattcccatattgttggacattgaggtgttcccagccttttggtgtatatattttgctgtagtgaatatctttgaatattaatctttgtccacactgctgattctttcctaggggggtttccttgaactaggattgctgtgcattttgccttagctgtagtatttactatgaatagactctggagtctaggtttgactgaccgagtggagagagtgtctcaggccgggcaggctgattggggtggctaggaatcacagtaacacattgtgatggagaagtattcaactgtccaagcaaggccctggaatagccactgggcaacctgaattttccagaatgctgagtatacaccacacagtagcctttgctttttgtgttttcattgccaggtggaggccctgctggcatccgaagattatggcaaagacctagcttctgtgaacaacctgctgaaaaagcatcaactgctggaagcagatatatctgcccatgaggtaagcaaagggaggcgggccaggcccgagtgcctgggacacagctctgcctgactcctaaggaaaacaagcgtgtttgagaaaagagagtgacttctttcacttaaagcagccattctcaaaggttgtggcctcaggatcattatacacttggcagttattgagggctcttgagagatttttattatgtaggttttatcaatgctcaccattattaaaaattacataaattttaaggccaggtgcagtggcttacggctgtaatcccagcactttgggaggcccagacaggcagatctcctgaggtcaggagttcgagaccactccggccaacgtggt

SEQ ID NO: 135450 - DNA, 1044 bp, Homo sapiens
cgtctcaaaaagaaaaaaaaaagacatgacttggaaggccttttctgagatgtgttcaagttaaaccttaaaaatgtgtcgtttttgtttgggtgtatatcttcagcttgctttgtgtcattcttgtggtcctcttgggggagagaccataagtcactgttgatggatgacaaagggtttgacccttcccaaaggtccaaagactgtccctgctgaagcctgtcccaccactgctggttactctcactgcctcactgcctcctgttttccttccttttatgattctctatttattaatgttcctctttattatcctcttccccagctagactgtaatgtgtgcatggacagggaccatagcagttttgtcactctctgtccccggggcctagcccacaacacatagcaggctctcaatagtgtgccttggctgcttctactccagggcttactgaagaaacatgaagcttttgagacagacttcaccgtccacaaggatcgcgtgaatgatgtctgcaccaatggacaagacctcattaagaaggtgagtccagcccattggtaagacctccatcgcccactgggacacccacgtgttggtaccacagaggtcccccaaagttcacttcctgggatgttcaccaaaccaaggtctgcgtggagaccagcagcaattccattcctgtgtttcgtgacaagttggatatttccccctttttgaagccagtaaagttattctgcagtgcttattttttctgcattaagcaacagagacactggcactcccaaatgctgctcttagtttatttctcaagcaatacagtctctttatagggacagtagaaaatgcaaataagcaaaacataaaataaaaattacccataaagccccaccctgacaccacacattagatctttgtgtctgacctgccagacctttcttttctctccacaggtttagagctaccagctagatcaaacagccgcagactcccgtttaataggatcatatcactccataaattatcaaaaacctcgaggctgt

SEQ ID NO: 135451 - DNA, 1853 bp, Homo sapiens
gtaatcccagcactttgggaagccgaggtgggcaaatcacctgaggtcaggagttcgagaccagcctgaccaacatggtgaaacccccatctctactaaaaataattagctgtgcatggtggtgttcgcctattagtcccagctactcgggaggctgaggcaggagaatctcttgaacccgggaggcggaggttgcagtgagccgagatcacgccactgcattccagcctgggcgacggagtgaaattcactccgtctcaaaaaaaaaaaaaaaaaaaaaaaaaagaattcctaaaagtagaattgtcagtacgtgtatttgtgtgaagcctttgaccgcattgctcttacaaaagccttaccctatcattgtttacccagcagtggacaggggagcaagtggcccattttatagaagtttagagcctttccagggagggcatagtcaggtaaccacagcaggtaaggctgaccagtgtgtgcctctctccatggcctagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgagcactgtcagcaaggcccggaagagccttcccagagctgctctttgtctccttccgtgtcattggttttcttctgcagagaagaaactgatcaattgtgggcatggcagagaacctactaccagggcagaccactgactgccagctaggaggagacagtgtcctgaggccagaactgccacccggaactgggctggcaccagggtcaataaacaaaagcctgtaaacgctgctgcacgcagagatggcataatgtgacgtcatggcatgaacaaagttggcacagcaaaggcaccactagctgccctggtcaggggcgccacccagctcctgggtgagggaaaactgggtccggatatcggggtccacgtgtcctgggtagtagtaatagcaactgaactagaagacgggctgcagggagctcgtcatggcacagatggaggccaggcctgggtgcagggaggggcctgctaatgtgggttctgaggctgtagttaggaagattgggatttatctgtacacaaaaaatggtttgtctgggttttgatgtttttcctttctaatccatctccactgaggagggcagtatattttccacacttcgttttctaggtgaaaaggagaacagcttgaagacagatgattatggccgagacctgtcttctgtgcagacgctcctcaccaaacaggtctgccctggccccttcactggttgaaatgtatgcagatagcatctgtgagatgactggtggcgtctttcactgaggcatttatcttctgttagcccctggggatcagcaggaaaaagatcctgtcctggtcctcagggagcttccagactaactggggaagcagacacagaaccaggcatctctgcagcagcctgctgggtgctgacgggactgggcactgcaggagcactcactcagttttcagcaggcgagggttgaaggggcaagttctcctaagcgaaatcatgaggggtgaatgaaaacggtcagggagagaggcagggcgagtgttctgggcagagctggcagggatccctggggcgggagagcggaaggctggggtcagggaggtgggaggaggctgccgcagtgatctgcggtctgaaggagagcaggaaagggggcatgtgtgactgagtctcagcagtgtccaggtggacagtttggcttgggcatctg

SEQ ID NO: 135452 - DNA, 2453 bp, Homo sapiens
tggggccacgtgaagcttagctggcccacagctcaaggaaggacgcccaccttctgtctgcccagctctgccactcccccttgaggaagctgtgagctcagtgcagagctttcaaacatgggtgtggctggcatcaattaaaaccagggcaaatgagagggccctgtgagatcgccattcagaagcacgcaggacagactagagacaagggcaaagggtaggaaggggaaaaaaggctggtgaagacttgaagggggagcaggagacaggagcagaggggagctaagctcccagcaggctgtgtgcgcctctgattcccaggaaccaccccgcaccccacctcctgcactgcgtcggcacgtccagccctggcgactccgccaactcagtctcttctgcttccaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggtacacctcccgctgccctcaggagctgctcggcctcccagagccctctctgggccctgctcagagcccacacttaactgagtcacgacaagacgagcaggatggaggagcatggtttcatcagaagtttcatttctttttgtgttcttgaggcagggtctctgtcacccaggcttcagtgcagtggtgctaccatggctccctgtagcctcaacctcccaggctcaggtgatcctcttgcctgagcctcttgaataactgggactacaagcacgtgccaccacgcctggctaattattttaatttttgtagacagggtgttgctatgttgcccaggctggtcttcaactcctggcctcaagcagtcctcctgcccaggcctcccaaagtgctgggattacaggtgtgagccactgtacccagccagaagtttccatttctgacagtccagcaactccctgcttgactgaccagtcgcttccctccaggtccgcctcttccttgaagcccctggggggtgggaacagagaaagaactaccaagtgctctgagccggcctcatgtctcccagcctcctcctctcatctttggggaggttccttgtggggaggccaccaccaccctgagcccatctgtgaaggaggggctggtgtcactgccacagcagcgcacagcatctgcccccctttggccctcaggagagggagctggagctgcagaaggaacagcggcggcaggaggagaacgacaagctgcgccaggagtttgcccagcacgccaacgccttccaccagtggatccaagagaccaggtgccagcccgctggggccggggagcagcagcatgtccctgctgtacttaagccctggggagcttccagccccaaggaggtggtggtgctttgtgtaaaaccagaggcagcctgggaataaagctgggctggcaacgcctggtcgggctctggagccgggagtgggggcataggtggagcagcctctcagtgctgcatgtcccagacatcaagttgttagagatcccggattgagtgggaccatgcagggcgcgtggtcagccccagccatgacttggtgacagacgatgcagggtctgtgcgttgggtactgatgttcttgcttttgttttcctttctttcttgtgtcttctctctgtccccccgattgctgctgttgtccggacaccaccttgtctcccggctgcttggatctgctctccacaggacatacctcctcgatgggttaatattgttttcttccttctctgggcttgtcatgtgggggtctcgtgcgcttgcccctcgtggcctggcttgtggaggatcccgggatgggccttcctgcccagggcgggctgcacttcccctcccacccttctcgtcacctgatgaggagtgtgtgccttgccccatagcccatggtccctggtccccgatagagccttcaagccagggggagccgtccttgcctcactgggcgattccaagggctcactttgggtagggaaggtgatgaagcacgaaggccagagctggagtccagaggccctaagaacccccgtgcctgtccagccaccgggctctgttgggctctcacctctgcttccccagcgagtccaacagtggtcagtgggcatgaagcagatggcagtgctgggggctcaggcagggtacagtaagtccacagctgagaagggctgggcactgacaccccctaagtagctgaggctgccacttt

SEQ ID NO: 135453 - DNA, 2472 bp, Homo sapiens
actaaaaatacaaaaattaggcaggtgtggtgatgggcacctgttagttccagctactcaggagattgaggcaggagaatcacttgaacccgggaggttgcagtgagcgtgattgcgccactgcactctagcctaggcgacagtgagactccatctcaaaaaaatttataaaaatctttggccactgcttcctggagtcctcgccgtacttgtccttggcgtgcactgccctctggcaggtctaccagctgctttggaaccctcacattgaaagtctctccctctattgaggtggttgggatttcttcagcttcaccccatcccactattcctattctagaatgttcttgttttacgaggtctcaggccaggcctggagcaggaaccagagggcagtaagtggctcctgggctggtgactgagctgagggcccccgtctgagcatctgtgctccccacccctgcagcgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggtacccgggagggctgtgggccaggctcagcccagagcagggggaggaaaagacacagtcacctgctgtgtggagggtctgttccctaatttctgtttttcttccaggaacacaacaggtgtgactgaggaggccctcaaagaattcagcatgatgtttaagtgagttcagccttactcgccctggctgggtggggggtgttcggcagcagggctgcctgctgagccgccctcggctttgtgctgcagacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacaggtaaattaattaaggccaggtgctgtgagcctctgcccggggcacccacctgccctccctgctcaggctcttgcttcccccgctcctagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccaggtatgggcctcaggaggtgggtgaagaggtgtcctttggaaaactaaagccaaatttgtggcagagctgagtctggggtaacaggccctgcgctgggtattctccccatttacaaatcaaactcagtatggacagaagtcccggatctgcttgtagaagcagctccgagcccccagcatcctgagacctgggaggtcgggtttgaagtgggtgcagctggctcaggcaccaggtgccatctcttaccccacagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaagctttgcttttcttcatttggcttgcgtcagaaacacaaggctcggcacagcgaaggcttgcacccgcctcccgggacccctcaggccgccacctctgctgccaggcagtccaggtcctcagcttcccggggcccttgttccgtgaactctgtgctcagctgccacaccttcactgtgccctgggcatcgcccgcagccaagagctgagtctgctggctgttgaactccagacagtagacagggctttcatcctgggtttgcttgatcaaaactgtgggtttctgggagcttttctggagatcaaacagctgcacgtcacctgcaaagagagacagatacgtggagtaagagaaactctagagaccaaccacatggcaggaggaggctaatgcccgggttcaatcctgttgtgtgcagccacagtggctttgagttgggttgctggagggaagccgtccttacccccatg

SEQ ID NO: 135454 - DNA, 1357 bp, Homo sapiens
gtgagctgttcccccttccacaggtacgtagggcaggcctggggcacagtggggccagggtgtccctgccctgcgggtctctagcctgccaagcctcatgacaaactgcttcaagtgcttgccttctgcccactctgagacccgtgttcaggtctttggtggttggcccaggcatcgtcccttctctaatgagaggaccaactccaggctgagggacccgggaggctcttcacgagcctggcagcccaggaggggtctggtgttgggggccagcaccacccagaccccagcactgattcccttgcctggccccctgcatcccgtctaggaatctcttcctgagcgctgggactgacgggcatgtccacctgtactccatgctgcaggcccctcccttgacttcgctgcagctctccctcaagtatctgtttgctgtgcgctggtccccagtgcggcccttggtttttgcagctgcctctgggaaaggtaggaaggggccgctaggcctggatctgtttaaggggtgggtggtctgggccctgcttgtacctggggttctgggttggggaaaagaccacacatgggggtaaggacggcttccctccagcaacccaactcaaagccactgtggctgcacacaacaggattgaacccgggcattagcctcctcctgccatgtggttggtctctagagtttctcttactccacgtatctgtctctctttgcaggtgacgtgcagctgtttgatctccagaaaagctcccagaaacccacagttttgatcaagcaaacccaggatgaaagccctgtctactgtctggagttcaacagccagcagactcagctcttggctgcgggcgatgcccagggcacagtgaaggtgtggcagctgagcacagagttcacggaacaagggccccgggaagctgaggacctggactgcctggcagcagaggtggcggcctgaggggtcccgggaggcgggtgcaagccttcgctgtgccgagccttgtgtttctgacgcaagccaaatgaagaaaagcaaagctttgggggaagtcatcatttatttgtcttttacatgaaaacagatttgggggagggtgggagagagaacaaggggaggagccagctgcttcgattttctgaagtcggaatgagggcagctgcttcaagacacagatctgggtccccacagtgacatgatgattgtgactggaccggaagcgggttagtgaagcaccattttctcctaagtcttattccaagctaagcaggcttaaggttacagtggaaagtgagagcacacagaggagcggacatgcagcaaggcgacgcagggcaagcagcgagggg

SEQ ID NO: 135455 - DNA, 1621 bp, Homo sapiens
agactctgtctcaaaaagaaaaccaaccaactaaccaccacaaacaacaaaaaatcatgtgcgtgtagcacagcgtgacgtcgggtggttcgcttgaccccttgtacttggccgcgttgggcacttttatgctgctgggcaaccatccccaccttcctgctgcagcccctgaggcttggaaactgtggagtgtgcctgtgagggcagccacccctctgggcgggagcctggtcggccttgcttctcaggccatgccttctgggcttctggaagcattctgctggggcagatgtggggatgaacgtgccacattttcctctaggcctggctgatggacttgagggcctctagggctaagggtggcctggcctaggtggggtttggttaggcagtcatgaggcccctgctggtggctttggactcagggttggggacgtctccgcaggtgtcttgtctgtataccctgggctacccgccagcccaagcgcagggtctgcatgtgaccagcatctcctggaactccactggctctgtggtggcctgtgcctacggccggtgagtggcagcggggcaggtgaggggcagctcgccaccccaggaccctccttgggccttgtctctgtagctgcacagggaagggctggttctaagagcttggccatcctgggagtctcttctcaagccttcctgggcagggttgacaacaagtggcagaagagcaggcagtggggctgagtgccaggatcaccctcccccctgcctggaggccctgggcctgcctgcctcgcccgccccaccagctgcttccccatcctgcatggcatggactgtccttggtgcctggggaccattttccagagaatgccacacccttggggtgctagagtggagtgtgggccacttcaatacccagagtagtgtctggtggtgacaaggacacagcgagtgtgtccggggctagtggggagagaggtggggtgggtgataggagccccacccaggggcacagccggctcaagcctgtccctgcacaggctggaccatggggactggagcacgcttaagtccttcgtgtgtgcctggaacctggaccggcgagacctgcgtccccagcagccgtcggccgtggtggaggtccccagcgctgtcctgtgtctggccttccaccccacgcagccctcccacgtcgcaggtgagctgcctgctgtgtccgcctcctctcctctcaggactcagcttcccgccctgcagagggcacaagggagctttccatgggccctttggcccggagacaggaaggcgggccctgaccctctcagtctggagcccaggtgaaggtctgcagtgagccctgaggggtggaactcgggggaggagtctggaagggggccagggtcggggccaggacagggggctgtggagaggccagaagaggcaggtgcccttgggaagccgtcagtggtagggggcaggcaacgctggagggagctgccaggtgcagggcaggggtgtccggcaaagctccctggggtacaacaggggagctgggggctaggactctccctctgtggggatgacttccagccaagtggctctgccgcctggccctggccctggccct

SEQ ID NO: 135456 - DNA, 1031 bp, Homo sapiens
ctctcgtgcggacgcactcaggcgcgacctccgcccctacgccgccatgagcggaaaacggggaatgtgaggctgacggcgccatgtttgaattggtcgcagcgcctcctgcaagacctggaagaaagaaaagtaacgattcttctcggccagagagagaagcatgaccggttttgcataccctgtccccagaaaaagcactctaagagtaggcgcgctactcctgggcgaggaaactgcggaagtgaggcattggtgccaggttcaaagatggcgctgagcagccaagcgcagaagcgaagagagggcggcagcctgcggccgtggccggcccgcgaggtctgggcctgggagcgcagatctggctgagcagctgattcttccagcagatccgagaaccgcgccactcgaacaggctgtcacctcgaagccaagtgatctccctttaatcctcagtctctgtctcaatagaatgatgatgaaaaatattcctacggagatcctaaatgtggttaaaaagctgggaggcccaaatgaggtcttctacagaaacatgcttattaaatcgaaattaaaagcaaataactaaataatgtgcctactgtgtgtcaggcaaagagcccagaacgtctctttcttattaagttctcaccctgaggaaagaattgctttttatactatattatgtcgttctgccattccgcgcgccccaccggaattaaaaaaactggagattctgacctgaggactaaaaaataaaaataaagaataaacaaataggccaggtgcggtggctcacacctgtaatcccggtactttgagaggccaaggcaggaggatcgcttgaagccaggagttcgaaaccagcctgagcaacatagtgagagcccgtctctacaaaaaaaatgttttaaaacttagctgggcatggtggcacgtgcctgtagtcccacctactcggcaggctgagtgtaaagatcccttgagtccagtagtttgaggctgcagtgagctatgattacaccactaca

SEQ ID NO: 135457 - DNA, 1673 bp, Homo sapiens
ctggcacctggggcagtctcagtgttcagcctgcttccggacgggcgaggagactcgtggtctggttctgggacttccctaacagcatggcccctaaacgccagtctccactcccgcctcaaaagaagaaaccaagaccacctcctgctctgggaccggaggagacatcggcctctgcaggcttgccgaagaagggaggtacgtttctgcgctaagttttattggagatttaagggatttgcaaggattgactctctgatttttaccccccaatccctcttgagatgtgacccctaagcacccccaaagggttttaaacctgggatggtggattaagtttgcgtgaagaaccagaagggactagactgggagaacgggagtgcacgggagctcatccctgcccccaactcaacactgacccctgagcttgtctccccagcccccaaacttcctcctctggggctccctttcttggcaaggggcactgccagccagcctgaggcccctccttcacccctccacatccagccaaatccccgattcctggtggttctacctcagtatctctcagatctgtccacctctctctctgttcttgctgccgacggcggcccacaactctggcctgaatctctgccacctcctcatcttggcttccagcttcctcctcctccccttcagcctgagcatagccaatcacgtggcccactccccggcttaaacccctcccttgcctccccgcgtcctccaggtgctcagaaacttctctggcccgccaacccggtccccgccgacctctcctggttcacacttctgagactccccacctggaggcctccctcaaggtggtacccttcaccttgacctcttgggactctaccctctgatctcggggcctagacacccacttgccctttcctctccttacctgtgcaccacctccagctctctgctggaaagtcacttcctgtgggcaatctgtgagccccaacacttgggagttaggagtcccagagtcatgctgcctcaccctcttgtcattacattgtaaccagcagtttcatgcctgcccttccccccattaaacttagaggtgagggctgcattttgggagacgtagctggagctggatagagagttgactgttctggtgactaggtctggctcataggggagggttgtggtggagccttcctgggctgggtgtggataggcccagggcctgcaaggaaacgggaagctttgattggctgagggcaggcaactcttatggaagaagcactgaggaggagtcctacctcagggctcagtgtggacctgttggcacttttactgggtctcagtcccttttcctccacatgggatgcagagacctcctgcccagcttgaaacctaccttgctgggtgagccacataaaacaacttgtgcttgttttctcttctataaaatgggatccacagtactgatctccaggcttgctgtgagtctgaaatctaaggggagcactagacagcgcctagcacatcatcagtgctctagagtgcatttgtgcgcagcaaaatgtgggtgagtcttcctagtttccttccagtgagcttcctgggagcattaacaggactggaagggatggaaaggtgtgagggggttcatctaaacccaaagaacagctcct

SEQ ID NO: 135458 - DNA, 1307 bp, Homo sapiens
caaaacaaacaaacaaatgctactaatcagggtttttctggctttttatggttcatgtcttggggtgctggagggacagaatgtggggcatccgcattacttgaaaagtattatttaaacaaaatgctttggccctccttagtggttcagaactttgcctctcaagtagaacttgttggcccctttcatctctatgaacagaacaccgcctatcgcttggggctgttgtgaggcctcggtgagataaccgtgccatgcgctgctgaaactggcacttaacgctcagtatgattcttgcgggcgctgggcaccgcggactaatgtggtacctccctgccttcacaggacttcgagtttaatgtggcttcagtgtcgtaacctttatcatttcataacagaaacgggttcagagaggaagggtgacttgctcaagggtacaagcttgctgggcagggcttggactaaaacccaggaatggccctgcgcgcggattacacagcctggggcttcgcacacgagcccgagtttgagtccgatcggcagttccccatctggcatccagaatggggtgccccctgctttctccacgaagtggaaggcgccgagaggccgggcggaattcggggcccccatacgaggccgggcctgcactttcggggtggtgggcgccccgctcccggtgccccgcggagcagggaagccgctcgctcaccacgtgacgcgccggccgggggcacccgcgcctccgtgcgacgccccgcccaccggcctgccgcgcgccagtgtcctgggtcgggccggagaggggagagcgggggaggggacgcggcgcggggggcggccgtgcgtcgccgcgcgccttcctcccacctctcgccgggccctgtgtctccgcgccgcgactccgccccctcatcccgccgcccaggccaatggcgccgcggcgcgagcctccccggccggaggcggagcatccgcgcggggcctggcgcgcctgcgccctgcgcccgcccctcgccgtaggaggaggtggaggaggaggcggctcgggagagcgagcagcgagctggctggatcgccgagcgcgagtgagggagccgagccgcccgccgccgccgcctccgcctcccctccgcgaacaggagcccgggccggggcccggcacgccgccccagcccgtccctcggcgtcaggccgcgagggtagcgcgcgcgagcgagcgagggggagggagagcgagcgagcgccgggaggaggcggccggaccgagcgggcgcccgcgcgtgtggcgtgaggggaagccgctt

SEQ ID NO: 135459 - DNA, 1001 bp, Homo sapiens
tctgtgcctcactgctttccgatctcatagttgctcccagtaagtgctccaaagtcgtgtggggccgcatctgaggtctgcccgcctgaattgggttggaggggttcatgttctgagaaggcgaaggccagggtgtaggatggtgccccgtgactttccagtctttgtaggcgtgcctggtatcttcatcgtaatagcagagtcgtcaactttctatgaaaggtggttttaccttgataggtggtagtggtggcctaatttgtatcattgtcatgggtttagtttccatattctagttagcagctgctactgttctcttgcaagtgtataatgtgaaataataaacgtgaagacttctgaataaggttattctgtgtctttcatagtagaaaccttaatgatcggtctgttgtagtgaaactctttaaaaaggcgctatagaaaaccaatttctgagtaaaccagcagacagcatgacttgtaaatggtcttttaattaattaaaaagaaattagtcagctacaagcatgaacatgtggaacgcttgcctttgtactaggcgtttttgtttttgttttaatggcttttggaatattatagtattaacatctggaaaactaggtaaatttatcttagaattaagttttttgctccttttttgcagaaaaagaacagcaagaagcgattgaacacattgatgaagtacaaaatgaaatagacaggtaacatttttcttaatatacttcggagaaattttctgagatgtgtctaatagcccggtaattatcgaagctatggtcaaatctatccactgtcaaaggggaaatgattctaacttggttggaaatacttatgtagattcagtgttttttggtgaagtgattgtacagaagtttttgaaagtgcattgaccttacaaggtttgggtttgctttcaaagactgaaaattgtctgaattgcagtgtaggtcttctgatggtttagcagtgtggcatcagtg

SEQ ID NO: 135460 - DNA, 1078 bp, Homo sapiens
ttgcgtgcaacaaagacaggctgggtgcggtggcgcacctgtaatcccagcactttgggaggccgaggtgggtggatcacttgaggtcaggggttcgaaaccagcttggccaacaggttgaaaccccgtctctactaaaaatacaaaaaaaattagctgggcgtggtggcgcgcgcttgtaatcccagctactcgctacttgggaggctgaggcaggagaatcgcttgaacccaggagggggaggttgcagtgagccgagattgtgcgcttttgcattccagcctgggcgacaagagtgagactgtttcaaaaaaaaaaaaaaaaaaaaaaaaacctcaaagacgggaaaagatatacagctactgctttctattctgtttaggagaagctatattctaattgcttgatgaaagatagtgacagtctgatattgagcaattgcctttagttaataatgggtttataaaaccaaagatgctcactaagttcggaaaaattttaaagggatcacttaaattgttgttagtgtgtgcctgttgaaaattcagctgacctgtaattttctggcctagtgtctgcactgcttggggaggaagatgaagaggcactgcattatttgaccagagttgaagtgacagaatttgaagatattaaatcaggttacagaatagattttgtaagtatctctaacttaatcttgtttgccactgtggaaattaatgtgagctttggttggaagacctgttcatatttctaatctttcaattatttattacagtattttgatgaaaatccttactttgaaaataaagttctctccaaagaatttcatctgaatgagagtggtgatccatcttcgaagtccaccgaaatcaaatggaaatctggaaaggtatgttttgaggaattatttgacaaaaatagcattttgcctatttcagtttagttttaaccacttacaagtgcttgatactttggtcatgtggctaaatacaaaaccttaaaatataaaacgttccagtgtgctgaagccaagtattacagtagtttagggttctcattagatactacagatgt

SEQ ID NO: 135461 - DNA, 1002 bp, Homo sapiens
ctaattttatggaaaaccaaatgtagttgatactacctctacctgctgcacagttttataattgctcttaggtaataatggtagcgtagatagtatactgatatttgttttgcttagcttttggggaaaatcttattttttaaattatagggagtttgggtgttatggagagattgtatcaaaagctcttccggtattcatttaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggtgagttctaatactcatttattcaaggttggacttgtctcggttgtttaaaaatgagtccttatattgtgcttttttttttttaaggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggtaaaagaaaatttggctaaacccacaaagataacttttaaagaattcatgttattttggggtgtatatatatatatatagtgtggtagaactgaccagaactgattgtggaaaaaaagtaagccattttgttgttcaagaattaaggaaatgtttgataagcacatggtactaatgtttaactaggttttttttggtttttttttgggtttttttggttagacttatcaccacccaagcttgtttttccctagccagtacttaggcaatataggcagtgtagctggtcaaattctgacatctctgaaataacaaagtttcatgtattttcgacaaactgcacaatttctgaatagtcaaattaggataggttggttttatttcggattatt

SEQ ID NO: 135462 - DNA, 1792 bp, Homo sapiens
ttcaggaggatgaaggagaagatgactaaatagaacactgatggattccaaccttcctttttttaaattttctccagtccctgggagcaagttgcagtcttttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaaggatttgatgcttttctctcagcataggtatgcttactatgaccttccaagtttgacttgtataacatcactgtcaaactttgtcaccctaacttcgtattttttgatacgcactttgcaggatgacctcagggctatgtggattgagtaatgggatttgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctatataaaatgtggccaagaagataggctctcagtaagaagtctgatggtgagcagtaactgtccctgctttctggtataaagctctcaaatgtgaccatgtgaatctgggtgggataatggactcagctctgtctgctcaatgccattgtgcagagaagcaccctaatgcataagctttttaatgctgtaaaatatagtcgctgaaattaaatgccactttttcagaggtgaattaatggacagtctggtgaacttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagattttttttggactggggtcattctccttgttttatagagaaa

SEQ ID NO: 135463 - DNA, 1035 bp, Homo sapiens
ccgtgggacagcagaccccctgccacccatccttagagcgctctgggccagcgtgcttggggcctgtggatgatggcagtgcctggggctgaatgccctaagtgagcgcctgtcctattgcccagctcctccagaagtgcccggagaagcgcctcggggcaggtgagcaggatgccgaggagatcaaggtccagccattcttcagggtgagcggctggggtggcggtggtcccctgtgcctggcagggtaggtggcatggagtgactcctggagctgctgttcctgccgtctcaggcgcctctcctttgccctcagaccaccaactggcaagccctgctcgcccgcaccatccagccccccttcgtgcctaccctgtgtggccctgcggacctgcgctactttgagggcgagttcacagggctgccgcctgccctgaccccacctgcaccccacagcctcctcactgcccgccaacaggccgccttccgggacttcgactttgtgtcagagcgattcctggaaccctgagggcatctcctggcacctctgtccccttcccccacagactgttagagcctctgctcgttcacccgtgcgccctgcctggaggtccaggccttgctgggtacttctgagcccttgggattcaaagtggcagccatggggccactgttgtgggctttgctcagtgtcactgggcaaagtgtgtcccttccccctccagctcgccctcttctacctcccagcgagacctggcccagaaagggtgccgcagcaaggagtgatatggtttgtctttttaagactggacttgctttatattaaatttgtaaaagtgtgcactggcagcagcctgggcggggctggggtggagcccggggtctgcttgggcctgagccacccacaggtccttttcttccccttcttccttggaaggcagaactgcccaccaaggcagggatctgtctgacttgaagctccgttctggggtctgggaggcgtgggcaggagtgagggccccaggccctctgagc

SEQ ID NO: 135464 - DNA, 1020 bp, Homo sapiens
caaacatacacagccgccctcagtccagggtgctccgccataccccacacctccattctgcatgggatgggtcccaaactccatacccagagctaagccggcccctaggggagctgcccgccaatgccatctgtctcccaaggggaccctgtcttacaccccacccctcattccaggaggagctcaaagaggagcagacagccatggttcctccagccatccctcttcggcgctgcagatactgcctggtgctggtgagtgatgcacggacacccgtgggagaggttgggccaaagctgagactcctcgacctcctcctgccccactgcctgggcctcgcccctcctccaagaaggccttccagaatcaggccctgattccttccctcagtggtgggcccacagcagggctggcactgagcctccactctcctccatgcccacagcagcccctgagggctcggcactgccgtgagtgccgccgttgcgtccgccgctacgaccaccactgcccctggatggagaactgtgtgggagagcgcaaccacccactctttgtggtctacctggcgctgcagctggtggtgcttctgtggggcctgtacctggcatggtgggtgctgctgcccgggtgtagagggagggtgggatgaatgctcccacaggggtggacagagccaggactcccagggacccggcatggggagggaagggctcccctgccctcccccagcaccaggcccctgtcccctgcaccgcaggtcaggcctccggttcttccagccctggggtcagtggttgcggtccagcgggctcctgttcgccaccttcctgctgctgtccctcttctcgttggtggccagcctgctcctcgtctcgcacctctacctggtggccagcaacaccaccacctgggaattcatctcctcacaccgcatcgcctatctccgccagcgccccagcaaccccttcgaccgaggcctgacccgcaacctggcccacttcttctgtggatggccct

SEQ ID NO: 135465 - DNA, 1172 bp, Homo sapiens
tcaggtgatccacctacctcagtctcccaaagttttgggattacaggtgtgagccactgcacctggcctgaaatgtcacttctaaggatacctgctctgactccccagtccagggcaagtcccctgattgggcatccagagccccaggccccttctcctgcaagacactggtcccagttacgcgacaggcgcttatgggccctgtaggtggatctgtctccctccggagccagtacgctccatgtggtcaaggaccttgtccggctcgctcaccaaggacccccagtgctcagcagggactgagtgagcaggtccagggaggtgataccaaacaagacagcctggttttgccctcatggacctggccatccatcaaggatgctgaatcatcaaagccacatcgtaccaagtgttcattgctgtggtagatcgggcctgtggggggactcagcaggcacaccctggtgggttaagcatggcttcccagaggaagtaactttgacactgggaccataggtatcagctacgtgaaaggagagttcaaagatcatgtgggctggagtggccaggagatacttcctggaggaaggacatggagtgtatttgggtaggggaggggagaaggcagtatttaaattagaaagtgcagtaattagttgaatttggatggtcctggttgaaagagaacagactgggcaaaggtctgaaggtgacctgtgccgagggccttttgccaggacagtgaatgatgaggccaggctggctggagtaggggggcagtggggaccaagtaggccagaaagctggctgtaattccggtgggcttgaaaagagttgctttccaagagtggggactctctgccagcagtgctccctctggttccagtttcccaggcaagagaggctgctgggctcttaaagatcttgaagcaaatgaaggcaaaggaaggccatgcccggggcccaggcatcctggcttttgtgccttccctcgagggtgccatgctgccagtgggacagctgacacaatgagccttgttgtgggagacccaggccggggagcacaggcccggagctgggagccagggcagatgaggtaggagaaggtaatgattataacaacaacataataacggttgtctttattgagcaatgactacatgccagacacc

SEQ ID NO: 135466 - DNA, 2064 bp, Homo sapiens
gctggggggcctgaacagtttagcaggggaggccgagactcctgtaacaatcatgcagtagttaattacaggggggtgagtgcagggaagacgacagggtgacaggtatattgcgtaagtagacactgaggcccagggaagcgcaaggaatagtccagagacacacagtctgcgctgtcaccggcgggttctcaaatttggcccgcagggtcggcggcgctggggctcccggcccgcgattgccacgcccaccagacccgaggttgccccgctcaacccggccggccgtagccgccagtaccgtgtggaagcgtgagagtcgaggggtggcacgtgactggcggggcggggcggggctgaggcggtggaacgcgcaggctagtggctgtgtttcccgccggaggcttttgcgcagagccccgcgtccctggggggcggcggcggcggcggcagcgcaggcggcagaggcgcaggcggcggaggcggctggggggtccggaagtcaacaccatgtcaagtctgcacaagagccggtaaggggccatggggcctgacccggctgggccactcctggccaggctgccccttctgcccctcagaagggggaagcgcgggtgtggccaggaatcggcagaccccctcggcagagggtctcgagcgtccaccttctaacctcattgcctgtgggctgcaggaacgacggaggggcggcccttctcctgcccctgatgtcactgcttctgcctccctcatcctggacccctggtgtcccccttcccctgagtcttcctcatccagacccccatgccccgcccccgtgcctttcccccttttgatccccctgctcccgtactctctccaagtgcaccctgtcccccgtgcctttttcttactaggattgctagagaacttgcattctccagtctggcccctcccccaggccagatcctgcagcattggctgaattttgctcactcttcagttttccttcaggacgtgttttttaaaccctttgtccttgccttctggcaggcccagaggtcttgtaatggttatatttgtgagcatggtccattgtctgcatatcaaattactcctggttcctgaggtccaaggagttcagttggtggctgtgcgtggacccggcctggccggcaggaagtgcccagtaaatgtcagctcactaagtattagaatgttggaatatgtctaattttatggtcctcatttgggaacttctagacaagaatatctctcaagtttcttccctggcattctgtgtttctggttgtagaggaagaagtgaaatatagttttgttgttctccaaagctgtctttggtgaggaccttgactaagctgtgtgatttttatgtcctaaaggggagagaggcacaggttggaaactggcagtgtgagggagctgagggctgtgggtctcactgagccgatatcagcatgcttcatttgccgccctatctccccttccagaattgcagatttccaggatgtcctgaaggagccctcaattgcattggaaaagctgcgggaactcagctttagtggtaagaagccattctgtattttcacggtttccctacagcagccctgtggctagaatacagggggaggccacacctggtcagctctggggcccagctgctgggggctggggccttggaaggaaattacacacagactcttggggccttttccagattctgtagagctgaacaggcagtgactgccttgagcttggaggggtttcccagaggggcagtggccacacttagcatgccctaagctttcctaagctttccgcaggaggtgccagattcctgagagtaacaggacaggactgaagcctggagaatgagagttgggaccttttgagcccaggacagtctttcctcattccttagctagcttcctgtgttggtgagtttggttaactgcagggttgttccttgttctctccctggcttggggtctaagctgcctgaactaaaccttggctagtggtaaaatgggtagccttgggacactgactttaaggagctgatcc

SEQ ID NO: 135467 - DNA, 1023 bp, Homo sapiens
acagagcaagactttgtctccaaaaaaaaaaaaaaaaaaattagcatccagtctaggctgggtatggtggctcacgcctgtaatcctaacagtttgggaggccgaagtggggggatcacctgaggtcaggagttcaagcccagcctagccaacatggtgaaaccttgtctctactaaaaatacaaaaattagctgagcacagtggcgcgtgcctgtaatcccagctacctgggaggctgaggctggagaatcgctggaactcgggaggcggaggctgcagtgagccgagattgcgccacttcactccagcctaggtgttagagggagactccatctcaaaaaaaagaaaccatccaatctagtcatctttcttggggaaatgattcttgaagaagtacttcttgcccactctactccccgccagttggctccacggtgaagggctgggggttctgggactctggcctggggcatgacctttgcctgctgtgtccacaggcatcccctgtgagggcggactgcggtgcctctgctggaaggtgggtgtgcctggggtggggcttctgctctgctgagagtccctgggttttcctgcatgggctgcccctacccctggcttcttcctcctgttctgcacctttccttgcttgtctgagggagcttttctgggaagtcctgggttttctgttcctcttggtgtcttctctgggatccccttggggatgggacactttgtaatgccaacaatgaagacctctgcttcctggtccgtgaagtacagtgaaagtcatgcttattgggacaaaacaaaggctgtgctttgcccaaagctcccagctcaggtggccatggaagcccagtgtcctggtttccagccctttagagcacagggtctgatgatcatgtggaagagtctgtgtgaggaaaagcagagggaagggctggtttgggttaaaggaggagggaggcagtggggaggaagggggaggctacccctagctcatgctggcattcctggatttt

SEQ ID NO: 135468 - DNA, 1047 bp, Homo sapiens
caaatgctgagctcctccctgggcttcacagcacgtgagaaagaaatcgatgggccccaggcccagactcacagataggaattgacgactcagagcatcgatgaatgagagccgaagaaaccaaattcattcattcagcaagcaaacatttactgagcacctgttatatgcaaagttcttgagctagagcaacggacagaaaaggaacagagtccctgcccagcagagaagtcctcagagctggtccccaggctgggctcccggctgtggagtttgaacggattcaggaggctgagggaagggctgtgttggctcctctgagtatcttgcaggtggtgtcaggaccacacctcagtgtgcagtgggattgttgcagcaaggccactgctcaggtttccgggatagaatcgggccccggggcctagctgggccttggacagagcatcttcatttctccccacagccactcaaccccaaccctgacagccggtggaacacgtacttcaaggacaacgaggtgctgctgcagatcgacaaagatgtccggtaggcagggtgcctggggccgggagctggcccatgggacttctggggctctctgcagctctgtcttttccatttgcaggccgggcctatgggtgagtgtttgcggagctgctggtggattgtcccagcggttgggtccaggcactattgatgataggctgagaacgaggctagcgagggagattctgtgcttgcatgtacctggctgttcttatctgagctgtagtttcatttgtaccccaggtgtttatggattcatctgacattcattcaacaagtattgagccccttttgtgtgccaggcttagcactaagttcagggttgagcactggtgtgttccctctccttaaggatcttagaacctagaagggaggatggcaagacagacattcagcccattagatcttagcagatggcattcgtggtaaatgctcctgaaggaaaatttgagggggtttggggaaacctcacctgagaagcagtgattcagctgagatctg

SEQ ID NO: 135469 - DNA, 1492 bp, Homo sapiens
aatcacggctcactgcagcctcgaccactggggctcagctcccacctcagcctcccaaagtgctgggatttcaggcatgagccactgaccccagcattgtctttcttgatgggctcctcctcttctcctccagatgagctccccacacaagaactctgtgccatcatccctaaatgagtatgaggtgctgcccaatggctgtgaggcccactgggaggtggtggagcggatcctgttcatctacgccaagctcaaccctggcatcgcttatgtgcaaggcatgaatgaaatcgtggggcccctctactacacctttgccaccgaccccaatagtgagtggaaaggtaagaaggctcttggtgcccacatccctcgttgctggcccgtgtcaggctgtgcacctcactttccctctcgggcctctgttctccctctgccagatgaggagttggcctggatcatctctgagatcctttgcagctgtgatcttctagaatgttggttgtttactgatctcttgatatttgtaatttaattctgatagagaaggtggatatgtaggaagccgaattataagatttaaataatgatttttaaattgtcatcaggagagtgtgtaataaactgctaagtgaatgtacagtattgccagatgtgagaagaaagaggcgatgtctttagcctgggggtggagaggggtcaaggacagaggaaggactgagccagaccatgaggatggggcaactcggcggggctcagagcagggcagatgtctggtaggtgagaggtggggtgggcctggagtgcgccacttctgcccccatcctgctctctcccagagcacgccgaggcagacacctttttctgcttcaccaacctcatggccgagatccgggacaactttatcaagagcctggatgactcgcagtgtggcatcacctacaagatggagaaggtttactccaccttgaaagataaggatgtggagctctacctgaaactggtgaggaccccaggaacagacgggtggaaagggacaggaggcagagagttgctgtgccatcccagcccagggcgaggtctcgcttgagtctgggggtcagaagtagctgctgctgctgctgcccgggacgctgacccatgtgctgaggcagctgatggtggagcccagctgggagggaaggggaaagttgagaatggtgcccattgtgtgccaggcatactgcagggcatttactatgaactaaattggttaagctgttagtagtcttctgaggtaagtgttaacttcattttttttttttttttgagatggagtctcgctctgtcgcccagactggagtgcagtggcacaatctcggctcactgcaagctccacctcccaggttcatgccattctcctgcctcagcctcccaagcagctgggactacaggcacccgccactgtgcccggctaattttttgtatttttagtagagatggagtttcactg

SEQ ID NO: 135470 - DNA, 1009 bp, Homo sapiens
aaaggaagtatgcttttgctgttttgtagcatgctttttcagttaatattcactgtggctgaccagaaggcttgtctctactgggaataattgcctgtggaattgttctgtggattaaatgagtgagaggacatatttaatattctaagcatagcccaggcttttagtaagtgccctgtgatggtcactcagcacatccacaaacccaaggctatcatctgcaaagtgtgtgaaaagagtttgagccatcatttataaatctggagagcttattatataaaggtttgggtttccagcttctctttaaaaaataggaagatctgaggatgttggctggcagcaaacaggctccgcccctttaccaggcaaggctgtccggcagcctggtgccagccctggtgctcacacctggcatgctgggccctgctgttctgaattcacttctgacccactgcgtggtgctccatggccggcagccaacacagagtcatgccccccaccccccacgctgtctccccagcaagagcagaacatcaagcctcagttctttgccttccgctggctgacactgctgctgtcccaggagttcttgctgcctgacgtcatccgcatctgggactccctcttcgccgatgacaaccgctttgacttcctcctcctcgtctgctgcgccatgctcatgtgagtgcgggcatgagctgtcatcagctcacctgggcagtccttggagaagccagacaggaggaccctccgccccgaagggtgggcagggctgctctttcatggctggagtgggattctggagtccttgggagggcgacaaaccaaacttgaggtgggtagggagggaggagtgggcagggcctgcactcagagcatcccaggtcccagcgcttttgctgctgcttttcataggctgatccgggagcagttgctggaaggggacttcactgtgaatatgcggctgctgcaggtaatgggagttgggggcaggctcagccactgccat

SEQ ID NO: 135471 - DNA, 1047 bp, Homo sapiens
atgttgggtggccttgagcaagtgacttggccttcaaaccgtgtactctacgtaggtgttcacacctaggacacagcaggtgcccagaacatggccgtgcttgctggtggccatgctcaggcccggggaaggagggtggggtgtagtgattaagaacatgggctcaccgggcgcggtggctcatgcctataatcccagcactttgggaggctggggtgggtggaccacctgaggtctggagttcaagaccagcctggccaacatggcgaaaccccgtctctactaaaaatacaaaaattagccgggcttggtggcatgcacctgtaattcccagctgcttgggaggctgaggtaggagaatcactttaacttgggaggtggaggttgcagtgagccaagatcgcatcactgcactccagcctgggggacagagcaagactctgtctcagaaaaaaagaacatgggctcaagggcctacagctttaggtccacagttttgctctgctgtgctcatcatgtgacccaagccaagttacagcatctctgggtctcagcttcttcaccagcacgtggccttagtgttgctttgttgttgtttttttttttttgagacagagtctcgctctgttgtccaggctggagtgcagtggtgcaatctcggttcactgcaacctccacctcccaggttcaagtgattctcctgccttagcctcccgagtagctgggattacaggtgtgtgccaccacgtctggctaatttttgtacctttagtagagacagggtttcaccatcttggtcaggctggtctcgaactcctgacctcaggtgatccgcccacctcagcctcccaaagtgctgagattacaggtgtgagccaccaagcccagcctagagttgcttttccctaacttcatggaccagatctggaaaaagtgcagaatcacagtggccactcacagggctgttgggacttcgcgctgatgctcagacactggcccagtcctactggctccacacgagggagctcgggttcagtggcagtagtg

SEQ ID NO: 135472 - DNA, 2785 bp, Homo sapiens
tgtgcccaggactaccccatcacagatgtctgccagatcctgcagaaagccaaggagctccaagactcaaagtagcccggcggcaagaggcccatgttccggagagaagcctcccgaccctgtgccctggctcccgggacacatagaaacctgtaggaacccagcctgaggggaagccacaggatcggcccgagacccaggccatgcccactggggacacactgtgccgtgctccttctgccgccacgcccagctccccacctgccctgcactctgccctctttgcccaggatactgaggagggctggagctcgggaagttgtccttcctgggccagggccgtttctggcactgggaggctggcaggggcccctccctgcctcggctctgccgccccagcctcagttcctgcttctggtcttctcctgggctccactcaggggaggtgcttggccaatgggccagaaaccgcttctgagcggggcacttcggctgctccacagggaaggcgacactgaaagctgagtcctgccgtctgtctcacccacagatgtctgtagtcggtcggtgtgaatgtgggcccaagtccccaggcatcttctccgtgtgtgtgtgtgtgtgtgtgtgtgtgtgtgtgtgtgtgtgtgtgtgttagggagtgagggtctctcaggcctccaggtctcccagcccctccttctctgtctctacctctctgcctgtctccttccacctccttcccagagtgggactgtgtcttgcttcatgattcctctctccattactctccctgcccttctctgttggggtgccttatcctgagccacctcctctccccgcttgcctctgctcccctgaacctgggagacagatgaggagactggctcagcaaggcccctggaggtcaagcttggcctttgcctcctgttcccatcccccagccctggctcctaggtcctcccaactgggagggagtcctccgtgcctcacttagagggttctgaacccgttccctacacagaaatcttggaaaccaaatgctgctgagtaaggatgaagctttgagcctcctgcccctgctttctgcccagggagggagaaggaagagggggagctggtttttctggaggttcccccagaggccctcctgtccgaaaagaaaaggaccttgattctgagcccagggtcggaacccattgcttcagaagagttgtcattccctcggcttccaggtcccaacccagggttgggttgagtgagtcccacaaagggcaagtggggcccgaggaagcctctctggggccaggggtagctgagcttaaaggccctgggtcctgccagttccaggagggccatgtctgtgcctctgtgtacccctccacccgctgcgggctgagggaggtgcagggccttctctgacccctgcctgagctgttcccagggctggagcaggtgtaccctgagcaggggcagctggccactcccagttctcaccaagtcacctccctccttgtacaaggtttgcgtccggaagccgggtgccatagtgaggaccctcgtcctccagactggctggcaggagtcaggccccagcagccctcctgcccccaaagctttccgagtctggtgggcaggacttctcgctgcccttccaagcccggctttgggccaggaaaggcttccccaggtggctcttctaccaggcttttcctttgatgccgcctggatttccgcacctgcctgtctcctctcccagagcacagtatttgggagactttgactatttattcagactcctggctatgtattgcacattggcaagtgctctggggatgaggcatgggtataggaagggagaaaggagttggagacaagatcctcttcattttccaagatcaaagtcagcctcttctccccatgcttctaggaactgcctggttttcgagcaggtcctggctgagcgggctctgagttctgtactggaattgagtgtaaagatgggaagagaactgggctgactccaggacctccaggatgaggcagaggcatgatgcttcctgctcacctgggccaccctctctccaggacttgtcagctggtggttcagccccttctccaaccccttcataagcttgggccactgcctgggacccagcagacactgcccaggactctttagtgcactcactcttgtctgccccctaccttccctcctggaaccacactacttgaatcaccattactttgcctcgctggcagagttgggtcaagtgccctctccttgaccttgagatgaaggtcaagagcacagggaccaggccttggttaggctgagctcccagcaggacaccgcctgcagaaaggacctgccctgataatgtcccttccccagattctcaagcagatgcccaagggaggtccccacagagccagagtgcctgaggcttcctgcttgagaacctgccccctggatcttggacacttacagattgagctgtatgaattcagcgggtctcactccagagggtcagaacgtttgctttagttttttcatctgttttgttccttgagtcagtgctgttgatgacgagttgtcttgaataaatcatgtgttctttgcaatgggcattggtgctgtgatgagctgaaactttggagacctcagaacagggaaaaatgaacagggatggagtcagagtctcttagagtagcccttctaagaaaaggtccaggaaatccttctgggaagagcctgttggattcttccagttcagcctcagcagtc

SEQ ID NO: 135473 - DNA, 1029 bp, Homo sapiens
actgaggcgggggtgggtgggaagagctgtgtggtgtgtgtgtgtgtgtgtgtgcgtgtgtgtactaaggtaggggtgggtgggtagagctctgcctgtgtgtgcattgaggcaggggtgtgtgtgtaccgagcaggggtgggtagagctgttcctggaaagtcaaggactgagcagggcagacaccaagcctgtgcttggctggggaacagggcagagactggataggaagaggcaccaagaacatgaagtgggcctctgacttctctggcccttttgcctccattcccaaccctacagaaacattattgatcaataatgatacttttgctcagtagtccttaacagcattccaggcagtgcatccagggagaacaaggcccagagaaggggaaggacttgcccaaggacacacagcaagttgacaggacaaaaaccctggtctgatatttgggtcaggcaaggctcccggccacctcccagagggatggatggatattcagagaagtaaggtctgtccttactgaggcaggaagccagtcggacggtgtagccccagtagagaccagctttggtgcgagggtcctgcgatgataccactttgccatggtaggtcttgcagtctggaggggtaacagagtctgtaaagatggggtgagggaatggaagcaggtggctgaaccctggagctcatcaggccaacccaggggttggggaaccttccagatacctgggtgctgctgctggttcagtcgcacagtcacccgaagcccgggctccaggttcttgtcaatcttcacctcctggggagaagccagaagaaatgggtgccattcctctcaagatcagcaggggccacggctcttccagatgccaccaggggagccccggggctggcaagggaccaaggggtccaggtcaacctgccaccctccacccctggcaccggctgaacctgctcacaagagatcatttgtgcaaaacacaggtcactggccaaacatgcacctttggggcgctcatggcaca

SEQ ID NO: 135474 - DNA, 1050 bp, Homo sapiens
caggagaattgcttgaacccaggaggcagaggttgcaatgagccaagatcacaccactgcactccagcctgggagacagagcgagactccgtctcaaaaaaataaataaatggcgaatacagccaagcccagtgctaagggctgttctgcaccatcacattggatccctgcaacactgaccatgaggtcagttccctcaggttcccacattacagatgagatacttcgagaggcatagtcactattccagggtcactgggaagtgatggtggctcccagcccagttcactgtcccagccctcaggccttccctggggattcttgcccctgtcctgggacctctggagtcttggtcctcagtgctcattgtgtgtggccctcccacacacaaacgaagaaacggaggccccacagcagcaactcagtaacagtgcaggagacatgaccaggtccgcagggggccagggaaggaggtccctccagtaccttgcccagggggttgttgggggtgttgaggaccagggctttggtgcgtgatgtgaatttgccggccagctccatggggtccagctgccagttgctgctggaacccagttctccattctggatgggaccctgcaagagcaggtggcatggggtggtaccacttaaccacctgacatgcaggtcttccccagcatctatccccaccttctctcccctgggatcccaacacacacacctcccctctgccctcccagcttagaggaactggcttccttcacttctttcctccttttccaactcccagggtccaactcagcccacgccttggatccctctgcccatccatcctctacctagcatccttaccggcttcagggacacaaacacaggacgaccccctgccatcattgtcatgggctcgtagcagtcaaaaaagggttcgatgatgatgacctgatataagggtcaaatcagctggagtcagcatggccctgacctctcagtcccactcagcccaagtcttgcccactcacctcgtctccttcgtccaccagggcctggaag

SEQ ID NO: 135475 - DNA, 1028 bp, Homo sapiens
cctgggtgagccacacttccactgactcctcttcccctgccctacctcaggaagccttttgagaatgaggtgtggagggagagcacctggtaagaggaagggaactgggggagcccgaagttcccaaggacctcttccacctcttctgttagtagtactcttaacccctgccaaactgtattctgccctttggagcagacaacctggcagacagacaggctgtaagaagcgggaggagatcggctgttgctgatacttcctgtggaggggatgtgggagtgggagtttgttcagagagactgggcagtgctgattgctcagtctcactggtgttgcttccatgaaggtcaagtcttcctctggctcatgaagtgaggcaaggacagatgacctgtgctggaggaggctgttgtggacatgccagggatgagtgactgggtggctggtctctgcttccttgttttcctggtctcagggctttggcatggggtctgatgccctctgcgttctagggaccatagggtacagagcagggggtgcagggccgggcgtggtggctcacgcctgtaatcccagcacgttgggaggctgaagcgggcagatcacgaggtcaggagttcgagaccagcctggccaacatagtgaaaccttgtctctactaaaaatacaaaaaattagccaggcatggggctgcgcacccgtaatcccagctattcgggaggctgaggcaggagaattgcttgaacccagcaggcagaggttgcagtgagccaagatcgcgccattgcactccagcttgggcaagaagagcaaaattccatctcaaaaaaacaaaaaaaaaaacagagcgggggcacaggaaatgttcatgacttccccccagaacttgactagatgtggtggttctccatcccttaggcacacccaccaggaagccgtttcctttgcaaactcttgaatgacctttctggactgtagggaatcctggggatcactgccgtgggtcagaactcagggaagtggccgga

SEQ ID NO: 135476 - DNA, 1053 bp, Homo sapiens
atgatctgcctgccttgtaagtgggtcaccaaggactcctgcaatgattcgttccggggctgggcagcccctggcccggagcccacctaccccaactccaccattctgccgacccctgacacgggccccacaggcatcaagtatgacctggaccggcaccagtacaactacgtggacgctgtgtgctatgagaaccgactgcactggtttgccaagtacttcccctacctggtgcttctgcacacgctcatcttcctggcctgcagcaacttctggttcaaattcccgcgcaccagctcgaagctggagcactttgtgtctatcctgctgaagtgcttcgactcgccctggaccacgagggccctgtcggagacagtggtggaggagagcgaccccaagccggccttcagcaagatgaatgggtccatggacaaaaagtcatcgaccgtcagtgaggacgtggaggccaccgtgcccatgctgcagcggaccaagtcacggatcgagcagggtatcgtggaccgctcagagacgggcgtgctggacaagaaggagggggagcaagccaaggcgctgtttgagaaggtgaagaagttccggacccatgtggaggagggggacattgtgtaccgcctctacatgcggcagaccatcatcaaggtgatcaagttcatcctcatcatctgctacaccgtctactacgtgcacaacatcaagttcgacgtggactgcaccgtggacattgagagcctgacgggctaccgcacctaccgctgtgcccaccccctggccacactcttcaagatcctggcgtccttctacatcagcctagtcatcttctacggcctcatctgcatgtatacactgtggtggatgctacggcgctccctcaagaagtactcgtttgagtcgatccgtgaggagagcagctacagcgacatccccgacgtcaagaacgacttcgccttcatgctgcacctcattgaccaatacgacccgctctactccaagcgcttcgccgtcttcctgtcggaggtgagtgagaacaagctg

SEQ ID NO: 135477 - DNA, 1078 bp, Homo sapiens
ctgcgggcgctgcacatcaagttcaccgacatcaaggagatcccgctgtggatctatagcctgaagacactggaggagctgcacctgacgggcaacctgagcgcggagaacaaccgctacatcgtcatcgacgggctgcgggagctcaaacgcctcaaggtgctgcggctcaagagcaacctaagcaagctgccacaggtggtcacagatgtgggcgtgcacctgcagaagctgtccatcaacaatgagggcaccaagctcatcgtcctcaacagcctcaagaagatggcgaacctgactgagctggagctgatccgctgtgacctggagcgcatcccccactccatcttcagcctccacaacctgcaggagattgacctcaaggacaacaacctcaagaccatcgaggagatcatcagcttccagcacctgcaccgcctcacctgccttaagctgtggtacaaccacatcgcctacatccccatccagatcggcaacctcaccaacctggagcgcctctacctgaaccgcaacaagatcgagaagatccccacccagctcttctactgccgcaagctgcgctacctggacctcagccacaacaacctgaccttcctccctgccgacatcggcctcctgcagaacctccagaacctagccatcacggccaaccgggtgagtggcccggccacagctctgcgtgtgggctggcgggtggcctggccagggcttgtggtggggcactcggcaggctcagtgtcctgggaccgtcgatgcccctgagtgtggagtcctcacctggggtttacagaaccatccaggatagaagctctgttcaagagacagactccttgggccccatcccaggcctgctgaatccgaatctctgggccccgggcctgtctttgctccaaaatgttgcagttctcctgcctggagagactgcatggccaggcaaggtctgtcccccaaggtgaccttgagccgggttcctcttcagcagggatgtgcttgggcaggaggtccaaacccgggggttctctcgcaaagccgggtggtgggagtcaagacttagcct

SEQ ID NO: 135478 - DNA, 1096 bp, Homo sapiens
gagcagctggccaatgcgatatacttcccagggccaggtgctggaagatagtggggatcgaggcaggcaggtctcatccttagagcccacatcaagggggtaacagatggaaggatgagcactgcgagtggggacatgggggccatgagacccaggagatcagggaaggcttcctggaggaagtgagcaagagctgagacctggtgcacaggcagatgttggccagagtttggcccagattgtgctgatgctgggggcctggggatcagaaaagatgctgagatcttggggagagagggaagggaagcccagaggccccgtccaagcccacacccacctcactctcacccctgcttttttccctccagatcgagacgctccctccggagctcttccagtgccggaagctgcgggccctgcacctgggcaacaacgtgctgcagtcactgccctccagggtgggcgagctgaccaacctgacgcagatcgagctgcggggcaaccggctggagtgcctgcctgtggagctgggcgagtgcccactgctcaagcgcagcggcttggtggtggaggaggacctgttcaacacactgccacccgaggtgaaggagcggctgtggagggctgacaaggagcaggcctgagcgaggccggcccagcacagcaagcagcaggaccgctgcccagtcctcaggcccggaggggcaggcctagcttctcccagaactcccggacagccaggacagcctcgtggctgggcaggagcctggggccgcttgtgagtcaggccagagcgagaggacagtatctgtggggctggccccttttctccctctgagactcacgtcccccagggcaagtgcttgtggaggagagcaagtctcaagagcgcagtatttggataatcagggtctcctccctggaggccagctctgccccaggggctgagctgccaccagaggtcctgggaccctcactttagttcttggtatttatttttctccatctcccacctccttcatccagataacttatacattcccaagaaagttcagcccagatggaaggtgttcagggaaaggtgggctgccttttc

SEQ ID NO: 135479 - DNA, 1218 bp, Homo sapiens
tttgggtttttttggtgtcttgttttctttctcctccatgtgtcttggcaggcactcatttctgtggctgtcggccagagggaatgttctggagctgccaaggagggaggagactcgggttggctaatccccggatgaacggtgctccattcgcacctcccctcctcgtgcctgccctgcctctccacgcacagtgttaaggagccaagaggagccacttcgcccagactttgtttccccaccgcctgcggcatgggtgtgtccagtgccaccgctggcctccgctgcttccatcagccctgtcaccacctggtccttcatgaagagcagacacttagaggctggtcgggaatggggaggtcgcccctgggagggcaggcgttggttccaagccggttcccgtccctggcgcctggagtgcacacagcccagtcggcacctggtggctggaagccaccctgctttagatcactcgggtccccaccttagaagggtccccgccttagatcaatcacgtggacactaaggcacgttttagagtctcttgtcttaatgattatgtccatccgtctgtccgtccatttgtgttttctgcgtcgtgtcattggatataatcctcagaaataatgcacactagcctctgacaaccatgaagcaaaaatccgttacatgtgggtctgaacttgtagactcggtcacagtatcaaataaaatctataacagaaagtggcctttggaggtctttgtgtcatgggaggacgcttccctcacttctctgaagcctgccgggccgtgtggaacgttgcttgggcacctacaggagagttaactctgctcatctcctgccccatgagactctgtgcctttggaggcagttactggagcttgtaagctggacgcagcacctgctaggtaacaggctgtgacctgggctggggatcccatagccagcacaatctctgtcatcctactcacctgtggttgggcactcatgagggggtttttttgttgttgttgtttttttgacagggtctcattctgtcacctagagtgcactgctggaatatagtggcgtgatcacggctcactgcagccttgacctctccaggctcaggtgatctcacctcggcctcccaagtagctaggaccacaggggcatgctggctaattttttttttttttttttttttttgagacagagtcttactctgtcaccca

SEQ ID NO: 135480 - DNA, 1067 bp, Homo sapiens
ctggactgagcttcccagaaggtcaagaataagggcatgggtggcatagggcctggggtgggggcaaggctcctgtggagcccattactcagttgtaaacaagcagaagggttaatgcctacaaagtaagtgagaatgtcaaagtaagcctgagtgtgggtgcccagagctgggtgtggagggacacgtgggcctgagatggggccgacagcttccttctgtcccatagctctgcacgcccacgaccccgtcttcaagagcatcacacactccttcaaggtgcaggtgagcagaggtgggggtgagggccaggagggtgggccatgtgtggcaggctggcagcatgacctttgcccccctccagaccttggccagaagtctgggcctccagatgcccgtggtggtgcagagcatgtacatctttaaggtgagctccttgtccttgcctcagtttaccatctgtaaaatgggcagactgctcataccaagcccttccttacaatgggccaaaagttgctggaattattatgttggtgggagaacatggaaaatcggtctcctctggctaaagcacctggaacttagttgatcctcagttaaaatttggtggtaggggccgggcgtggtggctcatgcctgtaatcccagcactttgggaggctgaagcgggcagatcacctgaagtcaggagttcgagatcagcctggccaacatggagaaaccccatctctactaaaaatacaaaaattagccgggcgtgatggcacacacctgtagtcccagctactcgggaggctgaggcaggataattgcttgaacccaggaggtggaggttacagtgagtggagatcacgccaatgtactctagcctgggggatagagcaaggctccgtctcaaaaaaaagaaaaatttggccaggcgcagtggctcacgcttgtaatcccagctctcagggaggcagaggtgggagggtagcttgaacccaggagtttgagacctgcctgggcaatatagcgagaccccattctccacaaaaaggaagaaaaaaaaaaagaaaaaaaaattt

SEQ ID NO: 135481 - DNA, 1051 bp, Homo sapiens
agggccctgggtgaggagatgggaggccgagcgcggagggaaggggtgaagagccggcccccctcctgaagaagactcttcagatccccgcgcgcggggaccgtttggacgtaaccgcctcccgtctcggtgcccgtccatccagccggggttggccctgccactgtcgccacatcccgcctccaattcccgccccgcttccgctcggctttgacaccgcgcttcacagccaccccggtccattcgacccgctccgcacctcacacacggcccgccggcggccgccgccatcttcgcgcgcccgctcgccctaaccccgcccccagacgccatgcccacgtgaccgctcgcccccggacccggagcgtgggcggggatttcgtcacgtgacgttgccgcggggcggtgccaagatggcgaggcccaaagaggtgaggagccggcagcgggggcggctgtaactgtgaggaaggctgcagagtggcgacgtctacgccgtaggttggaggctgtggggggtggccgggcgccagctcccaggccgcagaagtgacctgcggtggagttccctcctcgctgctggagaacggagggagaaggttgctggccgggtgaaagtgcctccctctgcttgacggggctgaggggcccgaagtctagggcgtccgtagtcgccccggcctccgtgaagccccaggtctagagatatgacccgagagtgcccatctccggccccggggcctggggctccgctgagtggatcggtgctggcagaggcggcagtagtgtttgcagtggtgctgagcatccacgcaaccgtatgggaccgatactcgtggtgcgccgtggccctcgcagtgcaggccttctacgtccaatacaagtgggaccggctgctacagcagggaagcgccgtcttccagttccgaatgtccgcaaacagtggcctattgcccgcctccatggtcatgcctttgcttggactagtcatgaaggagcggtgccagactgctgggaacccgttctttgagcgttttggcattgtggtggc

SEQ ID NO: 135482 - DNA, 1043 bp, Homo sapiens
cgttctccagcagcgaggagggaactccaccgcaggtcacttctgcggcctgggagctggcgcccggccaccccccacagcctccaacctacggcgtagacgtcgccactctgcagccttcctcacagttacagccgcccccgctgccggctcctcacctctttgggcctcgccatcttggcaccgccccgcggcaacgtcacgtgacgaaatccccgcccacgctccgggtccgggggcgagcggtcacgtgggcatggcgtctgggggcggggttagggcgagcgggcgcgcgaagatggcggcggccgccggcgggccgtgtgtgaggtgcggagcgggtcgaatggaccggggtggctgtgaagcgcggtgtcaaagccgagcggaagcggggcgggaattggaggcgggatgtggcgacagtggcagggccaaccccggctggatggacgggcaccgagacgggaggcggttacgtccaaacggtccccgcgcgcggggatctgaagagtcttcttcaggaggggggccggctcttcaccccttccctccgcgctcggcctcccatctcctcacccagggccctttgccttcctcctctctcacctccgacgcgtctcttggcgccccacccgcgcttccttctccggccgtgacgctccctcgagccacggggagctttgcggtctcctggggtaccccccacccacgtccctgctgcaggctcccagtgtcctgccccggcgtcgagtgcgccctgctggctccccgacctctcccgcgatctgttcttgttaggattttgtttcgcgttgagcggagccacgcttgcggcttctgtcctctccgcgcctcgtatcgttcttttcttgcactgaatcaagtcagccagcatgtccaaatcctccaagagatttcagggattgaactaggctttagggacaagaagatgaaatattatatacgaaaactacaattctgacaaagtgctttctagcgtcagaccctggtggagcgcttcccaggagttatctcattca

SEQ ID NO: 135483 - DNA, 1037 bp, Homo sapiens
gtgccagcagtgttttccccacttttttttttttttttttttttttttttttttgagacggagtctcgctctgtcgcccaggctggagtgcaatggcacgatctcggctcactgcaagctctgtctcccgggttcatgccattctcctgcctcagcctcccaagtagctggggatacaggcacccgccacaacgcctggctaattttttgtattttcagtagagacagggtttcactgtgttagccaggatggtctcgatcttctgacctcatgatccgcccgcctcgacctcccaaagtgctgggattacaggcatgagccaccgtgcccggccctaacaatattattatataacaagattactttccaaaaatttaacaaatcgttttgtatattgagattttttgcttttagagagcagacaaaatggctatgaggcagtgtacaagtttgtatgatcagaaagagcaaaattacctctgttctctcattttgcaggagcagtagagaactgtggactattctgcttggaaggtcagctctgagagagctggtaagtggtggtgttcttgagtgggttctctgggttctttgtgtagcttttgttaccaaaaaaaacctttttttaaatgtaggaagtaaacacatttatttatttagagacagagtttcgctcttgtttcccaggctggagtgcaatggcgtgatctcggctcaccgcaacctccgcctcccaggttcaagcgattctcctgcctcagcttctcgagtagctgggattacaggcatgcaccaccacgcccgactaattttgtatttttagtagagatggggtttttccattttggtcaggctggtctccaactcccgaccttaggtgatctgccctccttggcctcccaaattgctgtgattataggcgtgagccaccacacctggcctatttatttattttgagatggagtttcactcttgttacccaggctggagtgtaacagcatgatcccagctcactgcaacctccgcctcccgagtt

SEQ ID NO: 135484 - DNA, 1048 bp, Homo sapiens
ggacagagctattacagataatatattaatatatgtatgtatgccacagacctggttttaaattttagcaactgtttatgagctgtgggatttttggtaagttatttaccctaagtgctggcaattccatttgtaaaaggagaatagtaatatttgccttttagggcagtagtaaggatcaaaaataatgtaacttaatgtgtttacaaataacattgttataactgtaatttaaccactttttttttgttttgttttgttaggcataaccagttctgcgttatgaagtttgtagaggtgaatgggtgtgtgtgtgtgtgtgtgtgtgtgtgtgcgtgtgtgtgtttgtgtgtgtgtttataggcatctgaagggcagaaaatagtctgtaggaaaaatattttaaaatatttttattttaaactcagtgggctattgagaatgaagaaatgattcactgttctttttgtagtccaagttcagctgaaaaagtgaaagctaataaagatgtagcttcaccattgaaggaactgggtttaagaatcagcaagtttttggtgagtaaaaattagcactcgctcaatttattacttgcagtgtggatgtgcgtggttatattgctagtgatagtgaaaattcagtttctttttgttttggggattaaattgttttataaatacccaggttgcaactcttctccctaaaagttacaagtcaaagttgcctgatccattcactgcatatcatagggttttcttcaccagacatgtggtggtctttaaggtgactaagtttgtcattttggaagctcacatcatgcctactgctgtattaatgtgcttagtgaataagcatcgttgtttctggcatgtacatttaattgtaataaaaattgtatgtcagtgactggctcttgtcttctattagagtcagaattgttatgttttatgaatctttgagaagcatttttgtttattcaagtcctgtgttcattgtagaagacaaatctttaaattctctgcatcctgtgtgcgatttctgagctgtt

SEQ ID NO: 135485 - DNA, 1054 bp, Homo sapiens
aaacttgtgtatattgttaaacaattaattcctttcatcctgtatattctggtttatgaatgtcttttcctttattttggcctaattcagtatgtttgcatttctgtgattccttatttatataaattgaacttttccatccacatctttaagtgaaattatcactaaatttaaacttgagtttcctatgtgcaaaggtgagtaactgattttgaattttgggttcctcagattgcagattattattatgaagaaagaacctgtattcttcgttgtgtcttacaccttctcacttacttccaagatgaaagacacccctatagggtaagcttgtttagtcctcttgcttctctttatactgtatcatcttaataattttattaatatttatttgaatatttaccttttattctaggtataatttactcttttgattttttaaaggttgaatatgcagactgtgttgataaattggagaaggaactagtttcaaaatacagacagcagttcgaagagctttataaaactgaagcaccaacttgggagacacatggaaatctcatggtatgtggttactgtgctctcctgtaactttttttttttaagatggagtttccctctgtcacccaggctggagtgcagtggcatgatctcggctcactgcaacctccatctcctggttttaagcaattctcctacctcagtggattacaggcacccgtcgtcacgcccagccaatttttgcatttttagtagagacagggtttcaccatgttggccaggctggtctcgaactcctgacctcaggtgatccgcccacctcagcctcccaaagtgctgggattacaagtgtgagcgactacacctggcctataactcttaggagaattgtatacccttgcttatagagctgcaagttaaattatttattcattcatttaaaacatacagattatcttttttttttttttttttttggtgagatggagtttccctgtgttgctcaagctggagtgcaatggcacaatctcagctcactgcaacctccacctcc

SEQ ID NO: 135486 - DNA, 1082 bp, Homo sapiens
tggctgggcacagtggcttacgcctttaatcccagtgctttggcctcccaggaggatcgattgaggctaggaattcaaaaccagcctgtgcaacatagcaagacctgttctcttccaaaaatttaaaaaaagaaaaaatgagctgggcatgtttgtgctcacttttagtcctaactactcgagaggctcaggtgagagggcagctgccataagctataattgtactgctgcactccagcctgggtgatagagtcagaccctgtctcttaaaaaaaaagcaaaaaatctgtctcttaaaaaaaaaaattaaatacggaccaggtgcagtggcttgcgcctgtagtctcagctatttaggaggctgaggtaggaggatcagttgcgtgtagcagtttgagcagccataatctgccactgcactgtatcctgggtgacagattgagaccctttctttaaaaaatgttctttaagtactgtttttaatctcatgttatttctctcccattttgttttcattggttgtacagacagagcgccaagtgtctcgctggtttgttcagtgccttcgggaacagtccatgctgctagaaattattttcctttattatgcatactttgagatggcacccagtgacttacttgtattaaccaagatgtttaaagagcaaggatttggtagtaggcagaccaataggcacctggtggatgagactatggatccttttgtagatcggattgggtaagtcagtgaattgaacatcatggaacttgcagtgtttagagcattgatactatagtggtatgtaagcaggtagggggtaggtgtacttttcacttaatcggtggggaaataggtctactgccacgttccctttcatgcagggagtaaagactgggattgagagaggactctcaaaatgagtattgtaatctgctcttttacttactgtcttcatttaaggggttcattcattcattgaacaaaaattcgttgaacaactattgtaggccaagcactatgcaaatgctaacaagatagtgataaataaggcatatatgcttgctcttctctttcaggtgat

SEQ ID NO: 135487 - DNA, 1041 bp, Homo sapiens
cctcactaaatcaattattttatatcctttttcagtggaaatatgaaagtcttaaattattaaggagggatgatatctgtctaaaaggaaggattaattctaaattttctcatgattgctgggaaatttggagagatgttaatttgtggataatgtgaagatcagtgatttgtccccttccaccacaggagccaacttctggccttgggatcattctggacagtgtgtgtggaatgtttccccaccttctctccccactcctgcaactgctccgagccctggtatcagggaagtccacagccaaaaaggtaagttgcttagtcagataagtaaagagaatgggagattctttatggagactttattaggaatcttttttgctttccacattgcagttctactgccatgacaaaagtttgtctgaaggtgaatgaaagataccaaagatagcacctcaattctaaaaaattaaataatcttttcattaagtacctattgtagatactgtgggactaagactaagtataaagttccttaatatctagttggaagttactagatataagaaataaatagctaagagccaggtggtacagagtaaatgtcatttgagcaataaagaccatactgttcaggagagataactgcccttgtggagtgatggggacttgagttgagtgttaaagcccagtgaagatttggcgaggggcgcagaaggcagttccaagaacagtcacagtggtgggcttgcaagaagtttgagagtctggttgaaagagcagactgtgggacctctccttgcttatcctggagggaaatgtgtgatggttttttctgttttggcaggtgtatagcttcttggataagatgtctttctacaatgaactttataaacacaagcctcatgatgtgatctcccatgaagatggaactctttggcggagacaaacacccaaactcctttatccccttggtgagataaagagatcccccttttatgacagctttttttttttttgatgtcttgctctgtcacccaag

SEQ ID NO: 135488 - DNA, 1311 bp, Homo sapiens
tatcctcagatattagactaatttatctttctctctcagggggtcaaaccaaccttcgcatacctcaaggcactgtgggccaagtaatgttggatgatagggcatacctggtacgctgggaatactcctatagcagctggaccctctttacctgcgagattgaaatgttgcttcatgttgtttcaactgcaggtaaggtcagctttcggaaacatcacctacgaggaggaaaagtggatatgcttggaggatttagaaaatagaatatctacataaaatttagaaccatcaagattgtgatttgtctgatttgtgtatctgggtctcagagactgttcagtgatcttaaaggggttgtttgccgtgaggtcacaggctgtctttcttctcagatgtgattcagcactgccagcgagtcaaacccatcattgatctcgtccataaggtcatcagtacagacctgtcgatagcagactgtctcctgcccatcacatctcgcatctacatgctgctgcagcggtgagtctgtcttggctgaccctcagctgcccagtagagatctcagcacttgtgccctcagtttgcaggaacctggacacatacccactgggttaaagttcgcgcatattccttggttttcctgtttttatatctgtgagggttttcctgtttttatatgtctgctgaggggagagactggggagagagaagtggaaaaatgtttgtgagggaaccagttgtattatttgctttattgagtatagtgtattgttctccaaccaggttaacgacagtgatctccccacctgtggatgtcattgcttcttgtgtcaactgcttaactgttttggctgcccgcaatccagcaaaggtgagatgccagatcttcccaagagccaaaaatgtagcacttggcacatacctgaagatatgtgggcatttaactcttccttttccttctcaggtctggactgatcttcgtcacacaggttttttaccatttgtggcccatcctgtctccagcctgagtcagatgattaggtgagccaagtcctagggtggtgggccatattccctagtgagaaccacatatgtctcagatctagcctaggtttattaattttatttttatgtatttgtttgtttatttttttgagatggagtctcactctgttgcccaggctggagtgcagtggtgcagcctccgcctcccatgttcaagcagttgttgtgtttcagcctcccgagtagctgggattataggctcgagccaccacgcccagctaatttttgtattatttatgtatttat

SEQ ID NO: 135489 - DNA, 1679 bp, Homo sapiens
gtagagatagtgtttcaccgtgttggccaggctggtctcgaactcctgacctcaactgatccgcctgccttggcctcccaaagtgctgggattacaggcatgagccatggtgcccggccgagagcaagagagatttcttatccaacatcaatcacgttagtatgtgagcatttactttccagcccagaaaatccagaggtttctagattcagggacttggtgtcccgttattaagccacaatcactctgtactttttctcatttcatgggttctcgagctcagccagtagaccacttaccagtacacaggctccatcttactacctgagcattctcgccttgctgtctcttgacaaaaatgtttccctgatgttcctttgatttttttactttcaatctaggttttacatcaataaaacatgttcttaatgtttaccctgggtacagaactgtcttgattggattatttccactggagagcttttctattttatattcaagtcatctagactataacaagaatgctctatgattagtttcttgaaaccttgaaatttccctatcattttttttccctctacttctttttccagtgcggaagggatgaatgctggagggtacggaaacctcttgatgaacagtgaacagcctcagggcgagtatggggttactattgcctttctgcgcttgatcaccacccttgtcaaggtacagtctgattttgttcacaaagggcagaaaaagaaaaggtccagtcttgtcagatgactctgaaatagtttccctggcccctggtgctgtaatcttcttgtctgtaggcagaatagtcatcttgaagttacagtgacaacagtttctatgtattgagtacctagtatgtgccagttatgtactctattaggtgcttaattatgtgaatttatttaatgattggaaggtttatgaagtagaatggaagaggccaaaagggtattgcagttactatcaagctattttgacagtaacctgggataatatcatatcccagtatatatacatgtgtgtatattcctgaagcaaaatttcacagtttatttcacaacatttattcttaccacacaagttgtaccctgatattttctattcagtctcctccctatttaagtgaattttgaccatagactgatctcataatctactaatgggttacaactcggtttgaaaaatactgacatagagcataaataatgacatagagcataaattttggagtcagaattaggtttacattcaggttgacagcttactagctgcatgaccttgagcaagtaaagaatatcttaagagtctctaaaacagaatgctatatggtctctacctcatgggattgagaagagggtcatgcatgaaaaaaactatacttcctgcctgcaggaatcaatgaatgcttaaaaagaaatgattgtaggctgggtgcagtgattcatgcctgtaatcccagcactttgggaggccgaggcggatggatcacctgaggctgatcaggagtttgagaccagcctggccaacatggtgaaacctcatctctactaaaaatacaaaaattagctgggcgtggtggtggacgcctgtaatcccagctactcagtgggctgaggcaggagaattgcttgaacctgggaggcggaggttgcagcgag

SEQ ID NO: 135490 - DNA, 1284 bp, Homo sapiens
atctttaggtgatcaagtctgtttcaggaaagtgatcagagtgccttcagcttgcagagagctggtctccagtgtccagtaggttaggttagccaccctagcctaattggacaatgcccttccttccaagatacactgagtggctccctggtaactcagaatacctctgtcttccagtcatactcccagcctgcagtttctctgcatctgcagcctggcatacacagaagcaggacagacagttatcaatatcatgggcattggcgtggacaccattgacatggtgatggctgctcagcctcgaaggtagggctccttctccacgttccctttgtctgtctttattgtgcctgcatgttactaataactccagtttaagttaacttgcagtagcttttagaagacgacattgttcttcctaggacatagcctttacataccctagtggctgctgtatagattggcgtatagcaaagggagttgattactcctcctctctcctagtttggactggggcctctaacagaagctgttgaactctgggattattgttggaatctaattcatgagagcacatatattgcgaatgaagtcatactgtctgaatcatctttggtttccatttggcaccctagtgatggggcagagggccaggggcagggccagctgctgatcaagacagtgaaactggcattctccgtcaccaacaatgttattcggctgaaacctccttctaatgtggtgtcccccctggaacaggctctctcacaacatggtatgtatttctcttccagtcacaacatggtatgtatttctcttccagtcatttttgctcataaatacgtatcttaggcagtgtttttggatgtcaacagtattttctgcttcttgaggaagtttgggaatgattaccagctcctttcctgaaattggaaacaaaaggactagatggtactttatttctgcctcctattgatgatagaataatagttaagaatgcagatttgaagtcagactgccttggttcaaattttgtatccaatcaactgtgtgaccttgggtacgttattaaacaactctgcctctgatttctcatctgtaaaatggggataatggtacaggttgagtatcccttatctgaaatgcttgggaccagaagtgttttgggtttcagatttttttttcatattttggaatagttgcagtatacttaccagtttagcataaatccaaaatgttccagtgagcatttcctttgagctatagttagagattttgacacat

SEQ ID NO: 135491 - DNA, 1225 bp, Homo sapiens
ttcaaaatctaactggaggttttttcttgacactgtaggggttcattagaccagtcattaaaggatacactgaagaaattttccatcgagaaacgctttgcctactggtcagggtatgtcaagtcattggcagttcacgtggccgaaacagaaggcagcagctgcacctccttgttagagtaccagatgctggtgtccgcctggaggatgcttctcatcattgccaccactcatgtaagacccttttggggagagttttcactttggtaccttagcaatgatgtgttgacatgagcctagcagatacagctccttgtgcggaagaattaatcagggtttatccctgagagctaaactgtaataggttctatgctgagagattgggactgtggggtatttgagggtgttgggtccaggagaccattaagaggaatgcagagaagtgatttgaaatcctttcagagttcctaaagcctcctgtacctcccttaggccttggctgggtcttagctgctccctggctgcatctgcctcttgtgcaaaggcataactgtcttctcgtgctgtgtaccttgtagatgctaggtcaataaatacttgttgactagtcagcagggagctgtgacagctgcagcagcaccctctctaaaaagcagtttgtcattggttctagaaactgcatttcctggtcttagaaaaagaacagaggccattgtctctgtactctgtctactgggagttggttttgagagagagagataacatctggaagaaatgcattgttcttggcttttttgtggtttgactccgtcacgctgtatcataaggacttggtattgaagtgttctttcttggggtatccagattaatttttttttttttttcttgagacggagtcttgctccgtcacccaggctggaatgcagtggtgcgatcttggcttactgcaacctccgccttccgggttcaaggaattctcctgtctcagcctcccaggtagctgggattataggtgcctgccaccacgcccagctaatttttgtatttttcgtagagatggggtttcaccttgttggtcaggctggtctcgaactcctgacctcaggtgatccacccacctcggcctcccaaagtgctgggattacaggtgtgagccaccacgcttggcccagattaatcttttgacttcatgaacaacttcagcttgatagatgcctcctttttc

SEQ ID NO: 135492 - DNA, 2038 bp, Homo sapiens
gtgccaggcatgtacctctctcctgcacagtcgaaagatgctgcagcattacttacaggtaagcgtcctatgccatgaggtcctggaatacctcacgctagcttcccaagctccaccttcatttcttgactctccttagaacaaaaatggggatggcctcccctcagctgttgcccagcgagtccagaggccaccgtctgctgcttctgctgccccctcctcctcaaagcagcccgctgctgacacagaggcatcagagcagcaggccttgcacacagtccagtatggccttctcaagatcctcagcaagacgctggcagccctgcgccacttcaccccagatgtctgccagattctgctggatcaggtactgcccatcatctgttcagcaccacctcccctaaaggctctgctctgctgtgtaccgagagctacctggggccttaattgggtcctggatggctcttgtcttttctcgcagtccctggaccttgctgaatacaacttcctgtttgccctgagctttaccactcccacctttgactccgaagtggccccctccttcgggacccttctggccacagtgaatgtggccctcaacatgcttggagaggtaagttggttctgtcagacactgtcctctccccccggctcctccccctgcctgccacttcccagctgaccttgggcatgttgggcatggtacctagcctcccaagcctgctcctctctgtaaactgaacatgacagcacctctgagaattactgtgaggattaaatgaggtaactgattaaatttgcttagtgcaggacatgcaagtaggaagctctcagtaagtgggagctgttcctgttgtcttagttttttacccttgcttctcttcagctggacaagaaaaaggagcccctcacccaggcagtggggctcagcacacaggcagaagggaccaggacgttaaagtaagtgctctttctgggatttgataaggggctggggcagtcatgggcccactgttctcaagcttggccagcctggccctctgcagcagtaccaaaaacctgtgtctcctcccaggtccctcctgatgtttaccatggaaaactgcttctacctgctcatctctcaggcgatgcggtaccttagggacccggctgtgcacccccgggacaaacagcggatgaagcaggagctcagctctgagttggtacggatggatagggatacggagggctggaccaatagggccagagccctgtggggtcctgcctggcaacccccaagggtcagaacagtagccagatgtgctgagcctcaccaagccactttttttcttgtagagcacgctgctgtccagcctctcgcgctacttccgccggggagcccccagctcccctgccactggtgtcctcccctcgccgcagggcaagtccacctctctctccaaagccagccctgagagtcaggagcctctgatccagttggtgcaggcgtttgtccggcatatgcaaagatagggcagtgctgttctgcccacctacccctctccaccagcctacactgcaccctggctggcaggggtgctgctggctgctagggcctatacaatggagggcacctcctgtcacccccctcccggagtagccacgactccagccaccacccactgacgttatttttatactagatgaagaggtcaacagcaggcatggggagccgagtcttctgtgctcaggtcctcacgctgcagacgccccctagaggaactttccttcctttccagcattccccacagcactgccggccaggggagaggcggcagcccagcagagggctctatgcacgggtttcaaacctgttttccacactctgtctttgcagttttggtaattctgtggtctatttatacagatattaaaatcttgtttatagacagctgtgtgatgtttaacttcaaagcccagggatgacaacgtggctctcagaacctagaaaactcccctggccaggcgcctgggagtggggctgcagcctcggggg

SEQ ID NO: 135493 - DNA, 1024 bp, Homo sapiens
ggccacttgccaactgtggtcccttgaggagctgactgtcttgctgatctcatctgtgaaatgtggacactgaggacggcatgagaacccatggcacgggggcacatgctgggtgaaacgcccgacctgcagacagcactgaccgctacccacttcttgtgcttgaactgaactgtcagacgcattctacagtccgctccacaatccaaatttaggaaactttttcttaggaataaaacgttccttgtgcggcttcatgtccaggaacagcactgccctctgagaggcacaggccccgcagaagacagggagggctgcacttcttcccaactagagagctgggggccggggcagccacagggcccctgctcactctgtggaagagtggggcagagggtgagtctacctttccctttaccaccctcagggccaggccctgacaggagcccaggtgactcgcacacaaggacggtttattggctagagagcaaacgcaggcagaagtaaaaacaccagataaaaagtgagtgtggagaggtgaagactgcggccgctggacttggcttgagctgtgaggggtgggaggggaggatagcaccggaagatgctgctccgggcccaacaccagccctggccaggctctcccctcccaggggcagcgcccagtccccaggggctgccagagccctgtgtgccttgccgcattcccctgatgcagcttttggcaactgaaaggcagggctctcgctgagtgcacctggggcttcctgagcccatctgcggcggccccaccctggcctaggtgctgagtgcagctgctgcagacagcccctccctccttagtggagcctggagggtggggtgctcggggatgcaggcaggggcaggggctccagagccacaggtcagaagcagggctgggggaggggtggagccattcagcctcaggcaccctcacagctaggtgactaggggcagggacagaatggggtgaattctccccactctgaacaactgtgtcacc

SEQ ID NO: 135494 - DNA, 1342 bp, Homo sapiens
ccttgctcttcagcaagctcttcctgagccctctcctgtagatcagagtagcctgagcctgaccttcttcctcacgcttcaactctgttttctcagggaagacactgatcaaggtggcagaagctgaaaagcaactgggagccgcggagagggattttatccacacggcctccatcagcttcctcacacccttgcgcaacttcctggagggggactggaagaccatctcggtgagggccctgggactattccgcttcctggtaaccatggcagttccctcctcagagcctttgagtacaggctctcttccagtgctggggctacaaaactcctgaggcctccccagagagggctcctttggactgagtgacctcctatctctgggcctcagtttccctatcttgacttgatcgtccccggcaccaatcttgccatgcatggctcagggtctcccagggcagcccagggtctcactgtccccatgccctgccctgtagaaggagaggcggctcctccaaaaccggcgtctggacttggatgcctgcaaagcgaggctgaagaaggccaaggctgcagaagccaaagccacggtaggtgtccccgctccccgctggcctcctggcccaggctctggctggagccaaggggtggtggcatgaagggacctggtatttggcatgacctctctcccctctccctggctggagatgcctggctgggggctgctgggctgagcctctctgtccctgccctcaagggagccttggtggcccccgagctctggttcccagggagatatctacggtgtgggcggaccagcagtgcccccagctgggtgcaccaccccgccaggcagctggagtctcctgcatgccctgccctgccctcctagatgctcggctctgtccccggctctgcccgggcatggcaccttcttactaactctactacttgctgcttgaacgtcaggccgagggtccctgtgctcaggcgcccccacgatggtgtggaaaacctgggagctggaccgcccgcttgctcagggccgtgtccgaggggtcccatgagattggatagggcctgggccatctggcgcccccttcactcccagctcactgaggcctgttcagcctggctgggtcaatgggacgcagcctgggacagtgtgcccagggcgaggccaggattggaggagctgggcccaagggtgaacaccctcctggcacaagaggttgctcagggctgccaggcctaaaggctgcctcataccttgcagagggaactcccaggcccaggcctactagggagatggctacctgtggctgccagctgattagccgag

SEQ ID NO: 135495 - DNA, 1064 bp, Homo sapiens
ccattctcctgcctcagcctcccgagttactgggtctacacgtgcccgccaccacacccggctaattttttgtatttttagtagagaaggggtttcaccttgctagccaggatggtctcgatctcctgacctcgtgatccgcctgccttggcctcccaaagtgctgggattataggcataagccaccgtgccgggcttttttttttttttttttttttttgtagagaggaggtctcacggttgcccaggctggtcttgaactcctgggctcaatccatctgcccacatcggccttccaaagtgctgggattataggcatgagccactgcacctagccaaggcttttcattaatgatggtgataataatactagctaacatgtatcagccccatactgtgtgctggccaaatagccaatgaactagatcctgttatctgcattctccaggcaggggctctcaggtccagaagggagactttgcctcttcgagccttggtttcctcatttgggaaatggggtgaacgccacccccctcaaaggactgggtgaggtaatagagccacgaggaaatctgagcctctgctctggaaggtctcattttggggagtgtgacgaggaagaggaggcagagccagccagggtgggggagggaggccaggagcagctggccccaggcaggagctgaggccatacccctggcagctgggccctcccagccctgcagggagaaacccaagctctgctacataattgatggctgctgagctcctggtggccgcccagcccgccaccccccaccgcagctggagccaactgcagccagggatgattcatggctgaccgactcctgcgtggccctgccccttgctcagcctcagtggcagcatctgtgaaatgggaaacagccctccttgcattagaggttgatgaggtcatgaggaaacccttaggacagggctggccaacagtgtttgttgttccttatcttactcctgcaggtcttcaccctggctgtgaccttgggcaagccctttctcttagctagagaaggccttggtgtccc

SEQ ID NO: 135496 - DNA, 1020 bp, Homo sapiens
ggccgggacttgagcggaggaccgagtaggcgcaggtgtccgggcccaacaggaccaggaaggtgtcggggttggaatgagtgggtacccgggccggggacggtgcgagagggtgccttgcttgggagcggaacgagaaggtacttgggtcagggaggtgatgcccgggcctggaacgtggcggggattggagcaggcgcgcaggtacccgatccgaggcggggagagcacccgggatggaaggagcaggcgtgcgggccgtgagcggcgccagagggtacctgggtgagtttcaatgatattccggggtgggggcaagagaagaaggggctgcccaagatgcctggggtggagtgagcaatttctgaagacggggatattgctgaggtccaacgcggggatgcccggtgcccggcatggtgggactattgaggggtccggcatggggtgaataggagactgggcagagtggctcaagggagtcggggacgttgttggggtccagacggaatgagtgagtgcacaggccagagtcattagtggggtggtctagcgcaggggaggaggcgcgtaggatgatatgcttaggcacccaggctgagggtgctgtaagtgctgtggtgacggtggaatgaggaggtgtccgcctaagattgtagggcacaagagatggctgcccaagtggggccaggccctacacagcagtagaagtgtccatttggtaggggaccttgccgtgggcttttcattgtggagaggaggtggaggggtctcagcttaggccctggaggacggacagggtgccagggggacggacacagtgtgggttgactggatttggatccatccctggagtgaagcaggcttgggggctggtgatgttacctcgcacctgcaggctctgcctcccagtggggacagcaggggctgctctggactctcccgcaaacagtgggcctcagtcacccctgtagcgtttatttgttcaggctcatctttaacaccatgtgggcttctcac

SEQ ID NO: 135497 - DNA, 1055 bp, Homo sapiens
cagccctgctcccccagcaccagattgtgcagtacctgagggacatgttcgacctggacaatgtgcgctacacgtcactgcccgcgctggcagacgacatcctgcagctgtcccggcgccgcagcgagatattgctggggtacctgggggtgcccgcggccagcagcgcaggcgtgaatggggcgctgccccgagagaatgggcccctgggggagctgcagtagaggcggcacgggctggggggtggcagagagaaggctcctcctcccttccctgggttggtatctgacagctgtggtggctgagggccgttgcccctgactttgccccacccccatcatctgggagtccccaaggcccagaggggacatttccatggagaagaacggttcctgggggaagcagaggccaggaccagtggggcctgtgggagagaaaggctgtgagagagggggttgttgtggagaattgggacaggcagagccaggatgccccaggtgggggaccccaaaacctcccatcgctccagggctgctgacaagggtgctgggagggtggaggtgaaggatggggcctagagccctgtggtgaaggtcacagtgtcctgagctagaagccacctgtggctatatggtctcagcatccagctggcctgtcctgatgccctccccacctcaaccgccttctcagagagtttgcaactccagagaaggagagtggggccaccttagtgggcagcaggcctgggccatccagagatggggcagaggtgggcctcccactcctgtgctctcttctgagcaggaactgggcccttgacagtgtcctttgacattccctcgccctaccaaagatcgtcttttctcctcccacctctgtcaccaccaaagacgggcggaggtggggctgggccctcctgcccccgcccatcccccttccatgagcccagacctccctgggtggtgctaggctctgagctgggggctcagaccagggatcgctcaggcccctgtcacctgtgggcccggggaccacttgggggaggtcagaggatg

SEQ ID NO: 135498 - DNA, 1001 bp, Homo sapiens
ctaggttactcacctgttgggctgggaggttcagtcagaggccatggtctttgggactaggtagcagccaacaggtgcacagaggcccagctgaccatgcgtcttccccagcagatctccttccttgggggcctggcactgaacgagggggtcaactggctgatcaaaaacgtcatccaggagccacggccctgtggaggtagggcctcagctgcgagggcctgaggttcccccaggttggggcgttactgggaggtctgcatccccccgtgatgccctggtctcctctctctcccaggcccccacacagcagtgggcaccaagtacgggatgccctccagccattcccagtttatgtggttcttctccgtctattccttccttttcctgtatttaaggtgagtttccaccccggtcaggatggccctgaacttgctcaggccgagttctgctagggactcactgctagccctttggatgcccctggggtgggaggggctgcagcggaggcagaaggtacccagggagcatttggatggggccagggactgtttgggaggcctgggctgggctgtgggctgaggtcatctggtgggcctgttttcgcagaatgcaccaaacaaacaacgccaggttcctggacttgctgtggaggcacgtgctctccctgggactcctcgctgtggccttcctagtctcctacagcaggtatggaggagggagagcccctgcctgcaccctgcccatgtggggtcctgctggttcctggtccctgtcggaccccaccatggaccctagtcccagaacctgtagtgcaggactggaaaaggggtcccagacctctagttttaaaaggacagggctccagctgcctcttctagcccagtccgcactgagcccaagattctgggaccaactccacgtatcagccatctcttcccagcgttccggaggagcccactgtagacaaattcagaggtcaagggctagatgggaggcag

SEQ ID NO: 135499 - DNA, 1042 bp, Homo sapiens
ccagaccctccgtggggttggcaggggctgccggggcctgctcctcacctgctcttcccacacccccagcatgatccaggacctggatatcaccgtgatggtgttccaccattttggaaaagacttccccaagtcggagaagctaagcccagatgccttcatccagatggctttgcagctggcctactacaggtgcgcctctgtggcccacccatggaggagggaggagacctgggggcaggggagggggtgcccgcctccaaggggcgtgcttagccccatttcccaccaggatctacggacaggcatgtgccacctatgaaagtgcctccctgcgcatgtttcacctgggccgcaccgacaccatccgctcggcttccatggactcactcacctttgtcaaggccatggatgactccagcgtcacggtgagaggtctggggcgagggtgggtgagctgggcctgagcccctccctcctgctcactcagtcaacacacaataattgagcacctacaggattccagccccatggtgggcacggggaatctaacagaagctggagccgtgaatctagctctgagcttcctggggaccaaagaggaaaagggagtcattcatttgttcattcatttattcattggcagtaagcaactgccctatgtcaggccctggctgaggaccaaggagttggtagttgcaatactcgctctttttttttcttgtttttttttagaaagagtctcactctgttgcccaggctggagtgcagtggtgtgatctcgactcactgcaacctccacctcccgggttcaagcaatcctcctgcctcagcctcccaagtagctgggactacaggtgcctgccaccatgcccggctaatttttgtatttttagtagaaacgggatttcaccatgttggccaggctggtctcaaactcctgacctcaagggatccacctgcctcggcctcccaaagtgctgggattacaggcgtgagccaccgctcccagccccaatatttcctcttaaagagctcagaa

SEQ ID NO: 135500 - DNA, 1023 bp, Homo sapiens
aggaaggcggcctgggggacacagaggcccagagtggggaagggacctagtggagggaacaccggagccactgctctcccatcacaccaccccaggggcccggggcctccagaaccgatgcttcagagcagatgacaccccctccagattctaggctgaggttcaggagctcaggccctttgtgggtagacccagcccactgacccctaaccaagccacactccagctgcagggggccagcacccaagtcctactaggcccttggccaccagcacttccccgagccctcccgaccatgctccctctagaggttatgaagaagcacacacaggctggcaagctgggactcgcaggcccctcccttgcgctcccaggctttctggaagcggtgagagaggctggaagactagacctcccgctccccaagcaggtgtccctagcccggggcctccctcagggtgtccacgcagcttctaatctctaatcaatctttccagatttgctgccaaactcattgagggtgtgttggatttcaaggtcatgattgacaagtgagcatccccacccctgcccagccccacacctgcccaggcctgcttaattaccacagccacctctgaccccagccctggcccggcatgccagcttgggccctgggccctgctccagctgctggaatctcctcttggtgggtgaccctgtcccatcccaactaaagaggaccccagagttttattcgctgcttcatctcccctgtgacaaactgaagcccagagaggggaaaggagggagtttctagatgacttctgaacagggcccatctggggcagaaagcgagccccctgcccacagcacagccctgaggtgtcctgctcatctgggagtgggagcagggacactgtgtgagcccccagcagtacctagcaggtccctgtctaccctgccctcctccccattcacttgcccagtggtggcctcactgcccctctaccccatagcgagaccctgcccgtggagtacctg

SEQ ID NO: 135501 - DNA, 1070 bp, Homo sapiens
cgtgtgggccaggctggtctcgaactcctggcctcaagtaattcacccgccttggccacccagagtgctgggattacaggcgtgagccaccgcgcccggcgagaagttcttaatgtaatgatgaaaactttggattttggagtcatacatatctggctctgcctggcaagtcacagctctgtgagcctcagttacttctctcttttttaaaatttctttttttttccctgagaaaaagcctcagttatttcttaaaataactataggctactatactttcttcatagaattgtagtatgtgttttataagatgtgtgcaaagcatgggacatagtaggcgatcagtaaatgctgattgcccttatctttttcaaagtttcaaagttgtacaggttgaacatgtagacgagtttcaaatggccaatgataatgctatatattatagtctttgttggggggcttaggaaggaacatttctaaaattctgaatgttgattttatactgtgaggttgttgggaatccactgtcccttggaacctatgtctctataacctgaggctggagagactgtgggcgtgacctcatttatcaccatcctgcctttgaaggcttgtttctttgatttgggattgtgtgttctggcaacttgtgtgtgtttcatcagtaatttgttatagtgcttcctggtaaggtagccttttcccaaacatggactggcctgaaggctctcttcctgtgaaatatcccggttaaataatgtcaggagtgccatccctttttttatttttattttttgagacagagtctcactctgtcacccaggctggagtgcagtagcatgatcttggctcagtgcaacctccgaggagagctgtccctttgcagagaatggtgatctcacacatataaaagggctgtatgttcccaaagattatttccaagttgattatttggaatgtgggacacattttcccataaaagcaatgtggttgggttactagtctgacctacaaagctttttatttggcatcttagttgaagtgccaatttactaatagcagttttgggt

SEQ ID NO: 135502 - DNA, 1692 bp, Homo sapiens
ttctagatatcagggcttgtctcagggcttactgtggacaccccggcttggataaggagaaaggaagaaagagagaggaaaaagggatgaagaagaaacaaaaccaatcaggagtcacttgttcccagcaactgcctctctaggggcctgcacctcaatgctatttttttttttgagacagggtctcaccctggcccccaggctggagttcagtgatatgatcatggctctctgcagcctccacctcttgggctcaagcagtcctcccacctcagccacctgagtagctgggaccacaggcacgtaccaccacacctggcaaactttttaattttttgtagagatggggtctcactatgttgcccaggctggtctcaagctcctgggttcaagtgatcctcctgcatcagcctcccaaagtgctaggattacagacttgagccacaatacctgaccctcagtgctttcttatccctgtgttgggtgtaactgcagcccagcagggaagaagagtgtctagttgaaagctgggaatggttgtgtggggagacctgtctgtggcaggcatctgcactccaactagacagcctggcccgcctttggtcgctgattgctgggggtgagacacttggtggtactccttgaattcctggtggtagagcatcatggacaagcatgtgcccactcagctttgaagttaggctactgggtcctagctccatgtctaatgatatcttggtcttgggagaccttgggcggatcacttctcttgaaatcttggtttcctcatctgtaagatggcgccagcagtgtctaccttatagggctattgtgtaaaaaaactgctggcagcaatagtgagtacttggttcactctggctggagatcagcgtgttgctgtggtcactgtcttgccagcttttctggagggtaggggtcggtatttggcattacgtttctgcttctcctgctattgggttgggagtcagggtcaggagaagtagaaagctcggagctctttggtaacctggtggagctcggggcaggtggggcgggggggtctgccacccctctccccatccccattctcctctctgtttggtaggcatacgctgactacatcggattcatccttaccctcaacgaaggtgtgaaggggaagaagctgaccttcgagtacagagtctccgaggtaggcccaaggaggagctgctgcagcagcctttccaaaaatagctccagagtcactgggtgcggtggctcacctctgtaatctcagcaccttgggaggccgaggcaggcggctcacgaggtcaggagatcgagaccatcctggccaacatgtgaaaccccatctctagtaaaaatacaaaaaattagccgggtgtggtgacgggcgcctgtagtcccagctactcaggaggctgaggcaggagaatggtgtgaacccaggaggcagagcttgcagtgagctgagatcgcgccactgcactccagcctgggcgacagagcgagactctgtctcaaaaaaaaaaaatagctccagagtcttgtgggctcagtgcccaccacggggccagagcagaaaataagatcgcccaaatacatgtgcacttcacattttcatatctatatttctaatttttgaaatctgtgaatagatggatatttataaaattgagatcaaggtaa

SEQ ID NO: 135503 - DNA, 1228 bp, Homo sapiens
gtaatcccagaactttgggaggccgatgcaggtgcatcacttgaggtcgggagtttgagaccagcctgactaacatggagaaaccccatctctactagaagtacaaaaattagctgggcgtggtggtgtgcgcctttagtcccagctacttgggaggctgaggcaggagaatcgcttgaacctgggaggcaaaggttgcagtgagccgagattgcaccactgcactccagcctgggcaacaagagcgaaactctgtctcaaaaaaaaaaaaaaaaagtttagtgtatttctgggtggcaggattactggtcattttcattttcttctgtttatatttctattttttatgatgagtaggtattgcatactgaacaaaaggcttccataaagtctttttaaaaagatgtcagggctggagttagcttctctatagcagcagcccatgggtaggctgcctacagaaaccaggtgctaaagccaccccgtccctgtcccatcagcctagtgtgcttccctctctggaaagcctatcatgctctcctgaccctccttcatattcagaacagtggggaagaaagagggatgggggagagttcccagtaggggccatgccaaggggtcattgtctggcagcagtggacttccctctgtggctaagcgggagccacttgctctgtagcttggacccctctattttgcctccacaggccattgagaaactagtcgctcttctcaacacgctggacaggtggattgatgagactcctccagtggaccagccctctcggtttgggaataaggcatacaggacctggtatgccaaacttgatgaggtgaggctgccacaggacaggccagggactgggctggcagtgagggtggttctggcaccagttggggaagggcctgcattgtatagcgcttctaggcatatacaaatctcagtttgttaaaatgtcaatttcacttagcaaaattacaaatgagtttatactctgcttggtcatcttctgggaaacacgactgtgcacatacggccctctgcactacaaggctgtttattaagtcactgtattacagcaaactggaaatgttccaagtatccatctgtaggggattatttaaataaattagtccatcaatatcatggagtactgtgcagctataaaaaggaattttttttattttttattttatctttttttttttttagacggagtctcgctgt

SEQ ID NO: 135504 - DNA, 1721 bp, Homo sapiens
tacatgatcttttttttttttttttcctgttgttcaggctggagtgcagtggcatgatctcagctccctgcagccttgacctcctgggctcaagcaatcgtcctgcctcagcctcccaagttgctgggactacagcatgcgccaccatgcttggctaatttttgtgtttttagtagagacggggtttcatcatgttggccaggctgatctcgaaatcctggcctcaggtgatccgcccaccttggcctcctaaagtgttggaattacaggtgtgagccactgctcccagccttaagttatatcttaaagctgacaaatcatagctttacagcttgatggatttttacatgtttttactcatggactcaccactcatgccaagttttttacccatggattcaccactcatgtcaagcaatagaacattctagctggagtgctccccttcccaattgatatcgcccagattattctgatttctattccataaattgatttttttccatgtttctgaacttcgtataactctctggcttcttttgctcaatgtcatgtctgagattcatccatgttttcatgtctagctataggtctttttctttgctgtgtagtattctattgtatgaatataccacaatttattcatttcactgttgatggacatttccattgcatttccaccttttggctactctaaacagtgctgttgtgaacattcttctgcacgtcttttgatggcacatgacaccagctcttgctgacctgagagtgtgaaggaaggtggcctgtgtgggaatcatagcactgaccttccagagtctctgtggggctccagtgagttaccacatgggagggttgaggcttttttccagattcctcctgttttgcccctagactcctgtgccctggaaaaatcagttgatgataagtcgcctgggtagtcttctgctgtggaagaataaatgctgtccctccccttccttctgtggcctgtcagaacaggaaccaagctggcctggcaaggcagtgtgggcccccagtcaggtgctgcccctgggcacctgcccactgggatgctgcttaatatgctgccaccactttgtgtctcttgtgttaccaggaagcagaaaacttggtggccacagtggtccctacccatctggcagctgctgtgcctgaggtggctgtttacctaaaggagtcagtggggaactccacgcgcattgactacggcacaggtatctgctgcttgtggggctctgtacttatctagcttcactgctttctgttttgggcttcaggtggtctctgggccctctgagcaagtgagagcaatcaagaattcgccaagcacctgcaacctattggggccagctggggttagggtggcttcaccggcagggagggcgtaggcatgcagggaggcccggatgctgcagctctgctgtggtccaccagggggagctgatgccccgtgcatggtgcttgcgcagcgctgctttctgttcttgtgaaaatggtctctgagctcctcatcatcaccaaaataattattaattgagcacttactgtgtgtcaaggcagcagcttactgaagctttgagaaatgggaacgcttcttggtggcctttgcagtgtcgtggcacaccctctcccttgaaccccttgtctcttagccacattctctgtgctattgggctgtttggatctgtggtccatgt

SEQ ID NO: 135505 - DNA, 1734 bp, Homo sapiens
atatagaaggttggaaccagaagaacctaggagataacctgctgggacttgtgttagctttcagacaggccaactgaggctggagaggctgaggccctgcccagggttttacaagttgtcaggagttgatggcaccaaaacccaccttcctaatcagtgattttttatttatttatttgtttattttttttgagacagggtcttgctctgtcgcccaggctggagtgcagtggagagatctcggctcactgcaagctctgcctcctgggttcatgccattctcctgcctcagcctccagagtagctgggaccacaggcgcccaccaccacacctggctgattttttggatttttagtagagacggggtttcaccgtgttggccaggatggtctcgatctcctgaccttgtgatccgcctgcctcggcctcccaaagtgctgggattacaggcgtgagccaccgtgcccgggcccttaatcagtgatttttatgcctttcctgagccaaaagatggctgagtgtttgttgggggaaataaagctacattattgaaattgagaccagttaacactcttcagtggttattttggggtctccttgtgctcccagtggccgaaagggtgagactgtctttttactttttgctaccttccctttccctgtcctcctgtgcaggtaccttgaggttatgcggaaactccagaaaacatacaggatggagccagccggcagccagggagtgtggggtctggatgacttccagtttctgcccttcatctggggcagttcgcagctgataggtactagagcgggaggtgcctatccctccacccccaaccaaggctgcgttctgtggccctcccctgcccctcctgcgctccctccttcccttcttcctgcccagggcagacagtgacagcttggaaagcagggcattagaccagctattgagggaggctgtttactgtcgaccttctgctgtgagagcccgtgtggtgggctggaggaggcggaggccaagcgccaccaagataatgggaagtgacatgggctggagcaagggcgcacgcctggtgcataatggactggtgtgaaatgcgccccagctcctggcagcagctgtggggttttatgttgaaaatgagggacccttttgatttggtgaccagtgtcatccactgttattatcgagctgtgtgcaaaggggcccgttagggagcagccgccaagtgctgggtggtgggcctgcttcctgtggggctcagagaggcctgctctggtgactccccaactcttgaagctagttttcaggatgggcgtaggtgatcatctctattttgatgaagaatgaactgcctacagactgatattcataaatgaccattagttgtggcctcgggtgcattgcctccccgaatcttctcagtgacactgcgaagggtctgccagcatgaagccggctctgctgactggcacctgcaccaggcaccatactgagtgctgtaggtgtggtaattgttgtcatggcccctaggaggaggtgctcttcttgtccccagtgtccaggtgaggaaactgaaccttggcaggctgaagtcatgcgtccaacgccatgcagctagagcttagcacattagaatacacaaacccagagttacttattgctccttcaaggtgaggtgttgagggcaccacgggcaggactgaggcccctgggggggtgtgactgctgg

SEQ ID NO: 135506 - DNA, 2085 bp, Homo sapiens
tgcgagatctcctagtgtgtttgttaaaacgcacattcctgggccctccatcccagcttattgcatcagaatcttaggggacaagagccaggaacctgcatctaaacacacgtgccaggcgactgcacaggaaagctggggaccctctgctctctggacctctcttgagggaggtgttaggacttctcatcctctctgccatccccatgccccagtttccaaagggcgccctcgctcagctatctggagagggtttgagagttctatccctcctcagtccctttcccgacaccagcacggatgtctgctgcctcagtgaggttcctagcaggcctgtggatgctggccacgggggctgctctccgtccgggctgtgtattctgagcccccgacgaggtggagaaagctgggttataaccagcagccttggctccaggctcttcctggtcaacattcggctcaggcttctgccaaactccagaggccagaggggaatgacacattttttccaagtcagcaaatggagccgggactgacggctgggcggccaccacttcattcccggagatctgctgccctcagcagtgtggcaggcccaaggtcgggaggacttgggggcagcctggctcactgccttgaaagccagtcacgcgctgctctctgtggagtggaatgtgggggtctgcggagccctgggggacctcaggataagctggaggagcagggtgggaagaagggtgcagatgccacactgagttcttgggtgtggctgaaaggctgagctgtttgggctcccccggcggctggccaggcctctgggtccctgtcggtattctaactaggaggcatgccaggcctggcctccaggattttgggaattgattccatggtaaaattttgtctttagttggttggttgattttgttggtataaacaccccaaaagcttttccaaagtttgggacccagttcctccagtagaggaaatctcaaagtagccactaggtggcaggagaggcacactgaacttggagagggtttggtgacatttatttgaggcagcagaaggaacagggaggggagggcgtgcctagagttgttggctgttccgcaccttctccacaggtccgggttttcactttgggtctaggctcttgggcatggtgttcaacagtagaccctaggaggagtgtgcccaggagccggggtggctgcagcaagggcccatcttgccacgtggccgctggttgcagcacacgttgtgttggttctccagagcgcccaccctcttccacctcggagcagtgagcagcattttgcagtccctagttggtgagtggcctggcctagctcactggggacctggaggcttgcatggagttctgtacgccttgcttgggaaggaggcagtgtttcctctggagaccctggattcaccatggtgctcttttaactgggagattaactaaaacaccgagaacttgggagtggaatcaggcagccctttcagggtctcatgccaagactgccctgatacccgtgggcatcctaggtgagggaccccaccttgcagggcctctacagcctctgtaaatgcagccctggcgcctttaagagcccagggcaggcaggaaaagaatttcagtttcaatctggcttctaaatttggagttttgggaagggagggatcagatttcagctggaagggaaggagctgacaggaaggcgctgtgcagagcctccccacccccgcccatccccccagttactgacagaggagccatttacaaaaggccgattctctggggagtggagaggcaggaacgcagcgtctgtgagtaatttcctgctcaatatggctgctctgactcacacgattcccctggggtcactgcgggctgcagctcgctcgctcattctggttctttctcttctccctttgtggctagaatgagctaattttttctttgtcttccagccccgattcctttttctcccactcgtctgttttcctttgccagagttacaggcaaaggactgtaacctccctgaaggacttagggagaccctggggtactgaaggcct

SEQ ID NO: 135507 - DNA, 1026 bp, Homo sapiens
tctttctgttctcaggctggcccttgtgactagttcatggcctcagacactgtactgtgggcaccatctcttgactcctggccggccttctcttctgggaaggggctgctccaggtcttcattggacccagagcttcctggatcccatcagcagaggcgggacaacggggaagggtgccagaggccagcggggtgggggagcacagatgcttccagttggcttggctccctgcacttggtcctgaaggggttaatgaggcttgaactgaacagaccgggccctcactcccttccgccccctccccctttggtccccttcctctggacctcacatcctgtgtttaggttccagcccacatacctctctaatctgagaggcctgagagcccgttggctggagctgcctaggttccttccggctgcagctggccacccccggctctccactccgactctgccctgggtcactgccctctggtgtcctgatgttcctgaccccacccccgcctgtcccacagtgggggctgctggggaactctcactctgctgtgccccgcctccagggtgtctgagcatgtgagaggtgcacatcgcccaccagccacctcccaaccccaacccttgtgtgccaaagagaggactctggctgccttctctgcttggtacctgaagtactgtcttctctacaagcctcttaattcaagtgactctaaacttctctcgactcaggctctaaggcccaaaggatagggcaagagaccctgtccccttctctcacctgcccttccagagacaaaagaactccaggctgccagaggatgagggaggagcatattcggattgaaaatggtgatggtgtggcaggaacacagggactgtccactctgcacaggctgtcggggtctccgtgggggctgagcacagggtggcaaacacaaagaggacactgaaaatgaccaactcaggatgggggagctctctagtaatctgaaaaagggagattctagccctagttgaggccggcgc

SEQ ID NO: 135508 - DNA, 1086 bp, Homo sapiens
tgggccatggctgtgtgggtgctgccttcagaaggaccttgtcaggacccagggagtcccttccccagcttgaatcacctctggctggaaggtcagggggcagtctgaagccgctgctccgcccaggtacatgggagggccttgctgggagaaaggctgggctggaggctcctcctgccctggagccttaggcttccttggcccagctcctgtggctctgagggggctggctctggggtcctgtgggcagaatgggaagaacccctgcctccaccccttctcgccttgcaacttcttctatgggagctagagggaggttgacctttgaccccttctggaattccagggcccttggggggtgggggggctcttatgaccacttctgggatgacataagcaccatggcagctgccttggcctctggcctggatctgcggctgctccccctcccgcccagggaccacctcccgctccctgctcccgcattctgtgtctcaggcccaggatcctggctgtggccagggctctgctccccaccccaccatgagcttggtttccatccttctttccctcccctcctggcgcctctttggcccactcgtcaccctggtgcttctccctcttaggttccacagctgatttttgaggagagggaacctgggccagtcatagcacccgtttgtctctaagttagttggaggttaagatcacagccacagagtgaggctcttactctctctgaggccataagtcttgttccaccccagccaggaggtgcctaacatactctgttttctgtggccaaaggtgtgggaggaggccctggtcagtcttggcagatccaaccctcgcatgcccagaacggctcctgtgagagctagtgtccaggtgtggcaggcatgggggtgctgttgcgggagctgcagctggaagctggggttggctgcctgtgggccaggccagcttctgtgataggccctgtcacttgctctccagctctgctcctctgctaggagcccgggctgggctgggctcagggagtcgggcctcccccgtgctcagccattcccctgttcagcgctcttt

SEQ ID NO: 135509 - DNA, 1572 bp, Homo sapiens
gaggaactgggggaggaaggcctgggggatcccctggcggggctacttcctgggcccgggatggacacctgggagctgctgcggttgttggggtcctggcaggggtgtggtgtggccctcaccactctgctcacctgctccttcctcacagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcaccgcagggaagggaggagagatacctgctgcttccattgcttttcccttcctggagtcgatgcctttctaagggttggagctgctccttgcaggggcgggtcagtttcccaggccatgccggggtggccatctatggtagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctctgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccggccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagagacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgac

SEQ ID NO: 135510 - DNA, 1013 bp, Homo sapiens
actgttgccctggtgccaggcagccagcaccggaggtgggtatggggcctgtgagagggcagttctgagtgctgtggagccaagcagaggagcagtgggctggagagaaaggagggtgaggttggcacagtggggaggaagaaggaggcaggtgggcatggggggcccctggggtacctgagtgccactgcaggcggagggcggagggagggagctgaggagaggaccagagaggcccaggtcagggttgagccgggaggatggcttgctttcattcactcagcaaacactgtcagagccctctctgttccagtctggggacaagtgctggggcgctgcggtgaacaagacaggcagcaccgtccctcctggaggattttccctcttggacttattccagcagaacctgggaaacactctatatgttcagcagttggggattgttagggggctggagggagcagtcatcctatgggctgtcagatgacgcgattatccatttatttgtccagaaagatgcggataatctgttattcgtggggaaggcagctgcaaagactgcaggtgaaggacaatgcttttttgtaaaaaagcagaaatctgcattcttgatccgtccgtctgtctgtccatctacatgaacacaggcccaggtagtgatgagcttatctctgggtggtggggatatgagggtttttggaaaattcttaatgcttttcctgcttccaaagatagttatgaaaatgccaacatggccgggcatggtggctcgcctgtaatcccagcactttgggaggctgaggcaggcggatcacgaggtcaggagattgagaccatcctggccaacatggtgaaaccccgtctctactaaaatacaaaaaatcagccgggtgtggtggcacacgcctgtaatcccagctactcggaaggctgaggcaggagaatcggttgaatccgggagggggaggttgcggtgagccgagattacactacggcactccagtctgggcaac

SEQ ID NO: 135511 - DNA, 1076 bp, Homo sapiens
cgccgccgcttctccgcccgcctccccggcccccgcctcctcccccggcttctaccggggcgcataccctaccccttcggacttcggcttgcactgcagcagccagaccaccgtgctggacctagacactcacgtggtgaccacggtggagaacggctacttgcaccaggactgctgcgcctccgcccactgcccctgctgtggccagggcgctccgggaccgggcctggcgtccgccgccggctgcaagcgcaagtattaccctggccaggaggaggaggaagacgacgaggaggatgcgggcgggctgggggccgagccccccgggggcgccccgttcgccccctgcaagcgcgcccgcttcgaggacttctgcccggactcgtccccggacgcgtccaacatctcaaacttgatctccatctttggctccggcttctcggggctggtgagccgacagccggactcctcggagcagccgccgccgctcaacgggcagctgtgcgccaagcaggcgctcgccagcctcggcgcctggactcgagccattgtcgccttctagggacccccgagggcacagggacccggggccccgcggggctggggccagacaaagactcggcaaaggggcgagaggagggaacgagcgggcgccgggccactcggggctgagctgggggcgagcgggggcaggcggctgatgttttataaattgtaaaataaaaaaaaaagaaatctaaaatcttggactttatttttgcagagagaaaaagcgcctatttaagtatgctttgtgtttctcctactcctttttttctttttattgtagtgattgcagtggtgtttagcgaggagcctaccacgtgagggagggctgctgcccggaggaggtgccgggcagccgggggcgaggcagggcgccctggccgccggggcgcgccgggggcgcagctcaggagggcgccggacctgggaagccgattccaatcagttgtcagacccgggaagcccgacgttccgctctcccgagtccctctgtggggtgaggaatgggtcttgtgaaattctgagcaaaa

SEQ ID NO: 135512 - DNA, 1146 bp, Homo sapiens
gcgctctatctggaccaagaggcctgaagggggctggttgctgctcccaggggtttcaaaggtgcctggggtgggggctgcccagacagctctggaggctcttggaaatggtctggaggtttgcctgaggagggtccatgagtggatccctgaaggatgaacgaggtctgcagagtctcccagagataggtggaccttgtggggctggactcaggggggaggcccatgaccagacgtcctgctgcttcaccgcctcctcaggggatcttctgagtctctgctttttggggcttccttctgagttctcagcacctacttcatcccttggtgggagtggagagacccagtagcccaccctgtggtctctgggtctttctttagtcttaagaatttccaagatttctgcaaaagtttcttagcatctactccatgccaggcgttgagagtgaagacagagttagcgggtgtttacttcatttttccgatgaggaaactcggacactgacagcgtgagacttgcccaagatcacatggccccagggctggtgctgtgtccttcccttggccccctcgaacaatctcaaacgctttgggcccctgtgaccaatagcacctctccaggcctcctcccagagaagccaggattgaaatttcaggggacttcagataaaggatgtcctacctacattttattggtgatacagacctacaggctgtggaacttgctcaggtgataacacgtagaagtaaaaatacactgcccttcacttccctggtgcctgtcttaaaggcacacaaagactttatttatggccgggcgcggtggctcacgcctgtaatcccagcacttcgggaggccgaggcggacagatcacgaggtcaggagatcaagagcttcctggctaacacagtgaaaccctgtctctactaaaaatcacaaaaaattagctgggcgtggtggcgggtgcttgtagtcccagctatttgggaggctgggacaggagaatggtgtgaacccgggaggcggagcttgcagtgagcccagatggcgccactgcactccaacctgggcaacagagtgagactccgtctcaaaaaaaaaaaaaaaaaaagactttatttatttatgtttgaagttcacctttg

SEQ ID NO: 135513 - DNA, 1064 bp, Homo sapiens
ccagggtgggagttcaccagaggttcctccaaatcagcttccgctgtcagtggagccaaggccagttctcagggcccagctcttggtgaatatgatcttggtttgatcgacccccaccgctttactgccaagtgctgtgggaccagggcccataaggaagcaaatgtcagtctcagcctcagcccctcattcagagctgtaccccagaacatgaatctgggggcccagatggggaaacagggcagggatggaggtggatttccacctacaggttgggggcagaaggaccaggcccctcacatgggcagctcctcgtggcacctcctagtcccccacaaggtgagtttggggatctttgaagttcctttcattcactggggccagctgagaagtggtcagcctcttctgggtggccccatcctctgggtctgttgggggcccacactctgtctctcctctttctcaagaactgagaagtgggctaatggggagggctcagcagttgtgcagcttcataaaaacccttggtcttttttgaggtgggctgggaaggggaggcaccacagctgtcgtcaggaaaaccttgctgaaggaggcaatggaacagctgcactatttggtgcccgggggagcggtgtggcttggggggcacatagtaggaattcacaaacgtttatagaatgggtggtttgcatgccaggcttctgctgggatgcataaaggttcagggcagccagtgtgtgcatgtgtgtgagaatgtatgtgcccacgtgtcaggagaaggtaccctcagatctgcaccccacgaaggggaataggcccaaacgagacaaggatgaagggctggccttatttctctgtacacctgagaaaggttggggatctcacctttccccctggagctggggaggttacatctggcacagagtcactgctccctggaggaagttaattaatgcctcagtatttaccaagtgtctgctggggcagcatggagctggggcatggaaccgctggggacctgggctcccatcaaaccccaggtggtgtcagccctccatcag

SEQ ID NO: 135514 - DNA, 1004 bp, Homo sapiens
tgagtcttctctttcttaggctgaggagccagtggcgctgtagctggtggacactggggaacgaggctagggctgcggatctggggtagcctccgctggccccacagaacttgctccctgtcactggcccgggtggaggttaatgacccccgcccttcgctgttgtctgtgttttcctagcatagtcctgggcaataggcctagtgcccagaaagccactgtggccctggcttcaaggaccttaagtgtaatgagaaagactgacagtggtttggctcttcttggagctctcgctcttaccaggcactggaccaagtctccctgaatttccacaccaacctttgaggcaggttcagttataattcccatttcatggatggagcaaccgaggcacagagagcttgggtgagttgcctgttcacaccgaaaggaaggagacgtcacagggctctgggggtggggggcggggcactaggaacttcgggagaggaatgaggctctttcgtttgtcggtcctctgggtgaattctgcacttgtccatggagtgtgcatagggtacagatgtgatatctcacatctggggtccctgctccagcatctggcaaaggctgcgtgttcatttgttcattcattcattcattcattcatttattcaccatgggctgaatgctggctaatgtgtaggggctgtgctaaactgtgaggagcagggcaggcagatgtcactcccctgagccatgctgaggcatccttgattctttggagccagatctgattgactagtggtgtctgcctggagccctgggtgctccaattgattagtgatgtctgccaagggctcagctggagcttttagggcaagcctgctgggaggtgctctggggtgaggatggggtgtccttcagtgctctgcacatctgggtggcctaacagatagggtggagactggggggatgggggctggagaaatgggttctagcttcagattggccttgttatcctt

SEQ ID NO: 135515 - DNA, 1038 bp, Homo sapiens
caatccaaggactcccctctgcttcctggcatcatatacaaggatttgaactgaaaattggggggacatttgttttaagagaaaattccccaagttccagcccagccaggtgtctgtttctgctggtgactttgggctcttctgaagagctgggttttgttggttggctcctgtggtgttgttataacaaacatgaatgagtcctgcaaacaggaggtccaaatggaagaagcacttaattaatatttgactcctgctgggcatgtttaggggtgggtagaggaggctgatttttggttttctggtttattcacttttctgctttcccctctgctaattactgcattacgctctcctctttattgatacaatttgcattttaaaagtgatctgggagatgcggaaagactatttggccacaacgaacttttcacaaatcaaatgatcctccccagcttcttgtacgggcagtttcctggtctgcacagccatggcctcagtgctgcggccccattagtagtttggtacacctggttgagagcgcggctctgccagtgactagtgtggaataacagtcaccagggtttgctgggttctcacctgctgctaagcgctcccatctcatcgccttcatggctctgctgtgggggtgggacttacactcccccattttccagggaaggaaaccgagatttgcacaggctaagccagtgcttctcagacctggctgtgcctcagaatcacagcagggcttgttcatgacacagagtctcaggagggagggccaggtcacactgacccaaacttgagtctaatccgcacttccctcttgtcctccctgtcacctagcacttcctgcctcccaggggcagctgggggttctctgagttccagaaagagggagacatgggaacaggtgaggacgcaggggacagagctgcctcacgtgccatgctggggcccctcgagagtacccacctcattccctgctctccctgaggtgccctgagacccgactgagcctcagccagcctcttg

SEQ ID NO: 135516 - DNA, 2610 bp, Homo sapiens
gatcgcgccactgcactccagcctgcttgacagagcaagattctatctcaaaaaaaaaaaaaaaaaaatttaaattatttttcaaaagaagttaagttaaatccggagcccgcgcgggggaggggcgagctgagcgagggggtggagccagccatgggcccgcccctaaacgcccggaagtgacgttggcggacaaaggcagcgcgcgccgcgagctgtcgcgtctggtcgtggtctggcggagctgcggttggcttgtggcgtctccgccgccgccgccctcccttcctcttccccatcttcttctctcggtcccgggagcccccgcccggagtgagtagcgcgaggcggtgcgaagggtaggcagccgctgggagaggggaggctgcgacccctaactgtttcggcgccctgaggtcccgggtccccggctcgtcacgtgacccggcgcgtgcgcgcgggccggcacaggcctcacgtgcgcgtccccaagaggtctacgggccggacctgggcagggactacggagcagtccatgggtcggggtacaggaggaaagtcaaggcactcaaagcccaggcagggcactcccccaccccggtccccagaccgcagcaaatccctttctctgagcctgtttcccttccgagaaacagggatatggagagcgcccacttggaggatggatgggaggaatcggtaaaatcggtaaaatgcccagttcagagcctggcacagttaagtgcccgctgcacagaagttgctgtcgtatttaaccttgggtgccacccgagcgccagcccgacacaggtgcagctcaaaaaagacagcccgagagcccttgcggccaaggtcagcctgtctgcagggaggctgccatatcgaaaagcccagactttgctgcgcaccaactgtgtgatctctccctctggactttggtttctcctctgtactataagtgattgccacaactggtgtcagaggccctgacagcggggagggacagtgtaaccggtggttgtggtgtgtagaatgattgcccagtgagatgggatgagcctctgggaggaaccagggctggtataaggagcctggattccctccttaattctgttctcggcttcctgtttgtatgtttaaagacacgtcacttcctttagtgtgctggtttttctctatgtaaactgaggactgtgcgggggttggaaggatgcatggagcgttttggtggaggccggaagccctaggatcacaaggatggcatctaaaaaatctcggtgggggttctgtgcttataggcagaggaagctcactccccactctggctgatttgcagagctgtttgagtctgctggcttggccgcccagcataccagtaacagtcccctaggtgtgtccaatacagcttctgtggcattctaaggcagttttcccatttgatcctcatagtgggcagagttgacaagaatctcatttgacagagatttctaagctcaagagagaatatgtgcccggcactgtgcaaagcactttaagcttttcatatgcacttttaatcacagcctttctgtaaagtcggtattactgttccattttataggtgaactgaggaatggtgaggtttaatgtcttgtctgtgcttacacagcaggtgtgcagagccaagattcagatctggttcatctggctccatcagagcctttgttagtttttaaatgtatcccctgttttgtcttcttccctccctttctcacttccttctttttcttagagcactctgccgtttgcatgtggcctgctgctgtccacaaagatccagggaggatggactctgtccactaggctgctagagggtggaggtaacttttaggcaggcttttccgtagagacttacgtgaggaggatgagatgactgcaaaagtctgccggtgacagtttcagcactgttttcttccatgggtcgtgggagaagagatgcagtaccttgggtctgaacaccttggcggggaggaggaggcagcagccaggtgactgtgaaggatgtaggatcacatttactggctgagcagccatttaccaggcatgaggggtttgtcttcctctctgagctagcctagagtgcacacaaagcccgtgtgctcctggccccctcccaggcccttcagccacatacggcatctgtgctctggagcagagtgtagcaggaccacctgctgttggctgactgaccttgctgttccctcagactcttagggacctcctcctgccccactccaatctggacaccacgaggcaaaatgtagccaggaccccaggaatcccgtttattaatgaatcagctgttagggcagatgtcaaagtcaggcttgctatttcccggccaggatgtgcctcccctggcttgttcccagaatttgcgtgtaagtggaattcttgtaaattagattattcaggggaccctgacatttaaaggaatcatgttacaaggcttttggtaaagcacagaattatattgtcggtagcagccttcaggccttcagtatttaccagttctgaatggttggacttttgtctgtaggattttcttagagtggaaaatggctatagctg

SEQ ID NO: 135517 - DNA, 1261 bp, Homo sapiens
gtaatcccagcactttgggaggccaaggtgggagaatctcttgaggtcaggacttcaagaccaacctttgtaacatagtgagaccccatctctacaaaaaataattagccaggcatggtggcacacaactgtagtcctagctgctccggagggtgaggtgggagggtctcttgagctcgggagttggaggctgcattgagctatgatcacaccactgcactccagaaaaaataaaaatgtaaaagaacttgaagccaggacttggggcgggtgctctgagtgcaaaagacagaagatgctgttatccaaggggtagaagcagatttggggaccctggacttctctctgcactcagcaggatgtgtgacttgtgaagcctggtgtgagactggccctctgccctgggggcctttctgccaggtccctggcccgctgactcacgcccccttccttacccaggagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggtatggccacatctccagcatcgacatcaacagctcccggaagtttctgcagaggtttttgagggtaggcaggtctggcgtgctctccaggagaggctgtggctctggtggcactgccgagtccatgtggggtgccaccttttacacatgtaacactgcaggattgttggctatctcttggtacctaccccaaagccttgaggagctgggctgggtgggcacagtggggtaacttctagattgtggacttagcctcagggttaccagacaggagctggctgttaggcagaattgaggtgcctgaattgggcaaacctctcttcaactgttgggttttgccagggacgaaacccttgctctcctgccatgtccacgggtgtttggactgagggtgttggctattctggacgaagactcctagttatgtgccatggtttccaccctctgctccacccccagccttttctgtaccaggctgggacccccagtcctggagccccccaccttcttgtctcatggctggcactggaggctgctgttggccacctgctccatccagcgcctcccctccctccatgttccctctctgcacccttgttcacctgttgccccgcttccattctccccattcctctctgccgttgtttacc

SEQ ID NO: 135518 - DNA, 1241 bp, Homo sapiens
gcaggggcagtggctcactcctgtcatcccagccccttgggatgccaaggtgagaggattgcttgagcccaggagtttgagaccagcctgggcaacagaccgaggccccgtctctacaaaaaatacaaaaaaaaaaaaatgagttgggcatggtggcgcatgcctgtagtcccagctacttgggaggctgaggtgggaagatggaggatggcttgagcccaggagttcgaggctacagtgagccatgatcccaccactgcattccaacctgaacagaatgcagaatgcaacctgaactttcaaagataaaggaatgtgtggcccagcagtgtgtcctcccatgctcatcccctcgactccgtacaagctggcagccagcacagacctccccaccagtgctcagcttgtgcggagtcctggaatcctgacttgagtctaagtcctagggctcgtgaggaagggccgcacgtgcggtgacagggtccctctgataggttatatgcctctgcttttcaggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggtgaggaactacttctgttgtgggctccaggacttcaccccggagccggactcttacgacgtgatctggatccagtgggtgataggtgagggttccaccgcccttccctgctcacctgtatgtctcctgccactcgcgttccccataaggtgtcaggaccagggctttgcactcctgcagcaagtgggccagtgaggattccccaccccgcccaggcccacccccaccccgtacttcccaggactgagggacaggctcggcctaaaaggtagatttcttccttctaggttttgtttcagttgaatacctgctaccatccatttgggtgcagttttttgttgaaaaaattttaatggccaataacttactgcattcaaagtgaggagttttataagggttttatttttaataagatgaatagtttaagcttcgtgtctagccctgcaccctcttagcctaacagcacacctcgagcgctgtgccctgggctgctgacgtggcggcaggccgctagcagcagtcggccacctcctgaggcgggcagcacaggcctgctg

SEQ ID NO: 135519 - DNA, 1051 bp, Homo sapiens
gaggggcggggtggaaattttatataaggaccttgttaaggccaagaaagtcagtttaatcttataatataaatatatcatttagtcacctcagcttatccccagaggtgtttacacaattcccaatgaccagtgcagcttggaagggactgaggctcgcaagtgggtggcacagtcggctcttcagtggctccaaagtgagcccctcacaacaggagacacttcagagaggtctgtccccagccacgcactcatgattgctttttagcagaagtcatggtcgctgaggccctgggtttggcaaaagcacagctgccagcagagcacagttctggtaggtggggccacggctgacctggccccagagctacaggaacaggcaggggccagcttggcttgcaacaccatgaaacaagcctgtggggcccttagtgtcttctcccgcagagcccaccagaaacacttctgtgagtaacagaacctggaaggaaaaggggcaggggtggggccttggtggcaccgcacaggacgtgccccaggcttcctctccagctgcactgccacgtgcggccaacaagagccccgcagccctggggtgctgaggcttggtccttcccagcttctgcaaatgccctggcactgccctccaattcagagggtataaacatcaatccaagccctgttcctctttccaacatgggggggacttggagtgccgctggagggaagggggcagtctctctggaagaaccagagctgcacccttcaccactggagtgatcacagcttcaggctctacctggctggcttttctcatgaaggatcccgtctcatctcccagatcaaaaagaccctcttctaatgctgtcccagcatctaccaacaggctgacctgagctgcccgtgtcccccgttcctgtagcctgagacctatcagatgtcatcttccacggagccactgtgctcgctaaggaggtaccacttcagcctgtcgggcagaggcagggctttgaccttcacatccacaggccacggctgaaggtagagccgg

SEQ ID NO: 135520 - DNA, 1042 bp, Homo sapiens
gcatggctctcgtcttccgtgcagcctgggtgggaacagagcctctcaaagatgatgtgaaagccagaccagcaggacgcaccgtgcagggagcagttgtaggcggctccggactccaggaggaagcgcaggagagggaagtgcagtttaaagctcttcaggcagatgtgggtgagggactcgtgggctgggcactcgctggggtcggccccgtgtgccagcagcagccgtgtgacttggaagcagaagcggttgatcatctgggcctcctctttgtcccctcccacggtctcaccaagcaggaagatgatgcaggtgaacactgtgtccccatctttggtggtggccttgacgtctgcccctagaagagccatagaacaagagatgctgggagaaggccttcaaccctggcaaagcaacagcacacatcgaaggggcgggtgagaggacgaggcctaggagcgcgccagcctcacctccttccagtaagagacgaatgttctcagtattgtggatctgcaccccgtcgctgctggccagagcatggagcagagcagtttttcctagggagggagggagagcaaggaggagcaggaggccaggaagcccaggtcagggcaacccagaggaggtggcagaaatccagacactcagaggatcagaagatgaactttcagagacaactctcagctcaggtgagggctgagggtgacaggcttctggccattccctttccacccagagaagtgggagcggaaaggccaggaaaggtaggatttttctggaccccaagatgctacctgagatgttggctgggcctctcccaatgggaagccattgtttcttggaaactaagtgcacacatgccctatttcttcctatagaaggcccttgagggccagcacagggacaatgactgcactgcctctctgaagcctctgagctcagcaagtcagcagaatccctgtgtgcccagccatgctgtgccaccagccagggccagcatccagtctgcccacctagctgttgtcctggggcaccc

SEQ ID NO: 135521 - DNA, 1013 bp, Homo sapiens
tccccccacaccctgaccccaccctgacccccgaccctcatgacccaagagtgtccctgcaggaggcccagcctgcctgttcctgccacagtcctcaggctggaggggcagggcctggattcctgggttcccagaggcctaagagtctgtctgctcaggggagaaactgaggtagcaggggctggagcaggggccgtgcggtggggccgtgtggcaggacagtggccgggccagcgaagggctttttctgtcccctcccttattctgtttactgtcctaagaagcaccaaggagcatttcgggggccccaacccccagggcgacaagccccagagacctctgtgcttctgatggccgggcttgctttcccctccctacccgcccccaccaggaagccctccctgccggccagagccccctactccggcacagacactgccaggtggttcctggtgcttggtccaagggcggggcctgtgacagccaggtaagggtggggccaggccccagtgaagcccccaggtgggcagcccagagcctgggacgggatgccgcaggacccctctttctctactgttcccccatgcccacatggaaggccctgcctggtccccgcctctcccaggtgaggtaagtcagcagcccagagcagggtgggaaggtgctgagcgccccgggggtctcgccctgcgtctggagggaggctggggcctggactttggcctgggcctctctcagcctcactgcccatctgcacacgaaggggtgggcccagggttcccctaaatttctttctaccccagaagtcaagggtcctactgagagcctagcaggcaaggattctgcccatggcgattcttcccatggaggaagccttccaagaaaggcttcttcacctcggcctgtctcgggggcagatcctcgcctactaaactcgggtcagcctgcccccgcttctcccaagcccggcgaggagatcccagctcgggctcgccttctctaaaccttgctca

SEQ ID NO: 135522 - DNA, 1037 bp, Homo sapiens
ggagactccaggggttgggaagagaaggaggaacaacttgaaggtgaagggaaagaaggaaaggagaaggcaaggaaaggagagagagagggaggagagacagaggaagaggaaggaagggagaggagagaggggtgaggagggaaggaagggggccagggtgtctcgtactccagtcctggccaggggacggcctgcccatttctgacctacccctgctgtggggacagccagggaaggccgtgcttctcccggacacggtgttggaggtctctggtggcgggtttccccggggatcccagaacagctagtgtcagctggggatgtgggcgcctagacaaggcccttggcagcctccaggcagctgggtgtgcagtgggtctccccagcagctccctggggctagccaccctcctggagagcccatgaggcctccaggccttctcctaagaaggggcattggcacactgggagtacccaggcatgcttgggacacactgggtgtgggatcaggtggggtggggtctgggccaggctccaggaggcgctcgtgggctggtccgtcttggaagctgcctagctctgccctgaggacgatggagccctggcagggagagtccctgggctccgcccggggtgtggcccggatctgggtctacaggcagaaggtggagagaggggactgcagggcaggcgccagtttccaactcatccatctgggtcaggcggccccaccactgccacttgctgtggactcccaagtcctgaaggctccaaaggtgggggagatgggatccttctttccccatcatcgaccctttgaaagtgggcagccaaaccttgctgggcttgccgggactgcagaccccaggccagtgggctgagtcttgggttgcggcatcatcctccagtcctggacatacaggagcccggtcccctcaccacggatccagacatgcttggaggtgggttttcctgtggctcttggagttgttttcaggtccaaagaaagatggtctggccgggggcggtggctc

SEQ ID NO: 135523 - DNA, 1044 bp, Homo sapiens
aggtccaagcaggcatcagagagcaggttccctggttgggtgtgatggctcacacctgtaatcccagcactttgggaggctgaggcgggcggatcacctgaggtcaggtgttcgagaccagcctggccaacatggcaaaaccccgtctctattaaaaatacaaaaattagccaggcatggtggtgtgcacctgtactcccagctactcgggaggctgaggcaggagaattgcttgaacccgggaggtggaggttgtagtgagccaggatcatgccactgcactccagcctgggcgacagagcaagactccatttcaaaaaaaaacagaaagcaggttccttgatgataaagcagccctgggggttgtggatgcggcagcaggtggggagatgcccgtgtctggggcacccagaaaagttgtgaatgtcttggatttgcctccatccggtgccccctctctgctcctccctaaacccgccctccctccaccccccaaaaccagaaccagatggaaacccaaagtgaatagtggatctgaggctggggcagatggtgtgggatgggagccccggtgtggggagtgaaccccattccagaaacactaaaggccaatgcatctccttcggcacagggacagcttggagcccgctgcggaagaacctccaggttctggaggcttctgggctccctggggatcacgggcacatgtttgctgctttattcaaaatggggaaccacagcagtgactggaagcgtatgggctgcctgtggcgccgagaattttcctccctccaccttcccacggtacaggctggtccctgaggaggaggcgtgggtcttaggaggaaagcagctctggggagctgttggccaaatgcccgtggcctcctcctgtgcccgaggtaccccagggagaggaggtccagagtggggccaggatgtcacatggatcccacctggctccctggggcaaggggcttctttccctcaacctcagtttcttggtctgtgaggtggggacggtgacagcacctactcagaggc

SEQ ID NO: 135524 - DNA, 1019 bp, Homo sapiens
agtcagaactcggttccaatcccagctcctccactcgttggctctgtaaagcactcagcacctctgagtcccacttttcctgcctggtatccaagggctagagaggaaggtgggggagagtatggcaggagtggggtcccggcaagccatagaggtatggtaagagcatcctggaccagtagccctctgactcccagcccatgacgtggcctcgctgcctcagctgcttgcaagcataagcttggagctgccttcttctggactctggggtatccatctccttgacctggctgtgaatggatttgagtgtgtgatatgcctgaaatgacccccagtgggtcaaagcacccccagcttccatgacactctcaaaagggcctatggccccaaagctaatacctggctgaccgcacccctcttgtctccccagggcccaccggaacgacatggagaccatctaccccttccttttcctgggcttcgtctactcctttctgggtcctaacccttttgtcgcctggatgcacttcctggtcttcctcgtgggccgtgtggcacacaccgtggcctacctggggaagctgcgggcacccatccgctccgtgacctacaccctggcccagctcccctgcgcctccatggctctgcagatcctctgggaagcggcccgccacctgtgaccagcagctgatgcctccttggccaccagaccatgggccaagagccgccgtggctatacctggggacttgatgttccttccagattgtggtgggccctgagtcctggtttcctggcagcctgctgcgcgtgtgggtctctgggcacagtgggcctgtgtgtgtgcccgtgtgtgtgtatgtgtgtgtgtatgtttcttagccccttggattcctgcacgaagtggctgatgggaaccatttcaagacagattgtgaagattgatagaaaatccttcagctaaagtaacagagcatcaaaaacatcactccctctccctccctaacagtgaaaagagaga

SEQ ID NO: 135525 - DNA, 1123 bp, Homo sapiens
agaaacggaaagtaggcgggcggcccttctgcgccctgccaaccctattaagtagttttcagacgtgctgcgtcgcccagaaagcccacatttggcccctggttttcctgcaggtcagcaagggtggctgggattagcaagcgctcagtcaagcgatggttcatctctgaatgaatgaacatttagcttccttatcagaccccgaagcgttaaggacctccacataatcttgaaagtggcatcgtttgactgcctcggccctagggtgtggcagacaccctgctgtgtccctggataatctgtgcttcttgctttggccagctaagaaagtgctgcgttgctgatgcatttttaaggtctgtttctctctttgttctggggctgttcttgcagctctcaagctggatttggaggagaagctgtttggacagcatctagccacggaagtgattttcaaggcgctgactggcttcaggaacaacaaaaatcccaagaaaccactgaccctttccttacacggctgggctggcacaggcaagaattttgtcagtcaaattgtggctgaaaatcttcacccaaaaggtctgaagagtaactttgtccacctgtttgtatcgactctgcacttccctcatgagcagaagataaaactgtaccaggcaagagaacccgctattatctcgtctgcaggccagtcggactggtccgggtgacctgctcactaactctggcctctgcttctctttcctttgtgttgctgtagcccccggctccactgagttaaggcacacttagtccaggtagttacaaagctctcctacaacatttctcttacttggttccaaaacagtccagtggggtaggggatgttatttccattaaaagatggggagccaagggcctggcgccgtggctcacgcctgtaatcccagcattttggggaagccgaggcgggcggatcatttgaggccaggagtttgagaccagcctggccaacatggtgaaaccccatctctacctaaaagtaccaaaattacctgagcacggtggcacgcacctgtaatcccagctacttgggaggctgaggcaggagaatcgcttgaacctgggtggcagaggttgc

SEQ ID NO: 135526 - DNA, 1339 bp, Homo sapiens
tggggttactctatgttggtcaggctggccttgaactcccgacctcaggtgatctacctgcctcggcctcccaaagtgctgggattacaggcatgagccaccacacccagcagacacagaagtcttaatatgtgattttaatctttatttctctggcaaactcagcaatgcaggcggggaccttataactaagacggctcttgacttttggcgggccggaagaaagagggaagacattcagctgaaggacctggaacctgtactgtctgtcggagtcttcaataataaacacagtgagtccaccagggtaaaggagccccttaactgtccagcagtgagccgtctgctctttcattgagtgtttcacaaagccacaggatcccactggatttcctcactttgctaaagtcaggaattttcttagggcatactgtgctagaaaccagtgagtgagtgtccagctgagtcctgcatgggcttgttgcacactgacaagagactctctcaaggggtacggacatgaggaatgtgctgagggtcgggactggagcttggccaggtggcggtggtggcaggaaacccagctgtgtcttgttctgcaggtggcctgtggcacagtggactgatcgacaaaaacctcattgattactttatccccttcctgcctttggagtacagacatgtgaaaatgtgtgtgagggccgagatgagggcccgtggttctgccatagatgaagacattgtcacaagagtggcagaggaaatgacgtttttccccagagacgagaaaatctactcagacaagggctgcaagactgtgcagtcgcggctggatttccactgagctcctatccagatggggtaggagacagctgggaggctccgcacgccagaggccttgcctttcagaagaaccctgaagaccgctttggggttttgcctgtttgcaccttagacttttgggtatagaatcttttttttgagaagaggtctcactccgtcatccaagctggagtgcagtggtgcaatcctcaactcactgcaacctccgctcccggtttgagtgattctcatgcctcagcctcccgagtagctgggattacaggcatgagccactgtgcccagctgggatatagaatctaagagttgattgtggaaaacacgtgaatctattgcgcgcatttgtcatttagcaagatggcagcagtccagctgttctttgcagctggagatgaacttttaaaaatccccttcacacttaatgtactgaccgagacagaagtacctgaaaacagctgtgcatggcaggcccggcaatagcttctgacccacagcaccc

SEQ ID NO: 135527 - DNA, 1024 bp, Homo sapiens
ccgcctgtccatcgctctagctgctaatacagccctggctgtggaatccttcaccgtctcagctggtatcagccccagcctgccttgtgccatatctcagcttggatctctgctagagtccccccaaccatatatcatagagttgaatcacaatgagaccgttggctttgaatttgagtcgttggttcccatggtgagatgcttgttaagactttatacttgggtcaatctctcactttattttgtagaaccatttgaaatcctaggatgtgcttgttctggaaggatgacatgggcccagactgaacaagtcagcttgatgatcttaaatgatggaagtataggacgttgcttattttaaaacaagggaaggacacaaaatggaatgactgcttagtcctttctcagatactcttaaaacaattttttattgttaaatttgtggtaatacatggtcacaaccgtggatcaaacaaggtcagtctaaagtggcaggtcctaggtgtgacctgataccaccaccctttgtggcagcaccgggctggactgccctgatccctgggacgtgagacttagcttccagccagtgtgaatcattgtatctgtctcataatcacagcacagctgcagacacaacaacgtgcagcattttttacataaaaatatggtagaattaatttatgacatggaaatgccttacgtggtatcacacttagtcttgaaaaaaacaccaaggtgacgtttaaaatttttagtacatatcctcaaattggagctaagttatacttcttttataaccttttgggcatctggtcgagagaagacaagattttctctatttacagtgaggcaataaatatgtttgccacctttggactgccgttactgatttgtaacttgaaaaggctacggttgatcatgaccccgcctcccccacctcccttataagatgtggacgagagctttattgacctactgactataaaatagtaaattctagattttatcatgtgaaatgccactt

SEQ ID NO: 135528 - DNA, 1044 bp, Homo sapiens
ggccatgaccacagacgtgccagacttaagtcggagacctgaggagccaggctgcaggttggcctactttgcgctaagctgggggtggaccagtggtaacctccctccgaagtgggttctgcctcctttctagcctagcgggagacaggaaggatggtgaggactcttccgcagccgaccaggagggaccaaactgtttcctttcccggctctgccttggggtgggaggagcagcacaggggttaggggtgcaaactggtggcagtggcagtggcaccaaggggcttttcgggaaggagtcgggccagggctttagaataggcaggaccagcaaagggagggctccctggaccgccgtcccctctgggccaggagcttacagaccgcagtacttgaggtttcgcaaggtgcttggagggcgtctagacggctttgctggctttcttatgggctgtaaatgtggctacattttgccgctgtttcttccccactcctgattggctttgtctttcccagcactgcagaaggatctggacgacaacctctttggacagcatcttgcaaagaaaatcatcttaaatgccgtgtttggtttcataaacaacccaaagcccaagaaacctctcacgctctccctgcacgggtggacaggcaccggcaaaaatttcgtcagcaagatcatcgcagagaatatttacgagggtggtctgaacagtgactatgtccacctgtttgtggccacattgcactttccacatgcttcaaacatcaccttgtacaaggcaaggatggaagtttggaatcccttcctggatgtcatcgggtttggggtctctttgttgtgggatgagatttgggagttctatgttgaaatgagtgagcccggaaaacggttcatgtctcagttccccttggaaaggtgtagaagttaagagtttgagatgcgtggagcagttaataccatcaaagctttgtggtgggttctgaaaatcggtccagtgagtatgtagggtcatgggattttagaggtggacatgatcaaat

SEQ ID NO: 135529 - DNA, 1052 bp, Homo sapiens
tgtccccacccagaggcaggaagctgctcctgctctgcgccccctgcccttctccactccctgccatgcccagcaagctgctctgccctcctgcaaggccctttcctcaggggagtgtgtcgcccgaaatgacagatttgtcatctgactccttggatttacagaggtggagacaggccccatcacaagctcccagggtcccccaagtccccagtgaagaacagcagaaccaagccatggaagcccacaggctctaaactattaaacctgcattaaaaatttcggctggggcgccctcggggcataatctaacctgtggctccggggcccggcagggtgggtagagcccacggttctgctcacgggacccttggtgtggagcatgagcacccacctgtgcttgggaagggaggcctcattgccatcccgctagtcggggaaggtgccagggccaccgtgaggcctctctggtggtggctgaggccttcagcatggctgtggttgagaatgtagctccggagccctcgccctggcctggacgctggccttgccttctaccagctatgacctgagtggttacttcaccttcccaggcctcggctctgtctctgtaaacctctgtcttgtcctgtggttgccgaggctaaatgagatagctgggcagaggggaaggggcgtggtgagcggcagctgccagcagagataagggcatgggccatccaccgcagctcctgcggccagcacagagtctgagaccatctcgtgtgtcctggaaattccctctgctgggtcctcagactgccacagaggagcattgggtggctcaggcgcctcatccattagagacttcacgctgacccccaggcctggggcggccccacttgggatggctctgctgctgtggagggtggagggcatggcaggggctgaacccgagcccgctgtgtctgttgcagagccccccgggcccattgacaacagcaggattgcacaggtcaaaggaagcggccatgtccagctgaagcagggtgagttccccctggggtcagcca

SEQ ID NO: 135530 - DNA, 1047 bp, Homo sapiens
tcactgctgccccagccgggcttcttagaggaggtcagttgtcctatgtatcatcatttactctgggaatcctactgtgaaatcatgtctgtatttttctggagcagttcacatagagtagaatgtggaatttcccgtgaacgtctccttcctcccccgtatctgccgcctgtcacttcgccaccgtgctagaatactgttgtgttgtaagatgactaattttaaaagaacctgccctgaaaagttcttagaaacgcagtgaaagggaggaacttgtcctttacccagtttttcctttgtaggatgggaaagtataaaaaggcacagaaggttgtcatgggctgttccttgggggtttttatcctgctcaccgtggagataagcctgcggcttgtctaaccagcgcagcgcaaaggtctcgatgccttttggtaacatccgtcattgcagaagaaagtttacacgacgtcaaaaagtgacgttcatgctaagtgtttttccagaaatattggtttcatgtttcttattggctctgcctcctgtgcttatatcatccaaaaactttttaaaaaggtccagaattctattttaacctgatgttgagcacctttaaaatgttcgtatgtgtgttgcactaattctaaactttggaggcattttgctgtgtgaggccgatcgccactgtaaaggtcctagagttgcctgtttgtctctggagatggaattaaaccaaataaagagcttccactggaggcttgtattgaccttgtaactatatgttaatctcgtgttaaaataaaatataacttgtggctccgtgtcacgggactgttttgttgcatgaagatatgaccctagttgtggaagcagcctggtgtcattggaagccccctgggctggggagctggcccctgggaggagctggagacctagatagctctcagttccacccccatccacggtggagggggaggctctcagaccgtggtgacgtggaattcgggctgatgtagtgcgaggattgcgagaggctgcttatggccagga

SEQ ID NO: 135531 - DNA, 1046 bp, Homo sapiens
aggccactgtttgcttcctccctgcatttgccaagacatctaacatatcctgatattgctttttcaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaaggtgctaagacttatatttaataccataaaaaaaaaaaacttaaaaaaaatggagttgtttctccccacaaccatgactgttacaggcagttcctcaagagactggctggcaagcaccataatgcacgttctcctgtagtctcacgtggacttcagggtctgggcacctgaattgccttgtctagtttgggctgtaatcaagtttcacttgctgatgaaattttatgtggaaagctgccaaccgccaacttacagctatgtcattcaaaatctgataaacatttcttcttttggcggtatctgtagattaaaaaaaaagttgcattgtagcttctcatctttctgaatttaaaagccggcacgcatcatgcaggtgccaaagacttccctactcttgtttatatctagtatccaccatacactgagctacattaggtggttacagattgtaacttaataaactgaactgtgttagtttgttaaattgtatactcattcacttgggaggaagtcacaagtgaaataacatctccttcttgactaaagcagtaaataagattcttatattggcaccaaaagtgtgtgtttttacttaaacctggtcagcatccttggtagggcatcacgagtaccctgttccatctacatgatcccagacaaccagctgaaatctggaaaagtttggtgaattgaccacttgatttttacattgcattgctgattttccaagtgtcatcaaattgacaggtttttgttgttgtgtttgtgtttttgttgttgttgttgttttgagacagagtctggctctgttgcccaggctg

SEQ ID NO: 135532 - DNA, 1050 bp, Homo sapiens
gagtctctcattgcttttgtctccaggcctggctggctgaggttgaaggccggctcccagcacgcagcgagcaggcgcgccggcagagcggactgtacgacagccagaacccacccacagtcaacaactgcgcccaggaccgtgagaggtacagtatctgcacagcgcctgcctctggcaagggagcctgttggctttgtatttatttctaaattttggaatctggaatgaccataaggcacttgttcaatgccaaaatgtctgttgcgattgacctgtcactttttccatgatgcagatttataattccacatgggatgggtgatctgagcgtgcgatgatttaccatggcctcagttacagcactcgctgaggggcggggttgcaagtgctctccagtcgcagggactcaatctgagtcctccctggggtcagtcgctttagttgctttgtgttttcctttcttgagcagcccagatggcagttacacagaggagcagagtcaggagagtgagatgaaggtgctggccacggattttgacgacgagtttgatgatgaggagcccctccctgccatagggacgtgcaaagctctctacacatttgaaggtgacatttcatgtctgctggattcccctgccttttataaaccataatatctgagttactcttctttcacttttccttccttccttccttctgatcatttttattcctttgtccttccttccttccttcctaccttcccttccccttccccttccccttccccttccttccttcccttcccttccctcccttcccttccttcccttccttcccttccttccttccttcctttttttcatacagggtctcgctctcttgcccaagttagagtgcagtggtgcaatcatggctcactgcagccttgacctcctgggctcaagtgatcctccaacctcagcctcctgagtagctgggactacaggcaagcaccaccatgtccggctcatttttgtacttttgtactttttgtacttttcagtagagacagggtctcactatgtt

SEQ ID NO: 135533 - DNA, 1031 bp, Homo sapiens
ggtagcagaattcctatagagaatttccagaatggaagctggcccaatagtcccttatccatactctaatcttcccacgtttccattcatatggctttcaaagtggtagaatattggctgataagagtaacctttgccgggtggtgcggtagctcacgcctataatcccagcactttaggaggctgaggcaggcagatcacctaaggtcaggagttcaagaccagcctggccaacgtggcaaaaccccatctctactaaaaatacaaaaattaggtgggtgtggtggcatgcacctgtaatcccagctattctggaggctgaggcagcagaattgcttgaaccctggaggtgaaggttgcagtgagccaagatcgttgcagtgagccgagatcgcaccattgcactccagcctgggtgacaagagtgaaactgtctaaaaaaaaaatggagtaacctttacagcattctactcgttctttctttcagagatgccataacaaaaatgaaagatgtctacctaaagaatcctcagatgggagacccagccagtttggatcacaaattagcagaagtcagccaaaatatagagaaactgcgagtagagacccagaaatttgaggtatgaaacttctgttgtggaaagctttgttggaaacgaagaacaggtgttcctcggtgtagaatggtgtggggccctgacgatcctctcactgggaggtacacagtgggaatggcaggctgtttcaggagttatggtcaaaggaaaaatacactcttcgccgttgaacattctcctactcatcatagcctatcttaatcgtggctgtaaaacctgacaatgtttaatgttgtatctgtatacggtgcggggttggcggggttgttttttaattttagagacaggattttgctttgttgcccaggctggagtacagtggcatgcttgtagctcactgcagccttgatctccttggctcagcctttgaggagctgggattacaggcacatgccaccatacctggctaacttt

SEQ ID NO: 135534 - DNA, 1154 bp, Homo sapiens
gaactctgagaggcttcctaaaggcctaaaagaagtcactaggctgggcgcggcggctcatgcctgtaatcccagcactttgggaggccaaggtgagcagatcacctgaagtcaagagttagagactgtggaaaattagccgggcgtggtggcacatgcctgtagtcccagctacttaggaggctgaggcaggagaatcgcttgaacctgggtggcagaggttgcagtgagctgagatcgcaccactgcactccagcctgggcaacagagtgagactctgtctcaaggaaaaaaaaaaagtaactagacttttagaggcagcagagggaggtgtgcatggggtaaggagaagagattttttttttttaatgttctttttcacccacattctctgaggaatgtgatgtcccatctgtcactttacaggggtggagacttttggcctcagcctgtgtgaagagactggcaggaatactcacgctagggaaaaggcagcagctaggcgtgcagtggttgatggggtttgtattaaggaaacataaatttcattaacacttcagtgttgccactgacattgatggtaacacttggtaggaaaaggaagaagactgtctcaaaatgtgtttttcatggattctccctagagtcagaagtatctcttactctcctttactgtagcgttgctcactgctttttctggggcattctggccagcatccatggaactgggaatggtttatgggacttatgcagtttgcatgcattgatttttgcatctcggctgggtgtagtgggaaagagcttaatctatttcatgaagccacatgcagatgtctgcaccccccatggctgcaggctttgctttcagccttctttcaaggaaagcctggggctttctggtttctcatttatatttgtgtctgcagggtgcaacaccggaggatttcagcaacctcccacctgaacaaagaaggaaaaagctgcagcagaaagtcgatgagttaaataaagaaattcagaaggagatggatcaaaggtatagtgcatcaatatgacttattaagaaattcaaggccaggcgcagtggctcacaacctgtaatcccagcactttgggaggctgcggtgggtggatcacctgaggtcaagagatca

SEQ ID NO: 135535 - DNA, 1064 bp, Homo sapiens
tcactgtcccctttctttgtacttgaggttagtactgtgactgtccaataacacatggactcgcctgggctgtgttccccatgtgttattgacgcttgtggctcccacggctctttaactgtcgcctgaaactgacagctttttaattcttcaggtgtctagcaatgcacttaatgaaatcttcaaaattattattttagccaatgatttcgctttctaattttaagagaaattctaattggctggcttacaacttcagactgaaaaccagtatataatgattaaaaagaaattccacgtactgtgatggcacttcttgtattaatagatcatccatcacaaataaagtcgaatttgtctgagaatttggtatttcctattcaatggggatttctgttcaatcctaatgactcgtttttactatgaagtgttaataatcttcctatacaatattttgaggtgagaactctgtctgtggaatgcttaagaaagaatatataactttgcgtaaagaaagtagccgagtagagagcaaatagtgtatctagttgaaatgttagttctttgaattagcaatgtttagacaataatgtgtgagaaaatatctgtatatgatagtgtgccttgtaggaaagatacttggagttttctgctgtgcaccataagtcttgtctgtgcgtacaatgaattccagttgtgataagtagatctatgctcaagttcacaggcgggctggaatcactgtagactgcccatgtcagacagtcaggaatgtgactgtatgtaccattttccccctgcaaaagtttgtctttctggttctttcctttaaaatctcatgtttctatatagggacaatttatttaaaaggttattttttatttacaaggaagtgtcaactttgaatcaatcttaaattaagaattagttttttaggctgtgtgtggtggctcacacctgtaatcccagcactttggaaggctggggtgggtggatcatttgagctcaggagttcgatatcaacctgggcaacatggtgaaacccccatctctaccaaaaaata

SEQ ID NO: 135536 - DNA, 1040 bp, Homo sapiens
tgatcagagtatataaatcccatgcaaacatatctcagcataactgattttgtttctaaataattaaacaggataaaatgttatttgttgtaagctgttgacatttgtaaggaaattttgtttcactgaatatgtttagagatgccgccagaacattaaccattgtttcatttttatgtaagttgaagaaaaatgaaactagatagcatgttctccatttgcagtctacaaaggggaattttattgcttaaattaaagtttcattttctggcctgtgcaagagacttttatatctaaaatatggatgtacgtttttcatattttagagttcattgtatggaaaaataccatcaaagttgaccgaaagattttgaaaatccttaccagttgtttgtcatatgttaaagtcttatggttaattttatttattttatcttgttctcttgctggttattggcagactcagtctttctgttttcacaaagaactcatgaagaggacgatagggaaacccacgtatgcctttgaggctagggactatgttgtaagttcacctgtgatggccaggtcatacagtcatggcacagccactaaccccattcacagcaccaagactggggacccagaggcacttgttatgcttccacactacgaaatgaaattcttaattgagagaactggacaccaggaaaaaaaaaaaaaaagaaaagcctaattgtataaattcaaccatacggaactttatccgaaaagcttgcatgaataaaggaagcaaactttctaataacagtggtgagctgagcttgtttttttgtttttttttttgtttttctcttttcattctagttctggtaaaatctttaaagggactgtgactgccgtctgagatgtcattgggtatgactttaccgcagaatttcacgcataaaacacagctgcagtgcgtggtcacgggagagtgacgctcttacagacggcagtgtagctcagtcacccatatccatgtttgtaacaaatggatccataagggagttatgccc

SEQ ID NO: 135537 - DNA, 1020 bp, Homo sapiens
agttggtagaattatcttgaattatcttgctttaatgctatctatcatatcaggttaagaattagaaatgtaatttcctaaagatgtgaaaaaagccgttggtggaaggcagaatacagcttcaaaagtggatgatggattgagctgagatgtataattaggacttgagtaatctgcagcttcttggctcaacgatgctggcgtttagaactccactcattgttaatccaagaatttccaagacaagggtgtttttgctagactgaaagtttcatatgaactgtcagttaacccatctctgccgctttaccaagcactcatgtgttatatttatatattatctctgtatttttttggactctcatgatgaatattcatgattgtttaccatttgtttatgtgtctattccagttttctcttaacattacacagtctgttggccaaaaatggtttgtgaatctgtggttcatgatattctctaactatttagaaaaagaccaaagaattcagtaatcaataaatgtaagaaaaggatggttagaaaaagataagctgggcgttgtggctcacacctgtaaccccagcactttgggaggctgaggtgggtggatcacgaggtcaggagtttgagaccagcctgaccaacatggtgaaaccctgtctctactaaaaatacaaaaattagctgggcatggtggtgcacacctgtaatcccagctacttaggaggctgaggcaggagaatcacttgaacccaggaggcagaggttgcagtgagccgagatcatgccactgcattccagcctgggtgacagagtgagactccgtctaaaaaaaaaagattaacacttaaaacagtgaaatgggaatcggaaactggttcttttgatgatttaaaggaaaatctctgttttaccataatcagcagtatgaattttatttcttactcctcaaacgtgtgctcagcaaatctttgttaaaaaaaatttcccaaatgatgtgtttattttcctgaggtta

SEQ ID NO: 135538 - DNA, 1315 bp, Homo sapiens
gaaggcaaaccagacctcaaatttggtggcaaatccaaaggaaagttatggccgttcatcaaaaaaaataaggtactgatggttggcgtgaaatgagttttctaaggtgtggagattttgacttgatcttttagtcttagaaaaactaagatcctaaacctgtagtttcagaatgcaaaagaagaagctagtgtgctaccttatgttgagacagtatttctttttggtggtggtatctttgccatggccctgtgtcttatttcagatgcattatcctcgtaccgtgactcccacactaacagagtactgacctctccaccgtttcgcctcatgcctttccctccttcctctcctagactgctggttaccttggctgggagagaggatgtagtgggacattcctgtaacactttatccgcacatctactggaaatcgttaccatgttaataacttggttttgaattcatgttaacatgtgtacccatgaacatttttcattttcttttcatagtgcgatacataggtgcatgacagcattaacctggggacgtagaatatgatcaaggcagcattactgctttaactttagaatgacttactatttattaatttaaacagactgctgtttccacaaccttagcattgaaggtctttcattttctcccatcaagctatgttagtttaggtaatgtagaaatatttaccctctggcttaagctggtttagagtaactaactagagctatagtttgcatgggaaagtctgcacgagcttcttgtcagatatttcttgctcttctgtcgcattacttactaaacctcccaactctcatcatattcttcatttaaccacctcctacatgttttcttttggaccatggcctaaaatttaattgtttgtgttttacttgcgttggatttcaaatattatttgatgcttatttttgttttgtgtcttcttgtttctgatttttactctgtcacggctccatctcttacatgtagcttatgtcccttttaacatccccccatcagcctccccctccccctcctgcctctgcctcaccctctgctgttcccaacggcccccagtctcccaagcagcaaaaggaacccctctcccatcgcttcaacgagttcatgacctccaaacccaaaatccactgcttcaggagcctaaagcgtggggtaagttctgctccggaatcctgtctctctggcgtgctttggttgcatgtttggttctgcataactaattttgtttgtgaatgaatccattgtgttttcccataacatataaaaaagttaaaaaaaa

SEQ ID NO: 135539 - DNA, 1075 bp, Homo sapiens
ttcctttaacataaaaggcagaccgtctaaaatatactttgatttattatcttctacacagcttactttctaggctggactgtagacatgttggtccttattcagcgtcttccacagttcacgtctagggcccttgttatgttttcaggattactgcatagaaacagggcaaagggcattatgaatctattaggaggtaatatgcttacagaaggaattatgcagctaaagctaaaacatgattagggattctgtggagctacaggaagaggatcacagccacttccaaccaaatggtgctgggtggggtacctctggcaccagctttcatgggtaaaatattctacttgggtaaaatattctaaaatattggcgtgagtggatttattgtcagaaagcttttatctgctctcatgggttgtgtgtgtgtgtatgtgtgtgcgtgtaagtacatgcatacatattatatataatgatggcattctgatgtgatgcctgtttgagatcttaagttattttaaaaactcacttagatagaatcttcaaaataaacggggaaactacctcctgagctcttgctgttctttacagaagagatgaagaaatcccccactggatttttgtgagactttctgaggaagccttgtgaataaaatagagactgttttagaaatttgaggtctaatgggaatttttttttaaacattcatagcgaaatgatacatgatgaaactcagcagctgaagagttaatagggcatttgtgctggacgggctcggggaacagatggaatgcatgtaggtgggaaagctattatttaaacagaggagggctactgtgtgttggaagggggtggatttttgagggtagctgggtacttaacattttggggctagactaatatatttactagtggacacaggaagaagcagacgccaaggcatatggtcaggaagggagttaacaggccaccaacaaagaggaagaatgcggcagctgaaatcaactgagggtagatgaaaagaggataaaatggcaccgacagatccaaaggccttaagaaactcaaaaaacc

SEQ ID NO: 135540 - DNA, 1049 bp, Homo sapiens
cattttttgtatacagacttctcgaagtatttggctttgaatatgattaactttttaattctacatatagatgtccctgttgtgaagcagaataggaaatcctgagttatttatgaattaaagtagaattctgtgatgtaaattataaaaaataaaatttcatttctggttttttgtttttttttgaaacagagtattggtctgtcgctcaggatggagtgcagtggcaccgtctcagctcactgcaacttccacctcctgggttcaagtgattctcgtgcctcagcctcctgagtagctgggactacaggcgtacgccactacacccggctaattttttgtatttttagtagagataggctttcaccacattgcccatggtggtcttgaacttctgggctcaagtgatccgtctgccttggcctcccacagtgctgggattacaggtgtgagccaccatgcccagccacatgtaatttttaatgtgttatatattctataatagaatattttaaagagaaaaagaaagttatagataggaatctgtcaattttaagcaagaatgaaggagtttactttaaatgatgatcagtttgataattatcttaagaaaacaaacgaaatttagtagtttaggttttcttcggttggaatcagtgttgccaactctgtgaagccaacaggatggagttggctctattctaagtgaagccagctgcgtagcagagtgttaaatttttttaccatttggggaaacagtctctagcacaatgaccactttagttattgtacatataaggaattgtactattgaatattttggttaccattgctgtagtactaggttgacatctttatggaacatgttaatatcttcagtgccttccccacgtttctgtttcttctaaaatgtctgactgtagtcatctgaaggaattgttcactataacaatttagagaacatttttttttaaaaaggaagtggttagtataaatgcaggaaataaattttgcaactgcagcttaatctttttaggcttaaaaaagtt

SEQ ID NO: 135541 - DNA, 1013 bp, Homo sapiens
agtattcacatgtatccattcattcccttgcccgttgttcactgactatctactggcaaggtatgcgggtatagatgccagcacataatcacacgatccttgactctgaggaacttgccttttgttttttctttttttcttttcttttttttttttgagacggagttttactcttgttgcccaggctggagtgcaatggcgcgatctctgctcactgcaacctctgcctcctgggttcaagcaattctcctttctcagcctcccaaatagctaagattacaggcgcctgccaccacacccggctaatttttgtattttagtagagacgggatttcaccatgttggtcagactggtctcgatctcctgacctcaggtgatccacccaccttggcctcccaaagtgctgggattacaggcgtgagccaccgtgcccagcctgttttctttctaatgtttggtttactgtattgtgaattttcccacttgcccacccaaacaactcttgaatggcattctggtgacaaagactttaaaatcacagtttgtctgtcactctgctttgaaataacaccatgctatacaaacttggatgagaggctacacctaatctttgtgttctgatagtgtagcaatgggtttagtgtggtattgggatgagaaaggaaaaggttatcaaaatgagtggaatgtgaactaatatttctgaacagagagaacagtgttttctaaatgcatgcattaaactgagttcatccatgtcaggcaatgaataattccctttttctaattctcccttgccttatgactgttggctcttacataatttctaaatgcaaaataggatattgtctaacagaatctgcagttagtggttacaaacagctgcagaaattgttagttaagttcaagttatgttttttaaacgccagtaacaatttcttccttttcttatcggtctagtttcatttaacttgtatggttctttttctgctagagtctcaatttatgagcc

SEQ ID NO: 135542 - DNA, 1026 bp, Homo sapiens
cttacactgggagcatcgttttgctatttttatgaaagtgccacttacctcctttccaaggatatgatgaattacccaattttggcatcacaaacattgaagctgagggagcagcaatgtctaaacattgaaattcttaagttattttgctttggatttgacttgaaacactgtaatttcccaaaacacccagtactttgactgttctgtcagttttttactttgttgcctgtgaaggcttatgtcagcgtcaagctaactggaggcagttttagttcttatcattatttaatgtcatctcccattatgatttctgacagtctctgaatctaacataaatgtttctcccccagttcccgcaaatgattaaattatctaattgtattcaaagcagcgcatcctcctttttttctagcagccagccacacagcactgggaacggtaagcctgtgcttacaaaagccttatttgtacatgtgaactttgtcttgtgcttgatacaattgatatgaactataagcatacgttcattttttaaactacctaggatcctgggtataagcctgattttcttttctttttgagagttaatgcccagatatggattgaaaccacattttgaaaccacatttttattagcactgtgttcactgtttttttttttgttttgtttgtttgtttgtttttactttttgtggtgatcgaggttttgctatgttgcccaggcaggtctcagactcttgggctcaagctatcctcacacctctgcttccctaagtctggcaatgcaggtgtgagccaatgtgcctggccagcactgtgttcaaatcacctccattcatccacatccatgctcagacttcggtacgctttggcattgtgttagatgccagcgtgtgaccagatgtttagtagttcccttataagacagtatatgtcatccttaaggcacccagtttaattaaaagtaagtttacagtataaagtagatataagaaaaagctagcagtttttatctctgggcaa

SEQ ID NO: 135543 - DNA, 1054 bp, Homo sapiens
cgtggaaataataaagattagacagttttgatggaaataaatgcagattttaaaataacttctagaaattatgacatataagaaatcaattcagagaagagtattcttgggccagacacattggctcacgcctgtaatcccagcaatttgggaggcagaggcgggaggattgcttgagctcagaagctcaagaccagcatgggcaacatgacaaaacctagtctctacaaaaaaatgcaaaaattagctgggcatggtggtgcatgcctgtagtcacagcagctagtgaggctgaggtgggaggatcacctgagccgggaaggtcaaagctgcagtgagccaagatggcgccactgcactccagcctgggtgacaaagtgagaccctgactgaagaaaaaaaaaagaaaaagaacaatgctctttgggagctttagataaaattacatcttctcgtaggactcttatggtttcataattattttcctctgattttagagtaaaaggcgatttgaacgcgattgcaaagaggcggacagggcgcagcagtactttgagaaaatggacgctgacatcaatgtcacaaaagcggatgttgaaaaggtgaggtgaaagctcaagtgtgggccgggcacggtggctcacgcctgtaatcccagcactttgggaggctgaggtgagcggatcacctgaggccaggagttcgagaccagcctggccaagatggtgaaaccccatctctacgaaaaacacaaaaattagctgagtgcagtggcaggcacctataatcccaactactagggaggctgaggcaggagaatcgcttgagcccaggaggcgttggctgcagtgagccaagatcacgccactgcactccagcctgggtaacaagagcgaaactatcgccaaaaaaaaaaaaagacaaaagaaagctcaagtgtgtctttcatttcccctgtgagtgttcatcaccgaccacccatccccaagttctcatttctaatgtagccacaaaaggcgctacatggggaatcattttcattttgtgtcaacca

SEQ ID NO: 135544 - DNA, 2514 bp, Homo sapiens
tgagcagaggagtagccagagaaggagggagggaaaatgctgctgcttaggcctgaccctggcccattgcctcatgctgctcagtgttacgggtaaagtcaagcaactgagcatgcctctgagaggtaggcatttagaaaacttcgaacacgttcattaagaaggtatttttactatggataaacttggaaaaataagccttgctaagtaaaaatagaatgtgtgtcccttagtgaacgtttctggtttctggtttgggttttaagtggggtacgacatacccacttgaacaggactaaggcgttttgccattacgccacatggtccatagaaatatccacgccgcttagagttctagctcaattaaaactgggagtcctgattcagacttggaagctgctcctgttcaaacccactactacgctgtgagtttagaggaaacaggatttgtcacaggcatgtttgctggaagctccctctttctttgcccttttcaagtctttttgtttctttgtttgcatctgtggaatctgagttttatttaaaattccagatggttgactgttctcagttgagtgtttattcttatgtttttttctacttttttttttttgaaagggctgttctcacatcagtgccatattttgctcttttaactgttaatggtttaatatctatataaatagcaaaaatgagcagctgttgtacctaattgcagtgtgaatactaaacattctcatagcatttgtgtgagtttgtctgttctgtctgtgatttcttgcagttcagtaaaattgtctcaaaagctttgccattgtcgtttttcttaaagttaatgcttgcttattttagattctctgtgatttttttttttttttaatctcagccacctctgttcactgggaaatttctttaaaaaatttgaagggtgatttgatctgtgtagacttttatttcaactaaaaagttgaaataagtaagtgtagctgtcaccccagaaactattagggtttgggtttttttgtttgtttgtttgttttagcttattattatgttttaaaagaaactaaaagcatcttatgacagcagaaagtaagaagcatttctctgggtctctagagatggcatttcctgtctcttttctgataggagagaaaggagctgtgatgacttcattctatggctccaaaagaagcactttttatctttgtccggagaacaattcctccttctttagtgcttgcaggcacactttttagacacacacttgctcactgtccagaaaagaaatgttcggccattgttggtaaacaacaaatacatctggcaaagctggtttatttgtttaactttgtaactgttaaaatagcttttccggtgaaagcagcgaagatagagctagaaacaaaccccagctattcaggtcatggtaggcacagagcacaaaggagggcttttgttccctcccttaatttcctgaaggatcccccagcacggatagtttttcgtatgttatggccaaataaatgatagagggacaggtactgtgaaaaaggctggggctgggcatggtggctcatgcctgtaatcccagcactttcggagtctgaggcaggcatatcacttgaggtcaggggttcgaggatagcctggccaacatggtgaaaccctgtctctactaaaaacacaaaaattagccgggcgtggtggcgcatgcctgtagtcccagctactcaggaggctgaggcaggagaattgcttgaacccaggaggcggaagttgcagtgagccgagattgtgccactgcactccagcatgggtgacagagacttgtttttttaaaaaaaaaaaaaaaaaaggctggaaggaaggaagatgggcatcacccacaatctcctaagccccatgaaatggtacgatgataattgcagttttcaggtagtggtttaataatgtggggagaggtgtggctgagcagtcttcatgagagataacttaccagtaaattcaaggtgcacaccgtgccttaaacacaaatgcatatttattatatatttacactaaggagtggcaagggaaccactctatggatttttcaatcaaaatcatccctcgtgtttttaaaataagacttttttttttaagactcttgtcttcagagatttattttatatgaaagtcaggtgacatgtcccaggcaatgcctgtcattgtctgctgggcttctgtgcatttcctgtctccacccacagcattgccccaagctggagggagctttcactttgttaaaacattcactttcagaggtgctggagagatagatcgtcaacctcgagtacagctctgaattggtgctggggttttctctttttgttcctgtctttgaatctcaaagtaaaacttttgggagcggctgcatctcttcagcaaactgcgtaactcggtgctccggcttaggaaatgggatctttctcttcgcagagaagtcacccgataaagactttcaggaccaga

SEQ ID NO: 135545 - DNA, 1880 bp, Homo sapiens
accaacatgatgacaccccatctctactaaaaatacaaaaaaaattagccagatgtggtggcgtgcacctgtagtcccagctacttgggaggctgaggcaggagaatcgcttgaacccgggaggcagaagttgcaatgagctgagatcacgctaccgcattccagcctgggcaacagaatgagactccgtctcaaaaaaaaagaaagccactgcatatttacacatggtctgtcctctccaattaaataattctgttcttatttgctctgctttgagacaaaagatgaaaagctgtgcacgttcttaataacagtagcttcatcacacatgttgaaagattgaaggaaatggatttcagctgtggactttttttgtttgttttaaacttgtaacaaaagcactaatgttatctttcattcctgatttcttaattctctttctatataaagctgacatgtctgcatttttatttcaggaatctttcaaagaagtaccaacctaaaaagaactcgaaggaggaagaagaatacaagtatgtttaccattgaaaattgtcttgtaatagacacatgccattgatgactacacacggaaaggagaaatacatgtctataaaaataagttgcatttcccattcattttgtgtcagtttttaaattggaggagagaacaataaaaacataattaacttttcttatatggagtcactggacctatgccagattgtttcaattaaagtaattaggaaaactttagaatgtaattaagcaaaaacaggaagtatggaatctgcattctagagttgatttggtttggcactgtcaggagtccctgtcatgctagtcattcatccaagaaatatgtcaatttcagtcagcaattaaggcatcttaacacagaccactcaaatattacatctctaatgtatatctaaatatcctttacattagtacatatagcatgtatatgaattttggattatatcttgactaagtatcaatgaagccaaatattacattatgcggagcggttcagttttgcaaaatgaaaagtgtttcaattgtaattaattctgagccattttgttgagaacacttgatgtgtaatgaatactcaggatcctatgggaggtggatgccaattaacctgattttaattaatattttcttggtgtaaagcagaatatgaatgaatgtggccttgtgtgaaacagagtggcgtgtgttctgttccataggtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcagtaagcaaaactttattctttttcttcctaaaagatggaccaaacacagtgggaatatccctagaagattaaaattaaataaaaccatataagactatgggtcttaaactcatacctttgagaatcatataaaagttatggaccccagctgggcacggtggctcatgcctgtaatcccaggactttgggaggccgaggcaggcggatcacaaagtgaggagtttgagaccagcctgaccaacatggcgaaaccccatctctactaaaaatacaaaaattagccaggcgtggtggcatgtggctgtaatcccagctactcaggaggctgaggcaggagaaacgcttgaacctgggaggcggaggttgcagtgagccgagattttgcacctgtgctccaacctgggcgacagagcaagactccgtctcaaaaagaaaaaaaaaaagaaaaaaagttacagaccctgttcctagaaagtgtttctaggtctctacgt

SEQ ID NO: 135546 - DNA, 1045 bp, Homo sapiens
gagccaccgcgcctgaacgaaccgtgttcattttttaaataacggtaatacaaatagggcaaaaaccttgtcccaagagaacagcaatggaaagttgatcttttttttgtagcagttcttgagataaatatcctttgaaatgaagttcactttgagatctctttagcttcttggtttatgctggtatttatagagtgaattatttattagtgcttttaagaagcattttgaatgctatatatgccagtattgtcaaagtgattcccattcatcagaactcgatggtcttttcagtatatcacctacaagggatctaatttaatcctgtttagtatttgactggtaaaagagaactataaagaatactggtttacctggatcaatagattcagagtcacgtaaggcttccttcaactagatataaaacttacatgatttttatggctgctaaggactgaaaggaggctacaaagaaaatgtggatttaacattttggaataatttttatatgaggtgtgaatttagaagtggtattttcaatttgtaagttacaggtaacagaagaaatgattaatatttaaaatcatgcagtagtctgggcacagtggctcatgcctgtaattccagcactttgggaggctgaggtgagaggactgcttgaggctaggagtttgtgaccagcctcagcaacatggcaagactctgtctctacagaaaataataaaaatgagctgggcatggtggtgtgcacctgtagtcctagctacttgggaggctaaggtgggaagatccctggggcccaggagttcgaggcttgcagtgagccatgatcatgccactgcactctagtccgggtgacagaacaagaccctgtctctaaaaaaattaaaataaaaaataaaaatgaattgtaaaataaaccacgcactagaaatatctcacatgcagccactacgtttttccaatactctaatcacccatatgtgctgctctcaatatatttggaaaataacccattgattatgtagtcatctgttttgcgcac

SEQ ID NO: 135547 - DNA, 1062 bp, Homo sapiens
ctggtaactactatattcttcaccattagctgtttttttttgttttgttttgtttttttgagatggagtcttgcactgtcacctgggctggactcattgcaacctccgcctcccgggttcaagcaattctcccatctcagtctcccgagtaactgttattacaggcgaccgccaccacacccggctaattttttgtatttttagtagagatggggtttcaccacgttggccaggctggtctcgagctcctgaccttgtcatccgcctgcctcggcctcccaaagtgctggattacaggcgtgagccaccatgcccagcccaccattagctgttttaaaaaatttcagttttacttgaaaatgttcttaatgaaacagtgaagattattcattttactaaatctcaaacccttgaagatacatctttttaatagtgtgtatagtaagatgagaagctctttagtgcagactaaaatacatgatcctgagttgtaagttgaactagctgcttttttcatgaacaccatttttacttcaaagaatgagcgacagacaaacttttgagtatctggcaaacattttctcaaaaataaatgaagtgagcctgtcacttcagggaaacagctggcaatgtttgttgccaatgataaaattctagctttaaagtgaaaattagaacttggggaaattgtttttccactgtgagtttgacagcttccaaatattaaagactcatcagaaaagatgagattggtactgatataaacaaatgtgattcaaaaaaaatattttacaagaaatgtttcaacagttggaagatctgcatatatctatgatataatattttctttttttcttttttcttttgtttttgacatggagtctcgctccatcacccaggctagagtgctgtggcgtaatctcagctcagccgagatcagcaacctccccttcccaggttcaatcaattctcctgcctcagcctcccgagtagctgggattacaggtgaccaccaccacacccagctaatttttgtatttttagtaaagacggggtttcacc

SEQ ID NO: 135548 - DNA, 1028 bp, Homo sapiens
ttagtaccttttggttttatgttgatgcgaagtagtttaagtgttacagaaacagtggctttaaagttatggtattgcttttctcaaataggcagcacttagtaaaacaaaaagaaaaaaaattgcctaataagctgggcacgctggctcactcctgtaatcccagcactttaggaggccaaggcgggtggatcacttgagaccaggagttcgagaccagcctgaccaacatggtgaaaccctgtctctactaaaaatacaaaaattagccgggcgtggtggcgggcgcctgtaatcccagctacttgggaggctgaggcaacaagaatcacttgaaacctggaggcagaggtaagcagtgagccaaggtcgcgctacagcactccagcctgggctacaaagctagactccatctcaaaagaaacgaaaaagaaaagtcaaaagaccattctggagtcctctgatgaaatgagatctatgtcgttggtatgaaaatgaacatcattcacattgtttcctaggcagagtcactgcttttgatgctatttgtatcatggtagcgttttgacagccaacaggaatttccttcttagtattcacattgagaaatgtgattaaacatcattctgttgcctaaaaggcaaatcagcagctagaacagctttaaaagggaccatggcagccactctcaagttctgtagccttttttgttttgttttgtttttaatctaatgaggtcctgtgaaaatagcccagtgtttgcatagataaaataagcattgtgggccgggcgcggtggctcacgcctgtaatcccagcactttgggaggcactccaacctgggtgatgaagcgagactccgtttcaaaaaaatgaaaataaaaaataataaataagtaaataaaataagcattatgcatttgaccacttgaaaaaaatgaggtttctctctggctagccattactccaaagatcaaaacaaacaacaaaacaagcaagagtggttatcatttatttctttccagtta

SEQ ID NO: 135549 - DNA, 1013 bp, Homo sapiens
acatgaagaggtcactgagtaccaggagtatgcgttgatctcttaaaacctggctgcgcctggtagctcacacctgtaatctcagcacttagggaagctcgtttgaggtcaagagttggaggctgcggtgagctatgatggcgacactacactctagcctgggcgacagagcaagaccccatctcaacaacagcaacaaaaattagccagatgtggtggtgcatacctatagtcccagctaccagggaggctgaggtggcaggatcccttgagcctaggagtcagaagctgtagtgagctataatggctccagcctgggggacagagtgagaccctatttcttaaaaaaaaaaaaaaaaaagacaaagcaaaacaacctttttattgtggagaatttccaatatactaaagcagatagaatagcataatgaactcccatgtgcctgtcaccctcaataaccatcaacacatggctgattctgcctcatcccacatacatcaatttctggttcttattttttattatttttaaaattagaaatgagtcctcttatatttttattgtcttactccatgctacattttccaccattcttctggctttcccagtcttctcacagtccatctcttttgacttttccctatattccttgcctttttatttatttattattattattttttttttttgagacagagttttgctctggcacccaggctggaaagcaatggcgcgatctcagcttacagcaacctccgcctcccggttcaagcgatctcctgcctcaacctcccaagtagctgggattataggcatgcgccaccacgcctggctaatttttgtatttttagtagagatggggttttgccatattgatcaggctagtcttgaactcctaacctcaggtgatccacctgcctcggcctcccaaagtgctgggattacaggcgtgagccaccgctcctggctatttattatttttgtttatttttttaaagacctgtcagcagga

SEQ ID NO: 135550 - DNA, 1079 bp, Homo sapiens
aaatgagttgtgtggatttatattcttatcagaaatatgtaggaatagtgggcacattatcatgtcctagccaatatggggtattttcttttcaaaaaacaaaatcctaaaatgaaaggcaaaaaaggtattcctgtttatttatttatttatttatttatttatttattttttgagacggagtctcgctctgtcgcccaggctggagtacagtggcgcaatctcggctcactgcaagctccgcctcccgggttcacgccattctcctgcctcagcctcccaagtagctgggactacaggcgcccgccaccatgcccggctaattttttgtatttttagtagagacagggtttcacggtgttagctaggatggtctcgatctcccgacctcgtgatccgcccgcctcggcctcccaaagtgctgggattacaggcgtgagccactgcgcccggccctgtttatttatatttactcttattactgagactgtactttttctccatgtgttgattaaccaatttatattcaccattttttattaactgtcaggttcatctgatgattcatgtgagttctttaaagataatttatggccaggtgcagtggctcacgcctataatcccagcactttgggaggccaaagtgggaggatcacttgagtctaggagcttgtaccagcctgagcaacatagcgaggccctgtctctgcaaaaataaaaataaaaaaattagccatgcgtagtggcatgtgcctgtagtcacaactcctcaagagactgaggcaggaggattgcttgaatgtgactggtctaggccacattgagccgtgatgcactgcagcctggatgacagaacaagaccctgtctccgaaataaatacatacatacttactgcttatacaatgtttttctcaaaggaggctgggcatggtggttcatccctgtaatcccagcactttgagaggccaaggcgggcagattacttgaggtcaggagttcaagaccagcctggccaacatggtgaaaccccatctctactaaaaatacaaaaattaggccgggtgtggtggctcacgcc

SEQ ID NO: 135551 - DNA, 1075 bp, Homo sapiens
tttcttgaacccaggagacagaggctgcagtgagccgagattgcgccactgcactccagcctgggtgacagagtgagagcctgtctcaaaaccaaccaccaccaccgaaaaacaacaacaacaacaaaaaaagaagaggtttaattgtctaattgcctcacagttctgcaggctatacaaagcatggcgccggaatctactcctggtgagggcctcaggaagcttccaatcatggcagaaggcaagaaggagcaggcaggtcacatggcgagagcaggagcaagagagagtggggaggtgccacactcttttaaacaaccagatcatgcctgaactcggagcaagaactcactccttaccacaaggagggcaccagccattcatgagggatatgtcctcatgactcagatacctcacactagccctcacatccaacactggggactgcctttccacatgagatttggaggggacagacatctaaactatgtcgttcagtctgtccaacttgactgcagttaaaagccacacagaaagactgcatttgtgcaatggtgtaggttaatgcctgtgcaccatctgcttcttgtctggcttctttgtgctcatatcaccgttctctgggaagaaaatattcttttctttctctttattctcttccttcctgcagggagcctgaagtccagtctttcccaaaaagaatatcttttttttttttttttttttttttagacggagtcttgctctgtctcccaggctggagtgcagtggcgcgatctcggctcactgcaagctccacctcccaggttcacgccattctcctgcctcagcctcccgagtaactgggactataggcacctgccaccacgtggctaatttttttgtattttttagtagagacggggtttcaccatgttagccaggatggtctcaatctcctgacctcatgatccgcccatctcagcctcccaaagtgctgggattataggcatgagccaccgcacccagcccaagaatatcttaagtgaaaacaaaagatagatgcccactctgttccatgaaagaagccattagc

SEQ ID NO: 135552 - DNA, 1044 bp, Homo sapiens
cccacatgggcctcccaaagtgctgggattacaggcatgagccaccgtgcctggccctaaatatttttaatggtatgcaagcaaaatagactgtataagctaagtgtttccatggtggagatcccacagtccaggactgagagtaaacacatgggtctcattcaggggctgttgcttctggagaggaagttagtgacgatgagcactgcctggcgagagcatggagttactgcttagaactgaaggtcttggctcaaagctgcactgggatagattctctgcattgacttccagatacttgtcactggacaaaacctcttcaaagcccatctgcctggcttttagccttttttttctgaaacccccgaggctttaacttcctgtacttggttcttgaggggagcagctgcatatgcgtgaattctttctccctccaagaaaattgaaaacaaaatattaatattcatttagagaatcgtgtaaagtatttattataaggctcataaactgagtaaatgatagtatgcgaatatgctattataatatggattgatttaaattcatagaataattaagcaccctgaaatacctctttctctggagcattggggtggaaattgagactttttaagtccttggtagcttgattgtcttctaatgaacatgctcggagtctggtatattagactctggctgggttcagttgctggtacctatttgttgtgatatcctgtacacccaccagatagaaagagtttcttgtttacttgggaaggagctacataatcatgtttggactagattttcaagcagcaattactaagaaaaatcctatgggcgaggtgtggtggctcacacctgtaatcccagtgctttgggaagccaaggcaggaggatcacttgagtctgtgagtttgagaccagcttgggcaacatagcaagacccccatttctttttttttttcaagatggattctcactctctcccctagcccccaggctggagtgcagtgcctaatctctactcactgcaacctccacctc

SEQ ID NO: 135553 - DNA, 1021 bp, Homo sapiens
cccagaccgtgataacacagttttcaatctgtggttaaatgaggctgacctattgtgtacaagtctcatctgtaatttttgttggagtatagtgtgcatgggggaaggtcagttaagtcctgcccatgttttcccgggagtcttagagtcagttctggtaggctggaaacccacatgatataaaggcatatgaccaaggccgccaggcgcatttcactggcccctgaaagctggaaacgactaagagatctttgcctcatttattgaggcccagagaggggaaacgagagccagtgtcacccaacagacctgggactggaactcgggtctgcttgctagtatgtatcaggcccctcccaacttcaagtgtaggtagaactagtatttgagccgaggtcagtgagtattctttccatcacatctctgccccatcgtagatattctaaccatggactgcaagtcaaggttgccagagtgtgaatgagcacagctctttgtggtgggtggttttacactctgggtaaatctcattggcattcagtagttccaggctattctggccttgacttcccttttgaccttcaagtaggtgggcactggaacaggaaagtaccagggaggaaatgagcccagaaactgatatccctttgtggtacactctcattctcacttggtgccaggcccctctcctgctctattgttccccttcatttcctgtcccctctcccactccttcccagtagtggagaactgctcaaatgtgttgcatatacatttttggacttttttttttttttttttgagacctcgtctcactctgtgccccaggctggagtgcagtggtgcaatctcagctcactgcaacctccgcctcccgggtcaagcaattctcgtgcttcagcctcccgagtagctgggactacaggcgcctgccaccatgcccggctaatttttgtatttttcgtagagacggggtttcactacgttggccaggctggtctagaattcctgacctcaggtg

SEQ ID NO: 135554 - DNA, 1821 bp, Homo sapiens
tactcaggaggttgaggcggtgggggggcatcacttgatcccgggaggtggagttagcggggagccaagtttgtgccactgcactccagcctgggtgacagaacgatactcttgtctcaaaaaaaaaaagttttagctgggtacagtggctcatgcctgtaatatcaacactttgagaggccgaagtgggtggattgcttggccaggggttcaagaccagcctgggaaacttagcaaaaccctttctgtataaaaaatacaaaacaaattagttgggcatggtggcatacacctaaagccatcctcccacctcagcttcctgagagctgcttgatcgcttgagcctgagttcaaggctgcagtgagccgtgatgacaccactgtcctctagcctgggcgacagaataagaccctgtctcaaaaaaaaaaaaaagtttcatgtttgtggtttgcacagattatatttcctgtctccttataaatatagctaatgtctggagctttggctgtcctttgggagaatggaatcttcctttaattgttttctctctgtttttataggaatgatgtatttaaaatccactggctgatggcggcccttcctttcaccaagtctctttccttggtgttccatgcagtatgtattagcattttgaggatcattcatgaaattacgtataatgcctgtgtgagcaggcaaaagaaatttgaagaaaggggatagattggtgggaaacaaagacaaagaatacatttctcataaagcctcctcttgtctgggagggcctggccatgcgggtaaatgattaccacctcccctcatattagacttcagacatcttctaatactgcttacagacctacagtttttctagaacacttattattgtttttatttctttgtttttggtttgttttgtttttttaccatttctagagatgagagtgccacctgctgacttgtttccacgacttttttttttttttttttttttttttttttttttttttttttttgagacggggcctcgctctgttgcccaggctggagtgcagtggcgtgatctctgtttactgcaagctcctcccctcaggttcacgccattctcctgcctgagtctcccgagtagctgggactacaggcgcccgccaccacgcccagctaatttttttgtatttttagtagagacggggtttcaccgtgttagccaggatggtctcgatctcctgacctcgtgatccgcccgcctcagcctcccaaagtgctgggattacaggcatgagccaccacgcccggcctccacgacttttttatgtttccagatattccctcatgttcctctgtgatttgaagttcaattcagtattagcatatttatctgagagaaaattgatgctataaagctggaggcatgagaattgagcctcagctttgtatatttggaacttatgcaaattaaaatgaacttgcccaagggggtaagatcacaacttctcctgtctgtgggcctccaagtgcccgtggagcacacttgcaaggatgacagtctctagacatgtactctttgctgtacttgaaagtggcctccttggaaaaggcaataatatatccagtggcagcgtcaccaaatgacaatgatttggataatttcccaaatgggtccaagttaaaagattctttgtggagccatgtagataatgagtgattctgaaatgcagttgtttgatttcagattgactaccactacatctcctcccagggcttccctatcgaaggctgggctgttgtgtactacataactcacctgtaagtatgcaggt

SEQ ID NO: 135555 - DNA, 1034 bp, Homo sapiens
tattaacaaagtattttaaaaccgtgaactacaccagtgagtttccacaggtagaatatggtagtagacgtgaggggcaaacatttcctaaatccttaccatgtttggggccgagggccaaggccagccttacaaggctgtgagtcttttgcgggaggagccttgtcttactggaagcagaacttggatgtaaagaacttacaatgaacagagaggttttagcagggatgcacagctaccctgctctgcttgaccagacagcgtctgtttgacagagttgtccctgtgaacttttctcacattttggagcacaaagtaaatgtggaaggttgggggtggaaggggacaactcctgaggcacccagatcagccgtcccaactctggcagagtttgcagcagagctcctctcggagttctaacagacctcatccacccttacgttcaataatgaggaacatgtgttgacatcaaatgaatgggacaggccagttgctctgtgtttccaaggagagaataagcactcaagttggaaggatcaaggagggctttgtgacagagatagggctggcctgggtgttgaaggaaaggaatgtgacagaggcagtaaatacacatgaccctgctgtctgctaagcaaaacatgctgagggactgtgccggtctttcggctgtcgagccaccgtggtcacttcttcagccagactgagtcctacagcctgccgaggtctcggagttgtgaatgacggagactgggttgtcacccggctgcgtgtgcctcttccctttagtagagtccctcatccctctagagtctccccccaccagcctgaaccaggctgtcgtggggcatagccttccaggaagcccgtcctgggcttccctgaaagacagacacacagagttccatggaatgtcagtctgagaagataaggacatttaacaaattaagaaagtcatgagtatttagacaatagaactagtctgggagggccttaaatgtcagcctgaaaagttaaaactgcttccttttggc

SEQ ID NO: 135556 - DNA, 1027 bp, Homo sapiens
ctgtcttctgggctgagaagcttgctcaggtggggactgggacagccggggctcctgggggggcctttccatctctgcatggtctgtacagcagggtagtttcagggtagccagacttcttacaagaaggcttagggctccaaaggtcccaagagagctgggtggaagctttatctaccttggaaatcacacagcagtacttccatcttactgtattagagcaattacggcctgtgcagattcaggggggtggcatagagactctccttgatagcggagtggcagagttctggaagagcacgtgggactggaaagaatgctgtggtcgcagatcgtgggtctggaggccaaggtgtacaccccacattggggctgctagcatcataacagtccacccatgctttggggcctcagcaacttctcatgtctgtaggtcctggcaaatgtagcctacatcatcatagagtccaccgaggagggcacgactgaatatggcttgtggaaggactctctatttctggtcgacctgttgtgttgtggtgccatcctcttcccagtggtgtggtgagtagctcacagggagggaggccacatgacagcttggctgtcaagcccaatagctgaactggccattcccaaactgatctcagtcacatgggacgtgtgtttaaaagtacagctttctgagtcccagactgacctgaatcagcctccaggggcagaaccctgtgtctttttccagttactcggggtattctggcagagctaatccgtcaccatgagctggcatttaacagagttctaagacaatagagaggaattgggaaatgagaacttggtagtaacttaaagtagcagcctgaatttgtggtggtggtagggagttggagaaatcccataaacagccagttcttgccaacttaggtggaaaatgaggaagttcattaacataaaactagtgatagttctcagcacacaaacatttttgatgttttcagaatggattgctccattcctggaaatggca

SEQ ID NO: 135557 - DNA, 1033 bp, Homo sapiens
aagtgagagacatgccatttgtagttttccttcctgcattggggtgaatacagctttccgttttggggtgaatacagctttcagttttggggtgaatacagttttcagttttggggtgaatacagctttcagagagtgtttgtttggcttttactttgttgtctctggattccttttgaccaaacctgagggaaatctaaaggaaagcattgaggccgaagctgcccactgtcctttagccgcgtctttgtctctcctgtcacgcgcagtggcttctctcaggtcctcggtcactgagactcacagctgcactgcatcctccgagagggagcttaattgagtctcgcacagacacacctagcgctggctccactctgtctcgcctgctaagatttactggctctgactgcccttgagcccgcatccgcgttcccttctctttctccagtgtcattaccttataggactggcgtcgagatacacaccgtaaatttaattaacagtctctgctgctcaccatcctttttttgggccttgtgtttctgaggaaaagtcagaagatgtattctgaagagccttagctttcatgtgagcttcagaagtatttaaacaatcccggttggctggctgcagagttgatggaggaacggcttcattccgaggtgccgccgtgctctgaaaggagccgcgaccatgcgaggcatttgttagggcagcggttctcaagggggtcctcgggatcaaaactattttcataatcatacggtgtgagtctcttgtgctgttgacatttgcctgatggtgaaaagcaatgatgggtgaaattgccggcaccgtcacgtgattccaggctgtggtaccagaatctgccagtagccactgcattctttactgtcacctactcacagggggtgaaaaaggctcatatcacttaagaatggtcttgaaataataaaactgttgatgtgattaaatctcaacccttgccttttaatattctgtgagacagcatgggaggtgtgcacacagcact

SEQ ID NO: 135558 - DNA, 1046 bp, Homo sapiens
ctgttgtttttgtccttgttacagttccaggatcctcttgggaagtcagctgggaaggaggggataatctgtctccttgctggccttcttagttcctctttcactcagagaggacaggggaccacctagggcaggggcagcacctcctgtgcactgtggggggcgttgctcttctgctgagtcatggagagtattgacttgggcatttgcaggggctgtggtatttcctgcctcagtgggcacttgtcctgttctcatcagtaagaaggacttaccagaatcgagtgtcatggttattttcctcagagtgagttggaggtagaggagcccacaggacaggaggtcagccttacaggacccccaagaccaggtggacatgacaccctccccaacccccgtctcctccttttctctcccctgcagaggtttcagcatcttcatagccgggcctgattccctaagatgggcaggggcaggggcagcctgggcatctatacttaaagctcttccgatgattctgttgctcacccccattaagaaccattgctataaaggaattctcctccacatgaggaggtcgatgcctggagacagaggcagcaggccaagggcaggcacacccagctgagatggggcagggctggaaggcaggcctcctggatcctgcctggggccttgtctctctccccacactcattctttcaccgtatttgctgctcctcatggtgaggtcagaaatagcccgcccagccttggtgagccttcgctcccacaggagcccaacacccagcccgccacagtccggtgagcagcaggctgtcggtgttcctaagtcagggaaatctttggaagaacaatggagggagtcgtgggaccccaggctgcgacctgctgcctggctgctcactgcatcatgctggtttcaccctgctcagagcgggctccacccctgctcggcatcctgactcatcctatgcatatggcagcgctgcttgcaggagagcccaggcgccctggcagcccccaggtccccatttgttccagtt

SEQ ID NO: 135559 - DNA, 1012 bp, Homo sapiens
gatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatgactctagtgacttgtaggaggcacttgtgaggagatgcttgcttcagtgtaaaagatgctcatggcctgagtcagttgagttttctttcaagaaaccacttcagagtgaaatatccagggtttccccgccctggacatgtccagcctgcccaggcagcacacagccctgtaagtccacctcgtgtgggtgagatttcctcctgcgtgatgacctcatcgccatctctgctgtctcattccacagcctccctccctcttctctcctcctctgccctcgcccttcccccttccccatcccctccccctcctcctct

SEQ ID NO: 135560 - DNA, 1038 bp, Homo sapiens
ctccctcctccacctctttctcctcctccttccctcctcctccctcctcttcccttctctgccatctttctccccgtgcctattgatcccacataggctcattctgggtacaccggctaaaggctttggtgcattgcagcgttttctcccagcagctgtgtgaaagatgcattttctaagctaaggagaattttctcaagagtggcatactcatgccaaatattattgctctgggccatataggctggtcttcctccacactaaaatgggtgtcttgttttggtacttaaaacagtctactccaggcatccagtccttacagaccaaggaagagcatagcgatgcctgttggaattgcagatgcattctggccttctcccccgtcctgaaacattttctttgaggaaggctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtg

SEQ ID NO: 135561 - DNA, 1041 bp, Homo sapiens
cgcccatgaaaggacttcagcagagagtgatgggtcagagctgctggagtgacaggtcagagctgctcagagctgtttctctgagccgaggctggggtgacaggctccacctgaatggacagaggccagtggattcgcgtaggggggtgtggttcaggtggtaggtccagcatggccttcccggtccacctcatccaacatatcatcatatcttgagaactctcctatccttttcggctttagtttctctccttcacatccatcacaaacgtcacctatgttttctgcatcctgtttgtctcttccatgggagaacaccctcccagagggcagaggcatctccataacccagaaggccgcctgaggtgttacccagcaaatctctgtgaatgagcgaaggacggaggaaagaatgacacccggtgctggggccctggggtaggggagagagcggggaggatgaggcagccctccccggggctagcagggatgaggcaggagtggggtctctttctcccttctttccacagtgttctaacctcggagggtccagaaagctcagaggaaccctgagcagggccgagtgccttccagctcccaaatatctctcctgcctctaagcatactccatccactcctgctttcccctgaagcccctgcccaggctgagccccaggccccaggaagtcttcagatggggatggacttgctggcttggggagctcattctgcagaggaggtgggcccagttggagggatctggtgtagacctgggagcagaatgtcccaaccttgaggaccaactcagagtggacagcagtgaggggcccacagtggggggctaacagttgaccagactgtgctgagcatcctgcctgggaggagggagagccagcacgggaaccagggcctggctggatgacagcagtagtagttaaagccctttagaaacccaggtgctcaggctgggtgcagtggctcatgctggtaatcccagcactttgagaggctgaggtggaaggattacttgagcttaggagt

SEQ ID NO: 135562 - DNA, 1032 bp, Homo sapiens
gtcagttctgctcattgggtctcaatttccccatcccttggatgggagcaagagtctctgctgggcctgcctcgcaggggcctggtgagacccaaatgtgagtgtcatcatcaaagcccctcacagaagtggaggacggtgcccaagagtagcggtttggactgctgctgcctcccacccggagcctgccacttgggggagaaattggtataatgcttgcaaaaacaaacaaacaaaaggcaatgtcttctggttgtggttatttcctttcctgcttgcctccccagccccctttgagtctctttttggggtgccgtcctgtctgaacctgccggtgtgtgtctctggggccagggtcagggcgaggcccaggggtggacaggggccgtgtagcatgccccagcctccccaagctcctgctgtatgtcgtccatgtcacgccaattaaacacgcttcctggacttgtcctcgcctccctgtgtgggcctgttgctttgtctgtttacattcttctccgtttcgttttaggtttcttccctttgtgacaccctttctctggctttgggtgttgtcttcccagtttcctgaagagaaagaatgtgtaggccgggtgcagtggctcatgcctataatcccagcactttgggaggccgagttgggcggatcacctgaggtctggagttcgagaccagcctggccaacatggtgaaaccccgtctctactaaaatacaaaaattagctgggtgtggtggcaggcgcctgtaatcccacctacatgggagcctgaggcaggagaatcacttgaacccgggaggcggcgattggagtgagctgagaccacaccatggcactccagcctgggtgacaagagcgagactccatctcaaaaaaaaaaaaaaaaaaaagagagagaaagaatgtgcaaagtgagaaccttgagtatacttttaaaccagaaaaatctgcaggagtgtttctgcgaggcctagagttgagtggtgtgaggccccgcccactgcctcacccacga

SEQ ID NO: 135563 - DNA, 1040 bp, Homo sapiens
tcgaagagaaagaactaagtgtgattccgtgccttttcgacagaaattgtacttcagagaaaccaaattatccgtcacttttgatgcataaaagttcttcttcttggaagaatgcccactcataaatgtgggaggaatgatgcagttaggaaatcatcattttgcaacccctaatgaaatatcatttcaggcaagagtcctcagtggatgctaaaactgttagatgaaaagttgatgggaactagatgtccgcacagagcgagaacattacccacttgagtcataaaggcaaaaacgcagcccaaccatacagagagctggctgtcgccaccctcacccagtcatcaaacttatcatcagtaatagtaggatgctcagacactatttgcctcccggtgtgatacaacagaagacacactcagcaccaactaggaaatattcctgccaaaaagttcagccttcatcaaatcagacctttggacttatccagtttgagggaaacataggggattaaaaaaaaaaaaaaagtgaatgccaccacaaggaaataatcagaagaatccagaacatgggacagggtacaaatccatgcctcttgaacagcttagtgtcataaaaaaagagctgatggcttcagaccaaagaggacttaatagacataacaaccaaaggaaatgcacagcccttgatgaaatcctgatttgacgaaaactgtgatcaaagacagtttgaagacagggaaatctgaacatgggctatgtatagaatgatactaggaaactcattaattttattagacgatattgtgggttatgttgaagactatgttttttcagaaatccatgctgaattatttatagataaggtgtcatgattcagcaaaaagtataaagagatagataaagcaagtcgagcagaaatgttaacaattgttgaatctagttggtaggtgtgttctttttacttttctgcatcttggaaattcttcatagtaattttttattaaagtaaagtcatttaaaaataacaagtatgcgacc

SEQ ID NO: 135564 - DNA, 1045 bp, Homo sapiens
ggcccctggacacagtcagggaaaggcagctaccatgttgccctctcaaagctcacagaggtggacagtggagatggacaaccaaataagcaatcccaatgtagttgttggagggctaaggcattgagaggctgggcagtgcagatgagaaacatggtagaatcaaggaaggcttcctggaggaaaagtatttcaggatatgcctgaaagataaggagctaggcaggcaaagaggagggagaaagttctgggcagaaggaacagcaaacgtagacgaagacaagagaaagagggttgatatattaaaagaactaagtgaagttcagcagatggacagagaggaagctggggagaggagtgaggcctaggggctggtcaggactgaggataagtgtgataagtggcccggccagcctctcacacctgcgtctctgtggggaactgggaagtccagcccagaaacgccatccagcaaagaccagccccgtgcccttccaggcctgccacagcccaggctccacccacccctggcatctcaggctgcccacagctccagaaccccaggcgcccactcaccatgcacagacacctccacctcggccccggcagtgcccgcctcattggtggcctggcaggcgaagaggcctgagtggtccagctccacatggtcaatgtgcagtgtggtcccctgcgaggccacctgcaccccagccagctcctcggctgggcggccattctgcagccacctaaggtgagtagggaggggggcgtgtcaacctgagaccagggaaggccaggccaggcaggacaagcaggaaacctagaagttcctcccacctgctctcaccagccgtggctccaggcctctttcctactcctggaaacaggaagcctctctcctgtccacttccccccacaatccgcaaagcacacgctctctgcctacccccagccctggcctccaccaccccagactcactggatagtgggtactggggagcctgaggcctggcagggaagttccaggggctgtcccacgatggtg

SEQ ID NO: 135565 - DNA, 1016 bp, Homo sapiens
cctacccccaccacctccccttccctgggtccctgagacccatcctagcattagcatctggggcgcagtccacactcgctgtggggtggggagtgggtgttgcagccagtcctggcttccagcacctcccatttgctgacaatccccacatgtccactctgagtggaatagccaaggcctgtccaccgtctcccctacctgagggtgtggccagagccgtggaggagggtgcgctgggagagcgggaggggcaggccgtccttgagccagctcacgtggatgggcggggagccccgcacagggcacaccatggtcaccagctccccaggcctgctcaccagggtccccgagccgtctgctccctgcttgatggtgggaggaactgagggtgggtagaaaaaagaggggtagtgcggaggtcttgggaggaaggtgggctcctcccagggaaatcccagaagtggagacctggacttctgccgccagcaaccacagtggtcccttgtgaaggatgaggcccgctgcatgggggacacagccactccctgactctcttctcacctcccgaatctccgctataccctgggctggcactattgtcctctagtttgaggatgggccatggaggcccagggaagtgagacccgtggcccaggacacagtgtgggctttgctcacatgtcgccttatctcccgtgcccaggcccacgcatcaccctccagatgccctggggctcctcacccagcacattcaccgtgtgcagcctggcgtcctccccggctgggttgtgggccacgcaggtgtaggcacccgcgtccgaggccctcaggccttttagcaccagggagccgccgtccaggtagaacctgccacagggaaggagggcccagggcagaggcgtaagggaacatgggccctaccgcctctggggagggcatgggccaagtcttaccggaggtgggggcccatgtcctggcccagcgggctgccgtccttcagccaggccacgtccggc

SEQ ID NO: 135566 - DNA, 1366 bp, Homo sapiens
ttaaaaaaaaataaggaggctgggttatggattgaatgctaccacaccacccaaaattcatacgttgaagtcttaacccccaggacctcagaatgtgaccctatttgaagatagggtctttatagagtaagtcaagttagaatgaggtcattagggcaggcctaatccaacatgactgtgtccttataaatagggaagtgtagacacacacagggaagatgaaggcagaggtgggggtgatgtttcgacaagccacagaatgccgaggaccaccaccaagaccctgggagagagacccagaccagatcctccccacagtgttcagaagaaaccagggctgctgacagtgtgatcctggatttgcagcctccagaactatgagacaatcagtgtggcttaagcctccagcttgtggtgttttgttttgttttgttttgttttgtttttttaccagtagccctacagaacaaatacaaaggccatgtacatagctctgtggttgggactggggcctgccaacaggagagggtaagaagtgggacgggccgggcgcggtggctcacgcctgtaatcccagcactttgggaggccgagatgggcggatcacgaggtcaggagatagacaccatcctggctaacgcggtgaaaccccatctgtactaaaaatacaaaaaactagccgggcatggtggcgggtgcctgtagtcccagctacttgggaggctgaggcaggagaatggtgtgaacccggggagcagagcttgcagtgaaccgagattgcaccactgcactccagcctgggcaacaagagtgagagactccgtctcaaaaaaaaaaaaaaaaaaaaaaaagaagtgggacgaagccctgaaatacatgggggtctgcttagacccaaggctaactctgagactgcatctctggctggggggtcagagaaccgctgaactttcagagctgcataggttggtaccctgccccggcctgtgggagataatgagagcaacggccagaaagggtcccacatttggttggcagtgggtttcacgtggatttccaggtggccaagtgtcaagtcccaattccaattagctgagaggcgctgcctgggagggctcattggagaaagattctgccaacgcatgtggtgatagattagtgatgtctgccagggacagcgagggagatgcatcgccacacatagggagtgttcccatgtggtgatagattagtgatgtctgccaggtacagggaaggggacacatccccacatatatggagtgttcccttcagaggcacaggccacagaaataatatcttatgacttgcctttatgcaggtctgaatccatttactgtggtttctc

SEQ ID NO: 135567 - DNA, 1040 bp, Homo sapiens
acatgcagcatgggagtggctggattctagggaatgccaacaagagagaaggcagggccaggcaatggctgcaggctgcaggggaacctgggccacctgtgcacacacctgaccccacccgtctgcagatgtcaatgagtgcctgcagctgcccaaggcctgcgcctaccagtgccacaacctccagggcagctaccgctgcctgtgccccccaggccagaccctccttcgcgacggcaaggcctgcacctcactggagcggaatggacaaaatgtgaccaccgtcagccaccgaggccctctattgccctggctgcggccctgggcctcgatccccggtacctcctaccacgcctgggtctctctccgtccgggtcccatggccctgagcagtgtgggccgggcctggtgccctcctggtttcatcaggcagaacggagtctgcacaggtaaggccaggccctgaccatccacgggacactgccgttatgggctcttgggcccctagggtgggtgtgcaggtgtcacccaccgagttcagaaacccagaccttccaggcaagtggggtgagtggtgtggtggatggtggcttctccaatgcagggtgtctcagagccttggctgtgctattgggcagggggcttccaagatggtgtggactattttttaaaccatttgacttcaggacactttgcccagagggagggcatcctaggcaagtggtcctgggaaccccctttgagaaacactcctcttagcactcagagggaaagcagtcagggagggagattttcaggggtgaaggagaatgttccaggtagacatgagaatgtgacaagggactgctgggtagaggggggtgggggtgggggatggcccctggaccctgcagagagggacaaagaggaggtggcctgccccagggctgatgcctcggcattcccgcctggacggaggggtctgcggggtggtgctgcttgctccttctatgccttggtgagcacggggtaggtaaggtggggctcctccctctcagcaa

SEQ ID NO: 135568 - DNA, 1970 bp, Homo sapiens
gggctccacttccccagtagtgtctaataaagaccctgggtgactctgaccttgtgacgttggtcagactccagtggaaacgttcccaggcagaacaaacatgccctgtacatttgggaaatgcgggatgctggggccaggtgtccacggaggctggaaccaggaggcctgggcccacatctgcccctgctgcttgttgatccgatgaccctgggcaggtgacctcgtctccctaaccctggtttcctgttcagcaaattggacacagtgaagacgcccaagcccagggccacaggaggcatgtgggggaggggggtgcagggcgagcccaagggcagcccaggattcagggagagccctcggggaagaagcatggctgcaaagatcaggagacaggaggccttggcgccttcgggaggcttcattgtgacggagggtggggcaggatgggagaccgcaggcacttcccggctgcagagggcctggctgcagagagccctcgtgcccatctgtccccccgggaagggccgctggttgcagaggtcttaggcctctgcctgtctatcgccttccctccctgggcctcagtttctctacctccacactgggggaagttggtctctgagcccctccaaactgggcattggcagagttgaattcagaggcgctcacatttggagacacgatgtctaaaattccagccagtgaaggttccatggggttgcaggtaggagagggactggggctgggcccctgccccacagcatccttctccacctgcaggtgggcggcggcactgcgtgctggggaagcacagattcttgtgccctctgtgaccttgagcctgccactgacctctctgagccctgctggctgcctccccaataggaatgacaactcctacttcatgaggttgtagtgggggctcaggggcacagggagatcccgctgaggctcccagggccctgcctggtgcttggcaaggagcagttctgatgggggatgtgtcagctgccagaggctcagagccaaggcccctcccacatctcctgcctgcgtgcattcctcacatcctggccttgggccaaactgctcagcctcagccgccttccctcgatgctggaggatcaggtccaagagatgcctctccccgaccagcctaggactgcagtcagcattcccaggccccagtgtggtctgtggggctgtgtgcagagtgtgcgaggtcagggttcccgggggtggcaggcactgaaggtgaacatcctgttcccgaccttcagtggcagcttgcccaggagacaaggctgtccaaggccaaggtcggggctgggctgtctgcaggggctggcggggggcactggctgtctcagggtcactcaggttgttcctcgactcccgccagacgctatgtccagcaaaggctccgtggttctggcctacagtggcggcctggacacctcgtgcatcctcgtgtggctgaaggaacaaggctatgacgtcattgcctatctggtgagggagcgacctgggtgtctgtcttcctgcgtgtcctgcaacctgtcctgtctgccccctgccagcctctgtctgggttgtcagcctgtctgctcaccgtcactcattcaagcctggcctcttctctcgaagcctgtcttgaactggaactaggaaaatagcttctcgttgtactgcctcactttctccatctgcaaattggccatccttgagatgccttccagagccaggtgatggaggcgcggggagggcacagaagtgaacttggcagtgctgctggcttagcctgcttgcagagaggcatgggctgggacctgctgccagccctgggaaggcacacagtcttcccatctccagagtatgctgtcagcctgcagtaattcagcaaagattgtggaatcctgagctggaaggaccctgggggatcacctggttctgggatgggaaatagg

SEQ ID NO: 135569 - DNA, 2685 bp, Homo sapiens
gactccggggatgccggggagtaggtgctacctggcacagccacctctttcctggggttgacaggcaaggcgtacttctgcgcctcagtgtccctttatgacagtacccaggaaacccccaacagcctctggagacaatttccgagaactgggggtatgagtggagaaccaggaaggctgggagcgaggggaatccaaggccttggaggtgctggtccagccttcaggcatttaccccctgagtaaccacccagcaccaccatcccatgagtatccacccagcactgccccgggcgccatcacgggggacgggccaggtggaggctttcgggtctttgggctcagggaaggtgacagtgaaatgttggggggacaacggattggcctgggatgtgagggggaagggcatcctgtttgctggaaccgcctgagcccagccctgaaggcagaggcggaggcagcctcccttcccagcaccccgtccagacagcacctggtgcagaaattgagccgcactctcccctcccatgccctgctgccagccccacccctgcccacccagagagctgcaccgaagctggggtggcccttgcggggctcctctctccccctagttttggaagaggggcctggaaatatgattctgagactctagccggggagcgagagttttgtaaatggcaccatctgtatgggtgccccagggcagatgggagaccccaggccccccagtcccagtgggaccgtgtttacatgcatgtttacacacgtgtgcacaaatatcagcatgcggacactcgtgtgtgagacactacatcctccttctccccggaaagctgccaggagctgccctggtgctggggtcttggggttcagagggggaaggattagactggcctccttggctcttgcctgagacgagggcagagtttgaaccaaggaagcgtttgtttggcctcttcgagggtctctggctcctgaacagatgggtgtccgcatggcagcatctggatgggcagacagcagcccagccgtgcctggctggtgaggcacaagccgtctttgtgttggggaaacatgaagctgtgggggaaaatagctgggccatgcaacgtcggaccatgccttaccatctaaaatgaggctgtcttttagttgctccaggaacggggccggctgggggtcagcaggcaaatgtggccgcccccacctcagtgtcctcatccgtaagatgggactaatagaacctgcctcctggggctgctcaaaggattcagtgagttaattatgcatggagctcagctgggaagcctgagtgtgaaccgttaggatgagcgagtttgctgtgtggccctgggcaagtggctgcacctctctgagcttcactttcctcacccataaaatatggctaaaaatccccctggccctgggggcctctctgagtgacagcacatagtaggtgctcactaaaggggctgcatggagggtgagtgaggccagcccaaggcctgtgccgcacacacagctcccagctctgcagagaggctgaaccctggattctgtgccacctgacgagagtctggaaaatagcatgtaattcccaccgctgcctggctgcgcccatgcagttttcacagtaggcaaaaggtccctctgtcatttccacagcgcttaagtctccctctgggctgccgagcccacggggaagcaggagacgtgcgcggccattttctctctggggacagagctgggctggcggatgcctgcgctgaccccggcctcctcctcctcggcatcagtgtggacggtggtcccggctatgtcgggggtaacgttcacagctcagtggggtgttgaggtgtctccatttgcccacagaggatgcaggcgaggcaacctgcccgagggggtggctgtggtgctggggacctgggcttgggtcccgggcctgccctggctgtgtgtccttggactggttcctttcccttcctgggcctcagtttccctctctgtgcagagaagagctgaggagcaaaaggccctcagtggtcacctagttccacctcctccctgacaccagccattgaagagatgcggaaactgaggctcagagaggtgacagggttcccaaatgtatgggtatgggggagtccaagcaccctggtgccccagccctgaagtgagcttgatttggggcagggcagggtcagcaatgtgggggccttgaggaagagactatagtgcgagctctggggctgcaggagcagggcctggccccccaggtcttgccagtggctgggcctccagctccagggggtcagatgtgtcctgcacccacccacgtgacatgtgtgccctctcctatactctgccatgtccccagacgtgcacatctccctcctgccacatgcccacacatacacgacctacactgcatgacctcacatgtgtacacgctctgcccagctctgtctccgccacgggctgtccttgtcctcacgtcctcccccagactccagaacccccatcctgtggctcctgacagccctctgttctgcattgcaggggaacgatcaggtccggtttgagctcagctgctactcactggccccccagataaaggtaggatgtggctcctccccttagcagggagcactagcatctgcagcacctgatggggaggag

SEQ ID NO: 135570 - DNA, 1013 bp, Homo sapiens
aggcacagaatctcctccgtggcaggggtgcccatcgggtggacagcctgctggggaggctcccttcgctggggccagctccaggggacacactttcttccccgccattcattcttcccggagaggctgtccaggtgctggggcacgggatagaaagtccctgccactcttcagccacatccctggcatcccaggtgtgggcaggcatggctctggcaccccaggtgcgggcagggatggctctggcaccccaggtgcgggtggggatggctctgaaacgtggttgctggtgtctgggatgctcagagccctccgagccccagtcagagcccccagctatgcctggctcctccccaggccacctgtgcctggtccccagcatctcttgagcctttcctggggtgggaatcaccaggatctcagggcctcaaccgccctggcccgtggcatgtcacccaggcaggagggcacctgtgggtattgcccagactgctactaccatccccacccctccagcttgaccttggacctggcctgcgtccatgcatgaatgatggacacgttccttccttcactcgctagctcatccttcatccagtgtctactgagcacccactcagctccaggggtgccgagtgcagggcccagggcagggccgagcagtgggagtttgaggcacactgccgctgcaagctgcccaatttttctagtagccatatatataatatataaatatttttatataatatgtattacatataaatacatatgttttatatatatatatatatatatattttttttttttctttttctggagactcgctctgtcacccaggctggagtgcagtggcacaatctcactgcaacctctgcctcccaagttcaagcaattctccctgactcagctcctgaataactgggactataggcatgcgccaccacacctggggtttcagcattttggccaggctggtcttgaactcctgacctcgtgatctgcccgccttggg

SEQ ID NO: 135571 - DNA, 1008 bp, Homo sapiens
aggggaagagtgtttaaggcagaggcagaggcccccccaaccacgtgcagagccccggggcagtccccagaagacaggtaaaggccccagctctttcttacaacctgcagctccacgggtgactatggtgggcccagaatgtttcaggcaggttggcagcagatgctctggcagagagtaaaaggcagaccaggctcatgggcacaatggggtgtgtgtgttgggggatggggacatgccatgtccctccccagctgaccctgtctttcctttcccctccgcagctacgaggctggaatcctggagaaccccaaggtaatcccccaaaccccatctcctcccagctggccacctttggtggtagcagctccatgccgatgctgtctgatgtatttatagcctaatttgaaatttcacgggggccagccgtggggctggggccgagccctgcctgtgttccccgacccccgcactggcccccctctgcccaccgtctcctcgctgcatttgaagacctccccccgcccttcctcttctaattgcctctgggatgaacaggggaaggaaatatctcagggcagcatagagagagagtgtgattgtgagacaataaagaagtaattaggcagatgagacacttgggggagggcccagcctgtgcccaccagctcccaggctgtgctgctggagttttggttgtggggggtggggggaggcatggctgagagccctaggccccatttgtctggatccgtgttgcacacccgccaccaccggccaccctgatccggtcccaagcttcccgggcgggctggactgggccctcagctctgtttgaagtttcgggtttctctcccgggggtagggggcttctttgtgtctacccctgcccactgtgggaggtgggggaggcagggccaaatctatcatgggaagagaaaaatctctttgtccctgagggaatgtgtcttagttcccgggcccagccccacaccccggggaggctgg

SEQ ID NO: 135572 - DNA, 2507 bp, Homo sapiens
ggatgcagctgggcctgggggaatcaagaagaccagctggaggggagggtgcccggggaggtttggtgaaattggggagcgccagagccccgcccaggatcccccagggcccgggcgtctgtcactctcacgcccgcgtgccgccccctggtcggtgttggctgtaatatcacatggcagccaccatgtctggggagcgggccgggggtggcattgtcctggctcagttcctaggacactggctgggagcatcctcactttatggttgaggaaactgaggcccgggcaccggctgctcagggcgagggaacgggccctggggctggtgccctccagctctgtggctcccctactgcccacggcccctccctgtccaaacctgtcactcaggagagctgccacccttgccccctgggggctgatggcccctgtgtgtggctgctgcctgctggtcacaggtttttctagttcatgctctgctgaccccacaacactcaggccagccaccctaattagccagtcagtcagctccaagggaggcagggaggccgagcctgcagggtggcttccaggcagggcatcctctcaggcccgtgggccccaagcatgctgggcaaccactcccggccattctccaagcagcctatggcctctgcaagcagcctatgggggcagagaggaggcccccccagaatagaggacctcaggattgagaaagcagagcaaggccagagggaaatcaccccctcggaccgtgcaggagggcatccggggcctggagcaggttactgagctacggtgggcaggtcctgcgccctcccaggcctcctgtctcatgagggcattgggtggagaagtcagtactaaagagaatctggattaaggatcctgctacctcacccacacttgggtcccagagacaggaaacccgagtctaaatcccaacttttcttcttattgctgtgcaacctcgagcaagttacccaacctctctgagcctccagtactccttgcccaaagtgggaaaacacagcacctccctcctagggcatctaaagcgcttggcctgtctcagggcaagccctcagtcatgcagctgggggtcccatgctacctcttcatgggaggaagggtccaaggtcctctcagggacccctctcaagaaaggctgggctgggctaagctgggtgtgagtcaggggaaacatcgttcctgctgagaggcccggggcacccagagtcccacccaggcacccagagtcccacccaggcacccagagtccagtcactctggaaagaagtttgccccagccatgcagactccccaagggctttgtgctgagggtggggctcaacgtcaggacgcacccttgcatccctggacctggcagccctgtccccctcgggatgagctcaggggaacagagcctggggaacccgtgcccctccccctctccaaaagaagccaggagacctgcggaagggagggcttgaaggcagatggctgagccattttctgcctccgtgagggctgattgaagggcaatgaggcagctaatgcgaagaaagatagaaatttacttgctttaacttcatacggtccacagtgaaagagttcattcagtcgccggcccgccatagctgatggatgaataaaccatttgcggcatcgatcatgcctctacatcatggtttagttcatgggccatttgcttccaatttctccttctcggggcctgtttcatgctttctttcgccctctccccctagcccccaccccgactctctctctctctttttcttcactctcttccctcccccgcacccccccccccccacagatgacattggaagtgagccctcccgctgggagggataaatagatggcattgatacttggcaacaaactatttgtcattagaactgggcttttaggaaggagagtaaaaagaaggcaggcgctcgagccaccgcggaatgcaaagcaaatgtcattttatttctatttagttattttatttaatcggcgctgtcaggtgcctgcccgacagctgcctctgacttccgctgcggtctgcagaaactcgtcctccagtcttcccatcccctctccttccaaatgcacacactgtcagcctccacttcggtctggggctccctcaggaagtgtggcgggagagaaagtgacaagcaacgcattgaaaacagttgacagtcgggcccagcgcaggtggaggtgggagagagctgggcttgggtgggagtggggccctcgtaccggcaccctggttggaggcttgggggagtcccaggcagctggagatggggctgtggagttgtgtggtcaccccaagatccagtccagttcactttacctttttgctgaggatgagccttgggacccgtctgtgcccagggaatgctgcagttggcagggtgggccagccctgatgcctacctgtggctgtgatgctggctggctctggccacaggcctcaccctgtttct

SEQ ID NO: 135573 - DNA, 2285 bp, Homo sapiens
acaaagtggctgcccacactggagctgggatgagagggagagaggctcgtggagaggcctggcccggctctggcgctcggctcttaccccggctaccacagaaaggaggatagggtggggaagcctcaggccggtggggaggcagagctgcagatccccctctcccccttgctggtgtgaccttgacagccagcttcaccatgctgggccttgggtgcactcatcaaaaaacggaccacaggcatgatgctcacaggtgcccggcatggtatgtggaatggggtgtcggaggctaagtgctttaataatctgcctcttctgggcctttcccaagagcttggccaagccagcgactgtcttccttgctccccttcatctgtcccaacctactggggggccaaagaggaccccaaaggcagccgggcccccaggcctgtttgcaggcacagagcctccctttaggatcatctctgagaagatggtgggagtggccccagcagcacctcctggctccctgcacagggctcccaggagcctggagagccgtgagggtgggaggcgggtggcaggctgcggagggtcctgggcaccaggctctggcagccctgcccgaggaccagggcagctccgcaggctgagctggagaagaaacgtgacctattgtcatgatttggggactgtctggaagaagaaaaaaagaccggaggaaccctcccctggctagtgcccattcactctctagttaatttatttgaagttttaatctaattattaactattttaaaggctaagaggctttctccagcagcagcaccaacaatgtcacctcttctcccgggcaggccccatctaaggccccagcgaaggccgataataggaccggggagggagagaaagggagagaggagaggcggggggtggtgagaggggcttaaggttcattattgggcagacttacatttaatagcaatttacaaccaagttataaaacccctggaaatgggggttaagaatggcgaggctgacagcgccttgagtgaagcccctccaagcggcgcctggctaataaagcctcgaaagccgctattgaggcctgattggcacccgatggctcgctccatggtaatgagccgggcagatgggtgggggattagccgccaactttgaacagcttttctttgtcactgtttcagctctcttgttagccccaatacatttattgctcatttcacaccgctcgagaaagtgccccttgctattcaaagtcaaccccgaacccacccactgcccccacccaaccccttccctcctgccaccccggacccagctcctcggattcagggacgctgccgacacctcgcctgctggagcgggcaccgtgtcacccccatcaatcagatggctgcgtgtgggtctggggtacagggtcggggcgcggggtccgcctgacagacgtggcagggggctgtgtgtgtgtgtgtgtgtgtgtgagcgagtatgtgtgtgcttgagcccagccacacctcggccaggcggcccccgggtgactggtgggacagaaggtgctcccggcgtaagacaatggtggagcgtgaaattcaattagttcagggcctggttccaatttcacagcccctaaatgcaaaaggggcaaagagaatgggagggtgggggagagcgtttttattgcattttctctttcattctggggggctttctcgccccttctctccctgcagcaggcctcaacctgcacagggcttttgaaggagtcatttggagtccatatctgtcacatccatttaaggcgtttcgggaggagggagagggtggggtggcgggtgcagactcctccgctgagccgggcccagaggcccactgccctctcttcccaccctaggggtccctgtgaaggtgaccaacgtcaaggatggcaccacccaccagacctccttggagctcttcatgtacctgaacgaagtcgcgtgagtgtctgcagccctgtccggcctcttgggaaccgccgtctcgggcgagcacgagcctggaccgttgcagctaatggttgtggctgaggctcaggggtgcggagcacaggccatgtcccttccccatagccacagagtttcccggaccagggggacccatttggcaggagaggctccgtggtccttagccttggaagataacaaccccaggaggtctcctgcctccaagggatcattaggccggggctctcaggcccttggctggatgggaggccaggatagaaggaaagggagcag

SEQ ID NO: 135574 - DNA, 1017 bp, Homo sapiens
ggaaggaacaatgtgaactcacacctgggcaatccctgctctctctgggcctcagtttccccacctgtccagtgggcacctggactaggtgacccggctcagatgtcctcttgagtcttagatcctgaaatgctgcctaatgtgtggcctaagctgtgcccaccctgggacagcccagctgggtgggtgactctgagccttgcggtagcgcccgaacctaatggaccagttcttcccacaggggcaagcatggcgtgggccgtattgacatcgtggagaaccgcttcattggaatgaagtcccgaggtgagtctgctcagcctccctcagggcctgcctcgggacccagcaaacccagagatccctgagaccctgtcccctttggacgctactacccccatgctccgtgggcgaccttgggcacgtcctttcaccacaccccgtgagaccgcagtttccctcctgccaagtggggatcgtgggccctttgcccctgactttcagggtgttatgagaagagctgtccaagggctgggagaggcccaggagggcctggggagtctccgaggagcagggaggccagggccaggcctggaggtcaggctgtcttgtgtctggggtgggcaggccgggtgtggaggcagaccgtgcaggcccgatttcgtggtcattaaggccgcatggaggccgccggccaggcagggcgaaaatcctgccaggggtgggcgctgtggctgcacaggcactgggagccggccagggcctaaggacctgtcccagcatcaggcacggctcactggcccttttctccagggatggggctgtgccacagttggggctgtgccgcagttgaggctgagcttcagtgtgacatgcctgccacctcggctggcctctagcctgcctagcctcgtatccgcctgtggctgggcccaggagcagggcagttggtccccaagcaggtgcctctgtcttctcttagtagccaaagcccatgattccctttgtcagccaatc

SEQ ID NO: 135575 - DNA, 1067 bp, Homo sapiens
cccagaggcccacccaggatggggcccgccaggcaccaggagcatagaggatggctagagtcccaccctgactggcctcccatcaccatggcaactgcttctcaccttggccctggtacctaagaggggagcccttgggctccagccaacccctatgccccacctcttccaaatcacttcttctactttcccaaaggaccagagcctttagtccaggtgccctcacctccagcccaggccccagctgagctggcggatcccactcaattctgcaaaattgctcattctgcctaacctggcagcctcagggacagatgagaagaatttgggccacagtagctgtttggttcccacctctttctgcttggtccactctccccccagccacccctggccacccctagatccttgcccgtctccccactccccgctgcacctttcttggcagtaattatggtgtgattgaagctgctccacagagaactgctgacacctctgtctttttcctgtaaacacggggagatgaaaatagacacttggagctgctgtgtgtgtcactccaaagatgtccgttgtctcttccacggcaacacagaggctcagctgtcatttcctccttctctctgcgcagtggtttgtatgccgactgtcaaaagccccaaattcatagtcttttagcatcaggtttctgtcactgttttttttttccagaagaaacacacagaaatcatctgtaccccctacccctgtggagaggagagggaagagctttaaacgcacacacacacacacacacacacacacacacgtgcgcgcgcgcgcgtcggcagcaacctaaaaacaagttttttgatccgtcacaattaacactttcgaagaaaaggagcaggaatattaattgcactggtgtgttttgtggctgcagcctttccccttgcccgtgagccctccggaggctgcctgggagggtggcagccaggaagccggtgctgggggctcaggaagaggagggttctgcctggcctctgcccaccagacattctctgctcccggtggcactggcctca

SEQ ID NO: 135576 - DNA, 1035 bp, Homo sapiens
cctgaccttccagggttgggcctccacggccaggtgacttacagggcagcagacagcactggtgagggactcgggggcctacattcagttcccagctccacctagagcaagtcccttctcctcttgagctcagtttccccatctgcacggtgcggtcagcctaggtgattgcccaagccctctgccaccccagtggcctctggagagacctggccgcaggggccccatgggctgaaggtggcatgtgtgtacacatgtgtacatgtatgtgcacagctgtccccctcccctggctccctggtggaagggaagaagggatatttggggctctgggctctaccgtagtcgctttaattacaggctttcaacctcgggccggtgggcacgcatggggagggaggggttgctgctccgaaaccctgtcattttctagcgtctgagggccccttcaaagggggcatctagacattttctccacaagccgcagagtggactgtcgtggccccagcatgaacataatgacagatgcattttgcagcaagctgggagtgaatgggtccggccggcttgtctcctgtcagacgactcattattattattatttttttttttgtcatttgctgacagtttgggtttcatgcgtttctctcttttttctccttttccccctgcctggaaaaatggctaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtgcgtaagactctatggctgccccctctaaccgcctcacaagggatcccaaagtactatcaggctctcgggcctggccctcccctccgtatcagcaccttcctcccctgccgcccactgccatcctcatgtgagaccccaaaaggtgcaggccaaagggggttgagggaaagtgcagggcatgagggagcaaggggatgctagaacctgccttg

SEQ ID NO: 135577 - DNA, 1026 bp, Homo sapiens
cacagaattgctccagttagaaaggatcgcatgtgtttggctgggcctagcagcacgggggaggggtccctctccagctcagccctaagccccacccacagtgatctgcaggtctggggggtgcagggtctcccccattgcagcttatgccaggctcactggcccccaacccaggctgggtccgctgggaaaagaaatctgagcagaagaaccctgtggggcagaggtagaaaattctgagataaagcccaggccagttgctcccacagagatctctgtcctatctctggctccatctcctgcctgtcttccggcctggaaacttaatgggctaattatcccagctccgtcagaaagatggccaagcccaggacaccagggcatggggggctgggagaacatcagtggccccctccacgagggtctcggggtgtgttggaaaaagccctgggccagagttaggagtgcttcatcagacctgggctcttccaaagtcttgctgtgtggccttggacaggctctttccctctctgggcctctctccctgtgtacagtgagggctggcacagagcatcatgttcaaactgcaaatgcaaaacgctttgcgctctgtgcattccctcactgcatccacacaacctctggttagcaatgttttctcactgtgcaaatgaggaaaccgaggcacagggaggttaatcacttgtccaggtgtggctgggatgcggactcacagggtgggacactggagagcaaggactcaacctctactctccgtgcttggccctcccccgcctctgcaagccccaggaccccatcccagaagcctgtcccctttcccacggaggacctctgcaggtgcccccaggggcctgggcctcccacaatagccgcagcccctgggctgacccagccctttatcagggcaggagatcatgcgccatctggccctgcagctgcccaggtgggctcaccttccaggctccatttcaggaaactctagccttgccctgtccctccccccgc

SEQ ID NO: 135578 - DNA, 1126 bp, Homo sapiens
tgaaccaccacccagctgcctgcactggacacccatatcaccaagccccaggcagcatgtgcctctgagtcctgtctgaggtcttctgcctcccccggagattagagcctccattgggccagggatggggtccctttaccactgtgtccccagttgctggcctgtggcacttcctgaatgcctatggcatgaagcagtgggtcacttccctcctcctgacccttagggaaatgacctaggtggtcacctccttacccacaggccctttgcaaggttagagggcagggctatgaaagcatggtcctcaactcagccactggcaagcgcacattgtgccagtctcgcgggaggcagtcatggtctgcatggcggggtaaaccatggggcacccttcctgtgccccaggtctccctgtgtcctcgcggtgcaggaggcctccctagtggtatcctgttttcctccctgtaggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgaggtaggtgccccacacctcattctgacccccacttgggcacagagcctatcttttgactggatcctcaagacatctgtgcctgagcacatgtcaggcaccatgcagagcacagagtgatggtcacagaggatatagacaccactatgctcccgtggaacttacaggctagctgggagaaaggcatggatcaaaccattaccagaatgtagaattagacaaggtggcagcgggctgtgaggaatgcaggatagtctggctgggtataataactgggattggctaggaggggtggtgcatgcctgtaatttcagctactcaggaggccgaggtgggaagattgcttgagcccaggagttcaagaccagcctaggcaacatagaaagaccttgtctcaaaaaaatatatatacacacacacatacatatatatatatatatacacatacatatacacacacacacacacacacacacacacatatatatataaaataattggggt

SEQ ID NO: 135579 - DNA, 1016 bp, Homo sapiens
cccgggaacaggctgagtggttaagtaactttccaagggtcacacagctaggaggtggtggagctgagtccggagggcctgtcctgctgtgggttctccatcaccagctcccttctcatggggattggagtctagaagaagatgcaagtcagtctcctcttgctaacaacatgccctgggcacagagccatcattttctcccagagccagtctcttgtccctggaggcacctcatgccccgagagatgttgaagcccgcccatctgcccagggtcctctcccttcccctccgtcacctccacctcccctgcctcctgcgccctctgtttgtattttatgactctataaacccttttaaatggcccagaacaaacagggcttacatagtggcctcttcatttctcctattgccagttaaacgctttgtcttcaacaatgacaaacaatgttttccccctaagataaattaattacattatcctgattggagggcaggaggggccagggcgggagagggaatagaaaaaaaggcaacttcacacacatcttaacaaacagctgccccagccaccccagctctgcctgaattaattgaacccagtgtgtgttgttattgttaatttacatttttctttgttttgaatctggtttacaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagagacactagtcttttatttctagtgagtgtgtgtgtgtgtgtgtgtgtgtgtgtgtgtgtgtgtgtgtgtgtagttaattatgg

SEQ ID NO: 135580 - DNA, 2090 bp, Homo sapiens
tgaccccgccccgcagacgcgactcctccagctgcgagcgtcccggctttcccttccgccggaagtagggcgactttccttttccggctacgggtccccaagcggagcgggaggccggaccggggagccgagcggcggcgtcggcggcgtcggcggcggcggcgacggcggcgggggcggtaatggcggagctggtgcaggggcagagcgctcctgtggggatgaaggccgagggcttcgtggatgccctgcaccgggtccggcaggtacgggcgcagccggctggcaggagcacgagatcccgaggcggggcctggcgggcggggaagaggggttcgggcctggggggcgggaggcagcctgaaccgacgtctcagccgggccgggccgttccgtggagttcctacagccgggaggagccggggggataaggcgccactgcgaggcccaggcccggcctgtcgggcgggtctcccaggtgcctgaagtcgctgggaaagggtttgcttagagcgtctggccccatcgtgccccagcggccagcctggacccacagtgtagctagcgcggggttctgaacctcgcgaggggaggggtccgggaagcccacggggaggatctgggtgtagacataaagcagctgtctgacgcccagtagcttgttaaaacttggggaacatcgtctttagactttctgttgagtagaaggaactcgagggcatcttatatgtgagggtgctctttggagaggtgagagagggaggtgttacatgtgtgggggtggtccccaagatgtagaaatttctcatggcaagcttgcctctactggggagaatgatatggcctcattccgacattgaaactttactgtctgacaatgtcgtgcatttaatcaaagttaaattaactgggttttagaaggctccaggcttccccagagagtgaatatgggacctgccaaaaatacttactggcttctggcatggtacttagaacagaacgtgttcttcatttgtatctaaaacttacttacaagtcagccctaacacttcagcttcctcggttaagtgtcttatgtcctcctctcttcttatgtaattgtaagcgcactgatactttaaaagttgggctataactaattactgcttgattcctaacagaaagccacaggagtcattgtattagaagaaggtcttcactcgggcgcttgaagatatggtctttacatctctttccagtattccaggggagggaaccctacctgtttccctgataactgacttttcatgttatatattgatgctcctatagacattatattggatcccagaactttccaaacctgtggttccacctaaaattttatctgatgaattgttactttactgcctagctgccaaccagtacagtagtgagtatccatcttacttagacttcagatccacccatggctgtaatggatgaacatgccacccagctccccttccaccactctgcttgctggcgtgttacagtgctctcctctacagtacagggtcctgaaccttgtttctcactggctactaatatgtaatggctttcgctctgtgctgatgtgtgacagtcaccttgttggccttctatgtccgggaagaattatagtcactgccctaaagggctcagatcctcagtttgcagaaggcctgtagttgaacataaagtgaattttgaaccattgagaagacattccgcttctcttgagccagtggttgaactcatattcttggacaacctgctccagagggagaccctctggtaaatgctgacctaatgtggattgttgaagcagtggtgtttactactagcagtgaaaacttcattggaattgttctcagctctgaaatgcaccattgactggagcagtaataagcccaatggagacagggctgtaagtgtgttccttctgaatgttaacagctggaggtccatactatctccaaggatttgatggcctttaaaaactaaagaaaaaccaggttggtgggtaattttaggtttattgtatatagatttgcattgggcaagaacggaatgttagaaatctgtaatac

SEQ ID NO: 135581 - DNA, 1442 bp, Homo sapiens
tatatacacagcatgttacagagatgtgatttttctccccattaaacagaactaaaagacagtatatttatttaaacgcaaagctttttccccttttatgtctcctcataaactccagagacagtctggaaggccctcttaaatttgtcaaagagcagtaaagtgtctcacgctcagtttttctagcagatcgtaatactctcagttgaccctgctgggatttgaacctgcagtttctattaagtttggtgtgtgaagtccaacaccttatcaactaggctttccctctgacatcttgaagcctccgtgtatatcctttggactctgcagcaaagtgcatcagttgttagtttactctgagcatggtattcttagattgaaaagaagtctctgaagatgtcaaataaaatgtaaacattttctccagcagtgtgaagtctagtgagttaatgtttggcacaagcaggtaatttacatccattctatagggtagtagaaatgtgatctgggcaagtcacagtggctcatgcttgtaatctcagcactttgggaggctgaggtaggaggatggcttgagctcaggggtttgataccagcctgggcaacatagcgagaccttgtctctactaaaaattaaaaaaattagctggatgtggtggcccacccctgcagtctcagctgtttgggaggctgaagcaagaggctagcttgagcatggagatcaaggctgcagtgagctgtgattgctccgctgcattccagcctgagtgacagagtgagacactgtctcaaaaaaaaaaaaagaaaaagaaaaagaaagaaatgtgatctcattcagttccatggatgaagatctaaaaactgctggatattaaaaaacatctgtctacttttcccaagtcattggctggttagcagaagtagtgtttcttcaactagttcagataagacaaaatcctgagtagttcatcctgttccacagccgtcctctgcacttctatactgactgtctgcctaggttacaaggggacctctggatgagtagatccaagtctggtttatgttgttccattctcctaaaaatatttttaaatgttcctagaaggtctaccattgataacttagtagcacctgtcatcacccgtgagcaatcccttgttaggagagtgtgatgccacagtgcattataggttgacagcagccttccacaagctggaccagctagctgtctgccagtcgtcgcctaaatagaaattgttctccgagaaactactaatactttttaggactttaaaaagcattagatctgttttgatctagatagacccactcaatgcctctggattgtataactacagcatataatgttgatacagaatgcagtctaaatggtgcttcatagagttcgttcggcatcacggtagcactacacttaaatgagt

SEQ ID NO: 135582 - DNA, 1051 bp, Homo sapiens
atttgggatgtgtgttgtataccctgggctgatttagaactttaatgctttaagattctgacttcttagaacaagcactaggtttccttttaagagaacactgtacatctaccattaaaagaaaaagcctccattcattggccagtgggttcgccctgcgaggctcatttaacacatggttttgactcccggctcagtcaagtgtgctgaacactcaagagatctaagtggtactccactgagactgtcttgtacatgtccagtgattgaatagctcaagtcatcatttcacaagggactaactcctgcctgtacactcattttagctttcataaacacttgaaggaaactagtgtctgcaggaaatccacgggctgctcctgtagctttacattgttgggacccagtagagtacctggcggagtgagtcttccttaaagggttttggtgatgtcactgagtgtgtgtgcgccaccacatgttaatggaagtgctgaacttcatactgggtattggaaagtagatagtaaataaactatatattccactgtatgtctctaaggcttttctcatttgcagatgagaacatttataatgtgataatttatcatataatataattattttggggtagagacagggtctcactatgttgcccaggctggtctcgaactcctggcctcaagcaatcctcccacctcagtctttcaaagtgctgggatgggtgtgaggcaccgtgcccccatgcctggctgtctttattttaaaatctgatagcccatgtgtattaccaaactttggtttcttctgaagtaccagttatttcataaatagaaatttacttagaccacagttctcaaacttgtggcctgtgagctatagaagacttactatgggcctgcaggcatgctttgtttgacccacccagcaccaacacttaaaaactagagtgatttttggctgggcacggtggcttacacccgtaatcccagcactttgggaggccgaggtgggcggatcacttgaactcaggagttcgagaccagcctgg

SEQ ID NO: 135583 - DNA, 1024 bp, Homo sapiens
agaccaacctggccaacatggtgaaaccctgcctccacttaaaatacaaaaatgagtcaggtgtggtggcacgcacctgtaatcccagctactcgagaggctgaaccacgataattgcttgaacctgggagacagaggttgcagtgagtggagattgcatcattgcactccagcctgggcgacaaagtgagactctgtctcaaaagaaaaaaaaagatttctggtttccctagaaaagatctggccacactgctcccacagcctgcacagcgataatcagcaggagctgagtagctgctgcgtttttgacatgaggcattcacactctccgggttgtcttcattcccgccatcttgctattgttttatactgttctttgggatgcctaattgacagttttttacttatctttttgtaaattgtgagtcagtcgcctctggtttttatttgaaatttctaatggaaagctctggattgagagttaggaggtctgagttgcctgtaagccgatgcatgaccttgggctgggttgggctttcctagcatttgatctataggctgtttaaagatcttccgtggaaaagagatcatgggcagttaagtttggggaatgcaggattaaataaaggtgaattggcttctttactgtaggacttctcagaacctttaacatgcttatgtgcattaactcctacagggtttagggtgtgtttcgtaaatgtcctgaagttagatcacttcgtgccctctttccatggaaccaaatcacattctgtgcatcaaacgtcaggaaatgtggagctagataatttcagcagtcccttcaaacccttagacattcagagcatccatctaactggatctggaaaaagctcaccatgttattttggttcttgtgctttcttatgttatgtctgctgtctattcatactcccttctctctccttttctgtgtagtctttattctgataactttatcttagaatcatcccaattgaaaatgttctgcatttggagttttatt

SEQ ID NO: 135584 - DNA, 1149 bp, Homo sapiens
ataatcccagcactttgagaggccaaggggggcagatcacccgaggttgggcgttcgaggccagcctgaccaacatggagaaaccctgtctctactgaaaatacaaaattagctgggcgtggtggcgcatgcctgtaatcccagctacttgggaagtcgagacaggagaatcgcttgaacccgggaggcaaaggttgcggtgagccaagatcatgccattgcactccagcctgggcaacaagagcgaaactccgtctcaaaaaaaaaaaaaaaaaaaggatactaattttctggtagagacacatttttgaaagtactaaagacaagttattattaagaccaaaagaaaactcacttaacagtgaaaagtatttgtgctcttgcggtgctgccttccattaatcaaggtcaggggagaaatgggataatagccctttaaagaggacacttgtctttctccctcagatagagccatggtttgttactgagtgtttaaatctgattctctctgtagattgctgctaaaattgattcaattcctcacttgaataattccacacctctagtggacccctcagtatatggatacggagtacaaaaacggcccttggatgatggaggtaagttgccagaaatatctttgcctttcaggtggtagtgaacctgccagttaagtttgaatttgtcagccattaccttaacgactctctgaagtgtcactctgttgagaagaaaggttgaagggaagtatttaggatgatttttctcagcagttcttcagcatttgagttcctatttgccttgataatacagaaatcttttcgctgggctctgagataaagacttggcccctgagcatcagcttggaagtaatttgacctatttgagaattttgtttgatttagcctaactcccttcttcagtgcgcatgggaattgaagttcccactttctccacagaaaagctacgatttggtgcatggctctagggaagctgtggctacatcttgaccttaaagaaagagaagaatggtgacctttctgcagtctagctgccagctttttcaccattcccatttatgtcaggctttttctagaagcatcccttttctttaattcgtttatttgttgttttgttggctggtttata

SEQ ID NO: 135585 - DNA, 1044 bp, Homo sapiens
gccaggctgctacacaggaggagcacaggaggtgcacgggaggagccaagcgggagggcaggcaatggccaggttgcaagatctgcacctccctggttactggaggaatgaaactggttggactgactgcagggagaggctccagttgaaacatgagagaagtactggatgaaaaaggtgccacaactgagaccagaaggcagattcctgaactggtggggtgccaaggatgcatatcaaagactgctggaacatgtgggtatcaagattgaagacagtgaaggttaaaatggcctgatccaaagctggagggcggtggagtgactggtgactgctcttcccacggacaggcattcaggcaagctttcaaactgagctctaaattctgctctgggttctaagcagactcatgaacagcgttctgacaagtggctcaaaactgccactctctgaaacacaactaacccaaatccctttctatatcaggaacaaatcctttcccttgttccactgcctagcatattaaaaaaaactttacatatatatatatatacacacacacacacacacacacacatatacttatatatatgtgtatatatgtgtgtatatatgtgtatctatatatgtatatatgtattttttgagatggagtctcactctgttgcccaggctggagtgcagtggtgcgatcttggctcactgcaacctccgtctcccaggttcaagtgattctcctgcctcagcctcccaagcagctgggactacaggcgcgtgccatgacatccagctaattttttgtatttttagtagagacggggtttcaccgtgtcagccaggatggtctcaatctcctgacctcgtgatttgcctgccttggcctcccaaagtgctgggattacaggcgtgagccacagtgcccggccttatttatttttcggaaatacggttttgctatgttgcccaggctggcctcgaatgtctgggctcaagctttcccaccacctcagcctcctgggtagctgggattacaggtgtgagcca

SEQ ID NO: 135586 - DNA, 3876 bp, Homo sapiens
gatttgtattttttcattgtctgctgactgtgtttcctgagctgcattttccaaaagagaaacactacagaatcatttttgctgatggctggtgaaggagagacactcatcaatagctgaaagaggagaaactggaacaaaaagtgtagctaaagtggttttgtgggaatgtgattacagagttggttttaataataagaggctgtttggcaccgttgtctttgtgaaatgggcttgaaaggcagttgctcattcttagtgtccgctgcacatggactgctctggtgggtccgtgacgaggcctgtggaggtaggaggctggatcctctccttcagatgcttatggtcttgggggtgggggggccggcgaggggggcaccagggggcgtctcctcccccgtggccaggaggagcatatgtgcgtgttcctcatgactacagctgctgtggagcagtccttaacaatgcatccaaggagggtaaatcttctcatttgtttttaaaagagaaagaaggatctctttccatctttacattgagtttggatccagagcaggagggaggtaggaagttagagggatttaggctagcaggattttctcccaggcctcacagcatgtggacacacagatcaatttcttatcctgtgttcagctggacactgggttacagactgtgttgatcaagatgtcccctcctgtttcatatcatataacgcattcatttcagccactgagcctaaattactgtttgctttctttctgcctttcttttccaccccacccgaaatggtaagaatggtaaggatgaagttagtttatccgtgctaatgctttgattttttttttctctttctctttgccacagtaggtaaccagttaggggccttggtacatcaaaggtaagcagtgggttacgttttattatttattgatcatttctaattgtttattgatccaccatctgtactagagtgctagaaagtcagaggttgagaatgtgaaaaagcatgggttaggcttctttaagactcgagttttttgctagccatttctaagatagtgtcagctcagggataaactaatacaaggcattaaaaatcagccattattgcagtaacttaaaatacttgtagaagattggagttgctctttctaccaatgtacatttaatttaaaaggagagaatgagattttcccacctggttttgtggtgttgccagtattttattaatccttaaccccttcacctgagaagagacacctcgaagtgtgagggtcagacactcacaagagaatgctttgggtgcccagggagtatgggtgggtggctagtgcgtggtgaggaggccagaagccagggttccatccttccgaagtggtagggacttgccagagagcctcagcccagctaattctctgtttctgtgtcccctcatagccttctgtcaaacgtagaagatttagagagatacagaaagagccctgagttttacaaaggccaatctgtaagatggggtatgtgtggtcatagtgtatcgcccttcaaacagggaaaaatatacaagaaactgccacagtttctcttctggaaggatgaattttgtgctatgtatctgttgctgtaacatatccttaaccttctatcagcaaaacaattctgtcatcttgtattctgcctaggtgtttgggagtttctagaaatcaccggtcatcagttaaacaaaagttttatcctggggtttttttggtggttgttgttattgttgtttctttgtttgctttgttttgtttgttgatgaactgaaaaatttaaatgaggtgatcgttagtatcaaatgctgactttcctataaagccataactagtcaggattttcttttccaaggtgtttatattttgtaccttggacaagtttcagccttgcatttagattagaacgttttcttcctggaaacccagagcagttcgtcttggaatgtttcttcctcacagttggctaaagtgttccttagggccaagggctgcctgggcttcgtgacattttgtattgcagtagtgttgaagcccctctagtcaattcccaggtaatattttctgagagtagacagaatagacagctcatgctacacatggtgtgagcagcagcctcctggccacacgcacaagagccctgtcatccctcataacaaggtcaggaagcacatcctgacagggacctggcttctgctgcaggacgtgttgggacagcagggcttggcattcacatccatggtgttactgattaggaagctgggaatgaattgcctgatttggggagaacacatacatcgcaagaggtggagagaatcccgtcttgttcataagcttgagggtgtaaactccctcaaggagggagggagaagactgtttgttcccatcaaaatgatacagtggcaagtgctatttatgctattgcatttcttttaagtgatgcactttccctaaaaatatgcacttattcaatcctttctgtgatgggtaaaaacccagctgtgtgagagatgtttaaaaatgcttgccttttttttttttttaaactacttgcatttagcatcctcccaaggtaaatgttgagatttaattgctttctggggtgttgggcaaattggacattgtccacaatacactttatggcagatttgaaggtttgttgaaaaaagccagtgcagtagtagtttaaaaaaaaaaaaggcacataatggatgggatagcatttaacagaagtaccttgcagagtaagtgaggtaattattctgttctggtcaacagtgattacgcctccatcggatactggttccatttggggcgtctcaccgttaaaaacatccataaattagaagggaggccagaaaacaataaaaagattgggaaacaagggatgttgaagaaaagatggatatctcttcatctagagaggactccacaatagaagtctaaacatctcccaaaaccctggaggacctttcagtgacctgggattgatggcccattggttagagagcacctaaccaggcagaatgaggcaacactgagaggtgctgtatgaagaaaaggcagctgttagaggaggtgatggtttcatgaaaaccctgaggtttcttcctctgacaaaaggagatgaaaggcttagatctttggaaggagtgattgaccagacggttcattacgtgacactctttgtaggtggtggtggatttgttggccaaattggcctgatgtattttaagcttttatcatgcaacattgccagtatgggcagtttggggacctaaaatggctgcaaaagtctgtattctgtatttttttccaaaatgttctttgtttttaggacggtaataacggaagaattcaaagtgcctgacaaaatggttggatttagtaagtatccatgttgtctactttttccctgattcctgtctcttctttttctctctttttttctgagctgctttgccaggatgttctttttgttttaatctctcttgtgagtatcacctgtagtagaatgctttgcacatgccattccccacagctctgaaatgctgcaggtctcttcaggctgagggagaaaccagagcactggactgtggatgtccctcccttccccacctctccccacctcagctcagatcccctctgcctgtaggctgtttcacaagggctttctgctgccatcatgcccaaagagtggagatgggctcacgggggccaactcgatgtgtagtattgtgagccaagtgtcacagtttgtggaattaattcagtcattcctgcgtggtgaaatatggaataggggcgtgtattctgaccctgttcaatttgtttcagttatcgg

SEQ ID NO: 135587 - DNA, 1068 bp, Homo sapiens
cttaaagtctcttgttctgccatcacattgcaagcagtgaaccataataaatatcgctggcaggtgtgcattacagggcaactggatggtttgctggagtcaaagcatttttcttccaacacaggttaatctagtacacaggcaaaatattaaaaagctgctgtaactgggaagatacacgaagctgattctgtacacaaaggctcaagactacaaaaggcaacatctatttcctgcctttctcttctttcttcctactcttctaaccattcctgcttcctgtctacccaaggagcagaggcagtgggattataactttaggaggaaacaaatttcattgtcttcagtgagcagcacagctagcctgtttagtagctgaattcttctccattagagaaaccaaaaagcagattgtgtgtggcaatttagagaatcaatacgagaaataacaaccaggagaaattctggtgcagaaaaggaaattggcacagcagatgactttggtggtctgggctgtgctgtcacaacattgcagttgccctctcccgctgcccaagaaaccaacacaaatagcaggacacgtgacacgcagggtcccaacttggctgccatggaaagcccaaagcaggtgtctgtgagtgcacagctgcatccagcaccgcctccccctttcccacctcttggaaccaaactgggattcatagccttagcttaaaagtcatagagcagtgttgttggttatgaagaagaagcgtggagtatgggagttcagacagtgagtactaatccttgcttgctttcttcccatctttctcattgctggctctctctcctgcctgcatttatttaacaaatgtatatattgagtctactctgtgagaagggtcatgttggatgggggaacagagagatgtaaagggatgaaagatggtctctgcctccagagcagctggcatcctaataggagacgacacctttgtggagacacaagcatgagcagagggcaggcttgaaaggggcggcaaggctctgtgtcacagcgttggtactgtggtgtgtgttgctttt

SEQ ID NO: 135588 - DNA, 1750 bp, Homo sapiens
ggaggctgaggcagggagaactgcttgaacctcaggggtggaggttgcagtgagccaagatcgtgccactgcaggctgggcaacagagcgagactccatctccaaaaaaaaaaaaaaaaaaaaaagtgtcctggccagacacagtggctcacgcctgtaatcccagccctttgggaggccgaggtgggcggatcacctgaggtctggagttcaagaccagcctggccagcaaggtgaaatctcatctgtactaaaaatacaaaaattcgccgagcatagttgcctgtgcctgttttctcagctacttagaggctgaggtgggagaatcattggaacccgggaggcagaggctgcagtgagctgagattgtgccactgcactccagcctgggcaacagagcgagactcagtctcaaaaaaaaaaaaaaagtgccctttaaaaagacaggtttgtgaaaagttctgatgtggtttggtttctctgtgcctaggtatctgtgcctaggtttgctgtggggattgtaataggaagaaacggggaaatgatcaaaaagatccagaatgatgctggtgtgaggattcagtttaaaccaggtgggtatgatgatttaaaaatccttagtgttaaaaaaaaaaaaaaatccttagtgttaaaaggatgataaaacaccttacaaaacaagggcttggctattggttcatgtgtattcacctttctcatccttgcaacatcctgctaccagatgaccaatctcagtttcttctcccagccttcttttccctccccggatacatgtcggtcacctttgatttccaggccttttttcttttttcttcctggagtatatgcatagtatgtcataaatgcatagtatgtcagcttctgattttgccaagtaaaattttaaaatatatatgtataattttgattttattaaattggagataatttaaaaccacacacaaagacaaaacatcttagaataaaggacaaatttttaaattttataaatttgccttaatgagcaaaattttcgacgtggtctgaaaagaggaaaacatggcaggctcttctctggaagctgttgccatagctctgctctgactcccttggcttttttaaagtcaagctttgttttagttctttaatgatacattttttaaatggctataattgcataagaattgagcattgacctgaaacatgcaaaacaatataatgacacacattttcctatcacccacatcactccaaaagagtccctgcagctggcagtattcctgttgccccttttggcaccgcgggtgagaatattgattgggaatcagattaatccttgtttccttctaacgttgggcttttttctaatcctgtctctcacctggctcctcagatgatgggattagtccagaaagagctgcccaggtcatgggccctccggatcggtgtcagcatgcagcgcatatcatcagcgagctgattcttacagcccaggtgggtccagctctgcagagtgtgagtgtttgggctgcagaagtggaaagtgctacccggggctctcggtgcagcaccatagagctgtcaccctgaggcgtctcaagtcacattatgggaaaccagcagtttctctacatcagcctctttcctgccttcttggtatttttttctgctcattaattattctgcctttatttacctcaccatctagattgcctttacacagtaagtttctggctatttaaaccatgtg

SEQ ID NO: 135589 - DNA, 1077 bp, Homo sapiens
gataacatacacggtgccagccgataagtgtggcctcgtcataggcaaaggtaagaggcagctggggtttcacatcccccctcagctgtttggcttgagggaaggcaggtcacgggacctccagaacctttggtgaggtccctttgctgctgcaggctggggctgcccggtctggaggcagtagccaccttctgccgaaaccctgcttggcatggttctctgaggctgctgacgggcctgttgtgaggagcaaagtgtattatttctggtgagtatgaagagacagcagtaaaactccctgcctgttgagggcagcttagcttggtgaaaagataccttgcgcaagatggggggcatttgtcaatcgactgattggtaattaactcacctccaaggaacttagagggacggttgagacagtatcctcagtgaaaattccttctcgacagtgtgtcacttgtttcccttaccaggtttgagtatttggtcttgatccgcgtaacatgtgaaaatggtttttatcctttctgcatatttaccgtgagtcacggactctctgtggagggaaataaacattgatgtgttagttttttctgggcattttggagaacattaggaagaaaccctcattcatggctactgtagctccttcctgtccttcactgagaaccaggagagagcagccacatttctcagccattggcagcagttcatcttggctagccctgggacccagaaaggctactgagaccagggccgaggctgtggggccttcccagtgtagcagcagggctcggcttccgtggggctctgagccaggcctcgctgccagcgggggactcccgttgtcactgggtttcgtatttgccttcattaggtatttgacagcatgtggagaaaacagtcgtctctccagagtttctcaaatttctttgatcaccaaataccccttagctgcttgaggggcgctcgtattggataggcaggacttggggatgcttcaccagcagagacctccagagctgggcaggtgggagccccccgacactcacctcccaggagctgccctcgtccctg

SEQ ID NO: 135590 - DNA, 1029 bp, Homo sapiens
ctggccaagtctctattctttattgctccccaaaaaacattgcctaggagcctgcttttcatggtgcagagaagataaaatccatggcctccgagtaaagggcagaggtaaaggtcccctaggaggggcttgtaccggcccagaggaaatcagagctgtgggtgctggcccggtgtccccagacaggcgggtctggccagggtggaaaatgcagggatgcttctctgaaactccagcgggaccttaaggaaatcacaagcacaacatttggttttgttagttgttttttaaatttaaaaccaccctaaacttaaccaacgtcttctgcatgcgaccttatctgcatgccatgtctcccggcgtcttttctcccccgtaagggcagcccctgctgccttcaggaaggaccacctgcctttttcattcctggacctctgtagagtccttgcaagacgcccttgtgtctgcctttagcgtcccctccctactggcccgataggctgttgaggcagggcttttctggcagtgggtagagagaagcttggagtgtttggaggattgtggacggtgtcttggtgaggtgccacatggcatttagggcctgtttttttgactgtgggcatggaggaggggccgacactggccccggtctttgcttttgatcacccaggctcgctgctgccctataccagctttggagcagattacctttttctccacttttccaaactgtgctccaagttatccttgtattctggctcctcctagcaacactccatcccccacagagttgagcagagcagatccgcaagttctgtgaatttcagaagaagaatccaactattgttacgctgctggagcttttattacgcaaatttcattaagagactgagactctccgcaggtttttgaaagagaccaactgaatttttgttagcccggctccacccaggtctttgtgacctccaccccatccttgcactgcctgtgtagaccgtcaccccatggaggaggcagggacttgagaag

SEQ ID NO: 135591 - DNA, 1847 bp, Homo sapiens
tggataacatttcagttacctcctggccctggactcagctggttgggcctctcactgccaaattggccgtctgggtctggtcctggggaaacaggtgtcagggctggtggtgatggaggagaagcgtggctcccactgtccgctcttccctgccccaagtccctagtggagagagaagcccaagacctcttcagcagaggttttgtctggcccagctcccgtgacgcgagacctgggggaggtcactggcacacagacctgagaacctgccatcacagactaattcctcttcccttccgcccacaggagcagtaggacagcgtcctcgtggccaactctcccctcaaaatcattgtcaaagaaaacctatttgtaacagaggtttttacatttgcaaaccttttgatgaagaactgttgttttgttctgtgaaacactatatttagattaacggaatttttctaaaaatcaggaaaattagttactaaaaattgctgatcatttttgtttcattatttttgttatttcaaatgtataagctctgggattctttttggagcaatacctacaaagtcaggcaccagaatgtgcctcagagctgtgacatttcaacatgatggttttggtttggtttggttttgtgtcctttttatttgcagttttttctgttgcaacagaaagtggcttggaagtcttaggtggtatgtaacaaattctttttaaaaattttaaagcagtatttaagtattcttaaatgtgtaaattcatttaatgttttacttctaatttcttgtatcttggctgtctggttttattgcatttttaaaaaaactgaactattatgtattgtaatgaatgatgtgaattctgaactgagacagataattgtattgctgtccaacaggggttgggaggggcattttgtagggtttgtataatttctagagttcgaaaggggtaatataaaaatgtgctcgtgtgtttagcctacgtttttctcatgcctccattaccagttgcaattgtgtatctaagacctccaagcttgtttttaaaacaaaacaaaaaacctttctctattatctcagaaatataaatactgttatttttaatattaagaaattcaatataacttttaacacacactgtggaacattaaaccgtataaaaatgtagttataactatttttaattccaaggtgttgtttgcttttttcttttaaatattttcttaatattttgtcagattaactagatgaataaataaatctagtattaaccgcattatgaattaaataattttgatttaatgaaagggataatatgatttccagtgtttactgtagtgtatcttgtacagataacatgtatttttaaaggaaaaaaaacggaattgaagctattttttcttgcatttctaattgacctgagggacattccgtttgaaatgtactgaagttacagtttctggttttttctccttatttttcttataatgcttgaaatgtctaactattaaaaaagacaattggaaaatgttatgcatggggtttttaagaaaacaaagtgttctttttatttgactgacaattcattttacactctatataataaaatctccacaaggcatcttgtgggcaaagtctttctggcctgtttgctttccattcgccggttcatccctctgcccctgcccgcggccgcccgagagggaaagaggattcctgcgggcctcgcccgtcatcttgcaccgcgtccacccgccttcgttggtgcacagtctagatgtctagctagttcgttaagctaattttatgttaatggctctgtatgatttgacagcttga

SEQ ID NO: 135592 - DNA, 3165 bp, Homo sapiens
aggaaatcttaagattcattctttcattaatgctttcaacatatattttgtgcagttgggttattatggcagagtgaaaaatctctgtcctggtggagttctaacagggagagatagataataagcgcaatgaataagttattcagaatgttaggcaataatgcaatagggaaaaaagtggagcagggtcaatggtatgtggggggaatggtggcaacagggtgggctgtgttttcaatggcacagtcaaggtaggcctgctgcagaaagtgacacctgagcagacctgagtgagaggagtgatgtccaagtagctgtctggagaaggagcactgaaggcagagggagcagccagcacagaagccacgctttgcagggggagcctgttagctttgaggaacacgttgttcttgaagggagagaagtcatttcgagttaccctcgtatcctttctttgtatcttcgccttgcatcaggggccatggaacgtatatgggagaagagaagctcattgcatctgttgctggctctgtggagagagtaaacaagttgatctgtgtgaaagctttgaaaaccaggtgagaacaaaaggtgtgtattccctttcttgcagcatcaggttgtacaaccaggcttttcctgccccctccttatcccccaccccacccctgcctgccctgtcatgctgtaagtctgaggttttgaccatgactgtaggtggggtggtgcagatcagtgcaggcttcagaggtttccccatgttatgtcaccactccaagccttggttacctcctctgcaaagtgagtataatagcatggcctacttcataggattttctctttttttttttttttttttttccgagatggagtcttactctgttgccgaggctggagtgcagtggcgtgatctcggctcactacaaccttcgcctcccgggttcaaacaattctccttcttcagcctcccgagtagctgggattacaggcgccctccaccacgcctggctaatttttttcgatttttagtagagacagggtttcaccatgttggccaggctggtctcgaactgctgacctctgatgatttccccccacttggcctcccaaagtgctgggattacaggcgtgagccactgtgcctggcctaggattttctttagaattcagtgagatggtgcctgtaaagtatttagcacagagcctgatacctagaagcattcaatgaaggttagccccagaaagcaagccagtggggttggaacagagtgagtgagggggagagaaggggcagatgtaagcagagagctgaggtgggcgggcgtgggcctgccttgtagccagagtaagcattttggcttctactttgtgtaatctgggaagcactggaaggggtggagcagaggagggacttgatctggacttaagctcactctggctgctgatgggagattgaagggggatagggcaagcttagggaggtggattagggaccatactcatgatctgaagtgatggtggcttcaactaaggtgggagcagtggaaggtggaggagtgattggaatctacacagattttattttccgagtgtttttttaaaatcatgaaaagctgttgggttttgtattctttgggctttactgtgcataggaccccgtcaactgtgaatagaaataagtttacttcttcctttccaatttggatgccttttatttcctgcatatgttttaagggtagagccaacaggttttgctactggacttgtcctggagcgtgagagagagagaggaatcaaggaactctccgaggtttttggcctgagcaactgaggggatggagtcaccgttgactgagatggggacaactcatcccctatctcggtttgctatggaggactggagggggctgcgggaaagcttagttttgtgcttgatacatttgaaaatgcctgttagtcatctagatggcagagttgggtagctagcagttgagtaggatttggaattcaggagagtggcacagtcacagcacagagtggtgttttaaaggtattagattgagtggccgaaaagtgaagaggtctaaggacttagcctcagcactgagtacgtctcattagaatcgcgggtaaggaactagcaaaggggcttgagaggagcaggcagtgagtaagtggaggagacgtgagcagacttgtgtggttggagtcctggctcagatttcctttctcttcctttggctggtgcagaactcatccatgtgccacaggaaaatagtccgtgtttttcattgtcgtgtaatcgaacaaaatagggtttttgggctaaatgaactacttggaatggtgatatgtctaaggatagttaatggagactttatacgtggaggaatgtttgaagttagcagtttctgaaagtaagtccagacaatatagttacatgaatttgctgaatgtggcgcctgttccaggctttcaccctgttgaaccgacatctcaaatggtgtgtggtcttgtcagaaagtctgctcacagatggatgaaccccttgtgttttgtctttcagatacattggtgaagtaggagacatcgtagtgggacgaatcacagaggtaacgtcgatatcagattggtgtttacaaagtcgaggcaggctggcgatttcattcatgggacagtcattccacttgtagttacatgaaaaaggcattcattgcatttggccgttgtgtggcttctgatgtaaatatgtggcttgttcgatttcagattactggttcatgtttttttttttttgagatggagtctcgctctgtcgcccaggctggagtgcagtggcatgatcttggctcactgcaacctccacctcccaggttcaagcgattctcctgcctcagcctcccaagtagctgggattacaggcacccgccaccacgcccagctaatttttgtatttttagtagagatggggtttcattatattggtcaggctggtctcaaactcctgacctcaagtgatccaccagcttcggcctcccaaagtgctgggattacaggcgtgagccaccacatctggccttactggttatttatgatatgacacatgaacatggagcatgtgtccaggtgtggaacttggcttataggttcaacagaagaggtgga

SEQ ID NO: 135593 - DNA, 1956 bp, Homo sapiens
cagtgaatggtttggtgtttgttggtggaggtggcaaagttgcagggtaatagccgaagagccagtgaagaagccattctttttctgtttttttgtttgtttgttttgttttgttttgttttgagacggagtcttgctctgtcgcccaggctggagtgcagtggtgccatctcggctcactgcaagctccacctcctgggttcaagtgattctcctgcctcagcctcctgagtagctgggattacaggtgtgccccaccatgctctgctaatttatctatttttagtagagatggggtttcaccatgttggtcaggctggtcttgaattcctgaccttgtgatccacccgcctcggcctcccaaagtgctgggattacagacatgagacactgcaccctgccccattccttttaatctcccttggaattagctgtttggttgatttggagttccagggtgatactgtctgagtcataaatgatttatttgtgaatttctgtggctggtcacgtattttggtcctgtttgtatttcccttcccctctctgtgtctccttatagcctgtctctcttgctgatcgagaggtgatatcccggcttcggaactgcatcatctcgctggtaactcagaggatgatgctgtatgataccagcatcctgtactgctatgaagcatcccttccacatcaggtactctccccagggcctctcccttcttcactgatctgtgagctgctctgttgtttgttcagagacaatatgcacatctccccaatactttcccaacatccgtcagtatgaactggcctgaaacagccttaatgagtgtctggtagatctttccctaagaaacttgcaatattctcaatgcctagtgtcagtctaaggattttggggcaggaggtgtcaggtgggactagtttatgagagcaacctctggactacatcttacctctcccaaatttcagccagcttttggatgaatgtcagaataatatctttgttcttgtcgactatatcccagagcatcttgctgatttattaggctgcttctagcagatcatatcttgtaacgcttagtctctgagacatgaaaggaatacagaaagtttatgttaacggcttgatttatgtttggattggcttggtggtctgtttatggttggtttcttttctgaacaaatgccttttccctttttcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccatatgtggctcagcaaagactcgagagatcatccctttgtctgcattgacggccctgtgacggcctccagcccacaggcctgctttctcctgtcctaacaccaagcctgggtggcagatgaacagtgcttccttgggttgccagctgagtcccggtattagggaatagtttcagctctttcaaagtgcacagtgttacagtcgaatgggctcccatcctggaataatatggagaatcctttgtcttccactcactgtcattcacaaggcacagtgccccatgaaattgccccaatagaaaacatggcatccctgacctccaaatggtctgttttggcctccattcctatatcctttaaatgactgagaatgcagctggtaaagttggaagaataaagttaaccaagcaggccaggcacggtggctcacgcctataatcccagcacttagggaggccaaggcgggcagatcacctgaggtcaatagttcgagaccagcctggccaacaaggtgaaaccccatctctactaaaaatacaaaaaattagccaggtgtggtggtgtgcacctgtagtcccagctatttgggaggctgaggtgggagaatca

SEQ ID NO: 135594 - DNA, 1026 bp, Homo sapiens
agggcaaactcgctgaaatctgggtgacccgtgtccttttccggagagcaaagcagagaagcgagagcggccactagttcggcaggaaatttgttggaagatgaagaagctaagatagggggttggtgacttccacaggaaaagttctggaggagtagccaaagaccatcagcgtttcctttatgtgtgagaattgaaatgactagcattattgacccttttcagcatcccctgtgaatatttctgtttaggtttttcttcttgaaaagaaattgttattcagcccgtttaaaacaaatcaagaaacttttgggtaacattgcaattacatgaaattgataaccgcgaaaataattggaactcctgcttgcaagtgtcaacctaaaaaaagtgcttccttttgttatggaagatgtctttctgtgattgacttcaattgctgacttgtggagatgcagcgaatgtgaaatcccacgtatatgccatttccctctacgctcgctgaccgttctggaagatcttgaaccctcttctggaaaggggtacctattattactttatggggcagcagcctggaaaagtacttggggaccaaagaaggccaagcttgcctgccctgcattttatcaaaggagcagggaagaaggaatcatcgaggcatgggggtccacactgcaatgtttttgtggaacatggtgagtgcttttcaaaatttctgctcatggttttcctcatgcattcatcttaggccttcaaggaactttgaacaacagtacttgcgacagttccttccaattccacttaataaatttgttactgtagttatctcttagtggaactttctttgtataagaaaaagttacttcgtgacttcggctttattcaaaatctatttgagttgcttatttcttgcctgattcctctgctaattcactgttgaccttggacaagccactttactgttccagggctttagtttcctgaggggctggacttcagtggtttcttagggtccctggttctatg

SEQ ID NO: 135595 - DNA, 1033 bp, Homo sapiens
caagttcctccacccttttctttttggccagagttgatcattttcagaattcatcattttgtcaagatgatttttttgttgttaaatatgaataatttgctttcctctggacttctaaggcttcctgaaattacatgcaaacatttgtgcagtctcatgtttggttattggtttttgggtttgctatttttgggcgaggaggtccatatccttcatcagcttctcaaggggttttttcagaggtacaaggggaggctttggtttggttatgacagtgctacagccagcaacccgggggccacctgggtgctgctcccccacttcaaaacgtgtagctagcaggatggaaatcctgtctacatggaaatccttgtggtgttggataggccatgattcatttccctaagcctcaaatgcttctattgtttgtagtttttctcccagaatcttcatgatccatttttgtacattcttatggccttacgataaattcctagaagtggaatttctacatcaaaagaatagaaacttttaaaggtttttgatacatattgccagttgcccttctggaaggtctactgggtacgtcagtgtacctgagtgttaacagtgacggatcagtattcatttctcttataaggaaggaaatgaaagtcatttggtaacgtagaggcacaattagacctgacagcctttgtgtttctcttctgttctttaggccccccagttccctttgctgctttcttctttatgccacagatttaatgcttgaacacatattgaaattttggaaagttactgtgaatctaatggggcataataggcaggttttcttaatcctggcaatgaccaaactaatcacttgtctgtggtggcttggtggaaaaacggtttgtcagcagaatttggtaaagaagcagtcacaaggacagggtgttggtctcatatttgagtgcttccctgaggaaagaaaagataaagggaagaattgggtgaattcatcagactgtatttggcagatggagatgaagtg

SEQ ID NO: 135596 - DNA, 1008 bp, Homo sapiens
tggccaggctggtctcaaactcctgacctcaggtgatctacccaccttggcctcccaaggtgctgggattacaggtgtgagccaccgtccccggcccctagtcttttattgtattgtattgtattattttttagtcaggtttattgaggtataatttacatatcataatattccccttctttattatacagttctatggactttgacaaatacatacacttgtgaaattgccaccccttttgagatacagaacagttctatcaccccctagaattcccttgtgcggcccttttgtagtcatcctttctctcttctcccagctgctggcaaccctgatctgtttttttgtccctgtagttttgccttttccagaatgtcatatcaatggaatagtacagtctgaagcctttgaatctggcttctttcattcaatataatgggtgaggagtcaaccacgttgttgcatgttatccacatttcctccttttgtgtctctgagtagtattctcttgcatagatgtaccacagtttgtttatccattcaccagctgaaggacagtgctccagggtcctagagcacagaactctggctttgttgtctttatttctaccagttgtctctctctctgtctctctctctctcttttttttttaaaccctagaagattattaagatttataagactgggtatggtggctcatgccagtaatcccaatgctttgagaggccaaggcgggaggatcacttgaagccgggagttcaagaccagcttgggcaatgtagcaagaccccatctctacaaaaaattgaaaaattagccgggtgtggtggtgcacacctgtagtcccagctactcaagaggctgaggcaggaggatcacctgagcccaggagtttgaggtgatagtgagctatgactgcaccactgcactccagcctgggccacagcataagcacttgtctccaaaaatgtttaaaagattgacaatacagtcttcttcagagtct

SEQ ID NO: 135597 - DNA, 1870 bp, Homo sapiens
atttagccttttgaaacaggatacacagtagggtgattggtttgggagggcactggtacagtaattctccacctctcacttgcccgtgtgggtgccccatccccaccctcaggcacacacgcactcttagctgcttttggactcctcccgcaatgtcacaatagttttctttgaacattcttgaccctcagtcatgttgacatgcgtttggattttcagtggagaagaattgccagagaagaatcttcctctgattttaaccattgaccatatttatatatgcagtttcagcttgacttttaaattgataatcttttaatagaattccagataacatcttactgtaacaaacaccaaggggattatccaaattcctatttgaaaatatgtcttttatattaccagatttgccagctgcattattatctattagtgtgtactaaaagtatattattttggcttattttgagattagataattcccagtggaattctccccttaaccatctaaatctgtattttttttttccccatttagtttcctaaacagtgaggcttctgggcaggaaatgagagaagaggaggaggtaatatagaataatgcagtggctttcaagcattgtgacccatatgaggaatacatattcagttatgacttagcattcacatatgcacacatacatgtacgtatatacatcacattcacacatatgcatatatgtacatatacagctgaagaaggtctggattagtacttttccttattgtggagcacagtgagtgatattttctttttctttttcttttttttttgagacagtcttactctgttgcccaggctggagtgcagtggtgtgatctcggcttactgcaacctccaccttccaggttcaagcagttctcctgtctcagcctcccaagtagctgggactacaggcatgcgccaccatgcctggccaatttttttgtatttttagtagagacggggttttgctatgttggtcaggctggtctcaaactcctgacctcaagtgatccgcctgccttggcctcccaaagtgctgggattacaggcgtgagccactgtacctggccgatattttctattttatttcattttgaaaaagataggctgtgactcattagtagtggatctcatgactaagaatggatcctgacccaagtttgaagagactggtaggggtaaatttagagcctggggctccaaagtttgtctacccagttttaaatcctggctttccccttaacttgggtgggatcacaccattaaccgtgttacccctctgaagctttggctcccacacctgtgagatgtgaatgttgataacacacacccacctcataggattaatgagaacatgccaagatataatgcgctgaaggtcttagcatgcctgcgcagagccccagcatctgttagctgctgctgctgccgctgtggtggtgactgtccttgctaagatgctgcagctggattggcttcgtgggaagttgtggaattctgttccctgaggatgttgggaaggacagattgtacttaccaagagcatttattgttgtttttattttcttaaacatttccaatgaaaatcatcaaacctataaagttgaaagaacaatgcacctagattcatcaactcttaacacttgctatctctcttacatagaaacatttcccttttaccagtccacttggaaattggctatatactcacgatagccaagaacaagaacactctcttacaccatcacatcattgccacacttaaggaaatccacactgatccaggaacattatttgatatacagtccatattcagaatcctccaggtatcagtaatattttaat

SEQ ID NO: 135598 - DNA, 1045 bp, Homo sapiens
tgtttgtttgttttttgttttttttgtgacagagtctcgctctgtcgcccaggctggagtgcagtggcgcagtctccactcactgcaacctctgcctcctgggttcaagcgattctcctgcctcagcctcccgagtagctgggatgacaggcgggcatcaccacgcccagctaatttttgtatttttagtagagacggggtttcaccatgttggccaggctggtctcgaactcctgagctcaggtgatctgcccacctcggcctcccaaagtgctgggattgcagggattagccacagcacccagcttgtgcatgtgtgtttttaagaaaacgtccacaaggtaaggaaattcaagcaaccaagaaaagacgcttgataaacagtaagtcccatcttgctagtttcttctgtatttctccagggccactttaattgattctaaaatgtacattatttctcatttttaaaaaaaatctctaaaatcagggtacatcttaaaagcaatataatgccatggtttaattggcacatgatttagtgatacataaaataaaggcacctcttgcagtggcatcttcgatttgaagaagtataatattctacgaatatacaaatttctgtgtttttttgtccccccaacccctgcccttttaaagacatatagtaatatagtggggttataggtttatatactgctacttagctgtgcagagaaattacagcatttaaaaaaatcaccaatctgtcttcctcataagtcatcatctagaaatggggagaagcaaagagtggtattttggccagttaataaggtcttatattcttttggcttaaacagtatcttttgggtaaattctggattttttcatatatcctgccatcccccattaaaaaccagcatctggtcttgggggattgtgagatttttgtggaggtgagggaggccctggcctatgcttgctgcctttgctcatctagtctggtctggtctggtccctgggcctttcgcaggtatcccctgaagtgtggttggtggtcttgaat

SEQ ID NO: 135599 - DNA, 1241 bp, Homo sapiens
tctcaacattggaatgaagacagcttagggttctgctttcatgaagcttgcatgctcttaggtggagacagacagtaattaagcagataaacaggaaattatgagctagtagtgggtccattgctgagaagtaagacaggtggtaggatgacccgtgccgtgtgatgactttagattgggtggttggggaagacttcacggaccttaaaactggccttggaacgggaagcgagaactgggcacggaagatgagggagtgggagatttcaggcagagggagcagcagcaggtacagaggccctgaggccttttattgtgtctttttgcttgagcgagtaacttagagcacacgtagagaaagacagcagaagtgatcttctaaacactctgtcctgtgtggagagctccttatgtgagattttgctgtgtagtgaattaaggctcagccaaactggctcacgtgagctctttgagcttgcctgtctctgtgggctgaaggctgttccctgtttccttcagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggtaggctgggactgccgggggtgcccagggtacgtggggcaaggcgtctgctggcattaggcgatgcatctgcctggaagtctacctcctgcctgctgtccgagggcttcattggcgccacggaattgacttttccgtcttatatcattcctgtgtctttgtaggagtggaatcattctcatagtccgagtgtgtttccacatatggtgagagctgacaagcatggaggggttttggtgtaaaaagattagtcatttggagaggttttctcattttatggcaaggttcttttaaagccgtggatttccatgctgttcgtgcggcatggagatcacttcctaccgagagttaaggaggaaaaaaagatctctgagttttgaaagaagatttaaccaaaatgcatttgactcttctgtggatttttgttggctgatttggaaggcaggtgc

SEQ ID NO: 135600 - DNA, 1046 bp, Homo sapiens
attacatatgtgttatctgtactatgcacacacaggatgttttcatatatcttataaggtatttatatggccatttcttacactgttttcccacacatgtctttccacgtccatatattcagatctctccctctccctacctcttatttatgtatagctgcccagtactccatttcactcattcatccggtcctcttttgatgtgcatttggttgttttacacatttgtttggtttttgcccttataaacaaagcagaaacaaatattcatgtacacgaatctctgggcactttggctggtatttctaaaagttgaactgttggttccaagaactgtgtgggttttaaattttgatacattttaccaaactgttaaaaaaggttgtgccattgtatgctccagtcagacgcatatgggagtgactgttcctggtccccagtactaggctttgtcagtctgtttagtcctcatgttagtctcattttcatgagaatttctttacttcagactttgataaccgtgaagaaagaacaagatagaaggtgagctgtttggcttagtaattttctacacctactagagcgggactgggaaaaatatatttgtaaatgcagttcttgctgtcactgtctctctggggttttacaatccatattcctgccagcatctaacgtcttttcaaattcttaatgtctataacaggacatgatgacattcatcgttttgacttgttgcagcaaaagatggttagcaggattggaatgttgctttcattctagacttttccttgagaactgctagccccgtattgctagccagatctcatggatgatctgacttgggtttcatctgtccaggttggcagtggaatccctctgaccggccctcctttgctgaaatccaccaagcctttgaaacaatgttccaggaatccagtatctcagacggtaaagtacccatcccggggtacctgcagtggggtgaaagggcagccatgtgggactgcagcctgggtcattcggttcacttcctggtgaaagttcac

SEQ ID NO: 135601 - DNA, 1038 bp, Homo sapiens
gcagaccagctgaacaaaagcattgaggggtgtattagtctgttttcatgctgctaataaaggtatacccaagactgggtaatttataaaggaaagaggtttcactgactcacagttccacatggctggggaggcctcacaatcatggctgaaggtgaatgaggagcaaggtcacatcttacttggcggcaggcaagagagcttgtgcaggggaagtccgctttataaaaccatcagatctcgtgagacttattcactaccacgagaatgtgggagaaacctccccatgattcattgatctccacctgaccccaccgttgacacgtggggcttattacaattcaaggtgagatttgggtggggactcagccaacccatattggaggtggggggtaggccaagcatctgggttcacagaggatcctggggatggcaatggtggactccattctaatggactgcagactgggtacatgtgaagggactggacaaagccctacttcttgaagatttatggtgggatgtttactgacagcagaatctataaacctgagttttatcacgtactctcattagtaaaaaaaaaacaaaaaaaaacagaacatgcagcccatatatatggtatataaagtacgtatgtccactactgtaggagtagagtgcgtatgttatgtaccaaaacgcacatttaaaaggcttgcatgctaaataagtccaaatttgcaatacttcccgccccgctgggccatctcactcacctacttggaggttatggcgtatagactctccagaatcttccacccttcctcctcttatcggttttcctgatttcaggtggctgagcagtagggaggagaggcctctgggaacgctgtgcttattaagaacccagtgatcagcagtcatgttcatttacgcccgtcagtttcatctgaggggtattttgatagtgatctcttggtgagccgagggtgtcaattaactgctcagtgctgaaactgagtggtgcataattcattgcaatttcactctcctggc

SEQ ID NO: 135602 - DNA, 1048 bp, Homo sapiens
cagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccccgttccctccacgttgccatcagcatcctcggccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccagcggccactcaggacttcagcaagctcctcagttcggtgaaggaaatcagtgacatagtgcagaggtagcagcagtcaggggtcaggtgtcaggcccgtcggagctgcctgcagcacatgcgggctcgcccatacccgtgacagtggctgacaagggactagtgagtcagcaccttggcccaggagctctgcgccaggcagagctgagggccctgtggagtccagctctactacctacgtttgcaccgcctgccctcccgcaccttcctcctccccgctccgtctctgtcctcgaattttatctgtggagttcctgctccgtggactgcagtcggcatgccaggacccgccagccccgctcccacctagtgccccagactgagctctccaggccaggtgggaacggctgatgtggactgtctttttcatttttt

SEQ ID NO: 135603 - DNA, 1108 bp, Homo sapiens
gggtggggtgcactcgccatttcctcacgtgcaggacagctcttgatttgggtggaaaacagggtgctaaagccaaccagcctttgggtcctgggcaggtgggagctgaaaaggatcgaggcatggggcatgtcctttccatctgtccacatccccagagcccagctcttgctctcttgtgacgtgcactgtgaatcctggcaagaaagcttgagtctcaagggtggcaggtcactgtcactgccgacatccctcccccagcagaatggaggcaggggacaagggaggcagtggctagtggggtgaacagctggtgccaaatagccccagactgggcccaggcaggtctgcaagggcccagagtgaaccgtcctttcacacatctgggtgccctgaaagggcccttcccctcccccactcctctaagacaaagtagattcttacaaggccctttcctttggaacaagacagccttcacttttctgagttcttgaagcatttcaaagccctgcctctgtgtagccgccctgagagagaatagagctgccactgggcacctgcgcacaggtgggaggaaagggcctggccagtcctggtcctggctgcactcttgaactgggcgaatgtcttatttaattaccgtgagtgacatagcctcatgttctgtgggggtcatcagggagggttaggaaaaccacaaacggagcccctgaaagcctcacgtatttcacagagcacgcctgccatcttctccccgaggctgccccaggccggagcccagatacgggggctgtgactctgggcagggacccggggtctcctggaccttgacagagcagctaactccgagagcagtgggcaggtggccgcccctgaggcttcacgccgggagaagccaccttcccaccccttcataccgcctcgtgccagcagcctcgcacaggccctagctttacgctcatcacctaaacttgtactttatttttctgatagaaatggtttcctctggatcgttttatgcggttcttacagcacatcacctctttgcccccgacggctgtgacgcagccggagggaggcactagtcaccgacagcggccttgaagac

SEQ ID NO: 135604 - DNA, 1213 bp, Homo sapiens
acccggccaagcccaccactttttttaatgagagagtttttgttactgtcctcctctgacaggtaaggaagctgagaggctcagagatgtcaagcagctcggccaaggtcacacaacatgtaccagctggtgcctaccacggcagtctaatcagtagacagtgcagacagccccaacaggaccaggagagaactgtgcccagggccggatttctccctccacagtggaagagaagcagccaagtattacagccagcccagctccttgggccgcagagatcatctcaggaggcctttctaaacggagtgccctggggaagcaaactctaaacgtcctcgtacgagaagacattaggtgagaccaggctgaccacagtgtccctgtcagcactgccctcgtccctgggggtcacctaatgtcttgctcccctgcccccacactccagttgatatcactgctgtaatcagggaaatctctgagctctttttctgggagggcatttccgaggggccaaggagctgcggattggaggagcaccagcagcacagggcatgcccctgctccctacccagaagctggaaagtaccatgtcaggtttggggtcttcagtgaaatctgtcaagcagcgtctttggcactggggcaaagttaggatgaggtggcttccctcttgattactacagcagctgtctatggctgactgtccccaggagcctgttttgtttggggttttttcttaaatatttttattagtatttcaaacatacaggaaaagacaaatgttttccattcatcttgatagctaaatacctttagatctacacaccaagatgaagaccgccttgtgtcttggataaatgtaacgagcagatgctggcagctcgcaggtgctctgggctggagtagttagaactgccgggccaggtggagtgagccagcactgctcaggggagcttcatctctctgattccaaaataaatgttttctggagtctcaacttcaccctcctggagaggggtaatcttatctgtggaggagagagcaagggctgagggggcgctggggtggcatgagaggcccaaagaccttgacagacacggtgggcttggccgcggggcaccgggttaaagaggaggcttagccaagcccagcgggagttgatttgacagcagtgcccttagcagcttgattgttcggattttcagggctactg

SEQ ID NO: 135605 - DNA, 1171 bp, Homo sapiens
tcgtctttctaaaagctgaaaaatgttcaattcccaaacacatttggagcctaggagtttggattagggatgatgggactgtatcccatgtttcagctgagaaaattgaggctcagagaggttgttttgcccaaaggcacagagctgctaagtgagcatctgagcgtggacatccatggacatcagaggtcagagcataaactctttgatgtgagttccgccacccatcaactgagtcagctccacctcagcctggtgacagtgtcctggggagggctgggaagtgacattggagtggggtgcggggaggaccgtgagcccgctctgcagagcacacaggtactggctgccacctcagaaactcccttcttctggggccacgtcaccttctctcagcctatctggatcactaggtggggcttctgaatgggacgagggggaggggacaggaagccagtggggaggggggaggctgggggagctgtctggatggagctggcaggaccccaaggccacaggggaaggaatctgggacagggtggggagttgttggggagacacagtgctccatgacaaagggtatcacatgtgtcctgggaacccaggggccaaggaaagagctcagcccaggcacaaacaaggtgggaggaagttgggagaaatggccaagtttttggatttgaggtagttcctgtttactgtgcatctactgtgtgccaggccctgtgctgagctgtgcaccctcgtggaactctgcctagaaccttagaagcagagtggttctgatccttctaaaagcaaggaacctgagagcctccacactgtgaatgtagagagcgaacacacacacacatacacacacacacacacacacacacacacactccctgctgtgtcttatcccggtgagcattcttcctgttttgtcgccgaaaaccaggcatataggagagagtccacaagtgtgagtgacagggtcacctcctctgtcctgtgctctggggccagctcagcattctcttttgcctgctctgggaggcagaataggatagaaatcacgaaaggaggctttggacttaggcccagcagagccactcactgggcaagcggagtcccctctctcagcctcagtttccttacctgtaccgtacggataagagtcgccacttcc

SEQ ID NO: 135606 - DNA, 1012 bp, Homo sapiens
aaaatagttagaattgctcctcctgaaacgggtggtatccagcagtctacactgtgcccagcacttagcctgcattcagtacatatttgttgcgtgcatgaatgaatgaatgatctgcctggtacagacaactgcttggcatcattgccataagagctatttacctccaaaaggacttgctgcactcacttcttctccctgccactgccacccatcccatagcttgccaaggccttgctgagggagcggaaacaggcgcaccgccgtgccagcaggctcaccagccagacgcaagccacgctccaacaggcgtcccagcaggtgctggcgtctgaagcacgcagacaggagctggaggaagctgagcgggtacgtttgccagggcccctaccctatcgcctcctgcccctggcagcccgggtggggacgccattcaagctgtttcttcctcctccccctgaaaggtgggtgctgggctgagcgagatggagcagcagatccgggaatcgcgtatctcactggagaaggacatcgagaccttgtcagagctgcttgccaggctgggtaaggaggccctaaggctgggccctgaacccctgggtccctggggcacctctaggatcttcctgtgagctccagtcctggggaagatttcctccttgtcctcattgccatgcttcccgcatccccatctttgtggtcaatcacaagcatttataaccatgcccaggcccccttgccatgtgggacagggttggcatctagaagtgagttcactttgagtaactgtttgtgcctccagggccctctattctttggggcagggcagggggcacacagaaaactcaccattggcaagaacacccacaggcaccgggtgagcaggtgagcaggtcagtcctcaggagctgagggttcaggagaagaagaaagactgtcacggcagaaagtgtcatcaggtgctggtctgggatcagactaagattcaagtctggctctgtcccttctttgg

SEQ ID NO: 135607 - DNA, 1037 bp, Homo sapiens
aggagtcatatcaccactttgcgcctccattttctcctctgtaaaatgggactagcagccccttccttggagctgctgtcttgggcttctgcaaggatcccactggagaacagatttaaattctgttgaggaccctgctgacatgaggctgggatgatctttccctggatgagggaaggatcctaatcttgtttttctttctttttttcttttctccatctccaaaccagagtcatgatgtttgaaggaaaagccaacgagagcagccccaagccagttggcccccctccagagagagacattgctagcctgccctgaggaccccgcctggactccccagccttcccaccccatacctccctcccgatcttgctgcccttcttgacacactgtgatctctctctctctcatttgtttggtcattgagggtttgtttgtgttttcatcaatgtctttgtaaagcacaaattatctgccttaaaggggctctgggtcggggaatcctgagccttgggtcccctccctctcttcttccctccttccccgctccctgtgcagaagggctgacatcaaaccaaaaactagagggggcagggccagggcagggaggcttccagcctgtgttcccctcacttggaggaaccagcactctccatcctttcagaaagtctccaagccaagttcaggctcactgacctggctctgacgaggaccccaggccactctgagaagaccttggagtagggacaaggctgcagggcctctttcgggtttccttggacagtgccatggctccagtgctctggtgtcacccaggacacagccactcggggccccgctgccccagctgatccccactcattccacacctcttctcatcctcagtgatgtgaaggtgggaaggaaaggagcttggcattgggagcccttcaagaaggtaccagaaggaaccctccagtcctgctctctggccacacctgtgcaggcagctgagaggcagcgtgcagccctactgtcccttactggggcagcagagg

SEQ ID NO: 135608 - DNA, 1021 bp, Homo sapiens
tctaaagcagccccccgaaaacatctgtcaagttccaaacttatctgaatcggaagctaccaatagccaacctacatctaaggggaactgtaagatttcagaagaacaagaagcataggtcgcttaggcgtgggccacccaagaagagagacttaacactaggtaagcccgcgctggctgcgaaggcgggagcggcaccaggaccatccagggcgcaggcgcagggacctcacggccacgccactactcagcccgagctggccaatggggagcggcggccggaagaacgcgcggcttcgctaggttccgcggcttcctctgaccaagcttgacgtcaccaaagcgcgccggaaatgcgaggtcaactgcgcgccgctggcgctgaggggaggaagtttgctgtcgagcggcctgggttccgtgggcaaggccgtgggaggcagcgttggctgcttcgacacactgagggcggcgcgatgggagacgagatggatgccatgattcccgagcgggagatgaaggtcagagactaaccggggcctccctcccttctttagtcctggcgttgccttggagcccagctgaaaggcgaagcgcggtgctggctgtcccgcctcctgcttgaacagtttaccgcgttcacagctctcaccagcgcgtctgccgcgccgctggcgtgatagccccaccgaatgcagtttcccagtcccatcctggtctcgtgcacggctgttgagttaccctagctacttcctggggcggtcacaatagtggcaataactgctgtttattgagtgttgactgtgtgccaggcactgtggtagtcatcgcggcagccctacgaagtagtcgttaacgtagaggagtaagttgaggctcggaaagtaatttccctaaagtcacatttgacgcggggctgaaagccagcatcatttaagacctttgctctcccagtacttctgtaaggtgatacgggcttgcctaacgtagagtcagggaaggtcatccatcctgcagaacc

SEQ ID NO: 135609 - DNA, 1029 bp, Homo sapiens
tgcagagaagactattatggcccctttacatggatgacagacaaattcatgaagtgttccatatcagaaaaaaatgagggccgagtgtggtggctcatgcctgtgagcttgcactttgggaggctgaggtggatggatcacttgaggtccggagttcgagactagcctggccaacataatgaaaccctgtgtctactaaaaatacaaaaattagatggccatggtggcgggtgcctgtaatcccagctacttgggagtctgaagcaggagaatcgcttgaacctgggaggcagaggttgcagtgagccaagatcgctgcactgcactccagcctggacgacagagcgagactccatctcaaaaaagaaaaaaagacaattgagacagaccttggtctcagtaatacatatttttgttgtactgaaattgggtctactgaatataacatgttttaatttctttctttattgaattgatctcgttttgattcttcacaacaggattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaataggtaagttccctggtttatgttgcaaagtagagagaggagtatggtggcatgctcttgtgtttccttcccaagaagtcattctaatactaaaatgaacactgctgtcagtttgaaggttgactcccaagaagattaatggaagcctttctaggttttctccttggtcctttgtatttctccttacatgagttgttcctctcagctcaacagggaagaacttaaccattatgccatgcttttatttttgctcagttgaacttgggctctggctctctgggtgaagggttttattggcatgggttttcagttggcacaacagtatgatccaaacta

SEQ ID NO: 135610 - DNA, 1037 bp, Homo sapiens
tctttcagactttgcaggaaaaaaaagtcattccttgtcctccgttttatgagtcagatcatcctgtcagaggtaacaactgcttttcttattgggctgacctctaatgacatgttatgtatattacagaaattcaaaatcatgtaatgtacctgctcagtgaggtattggtgtttgctttatgaataatgtcactatttcaaacagctaattaagtcagtgtaaattatggccctctgggtgacatctgtgtttcacgataaatgacatgaaatggatcccgactttttattacaattcttcataatttgccctgattataatccagcagaaaaattaccatttggggatgagtttgggcttcttgggtcattgtacctgtgcattatatttagtcaatgaaatcagggcctttgattttttttttatccatagtggctattccaaacataagctgctttttcttgtatctggttgctgtcatttttatgagctactgattaagatgtgtctttcagttctggatgtgctgtggattggtacctacgtcttcgccatagtgtatgctgctgcagatgggaccctggaaacgtctccagatgtggtgatggctctactaccggtatgcctgtggaagaaatttcattgtttgagaattagagaagtcttctaataaagctggaggctttgatttcaaggggtttttttgtgtttgtgttttttttttttttttttgagacaagatctcactctgtcgcccaggctagagtgcagtgatgcgatctcacctcactgaagcctggacctcctggactcaagtgatcctcccaccttagccttctgagtagctggtactacaggtgcacaccactatgcctggctaattttttttttttggtagagatggagtttcaccatgttgcccaggctggtcttgaactcctgagctcaagtgatctgcccacctaggcttctcaaagtgctgggattacaggtgtgcgtcaccgcacctggcctgatttcaggttcttttactt

SEQ ID NO: 135611 - DNA, 1049 bp, Homo sapiens
aagcagttctcccgcctcatctctcagagcactaggattacaggtttgagccaccacacctggctggtcttacattttaatgggatagtcaatactaaatgtgagatcaaggactgataagagtgatggagaaaataaagccgtgttagggatagatgatgactggtatgtgtttgagattgtgtgtcaagggaggccaatttgatacttgaaaaagatgtcttgtttttaactcttttggatttctaataaggttgagtttttgaaatatgtttatctagatgccttattttaagattagaggttttttctattctaggggataatattaacactagtatttattaactgctacttatgtttcatgtactgggctggaagttttgtatgtatcatttcattttacactttacagtagcctctgaagtaggcttagtaggtctagtatacacatgagaacactaagtatcaggaaggttgaaaaatctgcatgtctcgtgggcagaaagtggcagaacagagtttaaatgcagttcggttgatggccaatgtttgtactccttgtactaagtgctgcctttataccatgtccgtatatctggactttgagtaaatattctcatataactttaaatgatttattatttgagattcttttgctgtgggatctgagaaaaattgcacatgagaattttttttcttgctttgttcattgtagaaaaaagaagaaaagcacccagagatatttgtgaactttatggagccctgttatggcagctgcacggagagacagcatcattactacctcagttacattgaggaatggtgagcagagagtctggacagggcattcctgctctcactggaagatcacacctgagtcaccttgtcccatgttgaaatcttttctgattgattgattgatggattggcagggtctcactccattacccaggctggagtgcagtggcacgattgtagctcacagaagcctggaactcccaggctcaagtgatccttccacctcagcctcccagatgggactacaa

SEQ ID NO: 135612 - DNA, 1394 bp, Homo sapiens
cccctgtgattcatgcttcccagtctggtcaacactgaaagttaggcaaaatgttagtgattttaaaaaccaagagtcatttgttggaaggaacagagcctatccaagcacacttaagcaaaaagggagtttactagaaagacttagtagtttctcaaggaatctggggacaggaaagctgaccagcctgaggaactggtaccaagaactgggaagaagaactaaggttatctctgtctctatagacgagtgagcgcagggcatctgagcacagaccagccttacatgcttctctgtgaaagactgcagtagagatcagctggagttcctggccccaatccaaaatgtctaggagcaggtattgactggcttagtgctgctgttggatttgtccctcatggtcagcaatctccctagttgtcatggaaggtacctcagaaaatgttcatgatagtggttatttatttacaaggcagaggcttgatacaccaggaacagatagagagggggttgatttggaaaattaacttcccatttgctggggtacttctggcttttaggccatcttctcagatttcagagcctcctagtcaacacctgagtctaaaccaagtgagtcatctctgttctcctatttgaacaatgttaggaggaaccaatgcaaagctctaaccaacatggctttttcttttttcttcttcttcttctttttttttttttttttttttttagattaattgggaatcttggctactggaggattctagtcgagctgaattgcctgtgacagacaagagtgatgactccttgcccatgggagttgtcgtagactatacaaaccaagtggaaatcaccatcagtaagtgtagcctggtagttagtgcagaaatagtcttctttctagttagggttaatattgaaacaccagttacatgttactgacagagtctactctgctgggcacttgtagcttctggcagcacatttctccctgaagagtgataacaggctgcgttgtgacaacactaaactgatttgaatggatgttcgttgatgagaccaaggccaaacactgtatgtatgtgtgggtgcatgtttgcacacttgcacatgtctgggtgtactttagaatctggttgaaatatagaacatcaggattttatggcttggtttctttgtccaatccaattccctggtgacctcccaaagaagcaatacccgaatctggtactgcacacaagtacttggtttgaaggcaaggattagaaaatagagacctcaggcccatggtttccaaatagggcctagatatgtgttttgaatagatcttccctgcagtagcttggctatactgtagtcattgaaatgtaaaagtgccacaaaagaaacagtct

SEQ ID NO: 135613 - DNA, 1032 bp, Homo sapiens
gggtaccatgaactacctatacccagctgcctggtgtgtctgtaataagcagagcagcctgtgagattaggagcctctgggatgggacgaggtttgtttctgagcctttgctactagcccattcaatgctggagcacaatcagaggccagttttactgttagcctttcctagagaaactcccctcttccttcacagttggtccagaggttatagttgtgttcagatgtgtagaagagagcccctgcggggagaaagtccgtcccatcagctaagtctagctaaagcctacttcatgggttcagaagacattaatggttccacctgtttctacactgcagttctaaggatgctgtattgatcagaagtagtagtagcatgatggttttccaataatcagttctgttttcagtggaaaaaatgcttttgatttatttagggtctggtatatatttttcatgtcagtttacctaatatgcatgaaagtgttttaacatctatgtatgtctttacagaagttagttgtagctggttccatatctattgtataaagaagtattaacagaataggtttgcttgcattattatactttcatcaatgtgacagtttacttggatttttgttttcagaaagtggtattttcatacttgtatctaagtattacgttgcattagacaaagtgtcttccatgaagataaactgccatcttagctaatttggaacaaccaagtcctattaatataaatagaaaatattgacacaaagaattcttttcttatttagttggttatttaatttaaagattaatatttttaccttatggaaagtttggaaaatagaaaaaaaaattattcatttttgagacaggggtctcactctgttgtgcaggctggagtgtagtggcaggatcttggctcactgcagcctctgtctcccaagtccaagcgatcctcccacctcagcctcccaagtagctgggactacaggcacaagccatcacacctggctgatttttgtattttttttgtagcaa

SEQ ID NO: 135614 - DNA, 1750 bp, Homo sapiens
gttagattctgagacctaacatatctatcaatttgcctcctttgttttgagatacctgtatttatgtgactttctatgtgtatttatctggaattacttttagtgaaataaggtggaggtctgaattaaaactttttcctggttgttaatgaaatgttgcagtgactgaactgttttgtgtgccatagtagcactgagaagtccatgaagtccaattattctaatgtctttccttagttttccttcagtttcatttatctcatgagacctgaaaactccaacatgaactgtgtacccatgtgttctttttgcttcttaaactagtaacatttctggctttattctaccacaaattctttttcacttgctttctattatgtgaacctccactgttacagtgttaacattttccttcctttttttgtcactgcaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagccctccttcccaccctcaacctctgctgtcaaagtcaaccttagtgaaaagtaagtcacttctaaagtttgattcttctgtgagttgggtagaaatattggatgttatttactaaaagtagagtcactctgagaggagttaactgagtagaatttttttacccagagtgatacttgcaaatggcaaaaattcaaccaacataaaatactggcatttcatcagtgaatagagtccagaagggtctcttagctagcattttatttttttgactatgggatttatattcaggtatttgttttgcttttttacgttacaaatgtaggaaatattccttattttaaaaaaagaagcaatccagagtatgcatcctggaagggaaatgaatcccttgtagtcttttttcctccctgtgtctacccttaactctctctgaactgctgtctacacagccacaaagtcatcttgtgacactgtaaattgttaggtgattcttctgcttgacagtccctatgaagccccgtggctgctcactgctaattcttaggttggtatccagtttcctccagatctgggtcgggcagctcactcatttcttatttatttacttctttatcttgttcttttcttcccactagaatgtaagcttttggagggaagcaatcccttatatcttgtaacccctcccaagataaccatgagttcccaagataaccatcgagtataagtactaccagctttttccctacttgcctgtactatctgttgttgctatggtggtgctgctgccaccacagttactgttaatactgaattggcacacatccacttcatgctaagggttgcatagtgttccattttgttgactgcaccacagtttatctgaccagtcatc

SEQ ID NO: 135615 - DNA, 1005 bp, Homo sapiens
agtgtttgtcaaataaatgtttgctgttaatgaatgctgatgcagtctaagacctctctagtgttaatcgttgtaagtatcaaatagtctaaagggcatttcaaattatagtatctttaaagcagaactcttgatttctgtctcccctagaggctagtccttttccaatgggtaagtagcactaacaaaccagatgtttgcacaagccccaagccccgaagcatcctagatccctctctttaacagtacctgtccccagtccaggctggcgggaggtcttgtcagctccaccctctgctgtgtcacatgtcataagcccacagctctgtccccctgctagcatcctgtgtcaagctgttgcacctctcaccttgttaacctctcgactactctctctgctatccctgctctacatagcagcaagagggatcttttaaatcataaaggagatttaaactcttgtaaaacaccagtagtagctttccaacacgtttagaatagaacccaaactccttggtgtgaccttatatgacctaccccggcctgccttcctgactctacccctgccctctacaacgcctcccctgacttcacagagcccacatttactttttttctttgctaaggtttctcctgccttgagacctctgcacttgcctttcttggtgcctggcaggtgcttcctgaagatctcatagcttgctttctgcttgcagcctccgttcagatggcagcccgcagtgagggctttcttggccatctcatctgaagtagtgcccttttttattctctttatgtttccctgtttgttctccaactgaaattatcagatgtgtttatattttattattcaacatgtcccagtaggaggtaagttccataagagttgggccctcatctacttgttcacctctacctgcactgtctagaacatgccttacacaaagtagagaccctataaataaggattcgttacaatgagtgaagaaataatgactgtgttac

SEQ ID NO: 135616 - DNA, 1057 bp, Homo sapiens
gcaagtggtagtgccagaattctgcttcagactctctgattccagagttcgggtcttaaatagtgtgtttggaaagaggcaagttctttagagtgttagcagtaattatcttcacatagtagtgttagagctactgtctttgtattttctgcattttcaatcattagaatgtattttttcaatggggatgaaaaataaatataaaaaaagaacattagtgtcgttctaaacagttaaattctttttttacctgagttaaatatgttcagatgttcattctgttcagtgagcgtttgagaaacaccaccttccttgatccaaacagaaagatttggacgtaacaactttttgtaccaacacattattgtactttttctagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggtaggagatctatgtaaatctgtttaaaagatttaaaaacaagctcatgtaacaattgctacctctttttgcatatagatttggatgatggctctttttgaagttgttgattttctgcttataatttaccacatttcccgtaaacttccttaactgtggcaaacagtacacttcatgtaattatgtaatttttttcacttaaaacatagattttttttaaaatactttttttcttgagacagggtcttctcactctgttgcccaggctagtgtgcaatggtgtgatcccagctcactgcagccttacttcctgggcttacgtgatcctcctgcctcagcctcctgagtagccaggaccacaggcatgtgccaccacacttggctaatttttaatattttatttggagagataaggtgttactatgctgcccagcccagctggtcttgaactcctggggtcaagcagtcctcctgccttggcctcccaaagtgctggaattacacgcgtgactggccaaa

SEQ ID NO: 135617 - DNA, 2908 bp, Homo sapiens
ttgtccaacccacggcctgcaggcttcatgtggcccaggacagctttgaatgcaatccaacacaaattcgtaaactttcttaaaacattctgagatttttttgattttttttttaagcttatcagccagcattagtatattttatgtgtggcccaagacaattcttcctccagtgtggcccagggaagcaaaagattagacacccctgctgtacagcatggttttgtactgactactatagacaattgtaacacaaatcactaggcaataggaattcagctctactgtaatcttataggatcatcgttgtatatgcagtccatcattgaccaaaatgtcgttatgtggcacatgactgtattgacataccatagcaaagaaaatttggtttataactgatgtgggattattccttatgtttttatatgtatgatttttcctatcccctctgcaaattaatgcagtcagaaaaaaatttcaaagctacttaaagatttctactgaaaagcggaagcaaatagacctgtcgccctctacagtcagacctacttcccagaggcagctactgttgtctctgtcttgttttagttcttttgggcaggttaccttcctgatgctaaatcttatgctgtccccctatttcttgacaatagtctgaagaattaactgactcccatagacttccagtgaaccttttttttttaattgaatataatttacattcagaaaaacagataaattctaagtagaaagctgactggctttttcctggttcctgactcacacctcactcctgcccttttcttcccagggcctctctcaggtttcacctaatgtatgctgtcctttgctacaggactggcctgcctgtttccagctgttttctccacattccattttatcttcattaggctttcatctcctttttattttctagtaatttcttaatggttcttgtccagtgctggttctccattttatcattttcactgttaccattgtagtcttgtttgtttttttactgggagattcctttacttgaaccattcatgtttaattcttttctcattgttgtcaacaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacaggtgtggagaggacttgcactcaataaatatgggtgaatgaatgcatgaacatttagggagtcttagagtggttcagatatgggtttgcaagtgactctgtgtctctcacctgtgtaatcctggtcagggtcccaccctctctgatcctttgtttctttgcctaaaaaatgaggatgacaatacctgcttcgtgggattgttggagagttaaattaagtctgtaaaatattacactgatgaaatgggtgctgaatatatcatagcaagtgatacaccatagtaacagtgtcatggtttgattgaaaatcagctgataggattaagttgactgacttgtttctgaagcccagatttgccattctgcttgaatggggggactttcagaccctggcagattgacagtttgccttgagtttaccaaaatggttttgtgtttatgcttttaggccaaatgtataaattttaattactttttctactgaggcaccatcatgttgtgtttgaggtggagatggtatataatatgattgtgatctcacttcttttagattaattccatcagttggtcagatggcatgtttatatattggggatattctcatgtcttgcatttatatttaagaggatagtgtacccccgacagcctccgatctttcagctcctagttggtctgtatctaacactgttctgtttcagttttgacagtgacctggaaagcctgtgcaatgctttgttgaaaaccaccatagaatctcacaccaaatccttgcccaaagtaccaggtaattgcatccttcccagtcttttaactccctttattctcttccaagtactgatatcttaaaaactgagtcttaatcatttatgggtttatggatttcttgcagccaaactgtcccccatgaaacaggcacaactgagaaacttcttggccaagaggaagaccccaccagtgagatccactgctccaggtaaagagaaccagtaactgggcctgtacatagtgatagggtgtggtggggtgtgtgtgtgtgcgcgcgcacatgcacgtgtgcatgtgtgagctagggtgctgtgtatgtgtgtgtaagtgtgtgtgtgttggttcttaataggggatagagaaaatgtctccagaatctgttgttaatctgaatagtggaataagaaccagcttatatatacttgatgaagcagcaaagtagtcgttttggcttttacactgttttctgcagtcctcaagttttatggcactgattcacaagggtttgagataggctgagctggatcctagcctctgctttagccagagaaggtttacttttctgatttgtgttgggttttgagtaagtttgcatctgggaaaaaggcattttaaaaaataaataaataatagaaaaaaataaaagacgaggtctccccatgttgcccaggctgttctcaaactcctgggttcaagttatcctcctgcctcagcctcccagagtgctgggattacaggtatgagccactgtgccttgccgaaaaaggcttcttttatgaaaaaagaagaaaaaaataagattaagcaatgttgattaaaaatacttacttaaaaatacttgcttaaagaagccataaatttttttcccattacattaccta

SEQ ID NO: 135618 - DNA, 1899 bp, Homo sapiens
gtcatgtgttttttggctgcataaatgtcttcttttgagaagtgtctgttcatgtccttcacccacttttggatggggttgtttgttttttccttgtaaatttgtttgagttcattgtagattctggatattagccctttgtcagatgagtaggttgtgaaaattttctcccattttgtaggttgcctgttcactctgatggtagtttcttttgctgtctcacaggaagattttctgtgatgatggaaatgttctgtatctttgttgtccaacagggtagctactagccacatgtggctgtagaggacatgaaatgtggatagtgcaatcgaggaattgatttttcattaatttgcttttgattactttaaatttaaataaccacatatggctactggctaccaaattggctaagacagccgtagcacatagcattggtttttagtggcatttgtttatgttatacttacattatgacaataaaatcttgcagagccatgtgcacatgggacacaaaagtcaataaatatttgcagagccattttaaataacttggggagggaagaaaaagggctagattattttgtttggtttttgttttttccaatatacaggaagtattcacttgcattctgaaatttatgatagaaagttaacatgacataaagccttactcttcgtagtctaaacagaaggccgggattcagttcaattcaattctattttctcttttgggtttttcttgttgttatttgagaaggagtctcactctgttgcccaggctgcagtgcaatggtgcaatctgggctcactgcaacctccacctgccgggttcaagcgattctcctgcctcagcctcctgagtagctgggagtacaggtgtgcaccaccacgactggctaatttttgtattttttagtagagatggggtttcaccatatttgccaggctggtcttgaactcctgtcctggtgatctgcccgcctcagcctcccaaagtgctgggattacaggcttgagccactgcacccagccttttttttttttttttttttttttgagacagagtttcactctgttaccctattttttgtagagacagggtctcactatgttgcctaagctggtcttgaactcctggcttcaagcagtcctcctgcctcaatctcccaaagtgctgggattataggcctgacccactgcacccagtctcttgtattttttttttttaaacctaattgtctgaatcagaagaatcattagatttatctggaaatgttcgagacactcaggaccgaggacattctttctaatccattttgcgttggacctgttcttagaagcttatcattggaaggtgacagtaatggtgtgattgttcaccccaccatggaaacttgcctgttacatttctagtatattattattatactagtgagggctccaggcttctactttgacaccagcattaattctgtctcttactttttcacattcttttaacagccccaagatgttctcgttcacacacctcagtttctcaaatccccatctgagcaaagacccaaaaccatttttgttcacatttgacaatacctgctcccacttaaaataagtaataattaaatcattttacaagttgagtattttttttttttatcaacagtgaaaattacttagcttttgggcttgctttgagttgtctaaattgtgttttgtttggggcttttgtagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttc

SEQ ID NO: 135619 - DNA, 1031 bp, Homo sapiens
tggctcactgtactgacaggtgttgtgcccccacactttcagtacagtgtcagggctttgcatcaaagtgacttccagcagagaaaaataccagtgttaggtactagaatgaagagaatttgtgagaggggatcagggaattggtctatgttggtataaaagttgtatctcaatcagtatcaggaaatgatgatgtatcttagtagaggtgggtaggcaaatttcatgcgataactgaaagatatagatgccagcctgttagtttactggtacttttctatgttaacgctaattttagcattttccctgcagtcgaacataaagaatttaccaatttaaccttttgtattttcctgttctctcacccactcacacttaatttttcttttcctcttagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccaggtaaaagctgtagccccatacctgtacagaggctgattatgagctgtctgagtcacaggccaggacagcaggtggcaagaaacagtgggcgctctttggtgcccttcagaagagaagattgatgtgacagccctctcccctttgtggagagagttctaagaaagcagagactaggtctgaaaatctttgcttttaaggggagggattagaactgccacatttagttaaggtggaaatcagtggggtttgtttttttttttaaacaaaattgctaatcctacttttgaataatgtctgcttagagccctaaaattataacctttgaaattcgatcatcgaataacactagcgtcatctcttagtatcttacagattgcagctaccccaagaggtaggtatttgaatggctattttggctgggcatagtgactcatgcctgtaatcccagcactttgggaggctgaggtgggag

SEQ ID NO: 135620 - DNA, 1063 bp, Homo sapiens
aggccatgagtttctttagagaagaaactatagatacattttgtattcgcagcccctaacacagagcctggcacataataagcccatgttaaagaaagacagtgaatgagtggcagaaatcctgagtctagatgctgttaatcctctagctcaagctgcccttttccaggacagaccagcagtgtggcaggtgtctcagctctgtgtagaaaagctggccagagaattcttttcccctactctagtacattcgattcagttacaggaagccttgttccatcacctgtgttaatggagtaggccaggtgttcctttgaacacaatgctgcaagaactacctagagtagatttccttcacatgataaggctctaatctgcttgggctcatgtcttggtttttcatttatatgtggctagaactttttatcctttgctggaattaatatggtgttctctcttctctgtttaaattagctgtaaacactttgactgaatcaacgttgaagaatgtccctcaagtggtaaatgtgcaggaattgaagaataaccctgcaaccccttctacagccatggggtatgttctgactgcagtgtgtttcagcccctggctgcttctgtagtagcggtggactgcctgcagggagcagcagtgccactgtcacagtctggttttcctgcaccgccttaggttataaggggggtggcggctaagcctgcctacacaatgcattttcaggagactgtcctttttaactggccggtgacagttgcctcacaaacttttaaagtttgtcttgatgctgtatgctcagtttctgtttgccatgtgtaagtctctgtgtggtacacattaggtgtgcaggttgattttttttttttttttaatgccctaggggttccagagttgatgctttgggtctcatgcagacttgattctggaaactgtaatctcaagggtgacactctcctccctcacttcccttctccaggcatttctgttcttcccatttcttttgcttttgtataaaagacagcacctctgtttggagactttagcttctct

SEQ ID NO: 135621 - DNA, 1025 bp, Homo sapiens
gttttgttgttgttgttgttgttgttttttgttttttgttttttcttagacaaggtctcactcttgcccagactggagtgcagagtgcagtacgatcatggcacactgtagccttaaccttctgggcccaagccatgctcccatatctgcctcccaagtagctgctgggactacaggcacatgacaccacacccagctaattttttaattttttgtagagatggagtttttgccatgtcaccccaggctggtctcaaatttctgggctcaagtgatcctctcacctcatcctcacaaagtgctgtgattataggcaggagccactgtgcccagcctagctcatttgtctttagtcctcatctgtgttcggaattcagggtgctgactccctcccgctgccctgggcaggttcgcagaacatgcctgtgccctgctttgccctgcatattttgtgactgtgatccctttagaccaaccaccatcccctgtggcaaagggaagagttgagggacatttcctcacttggaacatggggatcttgaggactagtatcagatttcagggagttagtgtctggtacccatgattagtctagcagcaagaagggcagccatagaccttgtggttctccacagcgtgcccaccctctgccattgcacagagcagatctgcccacggttctgttttccctctctcaagtggccctgcctcactggtccgctggcctctttttttccatgttgttctgtttatcaacactgcttgtttgaggaatttttagttatctcagggccatactaacagccaaaaaacaagccttctctattactattttgtagtgacctcggagccttggtatgctgtttagaccaagatggtatttgtggttgttgcaagcttttcaagggaaagaactatgcattagagtttgggaattgtagccagattcccagcatagggaaggcaaggcagaatgttacataagatgggaaaactcagcatatggtacaggaagtattgtctag

SEQ ID NO: 135622 - DNA, 1036 bp, Homo sapiens
tttccagactcttagtgatctgtgcctctgtcgctcatttctgaagcaggaactttagtgttgctggcaatgtcagtgtcatttgtagactcactcagtaaagagatgtctctttggggctctgttatagcaccattttcttcttagaacaaatatcaagatgaatttctgatatttttcaactccatattgctaaaaagtggaataaagtcacctaagatatggatacttctgaatttggcttttctatctcttgatcatttctagctattgatttccattgttttggttcatgctcatgcaaaaacgtttgaacatatttgtttgagagtatactgtttttttctgtgtgctgtcttggatcttgataagagatttattggatctggtttgttaattggtttactggctgattgcactgaacagcatttctttgcaggggtgtcacgtggtgtgtaggtactgtgaatcctaattttgtgtatttggggatttaggatactcaggagatacatagaattatcacaaataaatagaataataattacactcagtcttattcatgcataatttactatcatgtcacaattgaattctggctgtaaaaaattttctaaaatttggataaattgctgcttttatttttatttctgatttctgtttgtctttgagaaagcatgaaagagtttcctttcctttgtaatccttgtgagctccaacctcttctctaagcaagtctgctgtgtctgtccaggtactgctcagggcccagcagtctcactcacacattcttttcctctggtacagattcagcggaggtgacgggggaacactgtatctgtattgcctgcttggtaaactatctcaggggaacagagatgtgtttctccagagagatgcatatttatagctgcttctggcttcagtagaagcatgaaacgggttttgtttcattgaacataagttcactttttcttctctctcaatctaataaagtctgtttaggaaggtccccttgttattccagcagagaatc

SEQ ID NO: 135623 - DNA, 1046 bp, Homo sapiens
acaaccagcgagtggcagagtgcatagctccagagcccatgtccttgaccaccagaccgtactgcctctgtcaaatagctgacttagtagagcactaataagtagccattaattgtacataaaaatgattttctgtggactgacactttatttgctcataaaaatgaaggaagaacttccattttgaatcaagtcctggtctatcaggaggtccacaggccattgctgtgctgaggatgttattaaggaaagcacacagctagggtaaattaagggaagaggcttttttatttctctttgggataatatgttaatttcacatattctagatattttgtatttgttgtgatttaatggtcataaaaaaagtattttttccttttcacctcagacgactcagagctgatgtttgtgtggagaagcactcattccacctccttagagaaagctgctgtgagaacaaggcaccctgactctgtagagggaggagagaaactttggcttagaaacacaatcagtggaaatgtaatgggtcatcttttgctaaatccaacccattttctgatttctttttcttgctaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacc

SEQ ID NO: 135624 - DNA, 2490 bp, Homo sapiens
cctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggtaagaatttgtggaagctttttacttgtttccctctctgctatttgaaacattagcaacagacccctattacttttgtaattaaaggggagactcaaaacccaaaaataatctgtaggttaaagaagacagcttggagcacatgtggtctcaggaacttgtttggcctaattggctggatctgttacagcttaatgcagctccagttttgcttcttagcaaattgtccactctgcaagccaccagagtgtgtttcatggggaaaaatcaagcatctttagttgaggtcctgccaagtaatttaatgaacaataaataggaaatttcaaatttggaaggcactgtagagatcattatacccaaagctgtcaagcctcaaggagactgctctaatgtcaggatagtgccagtggaaccagcaggagagtccaagtgtcatcatagtccaccgccctgccagtgttttctgtctcctctgacaccatctttcttactgtaatggcagtcactgacatttgatttgggttcttttctattttcagtgttatgactttttgtaaaaactacagtttactgtttttgacagtgaaacctaattcttctctattgcattttccattttagcagctacttttacttctaaaagttatcaataagcaaggcaatttgaaaatctgtcctgagatttgctttctgaaagttatcttatgaaaggtaattcttcagcaatagactctaggagaaaagcaaggatcaatgatttcatggtgggcaagattactagtaactgctaattcattattcgatgataacttgaaaatggttcataatttattagaaaggaaacattttcctttcttcaacaaatgtttgttacactcctcctaaattcagctataaggacacggtgttgaaaagacagatatggttttgagacctacccaatgccctgtgaagaggccagagggctgctgaatgatgggaaatgtgctgacttggtccagaaaatgggcaaggagaaggccctatgagtcttagaggagaacgtgtaacacagtccgtatcactaccacaccatttgctctgcagtcagaacctgagaagacctcatgcacaggcatggtcatactatttcaacaaattcagaacccaggaaggaatcttctttcatttagtatctgtgcggaaaggtatctgagctgtctacttcagccctagttgaggaattgagtcttgtctaagctcacctacccaatcagtgacagaaatgagaatagaggctgggcatggcgactgacgcctgtaatcccagcaattcgggaggccgaggcaggggaatcacttgaggtcaggagtttgagaccagcctggccaacatggtaaaaccccatctctactaaaaacacaaacattgccgggcgcgg

SEQ ID NO: 135625 - DNA, 1897 bp, Homo sapiens
tttcaggctctgttctaaagtgtgttacatttcttggctcacgtaattcactctccgctgtgttgagatgggtagtttattaccaccattttacaggagaggatccatagcaccgctctgctcttgcaagtttctatgcacagtggcccctttccaaagtccatcttattctgcattctcagccacggagagatgacacttaactaaggtgaatggcccctcaaatgtagcccagttgttctttaagaaccagcttccagagaagttaagtgtctgggacctgacacagcctcgagtcagcatttgcccctgtgctagcagcatcctctgagcatgagatttgcaaacttggacagaattcagctttggtcatcatttcaacaatgaagctaatttaagcttacttctgcagcactgggaaagtcattatgaaataaaagtgcacaaatggagagaaagacagtgaaaatcacttatcatccattgctaatgagttcagccaaacgctggaggaatcagaataagtggtgtccgtaatagcttgtaaatgttttcgaactttttatttggtggatctcttgtggggttggttttcctgaccctggcattgtgtcaaacagacactgcgggcagtgtagcagataaacattaaaagttcccacctaccataaatcatgttttcagagaactgtgaacatggaatagcttgagaacttctcatagataggaagtccctgtccagagtctagcttcttttgtggtggttagagcatttgtaccagaactaatcttgctttttccatttgtgccagctgtgagcacctcctgcccacggatgcagcctgccatttcacgatgacctctcatcctatcttgcttcctgacccttttgttttttagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaagtaagttgagaagacttttcccagtcccttggtcccctaatgccattgtcattcttagggtgttatcaaagcttcagtgacaaatataaaaagaaaaaaaaatctagaaggctcatttaaaatatcttccccaaagcagtgtgatctgttttgcttttttatttttggttttttaatgagatgtcctatataatcatgaaaagatatcagagctgcagggagaggatctgtgtattgagctgctcccctcttctctcccaaggcccaaatcgctctgtttcttagtattggagtgacttgaagtgaatgcaagcagacaagcataaatgagcagcagcagagcaagccgaggatgctgggaggagagcatgcagactttcatttggatagtactctccaaattttccttaaaattcagctcctgtagggagatgtcacccaaaagttgaagcctttaatatttctcacctcttacatttttgttttattttcatctgaagctgtatctgccagtactttctttagctaattttttttttttttttttttttgagacagagtttcactcttgttgcccaggctggtgtgcaatggcgtgatctcagctcactacaacctccgcctcccaggttcaaatgattctcctgccttagcctcccaggtagctgggattacaggcacgtgctatcacgcctggctgatttttatatttttagtagagacagggtttcaccatgttgaccaggctggtctcaaacttctccgcccgcctcggcctcccaaagtgctgggattacaggtatgagccaccatgcccagccttctttagctaattttaaa

SEQ ID NO: 135626 - DNA, 2050 bp, Homo sapiens
caggtgcccgccaccaagcccggctaattttttatattttttttagtagagacggggtttcaccatgttagccaggaggtctcgatctcctgacctcatgatccgcctgccttggcctcccaaagtgctgggattacaggcgtgaaccaccacgcccaggctttttttttttttttccttttttttgaaacggagtgttgctctgtcacccaggctggagtgcagtggtgcaatctcggctcactgcaacctcccaggttcaagcaattctcccagctcagcttcccgagtagctgggattacaggcacctgccaccaagcctggctagtttttgtatttttagtagagacggggttttaccatgttggccaggctggtctcgaacccctgacctcaggtgatccgcccacctcagcctcccaaagtgctgggattacaggcgtgagccaccgtgctcggccttaaaagttatttgttgacctgtgtattcatggttggaaatgaaagaaatctgtttgtgtagatctttatcctgctgctcaggcggaagctgagattagaagttgggagcctgtcctgtttgtctcagcttctctcatttaatgtgccctacatgaagtttctctcatctgttgtgctgtgtgagatctccatgaatcatgagctagtgttctgcagtcatgacagatgtttccttaatattaaggcctgtgcagttagcaaaactttctatcctgatttgcccttctaaactcctaaatcaaaaactagtcagttttttagttcagcctgggcaacacagcaagtccccatctcaaaaaccaaacaaacaaaaacctagttattttgatgtcactgtccactccactaatacataaggaaagattattgtcaagagacacataccttttaccttgtgaaattatgtaatcagaagtttttgttctttaggtttcagtctgccaggagggatttagaatcctggatcttagaaatcaagtctagtagttttcaaaaactgtttttgccaatgaactcttaagtagcatcctgataaggaaaacaaaagtaggttcatgctgaagcaggggtcaggaactccaaaacacacagctggctggcaccacaggaccgtgaggctccatagcacatactttgaaaacatcgtccttttatggctcttcattttccattgaggaaacaagcccagaattctgaggtcacagagccagaaagtcacagatatagaactcagctagactatatgtcacatgccagacacagaatctggcacagaatagacacttaataacatgctccactgcagttagaaatttgggtttatcccagagctaaggtatcatctgcgaggttgtgttactggccaattttgttaaaagttaaatgtgtcatatccctataaacattcgtttactcatctctaatgccatggctcttgactgtcaaggagttgccttctgtcagtggctggctgcagctggtttgcacggacacatgagagccagccaagcacatcttcccagttgttcatttggtgacatcgtttggggtaacctgaaatgagccattgtggagtatttatatcatggaaatcagaaaaccctacaaaccaggactccccagcctgtcaaacattactggctgattcttctaattctggtttaaagtaaacacataactattcttgataccagataacctgttagtcttcatcttctaaatgttggctgttaactataaaccaacaatttacatgtgtgcctaagggaagtttaagtgattttgaaggagtagaggaaacacttaacattgtattattttaaaaactatatgattttatttcaatagtttttggggtactaggtgtatgattcaatagtgaaagggacaggaattgttttaactctgagggccaccaagtacagaataaaaggaaggaacagtggagaaggaagagctgggagtcgtctggggaaaggcattgtcctcaccacagtactcaggatcgtttctgcagaatcatcagtg

SEQ ID NO: 135627 - DNA, 1082 bp, Homo sapiens
taagtgctagaagccattttgcctgggttggatttgttctaactttaatttccctagtttgacaaaatttgaagttggtcttgtgtgaagagaccaatcaaagtaagccctgttttccagaagaaagcagcctgtggggcagagcccatggcctccattgctgggcagtcttgacacttgcaggagcacccagtgagcttctacaaaggagccttttcagtgggacctctcactgctcctttattttgtgcctataaaatcatgccaggaaatcctgagcctgggtgccagaatgattaaaaacttcccagcaaggtgcgtgaaaatcagagaaagtacctgttgctgtcactgtcgctccgctcccttggcttctaggcggcttgtcactcccatctttccaaacacccaactgagactttttctgtgttctgagaagcaggtaaggacatttgtctccctctgacctccctcacatcttcatctcttcagatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtactcctatgtctatttgttatggttatctttatatatgtatttgtttatgcatagatatctggaaggagacatctctagggtggttatcttaagagagtaggattggagtaaagaagttaactgtttcctccgcattatttttatatttactgagcatctgctacattcctaacatgattccaggtcttccaaaacatgtttaaaagcatagaatgcaagtaatgcaacatttttttttctttttttttttgtgagagggagtctcaatctgtcgccaggctggagtgcaatggtgcgatctcagctcacagcaacctccaactccctggttcaagcgattctcctgcctcagcctcccaagtagctgggattacaggcatgtgccaccatgcccagctaatttttgtatttttaggagagatgaggtttcacca

SEQ ID NO: 135628 - DNA, 1046 bp, Homo sapiens
ggaagatgagaggtgggcgtttgagtcgcacagaccttgttccagtcccagctctagcacccatcagctggctgaagttgggacaagtggcatattctctaagtctcagtttcctcccctgtgatgtaaggatcccaggcttattgggaagatttaagaaaactgctgtgaagcacctggcatatagtgggccctcaataaatcagaaagtttatcatcattgattattagaaaatttgtttcttctggagaagaaatttatgaaaatacggcaactgataaaatcaaacccctcctgccatcaggagagagttgcctctttaagccagagtgactgttttcttcctgtttaatttggctgtgacccaggtgtgttgtttgggggctttttctctctgtgtatatttaaccgccacccctcccctgtccagtttattttctgtatcatcatgacttcccatttttcactcaccttccaccaagaagtctaagcaatattgatacaaggtactagatagcgccctgcatgtctaggaagaaagtgtaactagatctgtgatcagtcttaaataattcaactgtaagggttttttagcacttttttttttccagtctgttatatttataacccaacagtctccattatcatggcttggaatttcactcagtgttttaacatgcggaatgttaacccaaacacgagccttagcaaaaaagtatcttctcagttgtgcagcctaccactgttaatggcaaataggcacatgagtgaatcacaaaataacagttaactgagggattcagctgacaacttttcatacccaggatttgatctttcctgattcagatggcagaagcttgtgttgtgattacataaacaataagaagtctggatttcatccctctaacaacagattgactttctgaaaggggagaaaaggcttgtcgctaggccaccattactcccgctagcacgcagttcataggccaacactcaccttaagaagtactccctttagagggtgctcccagttagagcacatttc

SEQ ID NO: 135629 - DNA, 1167 bp, Homo sapiens
attattttattagatttatgcagcagcctgcctccaaagaagaaatttggtgtgttttttcattgggaagtaattccagactgcaggaaaaaagcatttaaaaaaaaaaaaacaaacctccactgagcgagagaaagggagactctgatgagagacgtaggagccatcaggctgtaaataaataaaaagcacctggctgggcgccagcatacacgtctctgtctctgctatgacccaattcagggattctccctgagaggaggttttgagcctctgattttataatttgggtttctatgaagctggatgtcttgcctgtgtactgataagtaatatagtctgtcatcttttgtcagctaggtagggattggagtttttgagaatggtttttcactccaaacagctcagaggacctgggaggggtggaaggtgcaccgagtgggctcttggaggtctgctcacacggcttcacagtgacttcacagggtctgcaggagctctcctgagtggaccccagagccctctgctaggaatggaggggagtggtttggtttgagggcttttgttttgttgttttcattactattttcttgatagaagggcgggggggagggggggtgttgccctttactctagttcttgcatttgaattgctaacatcctcttttcccttttttcttcctattttgatttggtttctcattgctcaatgtcttctcttcctgtctcctcctttctttctccctatttctgtttgtttgcctctgttttgctcaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtaagccccctggggagggcccttgggaacccacacgccagccaaaaagcactaggggcctgtactcttgctctgaaaagaaatttgaccatgaggtgaaggcccctcccttgaaatttgtgaacaactccctcaaggattcctgtacctctccagggtaagactcatttcgttcaagccaggctttgttgaattcatggtggacctcagctgtgttg

SEQ ID NO: 135630 - DNA, 1046 bp, Homo sapiens
aaaagtaaatagaatcaagatcccaagaggagctgaagataaataaatgggagcaggatgtgggggaatggtcggtaagtgagaaatgctaaaatgatagaataaagcttaaggattgttggaggtagagcaggaactgtgtactgcatagttcccaaatgccctggtgttccaatgggggatggaaactaaaacactggccaggttggatttcatactgtagtcctgccatttttcttcctagagcagagataaaagttggccctgggcgatagctcattctctctgaaaggctgctagttaggcccagcctgtcaccctggatcatgagtgtcgtgtgtattgggacttacagcagggggctgaggcttgcagatgggcaagtggtgagaggccccactgacctcagtctgtttctcactggagcgcaggtttgggagcagcagcaacaccacatccttcggcacgctcgcgagtcagaatgcccccactttcggatcactgtcccaacagacttctggttttgggacccagagtagcggattctctggttttggatcaggcacaggaggtaagctgccacaagttctcccctcacaagcaaaatgggtccctcttgccttctcccccaaagaaatgagtatgttttacctgaccagtctgtttagtattttaaaagctgactgggcacgtggttcacgcctgtaatcccagcactttgggagaccaaggcaggaggatcacttgagcccaggagtttgagactagcctgggcaacatggcaagactccattctctacaaaaaatgttaaaattcgccagacatggtggcacacacctgtggtcccagctactcgggaggctgaagcaggaggatcacttgagcgctgcagtgagctgtgattgcaccactgcactccagcctgggtgacagaatgagaccctgtctcaaaataaataaatatgtaacatactgaaagtggttgaaacatatatatatatatatatttttgagacggagtctcgctctgttgcccaggatggag

SEQ ID NO: 135631 - DNA, 2800 bp, Homo sapiens
gcggccgccgccgcctccttcccgccgggcgcggggctgcggggctgggaggccgcggggcctgggggcggcgggcccgggcgcgctcgccattgttgtggcggcgccgcgcggcctcaggctcgggcggggtccaggggccgcgcgactccctcagggctcgcccgccacccccgtacccccgaggccgggccgggctgcagaggccggaggggcgggggtcccgggcccgcagccgggtctcggggttctggggccggcgtctttgctccccgccccgcccaattgacggagcagcgcgcccgaggcgggatcctgcggggtcgggccttgggtccggggcgctgagcggcgttcgcggggccgttcctggcgcggggtgggccgggccccggcggcgctaaagttggcggctgggggagggaggcgagcggccgcccagtctcggtgtgagtgcgggaaccagagggttattttcgaaatgctgaatgctccatgctaaaaatgtttaataataaacaggatgtcgccactcggggcctgccagatggggtttttttttttttcctcctcttttgcctcccctcaacccccaggagagaaattcagccctgttgaaactgtgggcctctgaagagtggatttgccttaagaggtggatttttttcctttttcttttttcctccttctaaatatcgtgggaggtcggagcccacctttaggcaagaattggaggtgttttcagtggtgagcttgaaggaagtgggagaaggggggctggggagtgtcttttgctaaatggcttcctgggagaaatctttaaatgcctttggtttacaggactgttaaactttccctaagattttttttttctttaaggtttagtgtgcatttgatgtggctttgtacagtgtcatccagtttggtttttgtaaccaattgtgtgcggtcttagcatggtttttccgaatctcgctgcagccatttagtcatgtctatgcacagcgctgtggtgtaaggtgggactggggaggcccaggcattggggtgcagatcctgcttctttcttccgtaaacctagtgactctggggctgtctgaggcttcatctgcataaatcggggcgtgcaccctccacctggcaggtttgggcagcggtgaagggcctagcagagggcctggcacagttagtggttcctcctacggttgttggtataactgctgtcaagtcctaggacagacgtgagccccttgtggtgccacccatagagccaaactgtgcccatggatgccacaggtgctggcctaaggcatggacaatacagaaggaattcaaggcccaaacattagtgggcgcttatacagtgctgagcctctcgggaggcagggatgggaaaaagtagcatttggaggtctctagaacttagtagacccggagtgtgtggcagttggtcagtttaaggcagggttagaacagtacgagatgctcaggacaaacagacgcccaaggagtcctgccttctgaggataactgctttccttggggattggcagataatcatctgagagtgagtttctacttgtttgggcaagtgtgtctcttggagcctgcgcagctggattctggtcctcatcgggttacctttacaaagcaagtctctgaggctcagatcttgcatctgtaaaatgggaataattatgcctgccttgggtatctattagggctcttgggagcctcacttaagattcacagtgaattgttttctctccataggaaggtgatgaaatgtatgtgtttgttgattatctgtttttctggttcctttctccttccttcctcccttgccctcttcctctctccctccctccctttcccttccttttccttccttcccttccttcttttttcttttcttttcttttttttttttttttttttgagacagtctcactctgtcgcccaggctggagtgcagtgatgtgatctcagctcactgcaacctccgcctcctgggttcaagcgattctcgtgcctcagcctctggagtagctgggattacaggcatgtgccaccacacctggccaatttttgtgtttttagtagagacagggtttcaccatgttggccaggctagtctcagacatccgacttcaggtgatttgcctgccttggcctcccaaagtgctgggattacaggcctgagctaccgcgcccggtcttctttctcttaatgcttattttttcctcttctcttggttgatggaactgtgacttccccaccccaaattctatggccggctaatgttttgctatggtgactatcacccatctacctggaagcaccagaatggcttagtacagctagggagctcagccagatctcggtgtctgctgtttgagattgtgtggaaggactattgctaagaagcaggagacagactgaacccagtgttggccacaagtgaggactgagacccaggtcacctcttggctgaacatgttagcttgttggtaaatggctctgcagtggttctgcattttattggggaatttgttttggttcattttggcattcccgcaaccatcttgttggttttttggtaaaatgtggcaccccctccagacctcctagctgtggaactgagatattttagcagggtcctgtcatcctttgatttttcctcgcttcctgcctcttggcccttcctttttgtctgacttcactcgggcccagtctggctctatactgttaactggttagttaggccaggagatagtcgctgcctctcccatgagcttc

SEQ ID NO: 135632 - DNA, 1591 bp, Homo sapiens
ctcctaacctcttttgaatttcagttctctttttttatcctgaaggattattttattgtacttttgagggtttttttttttttttttttttgccttgcacaaagtactgactcatgttgctaatggctgtggctgtatgctagttatatgtctcattatcctaccccttaagattgatcatttctgtgttggtttctatttcaaaccagaataggccaggtgggtcaattcatgtatttctgaattcaataatgaggcttccctaccgtgaaatgtacatatcttgtcatgggcggacaggtactaaatagagcctatctatactagattttaaaacaatggatttctccccaaaaaacaacatttccagcagacaatgggctttgtgctccaaatcttgtaattttggttttaaataaatttcatgtaaggaggcagggctaactagactgtcttcttttcagatcataacttgatctctttttaagattatttctgggacttgtacagcctcaggaaacttgggtctgtcattgggacaaagaaatacaggcactggctgtggtgttggagatgggagcgacatgggatatggtgagctttgtttctggtgaaatagaattgtttgtcattagctttaggtttaaaaggtgccattcagactggacctcctcacctgggagctggcagacctgggccttgccattggcgatattactgtttatacctctgggtggcacgtgggaaatctcttttgtgctgggaggtaggtttgtcttagtgtcttgagccagaagttgtggttgagctttgttctcagctgtacttgttggttttctgtgtgacctgagaagcatccttcgtccgagctgaagtgcacctccgaggtgctggcagcagcactgatttgtgaagcattgcgtgcagcaggagtagctggcagaacaaagcctatctcaagttgctggcggtctttcacatcttgtacaggacttccttccgttcttacctctgcagccagttgtgtggcttccgtctggaccgtcttcctcctttccaagataaccatcagtctttttctctgtggggctgcagcagcagtatttattgcatttttaattgacttgtcaggcaatagatactccttgagcacctatcatttgccaggcattgtacaaggccctttaaatacatttttcttgtggtagggcaaggtggctcatgcctgtaatcccagtacttggggaggccaaggcaggtggattgcttgaggccaggttaagaccagcctgggcaatgtgatgaaaataaaaaaatgcctcttaaaagaaaaaattagtagggtatagtggcgcatgcctgtagttctaactacttgggaggctgaagcaggaggatcacttgagcttgggaggttgaggttgcagtgagccgtgatcatgccactgcactctagcctgggcgacagagtgagaccctgtctcaaaagaataaaaagtaggtcgggcacggtggctcacgcctgtaatccaagcactttggcaggccgaggtgggcggatcacctgaggtcaggaattcaagaccagcct

SEQ ID NO: 135633 - DNA, 1028 bp, Homo sapiens
attgtgccactgcattccagcctgggagacagagtgaaattctgtctcaaaaaaaaaaaaaaaaaaaaagtctgggcacggtggctcacacctataatcccagcattttgggaggctgaggtgggcggatcacgaggtcaggagatcgagaccatcctggctaacacgatgaaaccccgtgtctactaaaaatacaaaaaattagccgggcgtggtggcgggcgcctgtagtcccagatactcaggaggctgaggcaggagaatggcatgaacccgggaggcggagtttgcagtgagccgagatcacgacactgcactctagcctgggccacagagcgagactccatctgaaaaaaaaggaaaatactgaaaagaataaatgccaaaataaatatataaatcacttgtgacctcaccatccagagctaactgcagtaaagttgctggtgtgtttctttcctctgataatgtctgtgttttctaaattagagcaatagtatatatacattgaatacacagttgatagcttgcttttccccttttaatgttatagtgtattcctctacgttatttttataattatataattgctattatacggatatgccataatttattgactcctgtattcgtagacatttagattattgttgccctcttttccctcctataagagaaactgtagggagcatctcggcatgttaagtcttggtccacgtggctgattatctcccataagtggaatttctggggtcagaggattgcaggtttgttcttctcttctggacaggatcggttgtctccttcagtctttgtcacctccctctccagccttgagcccaaggcagtctctttcttagttttttcttttttgaggcagggtctcactttgtcgcccagtctggagtgcagtgatgtgatctcagctcaccgtaacctctgcatcctgggctcaaatgatccttctgccttagcctcccaagtagctgggatcctataggcatgcgccaccatgcctgactaagttt

SEQ ID NO: 135634 - DNA, 2065 bp, Homo sapiens
tgcttcctgggtttaagagattctcctgcctcagcctcccgagtagctgggattacaagcgcctgccaccatgcccagctaatttttgtatttttagtggagacggggtttcaccatgttggccaggctggtctcgaacccctgacttcaggtgatctgcccacctcgacttcccaaagtgctgggattacaggcgtgagccactgtgcttggtctaatttttgtattattgttattatttttgagacagagtctcgttatgtctcccaggctggagtgcaatggcacgatctcggctcactgcacctctacctcccgggttcaagcgattctcctgcctcagcctcctgaatagctgggattacaggtctggctaatttttgtatttttaggagaaacggagtttcgccatgttggccaggctggtctcgaactcctgagctcaagcgatttgcctgcctcggcttcccagagtgctggaattacagccatgtgtaatcccatggtggcaatgttgagccaccttgccctgccaaccattttactttctttctgtgaaaccgaatactcttaagtacctcatgtaagtgagatcatccagtatttgtcattttgtgtctggcttatttttagcatagtatttccaaggttcatccatgttgcagcatgtgtcagaactaacttcattcttaaggcagaataatattctcttatttgcatgtatctaccacattttatttattcattcagcgacgggcagcagcctgtagatagttttgttttcatgtattgaatggtcctttcccccagtggagtgagtaaatgcatccggaagcagaattctgttgtttcccattcatcactgtgtgccaggtgtctgagaagggggtcttataggagcccacgcagaaaccaagctcacctcagtctgggtgtggggcagtcagggaaggcattctggaaaatgtagctgactcgaaataagcacctattgaaaatagtgtgctgagccctggaacattaaaaatgtgttcctatgtggaaatcagaaatgtatgggtcccagaagagaacttgtgggtcagcctgctttccagagagtgccgaggccctttgaatggtgaacattatgcaagcattcttgtatggccagtggccagcagggaggagggcagagaatgactgtgcctccgggaagccggcgtcaacttcccgacacgcttcaggatcatctctttgtatagaaccatgggatggatcgctgcaggacctactggaaaaaggaggtcatctccaggactctttccatgggtcctttgtgtcttgcagaacttttttcggcaggtgttgtttacatatggttcagagcttaaagaacagctgtgttccaggccagggcagaaagcacaggcctgtctgggaggggcatcatcactcctgcctgcctgcccaaccgacctgtcggtggactgaatgggccaagtgttcagaagtccttgggaagaggatagtgtcctgaatcataatgtggtattttctggttttttgtttgtttgtttgtttttggtaaaatgttaattgcagaagtatacaggttattttatttatttatttatttttttttgaggtggagtcttgctctgttgcccaggccggagtgcagtggcatgatctcggctcactgcaacctccacctcccaggttcaagcaattcccctgcctcagcctcttgagtagctgggagtacaggtgcatcccgccacgcctggctaatttttttttgtattttagtagagatggggtttcgccttgttgcccaggctggtcgcaaactcctgagctcaggccatctgtccacctcagcctcccaaaatgctagaattacaggcgtgagccactgcgcctggcccatactttaaaaaaaaaaaaaaaaacaaaattaaaagccaagtgtttgaagagaaatgaaagcttttccccaatgtcccaggcagtaaccattattgataaatttgctttgtttatccttctaggctcagtgcacgtataaatatggcctcatgta

SEQ ID NO: 135635 - DNA, 1227 bp, Homo sapiens
gctctgggtgtcttgttaggtgaaggccactgtgggagctggaaggaggcgatagacacagccaggtctaaggttgattttctgtatcaagtaaaatgattgtccttgctgcctgttttcttccaactgttatacactggagcctggtgcataaaattcagagacggcctccattttaagttttctcatagccccgtctttcacagtccttggtggttttgttgctgttaatattcattgctgttggcgcttttgcagctcctgatagtggctgttgtgcatatctcacttctcgactcaacctcttggcgtcacttgccacccctcctgccccccactttggtttagttcttccaggagatcacaccattggttgaagtgactgcagaaatgaagcactggaatgcctgggtggtggtgtttcatcaggctaggctggcggggatttgtgctctggcaagaggaggtgcggtttggaattacactgctctggctcctgggggggttattgttagctggaattcagagagagctcgctgggagagttgggaatgccatgccccctcttcctggtggagagtagctctcccttgcaggcacagtgcagcaccccacactggaagccctgctttggggtcagctgccttcaagtccaggttctaccacttagaagctgggtgacctggggccagcttttaaatctttttgaatctccattctcttcctctgcaaaatgtgatagtaacaccttcataggacctgggaaaggattcagagggtcatgtgctgcagagttgatagggcacctggcacaagacagcaggctctccatagaccgcagctattaatggttcctggattcagccctccccgggggcccgggggtttggagcaggcaggcttttgtacacttggggcttgtttgttacctaggtgttggggtttctaattatgtgctcagcactgtgctacatgctaaagatttggacccgtagcgcattgccctcacctcctggagctcagtcaccttaactagcaagggcctcccatgggcaggtgcatcagggctcttctgtacatctctccacaatgaacaccactgcggatgtctgttcccacgagcaagggcgtttgatagctggcagctgccctgtgtctagtctgttgtgttgtgttcttggggagtttcaggtaaatgtcttggaaggaatgaaggtaggcatgtta

SEQ ID NO: 135636 - DNA, 1051 bp, Homo sapiens
tttaagtctcagttttcttatctgccccaaatggatacggaacctgtctcacagcattgctgcaaagattggcgtaatttctgggatgcagtgttagtgcagtgtaggaaacctagtcaacttggaacagtatatggtgttgatactatgttgctcagttcaccgagatcttaaaaacaatgtaacagttacaatacaggcgtgtcacagttacaatacagccttgctacaaacatcaagctccagaagtgtatagagtagaaagtgaaagtcattccttcttccctgctgtttctttataatatcaagagaggactgctgtcttaaccagttgtttttaactaaggggactgttttaactgtgcatatgaattctaaacctgaagtgaccactggaaggtgggaggtgtgactgtttataggtagaccttaatataagcaaagacatctcatatggctccttagtgtggtctcttcagctttttgaggggagaaaaggccattgtaattctttgcacaccctggatgaatcataatgttgtattggtaaagttcagcagtggcatagactgggtttaattaacaagtgctgcttccaaagatcccacagctttacaatttgctgttgacatggttggagggtgggggaaggggaaaggtgggcatgcccttagggtaatggggcagtgcaatacggttttttagacgcttcggggagatggtgggtgggggaggagagttgtgagtatagagttttgggtgaggtgaggagtctgtgggtaaggtgtttataacgtgtgtagtgtatttggagtgagggtgcatgctcccttttcccaccgttctgaagtcacagcttggcgtacctgggaatgcccttggcgtagtaatccctggcccttattttggatctgtcctttattcctttgttactttagaactggcttcgccggcgattgtcctgggtttcctctagtgtctgaggcttggaggagaagtcatgcacggcttctggggtccagtcctttggcctttgctggagattatttat

SEQ ID NO: 135637 - DNA, 1058 bp, Homo sapiens
gttaggttttccagctcttggggttattatttctactttcatcatgtcttgttttattgcactgttgtcagttttactttacagaatttgggatttttcttttcttttttcagacagagtcttgttctgtcacccagggtggagtgcagtggcacagtcacggcttactgcaaccccaaactcctggattcaagggagtctcccaagtagctgggatccaggcatgtgccaccacacccagctaattaatttttttttttttttctgtagagatggcgtcttgctgtattgcccagactgatctcaaattcctcacctcaagcgatcctctcacttcggactctcagagtgtggggattacaggtgtgagccactgtacctggcctgaatttttcttaaagtctaatatagtcacttttagaacatgtttgctcatctacgttgaccgtctctatcttgatgggcttgatctaccaaggtggacaggcttctgtttgttctaatgtttgtactttcattgtgggtggtcctcttggccctttaaaactaccctgctctgctgcttgctcttttgtgtctgtctcctttgattcaacattttttttgtgcgtttcatctgtatagttgtgtatgtttatttgttcttattgtaggatggtttttggttatgtggatgtaattatccatgtgacagactgagctcatttccatagttcttccaaacaatgctgccacagtgcgggtatgtgcgtgcgtgcgtgcgtgcatgcacacgctgttgggtatatacctaggtttggagttaactgggtcatgggtgagcatatggtggctgcatgggcagctgccagctctcagtgatggcaccaggtacatgagggtcatccttgctctgctgacgctgtaaagatgttgcttctttgcaaattaaccgctggattccctgtaattctagtgaaaatcccagcagcttttcttttgttttagctgtttatttcagaaattgacaaactcattctgaaatttatatgaaaatgcaaaagggccaagaataatca

SEQ ID NO: 135638 - DNA, 1052 bp, Homo sapiens
ttgctttttacattgctccaagaaaatgcaatcaatactaatttgtaatttcctggaaatggtagataatccatcctgtttgttcctccagaagcctctatcctgtttttaccaggactgttgcccctctggcccatggtgcggctaccatcttgggctttttttttttttggagatggagtctctgctgtgtcgcccagactggagtgtagtggcctgatcttggctcactgcaacctctacctcccgggttcaagtgatcttctgcctcagcctcccaagtagctgggactacaggtgcctgccaccacgcccaactgatttttgtatttttagtagagatggggtttcaccatattggccaggctggtcttgaactattgacctcaagtgatccacccgccttggcctcccaaagtgctgggattacaagcatgagccaccgtgcctggctgctatctcgggcttctgttggtcgtcattctgggacttgtttttgtccctccacacgtggtccttatttcctggatcctatttgtattggttggataatttggacataatgacagcaactgtcttttttgtttgtttttttgagtcggagtttcactctgttgcccacgccggagtacagtggcacaatctcggttcactgtaacctctgcctcacaggtttaagcgattctcctgttttcagcctcctgagtagctgggactacaggtgtgcgccatcacgcccagctaatttttgtatttttagtagagacgggggttttaccatgttggtcaggctggtcttgaactccggacctcaggtgatccacccgccttggcctcccaaagtggtgggattttcaggcctggccaacagcaactatcttaataagaacgttcattgactcaagtaattgcaagtccagaagtagacaggtttgggattatttgggtgcacccattctgaaccagtcattagaaccggagctgggcttctcttaggccaggcccccgctcccctggggctggggctgggtcagcctccctcaggctccatc

SEQ ID NO: 135639 - DNA, 2026 bp, Homo sapiens
ggaaacttgtgtgtagagagagagctactgcctgcaaagggggttcatcctctatagggagtgtttgccccagagagtgtttacctagaggttaggtgggagtttagattcagcgttggttattatttgggggatgatagaaccaatcttggttttttttacccccctgtgtttttttctgtgagtctctgtgaggacatagggtttaggaaggtggggaggaatgctttctcctgggctgaaggaagtcacttgctgccagagacaggccagcctgatttgtcttcttcttttgtgcccagattccagcttgctccaggtgacatcattcctacaggggaaaggctttgggtgtaaacaatggcactgccgggcaagccagggacagctgcagctggctgggacgtggccttcctcctcggtgtgtgtgtgctcagctcagcctttctgccatcctgagttttctttaaaattatcttcatagttttaaaaaacaaatagcaaatctgtttggaattaatacacagtgttttatgacccttactgctgaattcttttgaaatgggaagtcaaaacacagtagaacacgggcgaggcagatgattagtattgcagcgtgacagcacctggaatttaagtggctcatgctggtgaagagagatccagggatctaatctgggagctggtttagggatgatacttttctgtaattttttttaagatttacagtttttctgtatcaagcgtatatttcttttgttactaaaaatgtgatggagaaataaatgagcagtactgggattatccacttccataaggccatctattgtaacatcagagggtgactgcagtaaatagctacgtttattgccccaaagtgggaagccttgaaactggggcagtttagtgtggtttaaattagtcacagtagagtgtttatctcaagagggttttctgagaatctccctgcatctctgtcttcctgagaattaaaggggtccactagcagatcctaaacacctgggagtttgtcctcatggtgtttgaaggtctgctctctgtaccagcacccttaaactgtgacacttaaactgtgacacaccaacgtggggacgggtccccagtgcacaggaggaggtagaagcacaggtgcctggtctacccagcaccacccagagcagccctgctggggaacggaggcttccctggctgcataggagtctggagagatgagcactgtcaaaagctgataattgggtgggctggagagagaacaagagcagaaccacggtgaggtgacagccgccattggtcgagtgcctgctgaggacaagtgctgggtcaagtgcgggggtctttgttctcttgtttattccttacagcagacctgggaggtgggagattaacatggtatgttcatcttaatccacgaggaaatagacctcaagtcacagtgtggagtggaggcgagatgcaaacccagtgtttcagatttgagactgccgggggtggtgtggggagaaggctgggtggcggcgtggggccagcatgttgggccgggggggtctggacttgaccctggcgcggtggggggtgatgtggaaggtgtgtgagcaggtgctccccgtggtctgtgttgctgtgtgagccgtggctctggtggaggggacccagctgaccatgtggttccggcaaggggcttgcaactaagtgctggagaaccccccagttctccactgggggtggggagtgcttcttgtgtcctcaccatacgcctcaatgcttctttgtttttcctttcctcttattttaaatttgttgcttcctatatatgctgtctccttggggtgcgtggtcttctggggatggctcatgtctcccataaggaacactgggttaccaggaaccccactttccccactctgtggtttcctcaaaccttattttcaggctgtttattcttggagagtttgtgcagtgttctgcagggacctcacccatttgggcttctgcaggtagaatgcct

SEQ ID NO: 135640 - DNA, 2361 bp, Homo sapiens
gtaggtgaggtcgccttacttacgttaaaggtttttttgccagacattgattggtgtgttggggaaagatagacttctttcatcttgtccctggatttcgtggtgatggttcttggctgagacttaacaagtaaactgtccagtggccacgtccttttctggcccacattgttacttcctgaagcgtttatccagcctgctatcaatttccatgcctgtggaatcatgatttttggtatgttttgtctagcagtgggatctttccgttcgttctataaagagacattccacctttctctctcactgcccccagcctcacggccagggcacgttgcagcactcattgtgtccccctgaggtcgggccttgggcctttgtcactattgtgagtggaggaaagagccatgaaatctctaggtgcccacatgtgaagagtgaagtgactggatttgccttgggtgagaatctggctgttggtggcatggcgtaaataaaatgcttgtttttgaagctgtccaggatcatcatctgtacagttggccagaaagcagctgttgagcctgggctgacttatatcagaacccattgtgccgcctttcgtgtctgcaccggtactcccactgggaaagcagattccaggtcgtggggcattcagtctgcagcctggtggcgtccagtgcagcctgggctccaagcctggccctgcactcggcagccttgtgaccttgggtgcgttacttttcttttctttctttcttttttttatttttttattttattttaagatgggtgtctcactctgttcccaggctggagtgcagtggcatgatcttggctcactgcaacctctgcctcccgggttcaagcgattctcctgcctcagcctcccgaatagctgggattacaggcgcgcgccaccatgcccagctaaattttgtatttttagtagagacggggtttcaccatgttggccagcatggtctcgatctcttgaccttgtgatccacccaccttggcctcccaaagcactgggattacaggcgtgagtcacccgcatcctgccgggtgtgttacttttctatcctgattgactgaaccttaatgtccttctctgtcaaacaggcagtagtatcttccagaaagtgctgttatgaaggggagtagagcacatgagggcttagcagggtgcctggcccttgaagtgctggtggccactgatctcccctgaatgcggagccgtagtggttcctggtgaatgacaggtcatcccagtgccctggtcaggcatctgacactggctggcactcaagtgtggagtgaaattaatcctgttacccggaaatggcttttgataaattaattacagggcagagatgttccctctggtggacagatagcaggaacctgttggacaggcgggcactgtctggagaggcggggcttggatgtgaagttgccgttgttggcgaatctttctggttgtttttgttccagcacagcctgggagcacttctttagattatgtgccaaaatatgcaacctggattctttttcaatgttcttttctccattgatttgttcccaaatctatcttcatatgggttttaggcccctttttcatctgcctaatggcaatattttcttttaggctggcaagtttcagaatgctctagctccccgtggcagtgtctctgagtggcttctgtgggaaaggagggcttacagcaagggggcacataggctggacttctttccagcaggcatcattgggttgtgtctgcttcatatgtcatactgaggttccaagtcagattctgttggagagaaaacgaattctgttgcctacagaagggagagaaggtgaggtaaagccgtggccataagccaggtttgacttatgctaacctgcgaggacttggtgcgtctatgccgggtctagtcccacagacctaggggtgagtcagagctggatggaaatgcctcagacccgctggagagctgttctcttgcctcagccggcttcctgcttcacacttggatgctcaccggtgctttctccctgcctccggataggctagtttagcttggggtatgcatgtgtgttgatggatggaaactcggcaggtatttgaagcctggtaaagccctgctaacagcgccctggcctgatgtttgtgaaaagcagctggcaagcagtggggccagatgcttgtgggcggggccagcctcgcactcagccggtcagtggagatccctgcaacgggaggaaatccgaatgattctggtttattttggagttgtgtccagtgaaagatctcctgactgccgtaaagcaggtgtgtatacacaaactttgtaaag

SEQ ID NO: 135641 - DNA, 1089 bp, Homo sapiens
tgaacagccgtggtgtaagtgggttgtgtacctcccctattctgctagccttattttcagtgttatacatggatgtgttaaagtactgagcatttatttttccatcttgagctgtccttgacttggagagggctctgttgaagtttacatgtcagtgtggttggtgtgcagtagactccagccaactcagagtgagaggaattaacagcaggtgggggttgggggggtactccacagatcgcctcggggtgtctacataaatgccctgtaaatgtgaatgaacagcctgtgggtggtgagagcagttttctaaggacagtccaaagccatcttcagatcttcaaggagatccatgattcgtgaaggattcactcctctggatcagaggttctgctgtagtgacactcttttttttttttctctctctttttttttttttcttctctatttcaaaggcagatcgggagcggtgccgagaaaaatttccttactagatgacatttcatcgcaatgtccgatcgtttggggcaaattaccaagggcaaggatgggaaaagcaagtactcgactctcagcctgtttgataagtataaaggaaaatcagtagacgcgattagatcctcaggtaaggcccagggttgaaggccagttcctcaaactttctccgagtgacatatcccagaaacccagagtccctcacctggttagacagatgtggtccgtgcacaccaggcttctgggtgtgcatgtagaatcactctctacttcctacttgaggtatgatttcagagccttgagcatcctgactctttctgtagtggaattttctccatctattaccttattgaagctggggagatatatctatagatatctatagatagatagatagatatctatctatagatatctataggtgtgtgtgtatgtgtgtgtgtgtgtgtgtgtgtgtgtgtgtgtgtatatatatgttttggagacagagtctcactctgtcacccaggctggagttcagtggcatgatctcagctcattgcaacctccaccttctgggctcaagcgagtctcttgcctcagcctcccgagtag

SEQ ID NO: 135642 - DNA, 1084 bp, Homo sapiens
gggaaggggatgtgttcagggagggacagggccttgctgaggctggcaggcagaaatctgctgctggggtttgcctgttaaggaatgtgaacaaagctgtctggcggcagcgccctcctggcctgcatctctggtggcctccctgctgatgtaggaaaccagacggtaaaagggacccagatctcagcctgctgaccccagcatccttttcttacaagtctgtgctagaaatgaccatggtagcttttgtaaaattgttgcctgtatttacttcagacaggatgtagagagtgagctagtttagttattcagctagatgattataaagtagtaatcaaaatagggccttagaagttatttttaaaacatttctaagagtttgcttagggatcatattgatggacagtatagcatgacttttgaaatctaccagccctaagtggtttccagctagaccacttattagcttgatggaacctggagaattgtttgacttctgagcctcagtgtcccccccttgaaataggaatgatacctggctttgctggtggttacacggtatccatgaggcattgatgggctagcataggtcaagtgcttagcctaaacctggcacagaggaggggcagatattggctgctgtcatcattccattcaaatggtactcattccattcacaccatgagctctggaacgaaatggatattgcacattttaatggaaggactgaaatcctctgcaccaccaaaagttctagagaggacaaagcattactccctcctgttatccagcctttactctgcctttgcggctccagtgagggctagttgtgctggagcacgtccgccagggaagaggtgaggatggagtgttggtgagggcatagacccccgtgtagttctctgctgccccaggccacatcctcccaccaaggtatcaggtggcaagtgggcccacaacgtggggactcagtgcttagttttggagaacacaaaagtgcgactacttggaagcttctcttttaggtagaaggagatgtaagaacccgatcagtagccttctgtttgtaataatcacgaatggt

SEQ ID NO: 135643 - DNA, 1062 bp, Homo sapiens
aatccttcatttgcattgtttacagtgagcttttagtttttgcagacagaaggctctacaagaaggcagaaaagtttcatttttaaaaaagaaaggccaggcaaggtggctcaagcctgtagtcccacctactcagaaggccgagatgagaggattgcttgaggccgggaagcagaggttgcattgagccaagtttaccccactacactccagcctgggtgatagagtgagaccccctgtctcaaaaaaaagaaaaagaaaaagtcagaggactgtcttgtgctaattttaaatgtcagtgactagaacttaagcatggtttgttttcttattagtttttgccagcataagaatctactggggaaagtcgtatttttattggccagaggaggtctgcttcctgtgagcagctgaacagctgtggctcctgagaacgcagagacctggccagcgcactctgtgcggtgcctgaccccactgccctgcctttgtctagttccagtgcgacggcctctcagccgccggagtcgctgccgcagccgggtttgcagaaatctgtctccaatttgcagaaaccgacacagtcaatcagtcaggaggtaggtgctgggaccccatcccaactgtttcctgggcatggtagcccctaaatctctttgttgctgggggatggaaggagttgctactgagaagtgtggttgtgcatgacctgtctattccagaggcacacccgatgagtgactttagaaaaccgtcatgggaaaccgtcaaggtcagtggttaagaaatttaatctgcagcttttagaaaaagacctcagatacagactaggatacaggcacctactttggttcctcttgatttaccgtgaggcagggtcactcaggctggactgcagactagttcagggtgaagctccatggaagcgtcacgtgagctccatggaagcttgggtcacaggaagacaaaaagtggcaggtcacaaaaaggttcactggccaggtgagtttgaaaaacaaaacgaagcgagctcctttactgcggtacttctcagtgcctttc

SEQ ID NO: 135644 - DNA, 1064 bp, Homo sapiens
tgggaaggggcatgatgctgtcagcagcagtctcccttgccaccctcagcaccctcgtggcatctgccagcacagagcacccttgtgacaagactcccttcaaaagcccacttccaggcaacacggctttcaaggtgtggagctgggaagcagacgactgttgactccatctcacttcctccatgtctaccccgtcttcttgacaggtttaaggggctcaagccgactgttatccttctctcccgaggaatttccgacgctgaaagcagctggagggcaggacaaggctggcaaagaaaagggcgtcttagatctgtcgtatgggccaggaccaagcctccgccctcagagtaagtgactgcagcctctgggcactcgatggagtaacagaacttcctcctctcatctctctgcactcctaaaagggtgctgatgccactggggtctccggttcgagctggaaacgtggctctttgactcgccacgtgatctgtgcatccattggacttgctgcctaggccattggattgggccttgtgccttttttgtctcttgggttgggccaggcctgtcccctccccctctgtcatccggttgttaattttgctgtgcctggtggctgtggcaaggatggacaaaggaccaattaacttaggtccccggttcaagagcttgttttctaaagctcccaatcctagctacatctagtcggaatcactggggagtttgtgaatgagtctgatttccagtcctcccctcccccagcccaattaggacctgtatttttaacccattcctctggggattgttacataaatcagcctggtactggtctctactggcccctcatcttaggtcgggccagggaagtggcaggattgtgtagcactggctggaaatttctccttggaagccgagggtggctggaggttaaggtggtgtttaggaatgtgattttccacgtgttctactcagggattttgaagtggctcatgtagtccaggggtcttgatcaggtcttaaattgtgaggccttttgtttgcttgccttgatgtatccccaa

SEQ ID NO: 135645 - DNA, 1388 bp, Homo sapiens
aggtccccaagtctacttactggcagcaggaatgaaatgggggagatggtggtaggattaattaggaaaccccatgactttcctgtttctttttcccattttccactttataaaacacattctgatttaagtggaaattgcagtttcagccattaccagcaaatcctgttcattgatgttatgtttcagatgtgttcgccgaagtcatcagaaaaccagggtacagtggaacgaggctcttttccccttcctcagctccgccttgaacctcgagttccttttagacagttccagatgaatgaccaagacgggtgagtccattgcattacagtcacgtgtgtagagatgagtgcggtggtgattctggtcaagatgaggggctgatgaatagaagtgctgtgtctcctggagaccacagagaacttaaccagctcagcgtggcagggtgtgtggggtggtggctgggatttggagctggatgacagattgagtcatgatttcaagtgcctggtagagttgaagttctggcacgtgtgtgttgctgctgccctaggccttagcaaccagcatgtaaaactgcaggacaaggcagaacttctttctgggatgtactcgtttgctcattatatatttcttttaaaggaactgatagaaataattaaatcaaacatgaacctttgcagtgtggaatttatttttggaaaggtatttgattttgcttccgtctgtatactggacatgattccatcatcttttcttttatcagaaaagaaaacaggctgggattgtctcgcccactccgcccactaaggcagctggtggagcgggcaccacggcccaccattatcaatgcggaaaacctgaagggccttgacgatctggacgccgatgccgatgatggctgggcaggtgggcagagaagcacgggtggtttagacgggcaggaccaaagtccatatgtacttaccagggatggaaaccccctggcaccaccgtgtgttttcccttggcaagatagggatgaagagccggacagggaagcagacctgatgccctccttcctcatttactccctgactagaggttccttcctggccaagccattagcttcttttggtctttagtcttgatcttagagttttgttgttaactttttaaaaattattgatgatgcaaaatttaaacaaaaaagaaaatagctcccaaccactgatcactcaggttcaataagtaccaatgttctgccattcggtttttgtttgttttaatttaatttttttccaagagacagggtctcagctactctgggcatactgcctgtgggttagccctactctgcaaggagcagtaaaaaatataaagataaaaaggaaggctgggcacggtgg

SEQ ID NO: 135646 - DNA, 1050 bp, Homo sapiens
acctctccgatggtgcctgggtaccactgaccttttctttttctttttttttttttcgagatggagtctcgctctgtcgcccaggctggagtgcagtggcatgatctcggctcactgcaacctctgcctcctgcgttcaagcgattctcctgcctcagcctcctgagtagctagtattacaggcacacgccaccatgcccgactaatttttgtatttttagtagagacggggtttcaccatgttggtcaggctggtctcaaactcctgacctcatgatccgcccacctcagcctcgcaaagtactgggattacaggcatgagccaccatgttggtcagtctggtctcaaactcctgtcctcatgatccgcccacctcagcctcgcaaagtactgggattacaggcatgagccaccacgtccggccaccactgactttttcattctttctcattcttcctgggccctcctgctgttgtaggcctccatgaagaagtggactattctgagaaactgaagttcagtgatgatgaagaggaggaagaagttgtgaaggacggcaggccaaagtggtaaggacccgttcctgccctatcagcatgagtgcatccctgcttagtgttgttgtgtacccagagcatttcccagtttccatagcaacctggaatggcagacagatgctgtttccactttgttttgagggtgacagctattgatgatggctgtgaaggaggggagccagggtttgcctgcaggtgtgactgtgtcctgtgcatagtcggcctcttcaccactgcatcagtgtgtccccaggtgtgttatgcagaccacgtcttcatggattgcttgtggctgtcgtgcccaaaaaggctgctgtggccaagcaagtttgggaaacctccctgggttcaacttcttttttttttttttttttttttttgagacaggctctcactctgtcacccaggctggagtgcggtggcatgatgtcagctcactaaaacctccatctcctgggctcagcgattctcccaccccagcttcccaaatag

SEQ ID NO: 135647 - DNA, 1063 bp, Homo sapiens
cctgggctcaagtgatccactgtgcctggcctcaacttctttctttactccagattcctcggagccttgaacatgctaaagtacactgggggccgggcacggcggctcgtgctgttaattccagcactttgggaggccgaggcaggtggatctcttgaggtcaggagtttgagaccagcctgcccaagatggtgaaaccccgtctctactaaaagtacaaaaattaaccaggtgtggtggcgtgtgcttgtaatcccagctacttgggtggctgaggcaggagaattgcttgaacccaggaggcagaggttgcagtgagccaagattgtgccactgtacttcagcctgggcgacagagcaaaactctgtctcaaaggaaaaagaaaaaaaaaattaagtgcactggggaggtgaagaagcagaatgcatgccagctttcctgaatttatttgaccatgttaattttgtctctttttttttttttttttttggatcatttccttggactagtttagttttgtttaatttcctttagaaaatactgcattgtactctcatccctctagtttttataatgttagtagcacttttaaaataataccccacaatggccaggcacggtggctcacgcctgtaatcctagcactttgggaggccaaggcgggcggatcacgaggtcaggagatcgagaccatcctggctaacacagtgaaaccccgtctctactaaaaatacaaaaaactagctgggcatggtggtaggtgcctgtagtcccagctactcgggaggctgaggcaggagaatggcatgaacccgggaggcggagcttgcagtgagccgagatcacgccacatgccactgcactccagcccgggcaacagagcgagactccacctcaaaaaaaaaaaataccccacaattagttgggcgtggtgtgcacctgtagtcctagctactcaggaggctgaggtgggaggactactggaatccagaaggtcgaggctgcagtgagccatgattgcaccactgcactccagcctgagtgacagagtaaggccctgtc

SEQ ID NO: 135648 - DNA, 1184 bp, Homo sapiens
ctggggttcaagcacttctcccacctcagcctctagtagctgagattacaggtgcctgctaccacacctggctaatttttgtatttttagtagagacttggtttcaccatgttggcctggctgatctggaactcctgacctcaaatgatcagcccgcctcagcctcccaaagtgctaggattacaggcgtgagccactacgcccaggccctcttataatgttttaagaaagtttacgaatttgtgttgcgctgcatccagagcccagggccatcctgggccacatgtggttggacaagcttgctttaaagtgaggatcatgaggacttttttttgcatcggtgaaatagtgtgacatatcgtgcctggggctctgtttaatgagagtgacttgataaatggtggggctgaaccgtggaattcacatggaagtagtgggagtggtggtccattctaatgaagaaaatgatttggacagctgacttgggaattctcaaggcctctgaccagtgagatcagaaatgcttggcctgagtgcaaaaacttaacatcaaatgtggtttgtcctaggaacagttgggaccctaggaggcagcggcagttgtcaatgagctctgcagacagtgcggacgctaagcggactcgagaggaagggaaggactgggctgaagcagtgggtgcgtcccgtgtggtccgaaaggcgccagaccctcagccaccgcccaggaagcttcatggctgggcaccaggccctgactaccaggtaccaagggcccttggctgtcctgtgtatttgtacttcattgagttgggtggctgggtttctgagaagtcctaagtgggcatttctttttcatttttatatttcttcttttgttaaaatgttttttcatagagacagggtctcactatgttgcccaggcttgtctcaaactccagctcaagtgatgccaaagtgctaggattacaggtgtgagccaccatgcccggctgttcttactttttttaagataaggtcttgctctatccttcacctcccaccctcaagcgatcctcccacctcagcctcctgagtagctgggactacctgtgtgctgccacacctggctcatttcattcattttttgtagagacgaggtcttactatgttgcccaggctagtcttgagctcgtgggctcaaggga

SEQ ID NO: 135649 - DNA, 1602 bp, Homo sapiens
tgagaccaggagttcaagaccatcctggccaacacagtgaaaccctatctccaaaaaaaaaaaaaaaaaaaaaagccaaagaaataattaaaacagcttcaaagtgatagaaaagttggaagtacattacaaacaatattttttctaaactgattgaacagtaagttgacaacctgatgagactctttacactgtggtacttgtttcctaccaagatggggacattccacccaggtaactacagttacttccaggaaattagccttgataattgattgtcgtttaatctgcaggccccattcagcttttaccagttgtcccattaatgtccttactcgaaataatccagttcagaatcacacacctctagccttctttatctggatcagttcctcagcctttccttcactttcatgactttgaggctttggaagattacaagccagtggaatgcccctcaaattgggtttatcatcatctttcttgtgaagaagtccacagtttccatccttggcagggatcttcaggcatgacctgacttttctcatttcatcccaccaaggcaaccacgacttcatcctgtccccctctggctacgtgcactttggtctcttgattaatggggtgcctgccaggtttcatgctgtagagttactcttttccctatttgtagttgataagaattttgttgggagaaactttgagactgaacatctcgtttttgatcaagcttttagtttactcatttatttacatcagtgggtgtaatctactctcacctggttggccattgggtgttccttcaggccagtgcgtgtcctttttccctgttctccatcctttttggagcccttccttcatctttcccggatgcatgacctgtcttgtcctgggtccgccctttctccatgaagtcctagttcctcttagtgaaggatgatatttagaaaccagtgtctgagacccagcaggctccttgctgctggggtgtcactgcttccgggcctcctcagcggacagttgcggggaatgtatgtaggtatatgtgtgtgcacaaatacacactttcatatttgtattatttctgtacctgtccatattggaaactgtgttctcattgatacctccagttccacagactttgttccacttcctcccagtgcatgtttgcacctcctttctgtgacagggagaatctatctctcatcgtccctcgtatttatactcacttggtcagtctccccatgtatgaccaatctcatttctgctgccacactctctcccttgcacatatgctctccttgcccactcagatgtcattgtccccactcctggatgccctgaatgtccctgctgggccaactctgcctatgaatgtccccctcatctagcttgggctttggccccacacctctacctgcatgccctcctccccttgcctgggctctaaccatttggagtgcagtcagccgccaggactccctggcaccaggctcctggcttgcattgccacacctagtgactctgggactggactgttgaggagtgggagggctggggaagggggagtcatgactttgaatacacttggtaaagcctgct

SEQ ID NO: 135650 - DNA, 2738 bp, Homo sapiens
catctcagctctgccactgaccgtgtgaccctggacgtcatctaacctcttgacccttagtgtcctagtctgtaaggtgacaacaggtgaagcctcctcacatgtgttgtggggagtccctgagcttgtgtacgtgatgcgtttggcacagggccagggttcagggacgtgactgttctagcagtggagcgtacgggccaacaggaagaagtacttgtttgtaaacacttggttggctgagcttctgtgagctcactgtgtcatttctctgctggtatattctctaggctccccagaattccctgcccaagagacccccaccacattcccagaagaggcacccacagtgtccccagcagtggcacagagcaacagcagtgaggaagaggccagagaggctgggtcccctgcacaggagttcaagtatcagaagtcccttcctccccgattccagcgccagcagcagcaacaacagcaggtaaacagatgagatggtaaaagactgtgataaacaggcctgagtgccgagcagatgtttcccctcctcgtccccatgccccacctccaacttagaaaaaggccagaatatcccttatgtgcccccaagaccagtggggacgtcaggagttgtacctcaaaacttgtgaccttggtagatcagcccctggccattatttatttctctgagtggtggaggtccctgggaatgaatacagtctttgtggtttattgagcttgttttctaatattgttaaggaacctattcagtgctgtttgcagtgagctccatttttctagtgtgcaggctggttgttttatttcagagcagtgcaccttggacgttccttagaggacagtgtttcccaccctggggtcctcccaaggtgtaagggaggcctgtgagctgtttgaagagctgcccaagagaggcacgtcacctttgggttacagatgtaggtttgcaggtttcaagttggacagctcccttcctgatgttgctgctgaactagttgtgcatggccttggaggggtcagttatgcccctctcacccatatttcttcatgtgtaaaccaggaagaatgaatacctgcctttcagcatggcagagtgtttcatgccatatcgcctataaactattttattggtgtcaccgttattggctttttataaactttatttttatttttttataaattttaaaagggacctactttttgtcctaaagatcatgtggataatggttgtaattccacccatctctcctagtcctgatagtcttgaagcactcatcagcaatcgtgcctactagagtagtaataagtaagggaacacagtagtcaatactaaggaatagtgcattttggtgggacactgagatgatacatagacattacttagtgcacaccaaacagcaaggtgtgcagtaaattattactaatattaattgaaaatatttcaaaacgtgtgtgccatggagaaacaaaccaaggacttaaggcttttcccagtatctcacttaattacctttaaacttctcacctcagcctcttctctcctctgggcacctgggagccttccagggaccgcctttaatgtgattttagagcatgggagtgtaggcgagcactgcacagttactcatgttcttggggtatagaattactgatgggggagagctctggaattacttgcgccaaacctagcagcgacaattgctctaggtaactccttggggtgcggaggaagtgatgggtaagtccttccttaagaatagaaggaattgccgggcgtggtggctcacgcctgtaatcccagcactttgggaggcagacagatcacctgaggtcaggagtttgagaccagcctgaccaatatggtgaaaccccatctctactaaaaatacaaaaattagccaggcgtggtgccgcacacctgtaatccgagctactcaggaggctgaggtaggagaatcgcttgcacccaggaggtggaggttgcagtgagccgtggtcgcaccactgccttccagcctgggtgacagagcgagactccatctcaaaaaataaaataaaataaaataaataatagaaggaagtctgaaagcaccagggcagcctgtctggtcatattccctggagacctagggtgtagacaggaggtggagctgggagatggaggcccacagccttctctgtggactgggagagtgaatgactcaagtctcttgattgatgagctatatttattgagtgctcttaataggcactgggagtgccaacagaactgtccagggaatcagctcaggatgtgctgtagactgccaggcaggttggccgcctttttgtttgcggaatggaagggtgtgtgctggaggccgtttgggtgtcctcagagtgtgacgcagcagtgagtcctgcctcaaggccaattcagggttcctttaggaattagcgcccgaggtcactgatgggatagagcagggtctgaaatgaaccctcctgagtcaggcaagggccttgattttgaatagttactgataatttgtttacccatttgtgcaaatgttctgtatcctgagtgtggtgctgtgggcaagggtgcacagggagtctcttagggttcagtgagggttaccagcagtaaaatccatcagctgctgtgagtgcaacaaaggagcactggccattctgtgggagcagaggaccggggacctggtctcgtctgggggttacgacag

SEQ ID NO: 135651 - DNA, 1417 bp, Homo sapiens
gacaaggagagaagtggccaatgtccagacattctgtgggaggctgctgttcggttccaggagtgtctgatctaggtgaaaacctagcctgtctcgtgtagcacaggcacagatgagcctccattgtgataatggcatggctgtccaccagccttggacagggacctgagcttgcaagctgtaacacactgggggcttccccttgagcagctgcccatccctcccctccttggtcttctgttctaggtgggctttctgtgctgccagctggaaagctggaagggcgtgtgttgggtggcatctctgtccctggccgcaccagcctgaccaagtctctctctctctgtgggcaggagcagctgtacaagatgcagcactggcagccggtgtaccccccgccgtcccacccccagcgcaccttttacccacaccacccccagatgttgggcttcgatcccaggtggatgatgatgccttcctacatggacccacgtatcacgcccactcggaccccggtggacttctacccctccgccctgcatccctcaggtaagcactgtggtctgacggtccatacctgtatcacccaggatagcgtggtggtcaagggtgtcctctcgagttaaacagatacacctggattttggtctggctctttgtcaagtacacaactggtctgagtttcaaagtagtcacttgcaaagtgtaggtacaataatagttctgtcataaagatttgttgggaaagtcatgaagatcgtgtatcataaattgctttaattaattttagatttctgctatgtcgttttgtccttcttctcattcttaatgttctttgtgctgtctcttttttctttgattagtctttcccaaggtttgtctagtgcctttttaaaatcagtatttgggcttcttcattcctctaacttatttgggttttattttaataatgcctgctttttcttttcttatttcctttaaaatattatcatatacttagtttattaatttttggcttttaagattctctttgcagtactaatttctaatgtagttgctctgtggtcagataatatggtctgtgtgatacagaccaggggtcagcaaacttctactaatgaccagatagtaagtcttttaggccttgatcagctagtcagttttggtgttgtaggacaaaaacagccataaacaatagtaattgagtgaacatggttgtttttccataaaacgttacttgtaaaaactggcagcaggctgagttttgtttaatggctgtagtttgctgaccaactcctgacttaggttgcttgacatttgttgggttttctctgtagcctcttccatggcaattcttttttaacattctacatttgcctgaaaagactgtattctctggttggagatagtccattaa

SEQ ID NO: 135652 - DNA, 1149 bp, Homo sapiens
aaagtaagcatgtgagtctgaattcctgggagggggacaattgtttccctgccctggtccaggccagacagacccgccagtctgttcctggtagtaaagcgcatgtgtctatctaatgtgccttttgaggatgtggcccttttgggtctttgttttaaacaatgtctcagttgtatctccctgccctgtatagaaaggcttcatcccctgtcctgagtgttaaggaccaagcctatatctgacaaatgtgcttttcttgcccccttccttggacaggtctttgaaccaggcagggtgcatgtgtgtgtgccttcagaggtcctcaggtcaggaaagattaagagccctatgatgtgtaggtgggtggggtgctgtatccacatgaaagtcagggtaactgttaacttctttgggcctttggttgaccctgagattggagcagggctttctaaatgagatgatgtagatcagtctttgccttcttcaggactgatgaagcccatgatgccccaggagtccctcaatgggacaggctgtcgctctgaggatcagaactgtgtgcccccactccaagaaagaaaagtgacccccatcgactcaccccctgtgtggagcccagagggctacatggcactgcagagcaagggctacccgctcccgcacccgaagtcgagtgacaccttggctatggacatgcgtgtcaggtgagatgaagcctggtcctgctgccttgccactgaaggaggactccaggtcctaattgagagggccctgggatgagctaccatcctaggagacactgcccacgggagacgtgctccttgaagggactcctggttcctctggggaaggagagtgtgaggaggattgcttgaatgctttgtccaagaggctcttttcagatggtgagacgtaaggtgaaggagaagtcccggggtcctcaaatcctgggcacagggcaggcgggtgggggcttcacaaggcaggtggggtccagagcatgggtcttggctcatttctgtggaagtaaacagagttagccctgccacccccatagccccagactcttcacggcctcccaggctccagcttgctcttgctctttgacccggaggattgcctggctcctctgtctccagggggcacacc

SEQ ID NO: 135653 - DNA, 1214 bp, Homo sapiens
gaggactgccccagagccaagccccgacggagagttgccagtgagacccatagcgagggctcagagtatgaagaacttcccaagcgccgccggcagaggggctccgagaacgggaatgaaggctcgctcctggagagggaggagagcaccttgaagaagggcgactgcagagattcttggcggtccaacaaggggtgctctgaggaccacagcggtctagatgccaagagccgaggccctcgggcctttgggcgagccctccctccccggctgagcaattgcgggtatggacggagaaccttcgtctccaaagagtcaccccactggcagagcaaaagtccaggcagctcttggcaggaatatggcccttccgacacatgcggatcccggcgacctacagacagagactatgtcccagattcctacagacaccctgacgcatttggtggccggggctttgaggacagccgcgcggaggacaagagatccttcttccaagatgaacacgtggcagattctgaaaatgcagagaaccggcccttcaggagaaggcgccccccacgccaagataagccccctcgattccggcgcctccggcaagagcgggagtccctgggcctgtggggacccgaggaggagccccacctgctggcaggtcagtggccaggcaggcccaaactgtgttctggggacaagagtggcactgtgggccgcaggtcccctgagctctcctaccagaactcctccgatcacgccaatgaggagtgggagacggcctccgaaagcagcgacttcagcgagcggcgggagcggcgggaaggccctgggtccgagcccgactcccaggtggatggtggcctgtcgggggctagtttgggtgagaagaaggagctggccaagaggagcttctccagtcagagacccgtggttgacagacagagccgaaagctggagccgggagggtttggggagaagcccgttaggccaggtggtggtgacacctcccctcgctatgagagccaacagaatgggacgcctttgaaagtgaaaaggtaaaaccagacaccatctgggccctttttgttgttgtgttctgttctcagcagcactgagttcacgcatgcatgccgatgccgccgtgtgtcggggctgggggcctgcccccaggccgtctgtgcgcgtctccattgcctgcccccacattgcctgtctgc

SEQ ID NO: 135654 - DNA, 1706 bp, Homo sapiens
gcatctaatccagctttccaggcgccagaggctgacccttggcttcacctcagttttctgccccaagggccctccggcagggcagtcctggagaggagcagaaatgctggcgtctccattctgagcatattccccttgtctctctcccccctacactctgaacatagcatgtgggagagccctggggagccactttccccaggagcaggcagagccggtgggggcagccttacacgtatgtttgcacacggacatggatgcactgtggccagcctgccgctcctccccacccgaggagtcagctagaggaagtgggcctagatcagggtgccgggcttgtgtgcaggctgtgtgcacgtgcggtgttttccctccttccccagctctggttaacaagatcctctttcccttacagatccccagacgaggccttgcctggaggtcttagtggctgcagcagtgggagtggccactccccctatgccctggagcgggcagcccatgccagtgctgaccttcccgaagcctccagtaaaaaggcagagaaggaggccaagttggctgctccgagggcaggtgaacagggagaggccatgaaacagtttgacctgaactatggaagtaagtcatcctcatatcttcaggggaaagaactcaggcagaaccaggggccatgcagtcctcgggcctcccgagtttgcccttgcactgagtaccttagctttcggaacagctcggccaggccctgggctgggttctggggctgtagaggtgagcagagtaggtaggattcccaccgagtgttgctcacagcccgttgaatccccgtgacaccctgcagcttccgggctttaaagagaggaagcctggggcccagagacgttcggtggtgtgtccgaggtcacacacagctgtaggagcagagctggggtttaagctctttgcgtgttctctcagttgtgcccttgggcctctttggtttggggtaacaatgtgttagatcagaggcggcctgagaaaagtgcggaagtcctgtccaggtttctgtcgagcctgatgctagatctcaggcgcctgttgaattgggttgttcttgtctcctggtgagtggaaagactgttccttctcgtgaaatcttggttcaggtgccatcattgaaaattgcgggtccagccccggggaggagagtgaggtgggttctatggtgggcgaaggcttcatcgaagtcctgaccaagaagcagcgccgcctgctggaggaagagagaagaaagaaggagcaggccgtgcaggtgaggggcggagggtgggggggcatggggctggagggcaggctggcagatgcccaggaaacccagagccagagggtaagggagttctcggtcaagctcaaggtggcagagaggaagaaaggagtatttagcaagcacacattgtctccccgttcctgctattaccaaggcccttctatcaatgtaggaataggtggtggcatcactgttatgcagtggaagaaaccgagtcttgaagagggtgacttctctagggtgataacagtggaaacttgtccaaggcaagatgcagacctccgtcacctcccagcttctccttcctccccactcctcattcctgagtggaatgagatttgtctccctcaagtcaagtggatcgtgaacgctatactaaaatggagtcagggctggacct

SEQ ID NO: 135655 - DNA, 1109 bp, Homo sapiens
gtgagatgggtttggcagcctcggtctggggcccatagaagatcctgtggtcacgagctctatcggggttggtgtgtttggccacacgtaagttgtcaggcatcctcagcagggcaggatcaagatcaggaccagacttggcaagggacaggcagctggggtagaaaagtctctgtgccacatgcagttttactctctggataatcgagttgggagtttgaggctataacccattttgtgctctgcacagcagggttttaagagcagccagggagatagtggcgttgacttgagtgccgagtctcgggagtcgtctgcgacctcctcgcagcgcagctccccatatgggactctgaagccagaggagatgagcgggcccggcctggcggaacccaaggccgacagccacaaggagcaggctccaaagccatctgagcagaaggtaacctggacgttccagtcacagtggccagggcctgggtggaaggggccatcgtctcatcatcttcctcaattcctgggacagtagaagctagagagtgtggtcattccagtctgtgtgtctccacctctctgcttttttatcaaggattcagaacaaggctctggacagagcaaggagcacagaccaggacccatcggcaacgagcgttctctgaaaaacagaaagggctcggagggggccgagcggctgcaaggggctgtcgtcccgcctgttaacggggtggagattcacgtggactccgtgctgcctgtgccacccattgaatttggagtcagtccaaaagtgaggctttgatttgttttcttgcttgctttttttactttttattttggtacttggagaggctgggggctcagatgggattgtctcctagaaggaatagaaggatgggagccaagcagtcttccagcggctagagtgttggtgtggagtcctgcacatggccagtgctctgttgagttgctttaaagattgcttcactgacaccagacaggccagtgatcttccctgtttctgtcaggccacccaagggacagggagaaagaagtgaggctggcgtcctgtctcctgtgccgtggggaaaatctggccatctcgctcatat

SEQ ID NO: 135656 - DNA, 3295 bp, Homo sapiens
tctccatttattatcaagaaaaacggattaacagccccgaatgtcacctcctggccttgtcttaagtagcatgtagaagtagcaacttgtttttaggcccagtggtcgtagctcccatgtgctgcaggtaatgtgcacgtcctgcttccccacgctgggaaacagaactgggggataacagcgaggcactcctgcctactggtgacaggagcgagcaaaggcttgactttgagtcagacctgggtcatgtgctggagccgtgtcgcctcggctggtgagcagctcttgccgagccacagtgtcctctcctctcttacatgaaactccgtggggtggccacacccgtgaggccaggtcttacctggaaagggctttgtatcaacagagccctcagtcactggcagctacttttgtcctgattgctgccatccttatcgtgtgccagtgtccccaaggggaagcgtgggggttttgagggcccagctgccagtctcagtgatgtaattccaatagatccttctgaccctccactgtggactcaatagcagggagatgaagaggacagtgactgagagaccaaggcagccctggttaaagtagaatgccccttcgagtgtctggggtagttggtgagtgggaggtgggaagggtaggccagagcccacctgcctcctccctcctcctaggtctgacgctgcaccctccctacgttccctgaggtgcgtgccaggcgtgttgtgagcaggcgtgtgcttccggcacacagggaacctagcagcctctgtacacacgccctcgtccccactgagtcccctgggtagagcagacctgtagactgtttccctcagggacattgagaagtagtgaggcttgatcctcttctacgtcccttttgccgctctgtttccaggcagccacctcccgcccctgtacctggatggccatgtgtttgcaagtcagccccggctggttcctcaaacgatacctcagcagcagagttaccaacaggtgacagcagctagccaggtggcctggctgggggtggtggggaggagccagtgcagggcggaattggcttgctcatctatttctcattgtctgtctggttttccatccccctcacatgtggtgaccagcacctggcccgccacggcagccaggaggcatttgttaagcgaataatcgagacagggaagaggagtggagttggctgctccagactctgcttagttttcctttctcaaagttctccctcctgtgtcctagccggggaattagctaaaatggaattttctttggtgatcaggtatccttctgatgaagagaagaaaggcctaaactcccaggcatggatgcattagaaagaggtagtcttagaaatgagcaggcgttggttatttatgcaggactggcatactttctgtgctgccaaggggtgatttttggaagtctcccctctaatgctggtgctgggcctttgggatggtctagccgcccctcagacccatgtgcctccacagccacgacagtggacttccaggcagaatctgctccaagtgcaggcttgctgatggaggatgtggcctctgctgacctctttttaaaaacatgttcttaactgctgtattgtttggttaccaagattttggttcttgcataactgggtcagactgcatgtatctttctttttgtgcattgttaaattcagcgttatgtttttggaactcacctctgttgacgtatgtgctaggatccatttttgttgctgtgtagaattccagggtagggatatgctgtggtttggggttgctaccagtttttcattataggctttatcccaatagcaagggaagcccaggaatgacatgctggcatttgaattttgggcagtgttccagcagccatgtggagaggggcaggggaggtgggaggggaagaaccacctggatgggccttgcggttacctccccgaccccgttttcccgttcacaggccgccgctgcccagcagatcccgatctcccttcacacatctctgcaggcacaagctcagcttggactgaggggtgggcttcctgtgtcccagtcccaggagatcttcagctccttgcagcccttcaggtgagctcatgtaccagcttgcggagctggcagctcacagccagggccttggccctgtgtgcagccttcgtcctgcagctgtttggtgcttgtctgctttggggccagtggggcggggaggggtgggagtttgctctgaatcactcttcagtccgttgttaactgtgctctaggagaggcctggggcgagctgatatgtggtgggccgtgttttgcttttccatgtcatcttgcctcctttccttgctccttcctcctcctctccccttgactccctgtctcctccccaccgcgggcttctccgtcagtgtggctgccagtcattgtggctgatgtcctgtgcctcgtacagcctggatgtcttcacttgtttaatccagcagcatcagcgccatctaggagcttgttctcaggccccatcctggaccctctgagtcgcgctctgggggtggggccggggatctgtggtttagcaagctctccggggatctctgaagggtgggaccagatccgcagctggactcatccacctgatcccgaccatctgtctggcttttgcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacaggtcaggaattcagtcactctacccaaagccctaggcttctttccttcacgaccttgccttttcttttcacccgcctctcagtgtgtgctggcctatcgtgctgttggttggtagccaccgtgcccattcctcagcgtgcaggaaatcagcctcttctgagtagccccatcacctttttttttttttggacagagtctcgctctgttgcctaggctggagtgcagtggcatgatctcggctcactacaacctctgtctcccacattcaggcgatgctcctgcctcagcctcctgagtagctgggactacaagtgtgtgccactgtgcctggctaatttttgtattagtagagatggggtttcaccatgttggcc

SEQ ID NO: 135657 - DNA, 2454 bp, Homo sapiens
ttgtcatcctcccccttggcctggcttcttcctccccatcagcagatctgccgagccacatggcctttgcatttcatccaagctgtggctcccagtcaacccccaccctcctagcagcttttcagacttgcatcttgcccctcgctgcctcccacccatgacctccctttctgtgtcacccaggaaacaggagcagtgacagtctccaagcccctgtggccacatccctgcctaggtgctgcctgtgcccctggggggccctgccccagcacatctccctctctttcatgcatcagatatcccttcccgtcagtacacagacgagctgcagtgctgaccccgtaatcccgccccccacacccctcgaaccactttcttcacccagtttccaggccgtcgctcctggctttcctgctgcctcaggcctcctcctcagtctcctttgctgtcccctctccttcccagtctgtaatggtcagcatgcccgtgggccctgctttgggtgtgtttcaagagtcatggctctaaattccttcatcttctcctcactcccaaatggacatctttagctcagatctgtccctggaattgaatctcaaatccaatggactttccagcatgtctgctatggtgtcttatggcatctcaagactcatcatattcaaaactcgattttcctcccggtccttctgcttgtccagtccacatcctccttggctccctgctccccctcacctcacccccttacccttcagcaggcctgtcagctctggctttaaaaggattcagaatccagctgtgtctcatcccctccacacccctgcatgctgtccagctcctgtagggactcctacctggcctccctgcaagtcagatcataccccaagtcagcactctataaatggcagcatcttcccatcattttcatcctgcaccattttggtgctccaaggaggagcatggtgttttgcggctctggccaccacaagtctcagtgatgtaattccaatagatccttctgaccctccactgtggactcaatagcagggagatgaagaggacagtgactgagagaccaaaagtggcccagcccccctaccccatcctgttcccctgtccttacagtctctgggcccacatccccacctcgcatatcttgttctagttagttaggccctgcagctaccctgttctcctgtcagcatgcttcaaaggacccccacagtctggaatccagcccagtcttgtttttaccaccacttgatgcaaaacagtaagagtcttgaacgtgtgtgctgtacaaaggaatgcagagatatacgtccgatgcagctttcatcttttgggacttggcttcgccattacttctgactttcctcactcgtcctctccttgcccaccccgccccgtgtgcacccataaatctggtgtgcacccacagatcctatgccgctctgcatcccgagtgtcctgcagctgtgtccagtgtgtgacacactatcctggcagtgtgcaggcccatgttggacagggccctgccgcttccttggcaccttgtatgctttcagtaagcacttgctggacaaaggcagaaagggctgaagatagacgcagcccttagcagagatgtggatgagacacacttaacgctgttagttcccatgcctgcagccagcttagtcttgcccgttttctcaccacctactctattccagcaagaagacgtgcctctgccatcgaaggtgtgaaatcctgggcgatctctcctgtgctgcagtagaaattagagcatgtcctgctttatgcaggctttgctttagttcttctgaagtgtatgaatctgaagtgcatgtgcggtcgctctttggtgcgtttggggtttctccatagcatcattccccctcctgactgtcattgtcgcccagcagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagaggtaaggggaccccatctgcctctgaccctagggagggggccttgtgtcaccaactttttctagcaagctaagtacccctgtgtggtagaaagagccagtggcgtgggactgccagggcagaaaggaaggtgaccatgtgtggggccatcacagaggcaggtcctggggactctgaacatgtcgagggctgagggccaggaatcagcattcctccccagctccccaggaggccctgctatggacggccatgtttcattggctctcccacttcactttaaaaagaacaaaatattgtgatggttcttgcttctaagaagaagccctcttgagtctggcttagagggaaagggcttgcagatttctctagaac

SEQ ID NO: 135658 - DNA, 2062 bp, Homo sapiens
ctggacagcaccgaccatggagcggaactggaaggaggaaggcggctgcaggtctcagcagacgctgtcccgctgctgccacaggcagattccagcagcctctggctacagagccttcctcaaaaagcaaaacccagagacagagcctcacgggacaagagtcgcctgtgtctatgtagttgtaggaatgaatggcagcagattattctttggagcatatttagaaagtggaagccttaaactagtagctttgtttctatggtgttttaggggggttggggaaattgctataattgtataaagcagtgtttgccaaagtgttctggaaatagagctgctgagatgtgcgctgcaaaaacaagggttccctggtcaggtccttgggggagtgctgtccccagggtggcctgctggggagggtactcaccacacaggctgagcgggcctaggttgagagtcctgttgaactctgcacacggcacttaggctttttgaccgcagactttttttttttccacgtagcacctaattaacatccctgggaactaactagtggtcagtggaacacatttagaagcatgttgtacattttggttcccccatccccttttctgaaaagtgaagactagaacaatactcggcacagttctggctcagcgtcaggcttctaggccttttgtctggggcactgcatcgtgttggtccagaccctgagacggccagtgtcgctttctgcacagcaggacagccatgcccatctgtacagggcctcagcctccctctcttgcggtgcgtctccttgagctctgtcctggaggtgccagggtggtcagtgacagccaccccctcacccttctgcgttctgggctgtcttaggtctgtggttgttttccatccaagagatccacggaccgtcccgagtgagcgcctctggccgcaggcccttccttccttgtgcctcctccatgtgctaggctttgactccatttctgtggtgacacgttgtgtattctcaacccctgcctttggttttttcaggcctagctctgctagccccagtgggaagccctctggatcagcagttaacatgggctctgtgcagggacactacgtgcaacaggtagaagatggctttccagacccttcagccctggacacttaggcccgtctccaagcgccaaaagagaagggactgtccaacctatctgagcgccccctgtctaaagacagccatgccctagcggttagagcacagaaccgggagctgggccgcccgcgtccctcctggcgaaggcatttctcctcttgacgggcgtctggatccttccttgtcctgcagagaagggaggatgctgattcctctgaggaggtggtgctggaaggtggaccagccctggcaggtcggggctgaggcgccctgggagactcggttaggtttgggggtcggctttaggagccggggtgcgcgcgctggttctagtcagtggtgtgtctcatctttgtcttggctgggtgggagcacaggtgaaattaagttttcccattttataatgaaaaggacatcgcagtgtcttttcctgcacgcactattctcttctctattctctaaaacgtgctggggctcagagcttaagcccctcagacgtgggtttttaatcagtcactgtgcctggctggtagagatgggaagtgattgctctcattggttcccctaggggtcatgaaagttgtgtggaatgagcttctaaagctttcttccagagttcagacctggtggggggcagatgcgctggctgctctgtgacttccccaccccactccccgtgtagagccacagaccaggggagccctgactaggaatggggccccagggaaaggttacagagtgggaatggtgggggggttggctgaatcgcggccagagatctgtgggggccaagtctgcctagggccccagcagacagtcgggggctccgagacgtgcagggggcacttggatctacttgaaggggccttttttgcctgtggggcaggaggtgcactgatttgaaaaggttcttcc

SEQ ID NO: 135659 - DNA, 5169 bp, Homo sapiens
cgaatcactgcactcagggcttatggggagggagcagagacggcactcgcgccactttccttactaggaggggggtttctaagtctggtccttcaaccaagggactgacaacttaggggagctttccctgcaactcaggagcaggaagggagtggtgggaactatgtatccaaacacgtttcagcgtcagggtcactttgtttttcccattcatctgtccaaaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacataccacaggcccatcccaggccccgtgggctctgcttctggggctccataccctgccctgcaggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaagcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctgtgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgcgatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaagctgaacgtgctttctcaggttgtacatccctcgtttcttggtcatttgaccagagagacctacagatcaaagaattctaattttacagagttcacacggaaattaggagtggcacggctgaaatgccttaacagaagctgtgtgggtagagaagggattgaaacccgtggctaagaagcatcttccaaatgcggcagcatcaagcactccaccctcttcccacggatggcatctggttgtgcacagtgcctgcctgtggccccgtcacttgccgtgagaaacgagctggtcagaggaggtaagcatttgatgtggcgtgttgtgttgtcacttctagcggtgcttttgcaggaagtggaggaggattatgctgtgctttggggtggggagggagcaagccaggcctggggtagcgaagggtaaaaggtaagaatgggctgaggcagcagttctcggttttgccattgcctcactgacctggggaaa

SEQ ID NO: 135660 - DNA, 1075 bp, Homo sapiens
cactgggggcagatgcatccttgaggagagatgaggaggccccgaggctcggccaggttggggtccctgggctgtaagcagctgagatggcacccaggagctgcccagggtcaggtagctgtggccgcactgtgggcttctggtcgtcggggagggaggggagaaaccctggcgttccttagcagtgttctcgcgcccaagacgtgctcggcaggttttgtggaatgagttgttgaaaggagtgaatgtccagtcctgagatcccctgaattcccacccgagttcactgctagtgcccctcaccccacatgtctacctgaaccaaggctccaggaacttcggtctttctcagcagcccggctgtgctgtggttctcctcgtgtgtccgggagccgggtggctggggatcccttctgtagcctctcgtgagccctcatggaccacggctcctcccttcttttctagggcgtctgcctgagcccgcttttctacaagatgtggggatttttgaagcgccctgtagtggtgacggctgacatcaacttgagccttgtggccctgactgggatggggttactgagccggctgtggcgactcacctacccgcgggctgtggtgtaagctaaatgactccattcccagggtgaatctagaattgtactttgtgacaggaggcgcccttactgaatagcataaatgggagagtgaaatcctggcttcttggtgataggtgtttttggcagtgagaggagagaccagtctgtccccaggacagccccagcagagtacaccttttaggtcttgccttctgagtctgtaacaggtgaaatttggcccattaaaggggtgcagtagaggaaaatctggttgccagccttaagtaacagttttaaagtctggacggcagaggattaatggatttggaagtaagtcttcactgttgagagcactttttagaatgtgtttttgtcataatgggaagtgattgctgttattattgaagggctctttattaactgattaatgtgtgtatgtgtgtgtgtgtgtgtgtgtgtgtgtgtgtgtgtgtttttga

SEQ ID NO: 135661 - DNA, 1064 bp, Homo sapiens
gtcctcctccatctccttatgttttcctgtctcatgttaactccatttctgtcatgtctttgcagcatcaagtacatgggtgtgttcacgtacgtgctcgtgctgggtgttgcagctgtccatgcctggcacctgcttggagaccagactttgtccaatgtaggtgctgatgtccagtgctgcatgaggccggcctgtatggggcagatgcagatgtcacagggggtacttggtgaaaagactccaatcctcaatgttttagaagcaggcaggcctgggcagcctcgcctcttggcctctgcaggtgcctctgtatgggaggccagagtttctgtcactaactttttctaagctcacaatgtctagaggtgggtacgcttttccacgcagtggaacatgacttttctttgaatctctggcaggtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagaggtaagtaagcagtgggcatcgtggccactggagaaggaagatgatagtggacccagagttttcttacaaacacatcaagtgaacattagcacttgaatcaaaacatgaagaatccacatccatatttctttttttggtgggggggatggagtcttactctgtcacccaaactccgcctcctggcttcaagcgattctcctacctcagcctcccaagtagctggtattacaagcacctgcaaccacacccagctaatttttttgttttgttggtagagatggggtttcaccatgttggtcagtctggtctggaactcctgacctcaagtgatccgcctgcctcggcctctcaaagtgctgggattataggcgtgagccaccgcgcctggcagctgggagcattttaaagtcaagtcttacaaaccctgggcagtttcacccgccttaaggaccacactcaactgtgaccttcattcctatgaacctc

SEQ ID NO: 135662 - DNA, 1009 bp, Homo sapiens
ccgtcagtaatgaacactccctcacacggagcacttcctcacccggagcactccctaacacagagcacttcctaacagaacacttcatcacacggagcacttcctctaacacggagcacttcctctaacacaggacacttcctcacacggaacacttcctcacacggagcacttcctgtaacaggacacttcctcacacggagcacttcctctaacatggagcacttcctgtaacacaggacacttcctcacacggagcacttcctctaacacaggacacttcctcacacggagcacttcctcacagggagcactttctctaacacaggacacttcctcacatggagcacttcctcacatggagcacttcctcacagggagcacttcctcacacggaacacttcctctaacacaggacacttcctctcacactcacacggagcacttcctctaacacaggacacttcctcacacggagcacttcctcacacggagcacttcctctaacacaggacacttcctcacacggagcacttcctcacatggagcacttcctcacagggagcacttcctcacacggaacacttcctctaacacaggacactctcacactcacacggagcacttcctctaacacaggacacttcctcacacagagcacttcctcacacggagcacttcctcacacggaacacttcctcacacggaacacttcctcacacggaacacctcctcacacggaacacttcctcacacggagcacttcctcacacggaacacctcctcacacggagcacttcctcacacggagcacttcctctaacagaacacttcctcacacggagcacttcctcacagggagcactccatcacacggagcacttgctcacacggagcacttcctgacatggaatgtttgaaactgccgttgagaataatcatttttcctttttttcagtttacccagttgaggttggatatttagaataattctgattcagatgtaaag

SEQ ID NO: 135663 - DNA, 1028 bp, Homo sapiens
ctcagtgaacacaggcctctgatgcaggaaaccaccaggttccccagttccaccaaggaagacgcatcggttccctgtgaaaacatctgtgactttatgtacgaataaaacttatgtaactttacatctgaatcagaattattctaaatatccaacctcaactgggtaaactgaaaaaaaggaaaaatgattattctcaacggcagtttcaaacattccatgtcaggaagtgctccgtgtgagcaagtgctccgtgtgatggagtgctccctgtgaggaagtgctccgtgtgaggaagtgttctgttagaggaagtgctccgtgtgaggaagtgctccgtgtgaggaggtgttccgtgtgaggaagtgctccgtgtgaggaagtgttccgtgtgaggaggtgttccgtgtgaggaagtgttccgtgtgaggaagtgttccgtgtgaggaagtgctccgtgtgaggaagtgctctgtgtgaggaagtgtcctgtgttagaggaagtgctccgtgtgagtgtgagagtgtcctgtgttagaggaagtgttccgtgtgaggaagtgctccctgtgaggaagtgctccatgtgaggaagtgctccgtgtgaggaagtgtcctgtgttagaggaagtgctccgtgtgaggaagtgctccgtgtgaggaagtgtcctgtgttagaggaagtgctccgtgtgagtgtgagaggaagtgtcctgtgttagaggaagtgttccgtgtgaggaagtgctccctgtgaggaagtgctccatgtgaggaagtgctccatgtgaggaagtgtcctgtgttagagaaagtgctccctgtgaggaagtgctccgtgtgaggaagtgtcctgtgttagaggaagtgctccgtgtgaggaagtgtcctgtgttacaggaagtgctccatgttagaggaagtgctccgtgtgaggaagtgtcctgttacaggaagtgctccgtgtgaggaagtgttccgtgtgaggaagtgtcctgtgttagaggaagtgctccgtgttagaggaa

SEQ ID NO: 135664 - DNA, 1042 bp, Homo sapiens
ccaacccctccgtgaattgcagcctcagtgggtggggacttgggggactgagtgagagagcttgcatggcctggctggccttctcactcactctgttgtccagaggctgggccagctccctcaccactgtggctctgcccccacagtacaatggcccgatggctggcgtgccaggccctgccacggtggagcacaggcccctgccaaaggactacatgatggagtcagtgctggtgaccctcttctgctgtctgctcaccggtctcatcgccatcgtctactcccacgaggtaggtgcgggggcggccctgggcacagcctctcctagcacgcagccactggcgccccagtgggtccacagagcccctcttccagcaacacggtctctggtgtctctccctctggaggggggtgggaattgggaagtcagagcccagttgtttgtgggatccttgctcctcctgtctctgcccccaactattcaaaatgtgctgtggaatgtttggccaaaacaattcacggtaaagctgtgaatgactgataagacccaatgtgctgcccattccagtggaggcttgtgttttaaagggggtacaatctgctcattcattcctatgctcatctcatctatccatccaccccatctctccatctctgtagctacccatctattcacccacccatttatccatccacccacccatccaccatctctctctttttttttgatacagagtcttgctctgttgccaggctggagtgcaatggcgtgatctcggctcactgcaacctccaccctctgggttcaagtgattctcctgcctcagcctcccgaatagctgggattacagacgcccaccaccatgcccagctaattttttgtatttttagtagagatgaggtttcgccatgttggccaggctggtcttgaactcctgacctcaggtgatccacttgcctcagcctcccaaagtgctgggattacagacgtgagccactgtgcctggcccatccaccatctctctagcctccatccatccat

SEQ ID NO: 135665 - DNA, 2907 bp, Homo sapiens
gacttgagagcatgcccaccaggctccatgccaggcctagcctggccctgggcctggaccccgtgacagcacagctcgtcctcccattttacacaccagaagctggtgcccaccttgctgtgagaagggcctgacaaaccctggcctgcctgactctgaggcaccagagctcccccagggcgggccctggcatgcgttgttgggggcagtgggatcacctggggccccctccctgtgagcagcccagcctcagggccctgtttgtgctccatgtgctggtggcaccgtctctgagcactggtgtcccctctgtcacattggtcaacggtagcccctgcagcatccgtttgctgcgaggctgtggggatggtccccgcggcaccttccaggagggtggcgccatcgggccatccagcccacacaggtgctcactgactgctccccatcccctgcaccaggcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatcgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcactgggagcccttggtgttctgagcagcagggcccaggcagcacatgagcagtgcccaggggctccctgcgtgaggacggcaaggtgcgatgtatgt

SEQ ID NO: 135666 - DNA, 1072 bp, Homo sapiens
tgaccaggaagcgggcagcagggcatggggcttcataggacagggcaggagtgcacacaccctgggctgtggtcagttctgggttgtcccagcacgaacatggcagtggttgatgccagtctgtggcccgtcccctcgacaccgacggtgagtgtcatttgcacctatacatgtctgttgagtagtgggctccttccagtgagcgcatagccttcgtttctttggcaccatctctgttcttgctggccacctggaagtgggctccagccgtgagcgagccttcttggcatctcaactgtccatgagctcacgagggaaactcaggcttctgattccagaagctgctggacatacccagcagaagcaggagagaaaggcagacagtgtcgtcccggagagaggcaggaggccattagggccccagggagccttttggggcttccccgccctgtagcctccacgctcctgctgggcagagaggctctcctgctctgacgcccgcagcccgggcctgctcagccctccccaccggcctccccacccctgacggctcttctcacacctctgtcttccaggccggggaccttgcacgactttcacagccatgagatagcggagcagctaacgctgctggatgctgagctcttctataaaatagaggtacaggctgctcctgccagggggagccacactgtttgtccctgaatgagagaaacccccatcaggggaaagccggggctccacctccatctgccttctttccttttgtagattcctgaggttttgctttgggcaaaagagcagaatgaggagaagagccccaacttgacccagttcacggagcacttcaacaacatgtcctactggtaagagaggcccagcgccaagccctgttgctctggatggtggcacgtctgggtgggctctgcgttttcctttgcagggagcttgaatggtaggagaaggagctgcctctttcattccgctaagctcctgggggttcccatgagcactgacaggctgaggacaggggcagggacaggatggggcttgctggaagtggccacctggt

SEQ ID NO: 135667 - DNA, 1012 bp, Homo sapiens
tgggacatgcaggcggagacaccagagggggttcccaagccctcggctccctcgcccatcccactccccgtgccatctcccctgcctctctcagagcaaggactcaaatccaccctggctaccaccccccagcactctgcacccagacaagcagtttgcattgttttttccctctagatttggtgttgtactgcgaggcattcctgaccacctacaggaccttcatctccccagaggagctcatcaagaagctgcagtacagatatcctttccttcctgacccagggcccctgcaccatgggcattttggagagagagggaccctcttgcccttcagtcctcgtgggggaagccgagcagcatattgggtggcagtgtgattgaagtagggacacaggagccccatggaccgaggttcccacctctaccctcccgcattccagctttgagctcaggcaagttcctcatctctaaaagggccgagtgaaatgatgtgaagaggctggaacatagtctgggaatgtgtgtctggtggcagttgtggtcattggatgattctaaaaacgaattagacatgccccagactgggaggggtaagtgtgccggtcctgcagacgcctctgagagaccctcatggtcggctccggcagcttctcagagctgagccccagggcgttgggcacgaaggataccaagacccaaatagacagctcaggggtcagcacagtcaccttccctggagcggaccctgcgactgccacatccacaactggaatgggctcctgtccccagatctaccccatgggcccaccctcagtaaatgtcaccctctgcagtagtggctgaggaggaccccaggggtttggaaggacccacttgtgtgacccattgcctcttcaagtccaaacctgcccatcctaagaggctgacctgcagctgctgctctaggagggtagcctgggtcagctgctcctcagccacctctttgcacatagcccacggctgccatctg

SEQ ID NO: 135668 - DNA, 1023 bp, Homo sapiens
tgcagaccattagaccggacttcactcacatactccacgaggaaattcttgaaggtttgttctgtccaggaaccttcaattctgtagcagtggcctcagtttcacagcacacagctgccccaccctaccacgcattcagtgtgctgattgagagggctggaaaagcagggaccgtcccctaatccctaaaacgtcttgttgggtggactctgctagcaaagtcattcccagtcatgctctggaaaggaggtgctagtgacctgatggggcatggccacagcacccttcactgcctgccctcaaggggccagcaccacctggccggccagtctctccacacgctgcttctctttttacgtttaaaaaaatgatttaaaagatgatgtcagagcaatggtgaagtaaattgtggagggaatgaaaacacccccaccttgaaatcctagcccaacccgtttcatttctgtaagggactctgtccctgtgtttcctcagcacgtttcccaaaacatgtgacccagagtgactcggggaatttctgaattatggaagtagtactaaaaaatatttacattgcagaaaattagagaaaaagaagagatggctcccacaaactcaccgcagccactgctccgccctccccttcactgttccctcaccctttgtttgttctgaccagggcagggcccagacctggcgatgctgcatcctagccccagctgtgccatgacaggctcagagggcccctgggcagtccccgggcttctcggcctgagccgactccacttgttgaaggggtgaacggtgcctgttgttgtgtggattacgtgagggagtgtgaaacctgccccgcatgtcagcggtgctgggggcgtgatcagcagcatcctgagcgccgagtgcagcccttgcttggcttctctgcagtgaatccccctccctgcctgacatagggggctccatactcagccaggcatgggagcgactttcatttcctttttgtccacagcgaggggctgaaat

SEQ ID NO: 135669 - DNA, 1026 bp, Homo sapiens
tacctcctcttcctctccacatttcccacctgcccaccagtctcagagctctgacttagccgtgccaaccatggccggtccacctcccagcaccgtggacgggcctctctcggcttctcaggagagcagctttcatgggaatactgtctgccttccttccgaaacctctttcactgactcggtgagaactcagcgtgcacacacacacacacacacacacacacacccctgcacatggggctgcacgttttttaaaaagcggtttcacgttcctgaaagacactgcctcccctttactagcagttgggggctgccagcgcacacctgctggcagcatggctgagctgacagctactgagggtcacaaggtgcaatgggagcccatgtgtttccagaacagaactgactcttctatacaaagttctatcaaactaggaatctgattttccacaaatggattagtggccatttagagaggaacttatcagacgcataagatacaaaatgctactagctttccatttacttgtctgtttttagggaaaggtacaaagcccttcgcaagtgtggaggtgacagattcaggacaagtgtctgttcggttgcatgtggtgccgatgacagaagcctggtctctagcctgttaaagtgcctgtagcgcttcgtccaactcagagaaatgctgccttgcagattggagcagacaagtacatggggcagaggaagtgcaggcagcggaccccactccccagtatgtgggattgtcttgatgtgttgcttctctccctccataatcgtttcccgccacactggggacccctgctgtctccactacagtggggccatctctccaggatgatttagccccagacaccattggaggggcagcagcaggagacttggatcccctctagcacagaggcaagaggtggcaaaagcagctttgctctctgcacctgggaagaccagagtgcaggctgtggcatcccctggccagctgtgagggccggctggagggcctggccc

SEQ ID NO: 135670 - DNA, 1045 bp, Homo sapiens
tgtacctttccctaaaaacagacaagtaaatggaaagctagtagcattttgtatcttatgcgtctgataagttcctctctaaatggccactaatccatttgtggaaaatcagattcctagtttgatagaactttgtatagaagagtcagttctgttctggaaacacatgggctcccattgcaccttgtgaccctcagtagctgtcagctcagccatgctgccagcaggtgtgcgctggcagcccccaactgctagtaaaggggaggcagtgtctttcaggaacgtgaaaccgctttttaaaaaacgtgcagccccatgtgcaggggtgtgtgtgtgtgtgtgtgtgtgtgtgtgcacgctgagttctcaccgagtcagtgaaagaggtttcggaaggaaggcagacagtattcccatgaaagctgctctcctgagaagccgagagaggcccgtccacggtgctgggaggtggaccggccatggttggcacggctaagtcagagctctgagactggtgggcaggtgggaaatgtggagaggaagaggaggtaggcggaaggaaaggcggaacggaagcttggtggtgaggcacgaaatcctgggagtaggacctaaacacagacttatactacagaatccaggtggagaacaaacaaaaacgagaatacaagaagaaaagagaaaaagtaattagattggcagtagctgagcagtgacaggccgttcacaataacttagtctaacgggccaccaatcacgccaagcaacccccagtcctcaggccactgtgatacccacacccagcacctcctcccttgagaagggccctgagactggagagtgaacagcgctgtcctcagggctatctaaacagcatgacacagagaacggctcaagtggccacatgctctgctgggacagaaaataaaacctgcgtggcccatcgctgtcttgtctgctcaggaacttcgtggccaaattcaatgtcattgtaattactcattttgaatttctggatgaatctctcaggttttattccttaaga

SEQ ID NO: 135671 - DNA, 1120 bp, Homo sapiens
tgtgtccctaaccctcagccgctgatgagcagacagcctcctctggcacgcgctcttcctgatcagcagaggaattaagtggagtggctgttatattgaggactcagaattgttcctttaaagatctgctttcctgctgggcacgatggctcacgcctataatcacagcactttgggaggctgaggtaggaggatcacttgagcccaggagttcaagaccagcctgagcaacacagcaaaacgctatctctacaaaatccaaaaaatcagttgtacctggcgacacatgcctatattcccccctatttgagaggctgaggcaggagaatcagttgaacccaggaggttgaggctacagtgagccaagaccgcatcactgcactccaacctgggtgacagagcgagaccctgtctcaaaaaaagaaaggaagaaaaagatctttcctgctttcttgctaaggcaacacagagcccatccctaatcctttttccatgccaggactataatagagagaaggtgtcaccgaaaactagtgccttttctaagtattttacttgtgagaaaaaaaactggtgcctggccagcttcaggcagctttgccttttaatgaattggccacacgctcgcatatgaggtcatcagcctccagcatcgtttcgactccggggcccagtggctttcaggggtgtgtttccaaaggagctggttactgattccaccttttccctgcctgtcctgccacactctggccagtgcacccctctctccatcctggcttatggatcaagtctcagctcactgggctttgcatgcctggtgtcacaaagcactcagctaaggaactctgcagatttggtgaggctgtaccctgcagagctgtgggattgcatggttagggcctgtctcgtccaggatacacctcagtatttcagaaaacacgaactgattgtgatatcagccatacccacgccacctcttgccagctgtgttattaggcacgtggtctcccctcccagcctcagtattttcatcagtaataagaacagtaaggcactgtgtgtacgttaattgagatgatccgtgcaacacttacatctgcctagcaggaagcatgaggta

SEQ ID NO: 135672 - DNA, 1022 bp, Homo sapiens
tctagtcttgttctgtttctaactttacacatgagagttaacctgtttggccttttttccccctctgtaaatgatgagtttggaccgagtgacttttaaagacttatccaaactcaagttcccagtttggtcttgtctggtttccatctgtgcccagggtgggcagtccaatgcccagtgccttcgaccaagatggtcctgcctgtctgaggaccttggagtgcattctcccaatgggtactgaggcctcacgccttagagcccccagcatccctactcatgctgggaagatgcgctcccctcaccctgctgtggccacacagaagcccctggtttcctcagaggcacctctggcaagctcctttcacaaatcttgcgaaacttggcctttagacaatccgagctcttgactgagctagatttttgtttttgttttctttccccttagagtttccacaatatcccttttgagcagttagggttagaggactatgaatgaactggactgttcgctacaaaattaaattcgaggacgttttaattaagtttggttatgagtacgtcatagtttttatccctgggacatacaagagccttaagacatcttgtgtctaaaacactgcattcttagcaaaaagcccaccaaggagcctgagggaaggaccttataaggtccttatgtcattaaaaggagaatacctcaggaaccattagtaatggccaggtttgggacattcagcacccagtatgccggaacctcagagaagggattcagtacggtgccaacatgtccttcatatatcctttggttaaattctgagatgagccccagacatagagctttggattactatcagagcggccctttattcctgactttcttcattcattgctcctgggcctgtatggtttgtccagcatggaactctgaaggagtgccccttggaaacacagcagttgacaaatctgaagacacctcacgtggttcttggcacagtggacgattatttccactaaaagat

SEQ ID NO: 135673 - DNA, 1052 bp, Homo sapiens
ctagatgggaaggctatgaatggttggttctctggggccttaaagaccatgaggcatccaggtgaggcaggggcaggcatgggaaatgtgagtggccaccttgggagcatcaccagtctggcataaactgacagagacattttagcctttttatcccaatctcgctttggaccttggatcagccctctgtgttccaggattaaaaaggaatatagccaggtgtggtgtcactcacctgtagtccccactcctcaggaggctgagacaggaggatcacctgaactccagagttcaagtccagcctgggcaacatagtgaaaccctgtctcaaaataaatagataagatagatgagatggatgagtagatgggtggtactattcctcacgtagaaagccaggtcgaggagagcaggcttcactagcgcaggatggtttgactctcagggatgtattagtttgcttttgctgcataacaaaccacccaaaacttggtggcttaaaataatagtgagcatttgtcactgcttaggacagggggtagcaggatgggtgtgctgctctggcccaggcttggccaattttggctgaactcactgacatccctgggacctgagctgagacaatggggctgatttggctgtgacccatgtagtctgtcacttccatcaggctggcctgggcttgttcacatgacagctggcgggcttccaaaaataacaaatggaagcgtgcaaggccccttagggcctcagctcagaagtagtgtgatgcctgttccattgcatttgctcagttaaattacaaggccagcccagattcagggagcagggaagttgcttctgcctcttgatggtagttgctactaagtcatgttgcacggggcatgggtccaggaagggaatgggctgcagccatttgggtaaacagtttactgctgaagcctaggggctgacactgaagaggggagtctttcactggcatctgcgcatgtccaggaaccaaaatggccaccattctccctttcgtctgttaaaatgaaacttagcacagg

SEQ ID NO: 135674 - DNA, 2806 bp, Homo sapiens
cattagggttccccattggtgttgcgcgtctgccggtctggacgtgtctcctccgttagcgcatcagacagagtgtgatttcattgcccgaaaagtcctccgtgctccgtctgttcgtccctctctgaggtgctttcagtggaaagccccctagctgctgtgggaagaatggggggaggggttccctgatgtggcctcccccggcctcgctgcagctttctcccttgtttcacagtgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctggtgagtgacaccttcccttgtgactagaacttccgatcctagcaggtctctaggaaccagaatgaccctccttgggggcagggttaaccctcctccctgctgtggcagggccctggttttgggcgtggaaggcaccatctcccacacagatgcttttacttcctccttagatgctcaccagcagcccagcgcccactccaccacctccccaccctggggtgcagggacctttcttttccacagcagccccgcgcagcagggacaggcttgtactcagggtgtttgctctctctgctgacagtctcttgtatttttttctttcttctttggcttcaacatagacctcccagaaaggagggactcaatcaaagcacaggacatggtctgtgcacagccatctgtggacttgattggcataatgggcctaactgtgtagagtgacttacaacccagccttggccggggagggcccaaggaaaacaagtgccattgaagtggaggatggctttaaacagagccactctgtttcagacatggcaccttcctcttctagaaaacactcgtgtgctaaggactcctgtgcatgtaaggaagcacgggccagcacagaaggcaagctgttccaccgtgggcaccccatgaggctctggaactgcccaggcactgggagggtgagcagatcgggggtacctgtggcatccctccaaactttctccctttgctgccagttaatgaacatggagggccctagtcaggtttgaagatctgagcctcttgtccagccatgctccccaggaagaggaagctccccagcagggagctccaggcttgttcagagctgcctgggctgctgctctcgtgtgctggccagtctggtggcttctaccaggaggcgactggtgtgcactgggccatcttttatccattgcgagaggacatgaggggccatctgattcttctgggaggcagctgcagactggaggacaaatgtccctggattactccgtataatcaatcacctggggctcagcccagtcccaggagttcctgagccttcctatactcagtgggctgtggctaaccaagcaagctgttttgtttccactcaaaaaccacactcagccacttcagaggtggccatgtccagtagaggaaaggccaagcttggagttgggagtcctgaattccagtcctgccacttgttagccgtgtcgcacgtgccattttcagagtctcagatcctcacctgccctgcccgtcccacagacacaattgagaatgtgaatctcaattgctctgaagatgtttcaaaaagggtcccaccatggaaacataaatgcctcatttagagaccccttgcctaaaatgtttggttagaactgttgccgagagccaggagtggtggtggcacatgcctatattcccagctacttgggaggctgaggtggaggatcacttgatcccaggagttcaagaccagcctggacaacatagtgagaccctgtctaaaaaaaaaaaaaagccattgctgagccagatttattgaaaatattttcggcccatttgccatccttgggcatcttctccatactgtggagtccacaggcttctgaatatttggggagacacccctagggagcacgtggaatcagaacctgttctaccacgcctgcagggcagtggcgagctcagcccccggaggcctgttaggaacatctgtgttgaacacctccccaggtaagcaccagggctctcatctggctctacatggtccctgccacagctcctggcatccccattataagtaaattgaggcagacagagccagcgaaccttaatccaagcccacagctagaaacagaagacctgggagccacacccaatcctaatgacagcccaggcataccacctgacaggtcctgccagctgctggtcacaccctctctcaaatgcagatgcaggaagcgttatccacacttcacagacaaaaatggtgctcattacacacacctgttggcccatgtacagtgtggtaagcaatatttcaagtgcttcacacgtatcatcccatttcatcctcccaacagccctgtacaggagacactagggttatccccattttacagatggaaaacctgaggcacggagacctttaagtagtgcccaaggccaaacgggtgagaaatggcagggtccagactcaaacccaggctgccggagccccgtctgagttctgaagacgtgtgaatgacacatggatccactccccacagaggagcagctccaagcccagagtcagcccagttctgtgtggctccagccccctcgtcctccttccacccaacctgcttccagtggacacaatttt

SEQ ID NO: 135675 - DNA, 1032 bp, Homo sapiens
gccacattggccaggctggtattgaactcctggcctcaactgatcggcccgcctcggcctcacagagtgctgggattacaggcgtgagccaccgcgtggccctcagttaggctttttcaaaaaggaattgtataggcaaaaaagtcatttaaggaaatacttcaaaatgtaaatagaaagtacagttagattatggtactgtgggtgatttttattttcttgatgtaatttgccacagtttccgtaatggttgtgtattttttttttaaataagaaatgtaaaaaataaaagtatagcaaacagccatattcccatctggtttgcttttataatcagggagaagaatgaagaatataacatgtgaatataaaataagccctggagacaggtctttgtcacacacccatgagcgagccggcgagaggcgggcggggggagctggctgctcctgcagggcctgtggctaacgggtctctttttcccctgttgtaactgcagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacagtaagcctttgttgcactgttgtcaggaagtg

SEQ ID NO: 135676 - DNA, 2520 bp, Homo sapiens
tgggctcattgcagcctcctcctctcagattagagcaattctcttgcctcagcctttcaagtagttgggactacaggtgcacgccaccatgcccagctaatttttgtatttttagtagagacagggtttcaccatcttggccaagctggtctcaaactcctaacctcaagtgatctgcccgccttgacctcccaaagtgctgggattataggtgtgagccactgcgcccggcctggagcattttagagaacccttagatcattttcagatgaggaaattgaggtgcaaagttgggggcacagccaagctccagtagctcattagcaaccaaaccagaaccccagggttctatatccagggagcctgctcttcagccccacctcacccactgtgttcttcctggtcacgtcctcaccctctcagggcctgtgtgtgctctgtcccgcctttgaccttctgtaaccccaagttcttcccaattctccagcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataataggtaattaccttcctatttgtccagtgcctcccatggcagaatgagaaagaaagggaggaagacagggctcgggccctttcccctcagcgctgagggcttggccccccttgggaggctgactctggagctgtccccaccccgccggccctcgctggccaccctgagctctcctgaaggcctccttgtgccctcagcccagggagacatggtatgatttattatgaaagaaaaagaaagggttgttcttttttgttcatttggtatttacaggttttattttggcggaggggagtaggcaggagttgaagtgtgaacattgggtgtggagagtctagtaatgaaagaaccccacatcctgtaccccaatatcacgctgaagagctttggtgagtgtggtttggtctgcctggacgtttcggtctgtttcagtcctccaccagcattgccacccaagaaaagacagtcggcgccgtcccctacccgagtggctgtggtggcccccatgagccgagccaccagtggctccagtttgcctgttggaatcaataggcaggtaatgcagcccctgttccctgcatgggaaggcagggagggggtggggggctcagggatgtggctcctgaagctgaaagaaacccatggtcttcaggcgctggtgtttgtcacatcgaggagtgcgagaccttgtacccatccctctctctccaggacacggtccaagttcccatatggggataagggtcagggcagggagggcagagccaaagggcgtctcctggggataggtgagtccagccccagggccctccctggccacaccccccacaaactccagatggctgcttctcagctgtatgtgtccttcgactactgacgtcagaggtggtttctgagttcgcctggcagtatttccttctctaagtaaatgcaccggttgcctcacccctggtctgtgccaccgtttctcagaagtgatttggctttgtttttctttttccacttgaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactaggtgagccgccaccatcctcctgttccatcgtgtctcggtggcttctctggggccattacagtcctgggtgggagtcccaggtcatgcaatcattgactacgtggctttggctgacttgtttaaaatctgagcctcagcttcctcatctgcaaaatatggataacagtatctgcctcccaaggaagttgagcatgtaaatgaaatcacaatgtaaaaccacagcctagatattcaagcggtgactgttagttcatctgtcagtgagtaatttgactctctttaccaaaattaagagccatttgtgttgagagctttaaacaaaggggtgggggtcctgacaacacttgacagaggctgaaggggagggagccgcgcgagccggccttctcgttagtcagtgctgaatgtgtactgtgcgggcccctccgagtctgctgggcagggggcttagagagcaggaagctgttcgtatcctgtgaactagatattttcacttctgagaatgtatcctaggagcataatcagtgattaatagcaagattttcattggtaggaaatcagatgaattatggtacattcatttgctggaataatctgtagctattaaaaatcactcatattgataactagaaaaagtacaggaccatttacatagtattctcaattgtttctttttttttttttttttttt

SEQ ID NO: 135677 - DNA, 1001 bp, Homo sapiens
atgtcttatgattattgaccattggtatctgtaaatttcttgtttgatatttttttcggcgtgttcaccttctagtttttttgttttcgaaagaacccttgcgctggaaaggatggtaactgactctttgccttatttgcagcatacgctgccttttttgtgtgtggtgcttttttgagtctggagaggcttggcagccgctggttcagggtctctggttactgtgttgcccactggcatccgctgccacctcctctgtaacttggaaacagctttctgctgaaagcctggaagcccctcatcacacacatgcaggccctggccaggccagatgtccagcaacaggaaggtggagggagaagctgtggtgcatccacgagtgggaacactgctggcagcgagcagcaggcgcctcgcccacacgaagcacagctgttgacgctgagctcgggggacggagcaggcaaagatgtgcggacaggaaatggattggcagctgccaggggctgggggtcgaggggaatgcggagcttccttatggggtgatgagaagtcctaaaattgattgtgttgatggtcacacaactctgtgaacagactaaaaaccactgaatcgtacactttaaatgggtgaatttaatggcatatgagttatatatccataaagctgtttttaaaaagaaggttgacacaaaagtgtatgtatgatatggttccatttatatcaagttctaggacaggcaaaagtaatctatgataatagaagttaaacagttggggcggggcagattggctggagacggtgatagaaatgttctttgtgtttttagtggcgcttacttgggtatatgcagttgtcaaaactcatcaaactgggaaaaaatgcattctaatttaaaaaaaaaaacacatgggcacttatgtcttcccttttttttcttttgctacgatttgaaaaaggctatttttcttttctgtttttctcagttaatggttctaaa

SEQ ID NO: 135678 - DNA, 1048 bp, Homo sapiens
tcagtgaccagtcggcagtttccagtcactgctgtagacatagactctagagtagtctcttcttctttttgttctgagacagtctcactctatcgcccaggctggagtgcaacaacggcacaatcttgctcactgcaacctccgccttctggattcaagcaatcctccagcctcagcctccggagtagctgggaccacaggtgcatgccaccacgtccaactaatttttgtagaggcagatttttaccatgttgcccaggctggttttgaactcctgggctcaagtgattcacttgcctcggcctcacaaagtgctaggattacaggcatgagcaaccacgtctggcctttttcagtcttttctaactcgtgcctcaggacaattaaaaagtctgacatccctctcaaaaaattctaccttcagtaggaggtgttgggctcatgccaaattataaatggtcaactttcaatgagattagggtgttagcacagtagccagatatgtgcacattttaaggtttctcctctgtgatagttaaggcaagtcaagactaaagaccttctgtctaggcagggagataggtggtaaatttaaaaagcagcccgccccttttatagtcttttcaagcctaggccacgcgagctagtgtagggagcgtcattgggatcatgacgtcatctttgaatttgggcacatgtctgcacatgtgtgcctgtcattccaggattgttttgccattgttcattagttgagttcacagctgcctctccagaaagatgacgatctaattataattgctcatgaatcaatgaagaaccaggaatgttttcctgtatcaacagatgcaaacaacacagacttctctctgttccttttgccctgcttgtaaagaagagtgaatctgaaagtggggcatccagggcactgtgttctggcgctctttaactccctctaaggccgtgatgctcctctttggggcctggcgttgtgcttttaggaagagctgcttctcccaccgtcctccctcctccaggcggtagggtgcaa

SEQ ID NO: 135679 - DNA, 1023 bp, Homo sapiens
gccccttgcccctttcacaggtgtggagactcaggctcaggtggagcagtagtcagtggcaaggctgtgattcccacccccaacctgctgccccctccccggctcctgtgcaccatgacaccctgagctgctgcctcccatgggaggacaggattctctgcactcccacctccaagctagctggcttccagcctctctcaccgtccctttcaggcctgggacaccttaaaagcccatgccctggtggcgtgagagagcctcccccagctgggagggactggagctgtgcagaagggaaatgcactcatgaggatgttgtcagcccacttggaggaggggcgttggacgttcttacactgactcaccgttgtttacgtaacccattcagttgttcaagggagtctttcctctttttttttttttcaaatgattgaacatgggttgtaaaacaggattactttggttttgtccctgaatgcatggtagcatttatcatttaaacctccacataaatgccacttgttcaagctgtataaccttgggcaagttacttccctgagtttcaagtaggttttaaaatatttaccctgaagatttgaggaaattcagtaagataaagtatataaagtacctggtaagaactaggtgaccaggaggcagtggggaaacagtgttacctggagaagtgttcatttctaacggctcacagtgaccatttttgacagtgattatggctcttttccaggtagtcttatcatctcaggtaaaagatagacccctgtcccctcatctggctctggggctgcttttccaccgggagcctgtagctcagagctgattatgactcttgaaggaaggaaatctgaggaatttaaagaccctcaatgtttttctctgagaaccacacccagcctagcacctggatgctggggggccgagccactcgaggccaaagagatatcccagcatgatcttttgaaatcggtaccccacctcttcccaacttcaccaggtaatttactg

SEQ ID NO: 135680 - DNA, 1312 bp, Homo sapiens
tttttctctgagacggaatgtcactctgtcacccaggctggagtgcagtggtgcgatctcggctcactgcaacctctgcctcctgggttcaagtgattttcctgcctcagcctcccgagatgctgggattacaggtgtgagccaccacacccagctaattttatatttttagtagagatggggtttcaccatgttggccaggctggtctcgaactcctgacctcaggtgatctgcccgcctcgacctcccaaaatgttgggattacaggtgtgagccactgcgcccagcctccccatgttcccttcattccaaaaagttactagtatctgcttagggcagcgagactcaaggatgtagcccagggtggctgttgtgatcagagctgatggccctttccaggatttggaggacaggcacgtacattatcatatctggtcctcacagtagcacactgggttcagcagagcagagtggaacgtggcctggggctttatcagcagccctgagtcactctggcccacccacccctgctgttcctgtctaggcttctgaaaatgctattattgaaaattgttattcttcaggtaacattgttaaggtttccttctatcgaattgattctgatgagatgttcacaagttagagcagccaaaacagaggagaatgagtttccactcataaagctctgtggcagtcccaagtacatttcctctatggagtcattacagcaccacttcattagtagaaaggcatgtctgaaagaaaaatttccttgatttttcaaagtgactggggaaaaaaaaaggagagagaaacctataggttatgaacttgtcaatgtcagagcaaataacttttccacaattgctttaaaaatattttagccagaacaaagattctctaggtgagaagctttacaaattcagttttgtttcatttattcaagaagcatttagtgagaaccttctatatgccaggcaatgagagataataggaaatatgagcaaagctggcacagaccctgccctatggcacttacagtctaaggggggcaggaccgtaaacacaaaggcacacccatgtggtatagcgctgccaaggaagatggcacagggtgtgatgaaagggtatgatgaccttcctttctcagggtggtcagagacgcttccccaaggaagagacaggccagcatctggaggatggacaggagctgcctgtggctgggagcttttcatgctggagtcattacagacagtgagagtgatcgagacactgtgacgctggcatttgttgttattgtctaatagtaat

SEQ ID NO: 135681 - DNA, 1744 bp, Homo sapiens
actcttaaacagctgatttgatctctctgcaatgacagaaaaactctctgctctgaagtgccttgccactttcgagtgcctcccatcttcagattagccactttctccctgtgtgacctgatgacacattttcttaaaatgtttcctgttcctcagcaagtttcatcattgctggtctctaacactttctgatgtgctaaggtggcagtgttactgtcatagtcctcttcttgcctggttgaccatggctttaggcacatctgaggtctgtcggcactgcgactccttcacactcaggttcctccctgccccgggcagatgacatgaagcagagagctcttgtccacgaggtggaaaagtaagcgcccagcctcttggaaacagaccgtaaacaaatctgtcaggtagtgaaaagagaaaaataaagccagggtgcaggacccagggatggggatgaggaagggcacttcccccaccatgggagaattgtgtcttctagtctgcaggacaccttgtgggaaagactcaatgaaagaaatgactgggtcttttgtgcattgtctgactaaagtagccatttatatatttttcttttgacattcccatgaaataaaagcctctactattgaacatttttatatttaaaatgatattctgcacctttttttaaactttatttttttaattgagacggtgtgtcactatgttgcccaggctggtcctgactcctgggctgaagtgatctgcccaccttggcctcccaaagtgctgggattataggtgtgagccacttcacctggccaatcggcactattttagaagaaaagagctagtattcagaatcataagcactttttattaatttctaccatttgtttgtctgtatattgtttaaatcacctttttctagaaattatcttcttgccctcagtttttatttatatcctctagacctctgagatcctgcaggtggctgtttgcctcatacacacccctcttaatttgcactagacatgtaatcgactacttgagtacactgtccattttgggatttatccattctgtagactactctttttttttttttttttaaaggacagcctcccaaaccagaacaggttcagagactccacttctgtagattactcttagcctccttttcctgccagccagctgagacctggatcattgacatcagggcaagtagaggggaagttggagagaagaacaaaaggggtgtgtagacccaccaactggatccaaggcctcccacggtcagggagaaaagcttggggttgtggcttaaacactggaaagcgcagggctctgtattttccctttctctcaggtgggcttctctcaggagcagagggaccatgaatgctgctagcgcccactgcatgagtcgtgattgaatcttgagaatcacggtcatctgctctggcttctctgccttttctccccagatttcctgccccttctagccctgggagcttccaggcccttgaggaatagcatatcatttccttgagtgggggcttcagtggggtgaacaatctgggaacctagtgaggagtcctgagggaatgggtttcagcccctcatgccctggaccagtcttacacagtctttcagatctttgaaacaaaagcctggagcttcttgatgtgatttacaggatacagatgtaccatgggccttgactggtgcttctccaagtcatcagcaaattagtcctcactct

SEQ ID NO: 135682 - DNA, 1013 bp, Homo sapiens
atttagccaaagtcgcacagcaaaaaggtggcaaagtcaagatttgaatgcaggctgtctgacgtcagagtctgaattgtcgagatgctacgtttcctctttatgaaagacagaatttttaatatctcgtgaatttaaatattaatcctgactcattacataaaaataaaactaggctgggcacagtggttcacgcctataatcccagcactttgggaggctgaggcaggcggatcacctgaggtcacgagttcaagaccagcctggccaacatgacaaaactccgtctctactaaaaatacaaaaaaaaaaaaaaaaaaaaaaaaaatttagccaggcatagtggcaggcgcctgtaatcccagctgcttgggaggctgaggcaggagaatcacttgaacccgggcggcagaggttgcagtgagccgagatcacaccactgcactccagcctaggtaacagagtgagactctgtctccaaaaaataaataaataaaactaaacttagcaatgtaaaataaaataaaccttgtagacagatattcttaatcctttagtgattatccaaagtataatttctatgtagcagaactactgtcacagccatccatttaatgccgctggtaaacactagcctgttatttaaatacataattcttgaattttgcagttcatctatttttgggttttatgttgaccagcagaatatcttaaaattttagttaaaagtggaggaaaataaaggttttaaatctaaaagtcttttgttgaaaagtggtttttcctgccccctcttttaacgaaaggtgactgacaagcaagagggaaacagtcagtgtttgccagattgatctaaattccagattgaagaagagtaatacagtagatttggtctgtgccacagttattttttattgcaatctgtttagtaacctcttgtagccgaatgtagtattaactacaagtagagtgtaattgtcatccaacactagtccaggcagtcagagtaaaat

SEQ ID NO: 135683 - DNA, 1621 bp, Homo sapiens
acatctgtgatttgactgggtgttctttcttctcagccagttcccttggatgttagttagatcatcacacaaactctgtaaggacacttgggaatatttgcaagttctttttccatatttatttggactgcctttgatttccacaattccttgatgaaaattgcaaaaattgaagcatgtaagcagaaatgttttgtaatggatccatacgtcctttcccttgaaactctcaacagccaagaaaaaagatgggtttggggacattgctcatttccacaaaaggtcaatgaaccatcgcttcttcccactcccatctaacagtcagtaccctctttgttttcagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagtaagctgactctggatgtttctcctggcctcacctgcttccagcaatatgagtttgtgcgatttgtatgttccctccctggggattgagctttcagtgcatcatacctacttcgtagcattccatgggcgggacctttggtgtccttgtaaaataagaaccattaggatggtgagtgtttgccacgttagccaagctcagttggctaagacagttctccttttccagctgtgtcatcctctgggcatttaaaacagctcagcacatcatgtccacaccccaggctgctgcctccctgccctgcagttccctacgttgccttggcgcacactcaaacacagggaactctgtgatgtccagaacatccatcatttggctttagggcctgtgctctgaaacatgcaaaccccttgagacacagccaaagatgtcctcaagagttagtggcctcagcagggccagtcaagccagatatgttgaaacagctattgactttcatcaacccctcccttcggcctcaaacagccatttcaaactctgtaggaatccaggtttcctctcttccaggaggcaacagacagatttctaccagagggctaccctctccccttggatctggagcagcaggcagtagaatttatgtccaccagtgctgtggcttccaggtctcaaaggcagaaggtcagtgtaacattaagaacaattgggtttgccttgccttctactgcagaatcctggtccatggttttggggatggaaaaaactctattgcactattattatgttcaactgggtggtgaccgtgggctgaattgttcaggaaagagtccaggggaccttggataaaagtgagagtttatgcaaggtcccatgatctttggagagagctttgtggcaaaagcttagggattctttctggggttggtttgggtgtgctgcttgggtccaacgggttccaggggatgtgggcgagtctcatctctcaagaccagctgttccttgaattgctaagatgatctgaatagtttagaagggaaaaggcttctgaagcctccgagtgctttcttacccatctcacaaggctggtggagtgcagtgagaccgccgcataaccaagtgctctcagagccccagacac

SEQ ID NO: 135684 - DNA, 1045 bp, Homo sapiens
tcttaagcatcacatgaaggattagactgttcacatccatgttgaagtataaagaaggaagtataaactgtaaatgggatccaccctgcttgggtgaagagagagaagaggcaggacagaggggagcgggagaagtcacaccatcccagttcatttgaatgcgagggatgactgctgacatatgagggctggtgttgagagcctcctgaccctgttgagctgttccaggtgagctagccaggtgcagcagcttcctgttgacttgtgtccccatctggggactaagaagggctttctgcagctctggccatcacacagctgtgaagctgtttggtttgaccacatgtgaatgcgggtcaggccctggcttttctctttggtccagagcgcagtgggtgcctaggtaatttgcaaagggcaggtagtttatctgatcctgcctggccacctggaaggtctttagcaagggaactgaactttggccttgttaagtcacgtgcagcaatagtagacagagtgagagccatgtagtgcaaggtgccgtgctatttatttggagggttgttttgtttggttttctggtttgttttgttgtactaaattgctggaaaaacttgacagagggagtgctttttatttttaaaactacaggtatttatttttccattgcgtaggacagtgttttgttgcttaattttcagccaatttcaagtatttctgctgttactaaaagaagcagtcttcttcctgggatatttttgttgttggttggtttcttcatttgttgaatatatgtttactgattatcttctatgggccaactgccatgtcagcactgggaaaacaggcatgaacaagacaggtacagtcctcagggaacttgtcccccaagcctttatttttttgagacagggtctcgctctgttgcccaggctggagcgcagtgctcactgtagcctctaactcctgggctcaagcagtcctcccacctcagcctcctgagtagctgggactacaggtctgcaccaccatgcccagctaatat

SEQ ID NO: 135685 - DNA, 1027 bp, Homo sapiens
tgtctaccccagttccgccgtggtcatgacggcgcagttgtgaatcttgccagctcctcagccccatgcctgcctgaacagcaactcagggcagtagacagtggagaaagcggaagttggctcacccagcctgaagatctttgagcaccagagaacccacgcatcctgcccagacttccccatttgtgtctgctttccctgcttcagtcctactcaacaggatacaagtcacatggattaggaaactgctctgacagcccatctgacttgggaacctgcctggtgagggaagaggctgtgtcttttagggacactgtggggctgccatcagaagacatggagtagggacagcaataggatccgtatgcagggaggcaggttaaaccaaagagggaaatagactaataggctaaaagccagattgagacttctggttcagtgccaaaggaagagaagagtgggcatttataaggtctcatttacttagaatagtgagttaaatgttcagtgttgcagaataactggatgaagatctggaagcagctgggaaataagaattcggtatctatcgaccttgctatgcatccaagctccttgtgttgagcgggtgccgtgtgccaggcattttgtgaaataccttattgtattatccacagtaaatatctcatttaatctacatcacatcagccatctcaagaaatataatgttatctcactcattttccagacaaaataagggaaagatttagagagatgatatctaagtatttgaatgcaaacattctgactccagtgcacaccccccttttagaaaattttttggccgggcgcggtggctcacacctgtaatctcagcactttgggaggccaaggcaggtggatcacgaggtcaggagatcgagaccatcctggctaacacggtgacaccccgtctctactaaaaatacaaaaaaattagccaggcgtggtggcagtcgcccaggctggagtgcagtggtgcaatcttgcactgcatgctctgcctcct

SEQ ID NO: 135686 - DNA, 1056 bp, Homo sapiens
gggggacagagtaagtgagactctgtctcaaaaaaaaaaaaattttgttttaattacatatgtggttcacactatgtttctattggatagtactggtccagagagtccgttagaacctagaggaggagggtgaacagtataatctttcttgtctattccctggaggtagcttgaacaacagatgttctagtaacccaggctgaagcgtcccaccaaagaaagttcctgaatgagttgtctctgactcgtgtgctagaactacttagagaattatattaaaaatccatataaaccatcttatctacatctctgatattaccatctggtgtagactgaatgtcatagctgttggttgttacagggttaattcattgattcttttatctgcgtgtttgctaacaagcacttatttattttatgatgtgtcagttattgggctaagtgccagattccaaaatgaatgagatttgattctctcattggggtctcaaaggactagtaagtagaacccttctctgtcccctgaattctgaaagttggaaaagaagacagtaaggtagatagatggggacccaaatatcaccttgatttctaaagccttgcttgaaggatgcagcttgttctaagagcccagtgagcttcccagtattgagtcccaggattagaccaacattacccaaccactcatagtggctttgcacttgtcaggcctccccatctgggggacatcggagaacaggcttaccatggagggcttactctcagaggtggggagggggttggttggggcggcacatggttgggtgcaaatcacacagggcctctctgagggagaatagatgccatcagaggttttcaaacagaagggtgacatagcgagacttagctcttataaggactactctgattgcagagttgagaatggggagggcaaggagcaggggacagttagaaagccatcgcggtcgtccatttgaggaataaagatggcactgggcaggctgaccgtggtgcaggtggtgagaagtggtggattctgaatgtaccattaaggta

SEQ ID NO: 135687 - DNA, 2066 bp, Homo sapiens
ttttgggaagtgctaaatgggttggttgtgcatcgtaaacatcaacattgggagtaatccacaaatccacccctcaagtggccaggaccagttcccacaactctccagggcacctgttctcccccagctcaactgccctgcactttccacagccagatcctgcaccgtctgccagtctcggttccagggcctccattcatgaacttttcctgcatctctcacaaagtgacccccacatgtcctcagcatttgactcacctcacagtgtgccatagccctgggttggaggcttgactttcttgtcagcttatagaccacctgagtgcagagcctgcattccagtgcccccagaacctctgtggcagcaaaggccccacgttgttgggctggttggaggcgctcagccacattgcaaccccagttttgtgggcgggcccagaactgggacttggtttttaactttgtttcaaggggaaggtgtgttctgattccaacaactgacttggaaaagaccgatctctgctttgcctctccaccgtgtggcccgtgcctcctccctggcgggctgagatgtaggccttcagacagacggcaggaggctgcctcctgtggaggatttgggcctttaaaatagaacttcaattccaggagacttagaggatacagctgctgagggagagcaatgaaaaatgagattccctcttgaaaaacgatcactatttcctgctctgaggattctagagtaaagcaactgagtttttgaagttgggttgcccctggtttttcctaggggcattccccggacagtgtggggtttagagagtgttaaatgagagaggtaatttggagggagttagaggaatgctatttggctgagttcaagatccagggaagggggatggctgtcttttcaaaacacttggttgaggagcctctttaatcagtatggcgagttttgtaactgatcacagactgctaaggcataaaggcagtgagaaagggaggactttctgacttaggaagatccccttctccgctttcttgccaaatgttggcaattccaggcatcactgaaatatatgttcttccccaacccattatttttggggttgtttaaaaatagtgtcttggttgcacccataatcccacctcccaagtcgagagagccagtgtataactttggcctcttccttgaggccgggagactgtcccgaggttttgcgctgagagtatttttagcccaggtgctagcacagccgggaggtctttgatgtgcgtctgctatgaaccagccatcttggtcctgggcttttccagaagggtgtaattcacttttacaagcagtcctggcctggaagtcttttcttctcctcttacagtgacttactcccctggtgatcaaggttgtgaacacacttaataaacagcttatttgctagtctttggcttcaaaagggggaagaggagcctacaccaagattgtggcatctgcgtcagaagcgagggtggggacaggatggtggtgatcctagccaagcccagtgtcccacgctgagtgggtgctgacttaagtggaacactgacccagaggaaataagaaaagtcctctagggccaagagcagacgtgagccctccttcctctgaacttgaattctgctttgtttgaacaatccttagggtacttactcctctctctactaaattaggagaccgtgtggctggtgtgtgaagcagaactgattcaaatccagggtctgtcacttactcctcggcctcactctccctgtctgtggcatgaagacagtggtacctgtattggagggtcacttcgaggcttcagtgagatgaggcctgttgagtgcctgcggtggtgctgggtgctcactgcacaagaagtggtcctagtcattgctgtgtagccattgtcatcgctgccagctccacgtgggcagggccttgtgttactcagcacctgatacaactccctgtacatagtgggggccaatacatttgactggaaatgaagtggattgaattttaggctctaacccaatgaaattctgtc

SEQ ID NO: 135688 - DNA, 1005 bp, Homo sapiens
gatttgggacacactgatgtttcagcccctccctcttaggaattctgatttgaaaatcactgtatctactctgtattcctatgagagagactaaaagattttgttcagatttgctttcttctgattgcaaataggaacatgtatggtttttttgggtgcactttttcagaccagacgccaggtcattctgacccaccccactcctctcctgagaatcactgacttagtgcagttatttgagggcaaaaagcactttttttcccagcacaaagtaggtgctaaacaaagtctacagccaaatataaacaagcaagccctgaagcagaaggaagagcagggctcagtggtggctttggccccctggttcttatgtctgtcactccacacacgcagtagggcttcaggagatactggctgactggtgctctgagccttttaccagaagagcctgattcagctaaatttccttggtaggggtgactgcttagttggaatttggtggctggaactggtggtcaccccctcttaccctacacggaccttttccaggttcagcatttacagatttgtttcccaaccaggaggggcttatcctaaggaatgttctgatctgagatgagattagaacttcccctgctgtcgaagtcaaagggtcccatctgcctgtcacttcccatgtgccctgggctgtgctgggctagtcatcagcccctccccgtctttggcccaagatgtggaaaatcttaatagctcaaccggttccctcagacctttgtcttctgaaacagtgcttctcacactccagcactgcagggccacctgttgaagcccagtgtcctgggtcccttccccagagaccccagttcatcagattcttaggtttgcaccagggctaaagagctggcatccagaccccctcccatgtgacactgatgccgtcatctgatgcccagtcccttttcagctgaacgaaggatgaagacacaatgttgtcctaaaattgat

SEQ ID NO: 135689 - DNA, 1512 bp, Homo sapiens
tttaagcattcaccttggggaggccacccccacccctctctccagacttggttaggggtctttggcctcacttgtgtagcacttgtcccctgacctcggtagcgatgcttcaggtctgccctccccgcgcctccacagggtttcttgttctctgaggagtaggggacaggacagaggcttttcctcagcaggcagccagctcagattggactttccttctagggatccctcttcaggttgggttggtgggaaggccgtctgaactggagcaggtgggctgtgtcagggaggcggtcaccggactggactctagccagcggttcccacctccacgcgcccaccgcccaagcagccagagctccagccctagccgcccaaaacaatgcagggcaacggttttctcctgagccaagtgtggagacctagatttccttgcacctgagggagagggaccacagtggtggcttctcacgccttggggaaccggaccagggcctgttcataacacagagatctgagctccttctcaagtcaggctgactgctttgggtaagagggcagaattttaaagcaaaaccgtgctctgcagggcgcctatttcagcattttcagactggtcttaacgtagttggttcattgccctcagaaatgaatgttgaaagcggtaagccccatttgaagcacccccgattttaacaagcttcaggacacatagttctgtgctaatatttttgttttgatgaaaaatttaaaaacactgctctcaacccccaccacaaagaacacgaaaatattattataaagaaactagatatatcccaatccctgctctgcagtggtggttcaatttgtaaagcaaaagttagaaccaaaaatgctttcaaaggtggcttcgaacaatgttcataactctctgctcgcatcattctgctttttacagagtttagagacccatttatagattcagtccacggattgtcatgcatttgcaaaaacgtctactagctctccgagttccatatttttattatcaagggacccttagatctgaggacatggggactggcagacaccagctgcagaacggaaccgtcttttaggaaacagaggccacgatgagtacatgatgggccccatctacctagtggaaaatgaagcggcatgtttttcttcacggtcactggtggctcttggcaatttctgactcagcaccattggactttctcctggcccctcctttcctctctgttgggtggggcggccgggggggtgcttttgtagccctccacagatggagttgataggaatgtcctgctttctaaccatctgcagaggacctgtgctttgggtcacagggtcctcagcaaattcctttcccttccagttgatttacagttggttccaattggtttacctgtttagaaaattctaagtccatcttaaatgtaaaaggtggttatcatcttagaatgtgctcaaagaactttaaagataactgctttccactgagga

SEQ ID NO: 135690 - DNA, 1022 bp, Homo sapiens
tcatggctaaagaggcaagttgctggaaaatacagttgtgctgcttactcagtgaacaaccagccaacaagctgcgtgcacgtttattgtgatgagaacttaaacacaaagcagacgtgtaagttcccctggtgtccccagttcctagcacatagtagaaactttgtaaatatttgtttggggtaaatgaagtcagtagcactacagataggaggccgtaaggaaggatggtttctaaaacaataaaaagggacatcagctaggccagtggtcttccaacttactgtgtatcagaatcacctggagagcttgttaaaacagattgctgggcctacccccagagtgtctgcttctgtaggtgtggcatgggcccaagaatttgcatttctaagaagtctcttggtgaagctgccgtcgttgttggttcaggaccacactttgagaaccgctgactaggctaatgcctgtggatgagaaaagaggcttagagaaattatgttttgcctaattgacaaaaccaattagtggctgaaacaacacagaaggccaggtttgtcctctcacttcctaacttgaggacagagaaatatattctgatgtccctaactggcagtctgctatgatagtgaccacatgcccatttctttcttgggatttcgtcccagcctgacaaccttggaacagaacaagaggacaggaggtgtcgttccaggtatgtgttagctgcaccagccactctttgtggcatctgctacccatcaaaggacgtggttgggctgggagccaagttaagttttctcattgtttggcagttgtgtccccagattttcttgcccatcttggagatcttagcacagccggggtgcttggggctcagctgccttgaaggggactcagtcccccacacaggtgattcccatgtcccatggtgggcactgagattggggtgaggggagcacacttgagggacccttcacttcctcacagcccttgcccctttcctcagggtgcgctgggaagaa

SEQ ID NO: 135691 - DNA, 1034 bp, Homo sapiens
aggagatatacctaatgttaaatgacgagttaatgggtgcagcacaccaacatggcacatgtatacaaatgtaactaacctgcacgttgtgcacatgtaccctaaaacttaaagtataaaaaaaaaaaaaaaagaaagtgtgaaggtgatgagtgctgtaggaaggaggataagggggcatcaggaattccagggatcatggggtcaggttgcagagctaaagagagtgtccggggtggcctcattgaaaggtgatatctgcgtccagtcttgagaaggtgaagcagttggccaagcagataaacctggggcacaggcatgccaggcagggggacctggtaggtattgaaggaacagcacgaatctagtgtgactgcagcagagtgagcgagagcgtgccagccttgggttcattgcaagattacatttctgtttcattttaacaaacctttgagcacctactctgtgtcaagtagtatttggcacaaagcttttcaaacctgggttccccatctgaaccatacaacacagaactctgtgactatttgttcagctcttcagctcttccaggagtgtgacacagctgatgctttctggatgcttgggagagaagttcattcagtacatctaatgcatgccctagggtattaggcctcattctctgctggaaccctgactgaaaaaggcagaattcctctgcccccagcccttgccctgtaattacagactagtaaatactatgaaagatcagagctaggatctgaagggtaagtcagagtaaagtaggtgaaatgtgaggtgggcccttggggagggagaggatactgtctaggtgagaaaacagtgggcagagacctgaggcagaggtgggagagggggtgagatggattttgtagggcctgtcacagccttgagtttaagaacacttaaactcagtctcaagctaaatagccattaagtgtttggagagagagagagagagagaaactgattgagaggatacgagatttgtgctttgaaaaattgatgagatt

SEQ ID NO: 135692 - DNA, 1009 bp, Homo sapiens
cctttactattaaatgggacactgtactaaaaaaaattctattgtttctatatttgttcatttattgattggatgttcattcatccaacaaatgtttattgaacaggtcctgtgtctccactgttccaggcacgggggatacctaatgaggaaaataagacatctctgccctctggagtttttagtttacatatgaacaagtataatatgtaggcttttggatgacaggtatcatatagaggagccagggaaggggacaggatggacaggggaagagggttgttagttttacatgtgatggaaagggagagtgatcagaaataaggagcagaatcctgtgtgttgcagatgtctgggcaggcgcgctccggaaaaggaagaggtggcgcagaggccctgacctgggaatgtgtgactagggcggaggctggagacccatggcagatgaagccaggccttgagatgactgtaaggacttggaagggagagccagtgggatttactgaggggttgagtatggggtgaaagagagaaagagtagtctaggacgaccccagtggttttctcctgagcatcggaaggttgactttcgaagcaggagagcttcagtggcacagattgtgggggatgattggggctgtgtgggtacagagtgagtttgaggtgcctgtcagagagctacaaggaggtggccattaggccattaaaatctggagtataaaaatctggagttcagaaaagaagtgtaggcttttttgagagttgttgacataaagatggtgtttaaagctatgagactgggtgagataccagcaagtaagtcagagaagagcaggggccaaagcctgagccccagagcactccagcattaggaggtggaggagatgagggagcaccagcagaaacctcgaaagaccttccaggaaggtagggggaaagcaggagactggtgttcagaagccaactgcagaaagtgttcctgaggaggaggcagagagggggcttcggt

SEQ ID NO: 135693 - DNA, 1119 bp, Homo sapiens
attccctaattttgccaatgaagaaattgaggcttctagaagtgaagtaacttgtctgaagccctgcagctagagtgtggctttgtgtctcctaagttaggatagcaatataacagtgatataataacgcatgtaataatataaaaccatacaacatactgtatatgttatgattttatatttacatgttacagaatattcaatacattgtatatgcaatccattatgtattgtatcatatataacatatgatgcaataatatatgtaacaatgatacaataataacatattgggatacagtattacaataatgccagtggcttcctatttgccaggcatggcactgaaaggtctgtgtatattaggagcttccatttgggagcagttgacatgtaactaaagtgtcctggaaatcggttttttcttaagtgaaagatcagatgttggaaagggaaaccctaagtgtgacagaatttttctcatgagaagtatgggtgtagttttgggtgtgggtaagaaaagggaaggaaacttcattctgtcatcagatacctccaaatttagaacaatatctatccgtagccattggttttcggatatgctttaccctgggaacgtgcgtaaaatacatttccgtgtttggctatttctttcccagctgcatagagggtgtcaccattattttagataatagccatggccagtgcccactttaatcacttttccaatcacttttcactgattgcttctaaggcacttgatttcagatgtcactttttgctgaaatacctggataactgtttcagggggccttgtggactaccgagaagtttgcctccaggggttggtaaacttctaaaagtgccaagtcatgaatattttatgctttgcaggcccaagaagcaaaagtaagactattatgtagatacccataaaacgatttaaagtgaaatcatttaaaaatatgaaaaccattcttcacttgcaggctacgaacaagcagcctcctgtttgactggggttgctcagcgagccttctggcttctccggcacacacacattcaggtctccatctatgcaaatggagacctccttcttcttctcaccactgtaataag

SEQ ID NO: 135694 - DNA, 1049 bp, Homo sapiens
aggcaggaggatcacttgagcctaggagtttgaggccacctgggcaatatagggagaccctgtctcttaaaaaaaaaaattattcctgaggtacagatgtttgtaagataaattttattttaattatactaagagaatgattatttactagaatattgcagtggatcttactctgatatgggggagaaaatccctagtgagggtaaataatttttttcaatgtattgtatctaaagcttggagatttataggtaataataataaaaacagtgacagctattctcattgagtatctgctgtgtaccaacaaattttaaacatctttattttagtttagttttttagagatgggttctcgctctgtggcccagactggagtgcagtggtgtgatcacaaatcactgcagtcttgacctcctgggctcaaatgattctcctgcctcaacctcccacctcagcctcccaagtctgaattcttatttaacctttaaactacccatgaagtagacagcataatggtacacatgaatgtatgtgaaaatacaaggtgtggaaaggtttagtttctatcccaaagttgttcagctaggaagtgcccccatagattcaaaccaggccagctggccttcaaagccaattccttcacactgccctcctgcctcctctggtcatgaggaaatgggtagcagaggttttcctagccaaggataaagatttgggggctggatccagccctccaactaaatgcctagcgttgatccctgcccctctctgaggaatctgtgaaatggggaagggagtcgctggagcagatgatcttgtggatctccttgggttttacagagatttgaggcttggagtagtcatacctgaaggagtgaccttgataacacatggccaggtcgggtctgattgaaggcagttcgtacagccacagcgttctcggcgtatttgtgcaaggcttggaaactcatcacagtggctgtgcagtcagccttctgcttctggtaacagttcacttttgattcttcccatttgtgaagaatcag

SEQ ID NO: 135695 - DNA, 1555 bp, Homo sapiens
caccaccatgctcaggtaatttttgtattttcagtagagatggggtttcaccatcttggccaggatggtctctatctcctgaccttgtgatctgcccaccttggcctcccaaagtgctgggatcctaagtacagacgtgagccaccgtgcccggccattcttaacctcttgaaactccttaagactttggtgaaagccatagacctctcttcccagaagaatgaacacgtggtttgccggcaccttaggaacccccaaagcccatgagacaaagccctggatctataaggccctgtcccatctgacccccggccttcccctgggcacatacctccagctacacaggtctttcatacacactgcccctttgcctggtccagctctgctcatccttcaagtctcacccttccctgacttccagcttagattaggtcgccctgctagacatgcgtcccccaccctgaatttagcactgatcaccgggataactaagtgattcttcgtgcatgttatccgaccctccccaagctccgtgttggtatttgttgagtaaatctctgaggcccctccagctatgacattctgagactgatctataagtttgcagatgtgtcataagagagtccctgagcttgtatttcctatgacattcgacacgtggtggcctttgccttcgatgatttcctccaggcctggacaggaaagttacttcaaagcagtctcggccagactcggtggctcatgcctataattccagcactttgggaggctgaggctcgaggatcacctgaggccatgagtttgagaccagcctggcaaccaagcaagatgctatctctacaaaaaataattttactaattaaccaggcatggtggcaagtgcgtatagtcccagctagtcaggaggctgagacaggaggattgcttgagcccagcagttggaggctgcagtgagctgtgattgcaccactgcactccaacctggacaacagagggagactgtctcaaaaaaaaaaaaaaaaaaaaaaggcagagtctagaggaccccagaagacagaagagtgcctcccagactttctgcctcagtgctttgctaggcctgacctccaggctggtcatcgcttttgtttatattctgggctgagctggaactcacacttggaacattcccacagtgcttggcgcttcctcgtattgttgtatttttctccaggagggaagtgaccaacatcagactttcctcccagcagacaaattccatacacaaagctttgtgtgagctaccgggtacccgcctgagagcccagcctctgtttctttggttctgggtgggtgagtgtgcacattacagggatccacgagcccttcccttctgagccatttctatctaaaaaaaaaaaaaaatctccttcaagaagtgagcaccgccttgcaggatcctgactcagagttcgtctggagccaacagcgtcttgcgtgtagggacaggcactccttaaaatgtttcctacttcagtggccacaatattacccctctggcttatgtcatgttcca

SEQ ID NO: 135696 - DNA, 1079 bp, Homo sapiens
taactttgccccaattcggtgtatgactatgtacaaatcttaactctttcagatctcaaagaaaagctctgtgtcttagtttcctcctctgtagaatgagaacagtaacagtatccttctcttatcgtgaggatctaatgcaaccacgagagtaaaatacacagaaaggagcctggtactgcatgggctaagtgcctaatgaacatcagcttactactatctctccgggtgacagagtgagactgtctcaaaaaaaaaaaaaaaaaaaaaaaaagccctgaagggtttatgtgacttgtccagctgggttgaagagctaggttgaagccgctgcccagtattgaaacaaacccttataaaatagagaagtagcttaataatagccccaaaaagacatcacagactgaagacttttctagtagtataagtacacgtgaacaagaaaatggtgacacttctgcttccagttcatgcttcttgtcagcagtattgcgagggaaaaacaacagtgatctaatgagccctgacaagagatggccagaagctgagcagttgggaagaaaactctttggtgaatctcactctgaatgtatattgtgccttgggatattagctgattaatttggatgacatattagtcatgataagcaagacatttacaaactaagcatccagaacgtgaaaactaaaattttgccaagcaccgtggcatgtgcctgtagttccagctactctggtggctgaggtgggaggatcacttgaacccaggagttcaagtccagcctaggcaacatggtgagaccctgtctcacacacacacacaaaaagccacaacctctaaaatttaaattatatctgaagtcacgcagtactcccatgagtaattttacagcatcaagtgtacgtgctctgtaaagggtttcatctcagccttctgttttgggctcttctgtctcctgaattgccatttgggaacaggcagcctagtcccgtggcactaagccagctagctaaacactggtccttctcaaatgcatgtttccagcccctctttaggacattatgcacctgaaccagaa

SEQ ID NO: 135697 - DNA, 1039 bp, Homo sapiens
gtagtattttatgaaacctgtgtttttcactggtatcaactattccattttctcattttcactactttttataaaatattaatggcaaaatataataaagcagtcaaactctttccacagcaacaatcactgccaccacaacaaaaacaccccacagaaaataagtgttgtggagaatgtgggggaatctgaacacttgtgcgctgttggcaggactgtaaaatggtgcagccactgtggaaaacagtatggcagctcgccaaaaaactaaaaatagaactaccacatgatccagcaaagtatatacctatgggtgtgtacgcaaaagaagggaaagcagggactcgaggagacctttgtgtaccatctctgtagcagcatcattcacaacagccaaaagatggaagtgacccaggtgtccactgatgggtgaatggataaagaaaacgtgggctgttcatacatggaatattattcagccttaaaaaggaaggacattctgacatgttccagtgtggatgaaccttgaggacattatgctaagtaaaataagctagtcacaaaaagacaagtaccatatgattccactagaccgtgaggtgcctacgctagacaaaattatagcaaccgaaaggcgctgaggtggctgccaggggctggaaggagggaggaatggggactatttcagttttgcaaggtagaaaagttatggagatggctgctggtgatgatggcacattatgaatgttacttattaccactgaagtggtaataagtggtaatcactttaaaatgattaagatggcaaatgttatgtgtactttaccacagttttttcaatgtttatataattacataatttaatcttaaatatctttttaaaatttttatttatttatttatttatttgagacggagtctcgctctgtcacccaggctgaagtgcaatggtgtgatctcggctcactgcagcctccgtctgctgggttcaagtgattctcctgcctcagcatcctgagtagctggggctacaggcatg

SEQ ID NO: 135698 - DNA, 2225 bp, Homo sapiens
gttcttcttctttttttttttttttttttttgagatggagtctcactctgctgttgcccaggctggagtgcaatggggtgatctcggctcactgcaacctccccctcccaggttcaagcaattcttctgcctcagcctcccaagtagctgggatgacaggcgcccgccaccacgcccggctaatttttgtatttttagtagagatggggtttcaccatgttgaccaggctggtctctttggccaggctggtcttgaactcctgaccttgtgatccgccgcctcagcctcccaaagtgctgggattacaggtgtgagccacctcccagcctaaggctggttctttgggagtctagactgcagtatgtggggtggacttattgaggcttgttttgttgatgatttttaatggcagtaaatgttggatagcacttaactaatcatcaaaatagcttttgaaacatttttgtacacattagtttctttgttgttttgggctttgttaatttgtttctttttttttttttttttttttttgagagggagtctcgctctgttgcccaggctggggtgcagtgatgcagtctcggctcactgcaagctccacctcccgggttcacgccattctcctgcctcagcctcctgagtagctgggactacaggtgcccaccacttcgcctggctaattttttgtatttttagtagaaacggggtttcaccatgttagccaggatggtctcgatctcctgacctcgtgatctgcccgcctcggcctcccaaagtgctgggattacaggcgtgagccactgcgcccagccaatttgtttcttatcataagtatggagttgcccaagatttttcccagatgaggatgatggcagctcacatttattatttcctgtgtgccgggaacgatgctaggagctttaccttcagacgtgtgtgtgtgatttaattaattctgttcttataaagagtcagcaatggcaggtattgtgcccatttgacagttgaggaaagggaggcagcaagagggaagtgactcgccaggggtgggttgtgtattgctgagaactggagtttcacttctctccccttcctggggtctagggctgacttgccggcaccaccactgccttgggttggaatgtactctggggttcccccggggctttccagcctctctgtaggactgttaaggtggcaccacatctgcctacagatttatgaagaagcccctggtttctccattattgaagtggcttaaaaagtacatttgctgaaaatattgcatgagaatctgctttggagaaacctttcacagatggcacaacggtaggaagtggcccttacgagttaaagtagttccacccacccacccacccaacactggctgtcactgagtgtcaagcagcctgccaggggaggagagggtactgagagggctgaggcgtcagtgcccttggggaactgacagtcagccaccacctgcgttgtgtacaggagacttttgatcttggctctcacaccctcatccgtgttagaggcagcatgagcctgagctgagaggtgggagacctgcctcatggcccctgggcctgcactgatgcactggatcagtgcccctccccaaccctgtctttccatctgtgcagtgagccagtacagaacagtgtctgagagcatgtgcttcaggtcctctagctgtggctttagataccagccctcctgtgtcattgttgtgggatcttgggcatgtcactctgtcttgtctaactctcagtttttccttatctgtaaaatggggaaaatcctaacagtacctaccttatggtattgagggagaattaaacgagatgatgtacataagcatttaatcagagtctggacacataagaagtgctcgataaatcttagcttttgttcttacttcaggtcgccttctactctaaagtgaccatttctttaaaaatggtaatctggtaactaaaattcaaacctcagcactcacagagaaggggaggtccctgactattgaggtatttccttttaggctggtttgttctttctctttctctctctaagaaagctgaagtccagggagtaggtttttacaattaagtaataaacttttgaagtgatcactcgtaggaagagtagagggcaattcatttcagctacacatatcccagtgcatgcaggcagaccaggaggccctgattttaat

SEQ ID NO: 135699 - DNA, 1089 bp, Homo sapiens
gggcgcctgtcatcccagctacttgggaggctgaggcagaagaattgcttgaacctgggagggggaggttgcagtgagccgagatcaccccattgcactccagcctgggcaacagcagagtgagactccatctcaaaaaaaaaaaaaaaaaaaaagaagaagaaccagcattagaaagggctccggggtgggtttatccaccctaccaaattacaacaaaggcacctgaggctcaggagattaagcaatttgcccacggtcacccagccagaagcaaggcttccgcagccccctgtgagctccagcaggacagtcaggaggagagctgtcttctgaaggaatcctcaggatgatggggtgtcctgttagtgcagcagctgcctctgtggcagaggggtccctggaaacatgaaggctcattttcacccaagtcacacagccaagagaataatatcagaatcaataaaaatatagatgcatggggaatagtcagatgggctttagtcctaactttgccccaactcagtatatgactatgtgcaaatgttaactctttcaggtctcaaagaaaagctctgtgtcttagtctcctcctctgtaggatgagaacagttaacagtacctttctcctattgtaaggattaaatgcaaccacaagtgtaaaatatacagaagcgagcctggtacagcacgtggtaagtgcctaatgaacatcagctactactattatttgtatttattattgaaaggaggggttgagagtagccaattccatgactcatgaacaatcatccatctatttattcagaaccatcacttgaaggaggatgggcgcatgtgataaccagcaaataaatacaaccactgtttccaaccaggggttttgtttgtttgctcgtttggggtcagctaagtggctatttaacacggtcacattccactggatgtcagctgtcctctcttctcattccatgtccttccttctctcagttactgtcagtgtcacactcctgctccgtttttaacaatacagtgtgtggctgggaatcgcatctgtcaggtccacatcagtggcacaaattttaaaag

SEQ ID NO: 135700 - DNA, 1793 bp, Homo sapiens
atcagtggtgtgcagttagttgggggttctgtgttttcctgtagtcctctgaacactaatgatgaggttaggatcaaattcccagaacaccactgggagaacgccaggacaccgtgaaggctgagccgccactcggttctgatgccgcatccattggtcagtgcacgttctttgagcttccacttgagtgcacgttctttgagcttccacttgagtgcatgttctttgagcttccacttgtagtgactgcctggttctttgggatgtgcaggagcaaagcgctcttaggtaatgctcgttctgccctgtgtttacaaaccaaggcctgtgccagctctactcagcctgacacccataatgagcaccatcccaggaatccctgtccctacttgttatttttttttttttcagttggcctttgaatgtgatttaggactggcttcctgcagcattactctcttttcccaggatgactgtgcagcgtgtgctgtctagggctggggtgcaggctgttggtgtgcctctggcacccccttccttctttgtcaagaggcatgggcagtattttcttgctacttccccctcctctgtgagctaaggtacagggggggaggttcatctgaatttattagaaatctgctgtctgctggtcacaattcctttctcccactttcttctcccaggctgtagtttgaaagacaggtgacaattctctgaacccaagtcccaccctgcagtctggactgctgcttcccggaacaccacgactcctgtaacagcttagacttctgtccccacagtcccttagcagcagctttctctttgcttttcactggcttgcccaaaccacacagtgactttactgcatattaagttttgtgatcaggcgattctgcagtgcttttaaagcgtagaaatggagcactgagcacaggatgctgtgtggtttgcccagggctgggttcagaggggcggatttcaggcatttgctctatagcttttaaaatttgtgccactgatgtggacctgacagatgcgattcccagccacacactgtattgttaaaaacggagcaggagtgtgacactgacagtaactgagagaaggaaggacatggaatgagaagagaggacagctgacatccagtggaatgtgaccgtgttaaatagccacttagctgaccccaaacgagcaaacaaacaaaacccctggttggaaacagtggttgtatttatttgctggttatcacatgcgcccatcctccttcaagtgatggttctgaataaatagatggatgattgttcatgagtcatggaattggctactctcaacccctcctttcaataataaatacaaataatagtagtagctgatgttcattaggcacttaccacgtgctgtaccaggctcgcttctgtatattttacacttgtggttgcatttaatccttacaataggagaaaggtactgttaactgttctcatcctacagaggaggagactaagacacagagcttttctttgagacctgaaagagttaacatttgcacatagtcatatactgagttggggcaaagttaggactaaagcccatctgactattccccatgcatctatatttttattgattctgatattattctcttggctgtgtgacttgggtgaaaatgagccttcatgtttccagggacccctctgccacagaggcagctgctgcactaacaggacaccccatcatcctgaggattccttcagaagacagctctcctcctgactgtcctgctggagctcaca

SEQ ID NO: 135701 - DNA, 1032 bp, Homo sapiens
gtcacattaacagtgctgtagagagataagaaatagcactaatgccagctaagtgtgtttttagaaaaatcaaccacagcaaccccaaatgtttcctggtctccagagcagctgttggcagaggcggtttgaatgggattccttgtagccaagagaccttataggaggtctgtagagatgagtcatgtgtgagcttgcagaaaaatgtctcccaaagtagcccggattggagattgccttgagtgccaggctgggtcttacctcaggccagctgagcgtgttccccatggccaggataagatcacgctctggaaagaggagaggcctgacaacccaccgcctgccccaccccgcggccgcctcgccgccgggacaggtgttcctctgactcgtcacccgtcttgccccaaaggctgttttatgagtaaataaataaaacccaccgtttgtgaattattaagggatctgtcatccagcaggccagtcatcttagtttctggtcatctgtttgagaacatcttagttgtgtccttgggtgattcttaccctttcctggggcttattttccccatcagtgccaggaaggagtgggactcaaaaggagcgctcctctgtttgtgtttttaagctgtagccactgcccccgccaaccccgcaccacccccccccccgcccccgccccggcttttttaaattttaagttctggaatacatgtgctgaacgttcaggtttgttacataggtatacatgtgccgtggcggtttgctgcacctatcaacccgtcatctaggtttgaagccccgcatgcgtgactgcaggcccttttttatacataagaaggccattaggtaaccactaatggggaagcctctttgaatgcagtccttcctgcttagctgtggccgaggctcctccttggaccctccaccccaaacacaatgtgaaaacccacttcctcgatgctctcacagctgcctctaccaaaatcaacttcctctgggctctttgtgccttctcttcctctaacatat

SEQ ID NO: 135702 - DNA, 1972 bp, Homo sapiens
ccaataaagacattgagcgaggagagttgataccgtcatgtttttggagcttaagcacagactggcagctgcgggctggattcagtccacagatatgttgggttggatccgcacgtgttcttgaggaaaaaaacaaaagaattgatggtcaatattgaaaaatcaggaagtcactcaaaaatctcaaaagcctggttcctgatttccttgaaaaatgagaatctctggtaactctgagcgcttgttcctgcctacaaggcagctatgggcaggagtcaggtggcggacactcccacagagcccctcaccactcccacagccagccacacctccgacggcccacttggacttttgacatttgcgtttgcatcccctcctcggagaaatgattcatgtttgtttgtttttgtctggactttgaaacctttgccccatcccttcattgactcattactccatccctcattcatcagggattgagcaccggctccatcaggctccgtacaaggctctggggactcagtggtgaactcagcagatgtcgtgctgcctgccctgaatacaggcatcctctgtgtgtcacagggtgagcaggaaggtggcaagagatcagacttgcagtggggagggatggtcaggaaactcctgtgctcctgtgacaaaatgggacttaaggtgagaggcggaggatgggtccacttagctgggcacaggcagtggggtaggggaccagtctcctggggtgggagcagaccaaggcctcctcagctgaagggaagaaggtccttggactgcatgtgtcagtttcagtcactcattcctttcttccctccttcagtggcttcactcatcgcctgcctcacggagcaacctcctgagggcctggagttgttcttgttcttgggacacagcaaagatcccggcctcctgggccataccttctaactgggctggccataagttaagcagttttgtatgtatgtttttaaagtccctttccttcctctctgtgctcccagcgaaccacaggctggctgggagtttcatcatttaccagaccctcctgccagcgctgtagctcctgtcaccttggagcagttcactgggcctgctaaagtggccacaggcttgcccagcacgctgcctgaagatggaataaataggtgtctcacgctcagtgtgctacggtttcaaatgtgtgaagatgcttttattgtaaatcgaaaagaaatttataatgactgcatttcatggtcacatttttgtcatgatatattttctcagaacagatactaagagtacaggccctatgatgtagggctactcatttttgtggcctgagaaagaggtcctcttagattggcagtcattgtatttcgatcaattttaaactcgtcaaatttgtacttcctttttcctccatagttaggaatttttgtcgtcaaagtatactcagtcaagcaatgagacattttgatggcacctgctctgcctcctttcactcacccgttttaacacttactgagtgcctccttgttggcaaacaccaagtgatgcctcgtggcagggagccagcaggaacctgtccctggaggccacagtccaggggtagaatcagaacgatcttgaacatctctgcaatttcctgtggttttcagaatgcatttatagactacctcatttcatttcatcctcacaacagcccagggggtgagggcagggcggagtatccctcttttgcccctcagggcagctaaggcccagggaaatttggttgtttgcccaaggtcatgccctggagaagtggaatggggaaccggccccctttcttgcctttatagagcactggttagagcctccctggttgctggggacacagctttccatcttaattcttcaggcttctcaatctcttttctgatctttgaaaaaaaagatctaccaatgaaattaagggaggctcactacagtc

SEQ ID NO: 135703 - DNA, 1035 bp, Homo sapiens
ggaaggggctgaccaggagctgcggaaagtgtgggaggaagatgcattttgtgagaagcagaaaaagtaagagttctgagattggcaagaccagggtcaggacctcgcctgcagattggggattgcagatgtggagctggctggaagtccagcctccttgcagaaggtcttttgctgcagttcataggaatcatagtgaaagattacaactgccaaggaagactggggcgcgcctggagtgaggatgacctttcctggtggtctctgctggctattctcagtgaacttccctttgcatttagacgacattttgttagatttctgttggagtttttttaatggacttcccactattcagtctccagaggagtatttgattcagaggagaggcccttaggtgaagtggtggcagagcctgacaccaggcaaacaattgttgtgattggagttttgctgttttgttatctcaaagcaacagaaacgttgcttaaatatgttcataatctcctctccctgaaagtagaagaaccagcgtttttagttctcagtgcttaaggcatccagggttttttgggtaaacaggaaaccccttcacatcccgcatagtgtgcagctctggcctgttcctcatcccgcccccttgcattgcctgatacctccttggtgtgcaggactctccttaacccctgggggagatcttttgagtcattgctgttctttgggacattttctttctcatgcagcagtgcctggctggggcagggccttgaggggttcatccatacctatgtatatcctcagagaatacacaaggtcataggcctcacatttgggggtcccaagtgccatggggaatcaagacagtctgggccagagggtggcacagggacaacttgctgggctggtgggggcctgtcaagtgaggcctggtggagaaaggttgaatttggagggccaggaacaagctgggatgcaggggaggctttctaaactctacagtgcttctagagatgacgaggaggtagggagtagaag

SEQ ID NO: 135704 - DNA, 1037 bp, Homo sapiens
ggccccaggctttattagcctgcagcaccttgcagggcaaatgcgaattcttgggtctaaggtgaagtgggcgggtgctcctgggctcctgtactgggagcatgccctgtggtcataaccccggtagcaggttagcttggcggctgaatgagggaaagcagatttttagggagctgcaaaggaggtctgtggctttgattgtggaagttgcttatgtttcctgggttgaatctgggatacttctgtggggtgcacccctgcagcggacccacaaggcaatatgacttttgcaggctgtggttgaagcacagaaggacatttttgtaggctttattgagggtttactatatatctaactcttagcacctaaaatgcattgcttcttaaatttttgaagctagtctgtgggaaagaatatggtcccagttttacaggctcagagaggttcagtgagttccggctgtccagacagcaagagggcggcaggcccctagtatattcattcctggccctctgaccagaagccagggtgcttttctcaggggcagggcgcttgggttcaggtgccatttcttgagtatttttctcactgaatttgagcccccacagccttgccgagtgaccatgagtcgccatcctgtacacctgctgctccagaaataacttgggttcatctgtgcagcatttctcaggaacttcttgtatagtgtcttgtcagaacggtactgttgggaaacttggataatttattttaaaaagaacattcactgagttcttttataagaactttataatatataagattatattatatctttttatatctaatataagattatattatgttttatatctttataatataagaatattctatgttcattgtcaaaacttggaaatcacagaaaagtaaaatgaaccggattggaaatcatctgtcagccaggtacagtggctcacgcctgtaatccctgcattttggaaggccaaggcaggaggatcacttgagcccaggagtttgaaacaagcctgggcaa

SEQ ID NO: 135705 - DNA, 1048 bp, Homo sapiens
tcatgcctgtaatcccagcactctgggaggccgaggcagaggatcatgatcctaggagtttgagacaagcctgggcaacatggcaaaaccccatctccccaaaaaaataaaaattagctgggtgtggtggcatgtgcctgtggtcccagctactcaggaggctgaggtgggaggatggtttgggtgtgggaggttaaggctgcagtgagccatgagagtagctgccccacagacttggtgtgaagttgaattcgtaggtatgaagtgtaaggtgaatgtcttgtctaccacctggtcaacttctctgaagtgcctgtcaatggtgacactctcttgtcctgagaaagttctccctccatcccctgtgggcaggcttcctcccgcaggcctcttcctcagtgaccaccccttccatctgtgcttcccatatctccacagtggacacggtggctcagggtataggctggagtcagacagacctgggtttgtgcccagctgtcgtgtgtaaagtcaacccaagacccagctgctatgacagacctacccattcccaccaaagcattgtctgccttctcattttttcaggcatgttatctgctcttctggtcacaaagtgagctgaagatcctgtaagacaccacagttacagccgcgcagcagtgccctgtgggcagccctgatatgctgatgtaggcaggatcctgggtccaggaactggatcagtccctagggtcctgggagggccagtggcgcaaccagtgatctccagaaggcacccgagattgagatgttgtgccccaatttcccgtttcccccactgagcaggggtggctggggcgcctggcaccttggcggctgagctgcctcttggcggggtctctctcccagctctgcagtctgcattcttctccagtcattgcctcaagtttgatggagaagtaggtggtattgtctgtgttttcctgggagcccagatgtctttggatgtttctctgactgcagggccgttcctacagaaaataatatcacaccaagtgggtgcagaaca

SEQ ID NO: 135706 - DNA, 1053 bp, Homo sapiens
ttttgtgttttcagatctttcttatgcttgctcagaatactgaagggtgcttcgctttctttttcctgacactatagttcagaataatttcttgttcatcaggttgaaggtttgcagcttccagaatgctccttttttgaatattgcagccagcaaagaattggtagccatgtctgcctctgcagtaaataagctgaagctaataaatattcacttggatcagtcctggctccctgaaatgaatttctgaaatcttcctggccctgaggagaggcagggcattgactccagaatgctcatttctggctttctttggcataaatctagcagaaaatcaagtacgaaccacctgctgtgcactcctagcaaaagagggccctatggttaaggggtccctttttcacccatgcgcaccaggtaaatagaccgtattatctaaggtccttctgtcccagatggtaggagcttttccctagggtcctgaataatacatttaaaccttttaaaaagagcatcatcctcactttgaataaatgtggtgtgttttgagaatccacaatgaggctggagaggccatgttttcattaaaccaatgcatatttttctctagatttttttaaattaagacattttgcagatactgaaggatttttaaatatgtttaacttttaaataaaaactataactttttaatgtagcagattcttcttttctgtttttcttggctctgtgtttatgtcttggtctgcttatgtatgatgtaagcaggcaggaagggtaaacagtgaagaagttcagaagaaacagctgtgggctcaaaatggaaggagaactatattagttccaagttcagacatcggtgttcctcttcctaaaactgagatttggaatctttggcttctctctgtcatcttggcagtaattttggtacaactaaacgatgcaaaagtcattcttattcatcctgcaacccctgaataatctttaaatgctgcatttgttaagccctgtgctaaactgcggcactgagaaagtaatacgaacccgatttat

SEQ ID NO: 135707 - DNA, 1765 bp, Homo sapiens
taatgtgttgaattgtctggcacatcccaaatgaaatgtggcgtctggaaggagcccttggggcctgacatgtgttctacaagagcacgttgttgctggagacgtcgctgctcccgggacgcagcctgcgtttgctgagttggtgcctaggtggctgcaggggggtgttttgctgcagtctcctggagcacagccacagaggccctgggtgtggctcaggaagcctcctatgggcttaacttctgcctctgcggttgtctctgtcctccaagcccaaagcaaccagcacattcgaaagtttcattatccttcttgctgctgtagtggcccagcaccacccctaatttccagaccttgcaggttttttccccatcagaatccagcccagcaaggctatcactttgcactttgcactttgctctaacaaccaccgccatgaccctagcatcctgtctctttacctgcaatgcatatttttgataccaaggaccaatagcctgattcctctaataaaataaaaatgcttttcagacttaccaaccacttattcattgtactcagggagtagcaagagccacgactcagcatgttaaaaggcaggattgaagatgaatacctggccattgtcctgattttataccagtcagacttaactgaaaaaaaaatgtgtctcgttcgaatttaactttttgggggatttaggttatgttaatgctatagcttcattaattaccccatatcaataaaaaaggcagcttttagcctccgagcataagagaggaaaagaaatggtggtatcaaaggaaaccttcaaagacagccagagctgtctccagggtaatttctgatccctgcattcttcccacttcaaagttggctgtgtgtgtgcatgtgggtcgagggggtggggagctgaatctgatttctctaataagtgttggcatcagccctgtttgatatcagatgcagggaacattttgatttgttatagcctttgaaattgttcagatgaccttcagaaaaatggcctcttgttacttctagggggaagggtgaaagccagggaaaggggaatccagtttaattcatatgcagaggattccctgaaattgtgctttcagcagttttttagtaacaaatgcatgtcctgattgaaagtgaaaagttgaagaataatagacctgtaacactgtgttcttgggtgaggctcttgttcactcttattctctggggagggtcagcagatttgagagggtgaccacatagaagtttatggtttggaaaatgtgggtaacaacatggagagatccgtcaccatagctggtttgcagcattctacccaaactgataggcctatcacctgttcaccttgcaagacgaagctactaaatagaggttctaaaagttggaacctcgtgtggcttacgagttttatttagataattttgaatcgattccactgttttttgaaatgaagtattgataactttctgataagctgccaaaatgttcacttgctgttacatgaattttagtggcagtggttgtcacagcagcaggcctcaaagcagaactatgctcccagaagagctgcgcaagtgacagcttagggagcgcgcagccccggcatcctgcctgctgtctaactggaaggcagtctcttcctcccagggtaagagctgggcctctgcacacagacctggtttcaaattcccccacctcgcattaactatgcaatggtggacaagtcacctaacttctctga

SEQ ID NO: 135708 - DNA, 1049 bp, Homo sapiens
gtacttgcctttgctctgtatattgtactctgtacatattgcataggtatacatagggccatgagcacgaaacaacgtgctcactaaatcctataattgccagaattgtagaatcctcgcctttgaaaaagaaaatcttaaaatgggaaagggaaggattttactttttccagcagatagtaaacatatgaaacttatcctcagagtttgtaagccaaaaatataaataaatttagggaagttagacgagttgaggcccaaaacatttttcagtgatcacagaaagaacttgctgttattgagagttcattttccagtgctggaggatccacagggccagcaccatgaatccagtctcactggattggccaggtggtcatttcttctcacacccctgcccaactttgtgtgatttgcgtgttcaagtgtcagcttacatgtgttttggcaggtgaccttgggaaaggtgttgaaagtgatcgtcgtcatgcggagcctgttcattgatcgaacaatagtaaagggatataacgagaatgtctacacagaagatggcaaggtaagcattgtgcagtcttgtgtgttccttggttttctgtatcccagaacaagtgtagtcgaattccagatgaatggcattaaaaactagcaatcatagcggaaatgatcagcaaacatagatttgtcagtgtgaggatgcacactttgtgaaaaaacatttcattctctctgcttgcattctccatcaagcttctgctttttcctctaagcctgatgcccttagttgaatttctaatttatcaccttagaccccagttgcctcattaaatgtgtcttctgaggaaatggatttttttccccaagtcaagcagctcctcagtagcccaaggttcagcattttgcttttcctagaaccacgaggaaaattcccattcatttgacacaacctgatgacactctttttccacaaaactaacaagtcgcccttaggaagtggctgtgcacagcagcatatattgaatactgctgttgaaagaagacgtgttatt

SEQ ID NO: 135709 - DNA, 1016 bp, Homo sapiens
aggctggcctttttggtaagtcccagctctagtgtcaaactggcttatgagatatgctactaaggcgttcatatttattcagtaaatactcactgagcccctggagataaaggcatagttctaggcactgttcggcgtggaccacacgaagtttttgccctcacggagcctgtctgtagcatagaaaatggacaagagaccagcaacttgcataaaatgatgccagatggtgataaagctcagaagaacagaagcggggtggccagagcacaggagtgaggggaagaaagggagaagttgacaccacctaagcaggagacaccagtctgggcctcacaggctgggaggagggctccctgcttagtgaggtgtccctgtcattttaaattcagatgtacaaatttggattcatcgtgacccttgactcatgacacactgtcatcactaacgcaggcatggccctttcatattggtttatttatagtgcagtgggcatctttgaacatagaactggaccaggagctgcagcatgattggcagcctgtgctgcctgggattgccccccaccgcccccgcaggagctgctgtcccctggcgtgtttatcattctctctcctgttttggaggggatgcttcaccatatatatatgcatattcctaaatttattctttaattttccctgggttttaacttaatttattttaaagggattatatgttatcttcagggacttaatttttcactgaacattttgtgttttttactaaatttcattcaatttgttggtttagctatagcttattcattttcactgataggaaatattccattatcagaatatatactaatttatttatccatttttcaatcaatggtcattcgatttatttctgggtttctgtttttctattataaacagtcctgctcttacattttaaaataatgaagagtataattggattgtttgtaacacaaaatataaatgcttgaggggaaagacaccccattctccatg

SEQ ID NO: 135710 - DNA, 1089 bp, Homo sapiens
aattttcataccttctccaagggatctgtgacccaagaaagactaacaaacagccgggcgtggtggctcacacctgtaatcccaacactttgggaggcagagacaagcagatcacctgaggtcaggagttcgagaccagcctggccaacatggtgaaaccctgtctctactaaaaatacaaaaatcagcctggcatggtggcgggtgcctgtaatcccagctacttgggaggctgaggcagcagggagaattgcttgaatccatgaggtggaggttgcagtgagctgagattgcgccactgcactccagcctgggtgacagagcgagactccatctcaaaaaaaaaaaaaaagactaaaaaccactgatgaaagaaatcagaaaacccaacagtcttttataaagtccattcatggaccccagaaagcctttagtttttggaggaaatatttgtgtgtcattctaaaggctaaagtagggtgattgggtgcagatactagtaagtggatttgaaacaatcagacgtcaggcaatgcaaggggttgcctcatgaggtggcaatggggggtatttatgcagaccacctgttggagatgctgttcaagccgtaaattgttggggacactggatgagaggacctctgaggtcctggtgttctttaattctcggactaaggccattgaaaggagcaagctgggctacttgaagaaaattagaagtgaacaaaagtatagggctcttgaaatccattttcgccatttgaaaatggtgggattgtttctgatgcagcggagatgttgaggcagttgagactgaagctgtccttctggaagagatggttgggttgtgctggaaaaaagtggattggaaaccgttgagagtcttaccgcagctagggcaaagggcagggaaacagaatgctctggttgcttaaaagttcgttttctatccgaacatactgaagttatggatcataccttgatttgaatctgtaatttctagaagtttgtgtttctagcccagttcttggaccatcaagccagctcattgaccaaatacttcaaaaaggagaaccaagcagctctccat

SEQ ID NO: 135711 - DNA, 2193 bp, Homo sapiens
attctggagctgcatatcaagctggaagactataaaggagctctgcagctttcttcgaggtttgttttgtggagttctctggttgctgttgttggtgacttttgatggctaatgtaatggacccccgacacctcacatcttcctctgctaaagagaactttgtattgtagttgttttataatggcctaatttgggtctccgtggcttacttttaatgtacagtctgttcattcaggaaatatttaaggcatgcttagcgggtgccagatactgtgacaaggtgctgggattcagcatcaaagaagacagtcataggttcccatagaattctgtaggggagttaggtgttgaataatcactcaaaaaattatttaatgacaaaggggacaggagcacaaagcaaatttaaaagtaccatgagagataaaatggggtacactgactgatggggtgccaagggaagtgtgagaccgtacttccctgaggaagcatcatttaagatgaaaactcaaagacggaagcatgaataggaatgacccaggcacgggggtgagaatacttgtgagaagaatcttccagacagagtgtgcacagtgtccaagatagagtgagcctgctcagggacgtggaagaagcctagatgaggctgtaacagtcactgcagctggagtgaaggtctccttggccctcctaggacttgagactttagtttaccactgagctgtgccttaacagtgatacaaaaagtagggagccctttacttatacaaacaaggagcatgggtgtaaagcatgagaaatgtggctttagagggcaaaagtggttaccccaatcagatgacctctgaagtcatgggggtaggtctttgattttgttggaaggatgagtaacagtcagaggcaggtgtttaaaaacagacacaaaagatacgtgttggcaagaatgtggagaaaagggaaccctcacacagtgttgatggaactgcaaattagtacagtcattatggaaaatagtatggcggttcctcaaaatgttaaaaatagaactaccatatgacccagcaattctgctactgggtatatgtccataggaatgaagtcagtgtgtcaaagagacatccacatccctatgttcattgcaatattgttcacaatagccaagatgtggaatcaacttaactgtctattagtggatgaatgagtagagaaaatgtggtgtatatacacagtggaataccattcagcctgaaaaagaaggaaatcttgtcatttacaacaacatggatgaacctagaggacattatattaaataaaataagccagagacagaaagacaaatattgcacgatcgctttttttttttttttttttaagagatagggtctgatttgtcacccaggttggaatgcagtctcacaatcatggctcactgcctccttgaactcctgggctcaagcaatcctcccatctcagcttcccaagtagctgggactataggtacataccaccacacccggctaacttttttttttttttttttttttaagagacaggatcttgccatgttgcccaggctgatctcgaactcctgagctcaagccatcttcctgccttggcctcccagtgttggaattataggcataagccaccgcacctggccacgatctcacttctatgtggaatctaaaaaagttgaactcatagaagtacagagtagaatggtagttaccaagggcttggcatgggggttggggagagatactgatcaaaagatataaaatttcaagtaggtaagaggaataaattcaagagatctattgtataacatggtagctgtagttaataacaatgtattatattcttgaaaattgctaagacagtagattttaggtgttcttaccacacacacacaaaaatgctaaatatgtgaggcagtgtatgtgctgattagcttgctttaactgttccacaatatatgcatatttcaaaacaacaggttgtacatgataaatatatacaatctttatttgtcaattaaaaaataaataaacaaaaactagcctgcggctctatcacagaaacatgatttaaagatgatcagaattagtagattctttgtaccccctatgccatttcagttatgttcacttctgggctgcaacaaatatatttttatatttatatatatataaa

SEQ ID NO: 135712 - DNA, 1033 bp, Homo sapiens
ttctcgttaggaataaatgtaagtatatctttgttttaaaaagatactcataaaaatagaaaaaattaagcgtaggcattcgaagagataggcatgaaggatctgaaacctttgctaatgagaaagggcacattctccagcagtggtggacaaatgaggggaggctggggcactgagcctggctccttacagctgttagtgtcataaatacttttgccatgatataggtgtctcccttgttcccatcttcttctgcttgctgcttctgggggctttaaaaattttcatgtttaagttagggggcctgccactttaagctagtcacacttgaaatatatcccttgaaattatctaaacttaatttctggccattttgtttcagaaatgctaacctcagggggtctttgttctctacgctaaaacttaatctgtttggaacaattccatttcctctctgtagaaattgactggccatggctcctgtgaatgatacggttgctattatccctgaacactgtaaaaatgaactttgaaacagttgggtaggacccaaacagaaaatgatgtatggcttggaaatagtttagctgaacattatgctttaatattttactggccattgcagcacaggtttagaaatttatgttcggctttttaaagttttatttttatattagaaactttcttgcaaaccaaaatagatgaatcaagtgtatttgaatcaatgctgaaatgtcgtccacatctgtggaatgaaaatcattagccagttacttaaaattcagataaaatgaaaccatcttactatgaacttcatccagctttcctcttcactaaaggaaagaatgccaagaatatttacaaaaatttatttaacaggattactgttttattccaaaagatttaaagaaaataccaaaacagatactaattgagcataaaatagcacccagccgggatggagttgagtatgtccaagcatccactttaaacacaaactcatgatttcttgaatctgtgtttgaaaatagat

SEQ ID NO: 135713 - DNA, 1061 bp, Homo sapiens
cagctgtgctctcttcacagtgtgtcaggtgtccttcttcccagcatgctttttcattattaaagttttaaagtccataaaagtagaatgggaaaatgaactcccatgggataatcccccaaatcccaaatcaccaacatttggctgtgttttctttatctatcctttgtttctttcttttttgcttttgcttttttgttgttgctactggaatgttttcaagcaaatcccttgtgtcatgtcattctacccccgaacacttgtttctgcaaaataaggacattcactgttataatcacaatgccattatcacatgtaacataattagtgattccttcatatcatcaatactctgcctgtattcgtatttccctacttgtctaaaaatgcctttttacagtttgttttttatcaggatccaaacgaactccacatgatctgtttggtgtttgtcttctctactgttctcctcctagcctccatttatcttgctgtgctttctgtgatgtctctttgctcttatgtctcttttaatttggtctttatttctaacattgttttccttcacattttactgagttttgccagttctcatttcgcatgttcttcttgtccagccatctcgcttctgagaacgtctattcctgatttgtgctgttttttcaaagcagcagttagttgtttccttaatttctttcagctcagtttgaaataattggttacagttttcaccggcttgtggtccctgtttcgtggtgtggactgtcctgttcgggttcaccttgttttctcttgtagtactgggtgtagtgtttctgtgttggccccgtggagggctcttccgtggagagagcatggtagccagggcggcctcctggcctcagtgaggacgaaggtactgggtacctgtctgcactctgtggctgtcctggccttcaggtgctgtgctggtggccctgccaggccctggacagcccaccctccttccactccgggcgtcccgccggctttgtttgagttctgctcccagccacgtgtccacagaagaggagctgcttttc

SEQ ID NO: 135714 - DNA, 1060 bp, Homo sapiens
actaataatagttctgtaatgtcagctgtctagtcagtttataaatttctggttgtttcataggtgtcataatttttttaagcagtttgtttgaattgggatccaaataaaatccacttcttgattgatatgtcttttgtgtctttttaaatgtatgtatatataatttttccttccacatctccctttttttccccctgaaattttgtcgctgaagacaccaagttgttttccatagtctggattttgctgacttcatctccttggtttcgttaaacatgtgtctgtgcttggtctatactgtagatttggtggctgggtgaagatgcttgatcagagtcatgtttgatttgcttgtttgttttcacaaggctgcttcatcgatggtattgtgttctagcaggaggcacaaaatgtctggttgtctctctttttgatgacgttagctgccgcttatgctcagtgtccacattcctcagggtgcagggaggtgatatagtcatgccatcttcccggttcatctatcagctggaacacgtctacaaagacaaacttccccatctcaaacaatttggttgctctgtggtataacttttacaggacaggcagagtaaatgcttgattggtttctttgtgttctagttttcagaatagagctggttgtctagcacccctcaacaatgaccaatttacttattttctaattattcttgaaatgaacataacaattatttttggctaggaccattcatttttgcaatgacctaagccctttacatgaaccaagagcagccccaggctattggggtgctgctgtttgcactgcattccagaaccccctccagagagaccaggacacagctctcagggaggggaagatctcttcacagccagccgcagagcagagtggtccacgccacccagagagttgactgggaacaagggctgtgttggagaaatcaaatcagattgccctaacgatggttttcaaggagtcggacactccttaacaatcatgcagaccaacttactcttacagacaaggaaaatgaggcccaga

SEQ ID NO: 135715 - DNA, 1033 bp, Homo sapiens
ttgtcttcatgttgaggagcaaggaggggttggtcttgctgcctgtggggtagcagaggcagaagaaaatctgagtataagtggactcatgcggttcaaaccctcgttgttcaagggtcagctataaatggcttctttttttttattttttcaaatggcaagagccagaataaatggctcctttaatgaataggtaccactgatacattaataactattcctttgtagacaagcatggctaagtagctaacaaaaactatttctcaatatcatgttgttttctgaaattaaaaagattgagtagccactatgctataggaaattttgaaaaaggcaaaagagctcacaattttaggtttttaataccatgattttacttattgactgttgtatttacggaaatgatttttgtagctcacatttttaaaaactgtaaacctaaaaatcgcctaaaccagtccttgtcttaatggacacagactgtggctttttcagacagtttttgctgcattggaccttggagcacactctctttgtggaactggagactctgaggcccagggagggccagccgccccaactaagagaggaaccgggggccatccccagtgtcctgattcctacttgactgctttccccactgccccagtagaattaatgaggttttcttgtacccattccagcagggagaggaccagtttcacgcataattcttcatgactgcccatagcattttaattgcctgttattgcgtcaaaatattgtcctcctgacagctaagataatgtaaatagaaagcaagaggagacagaaaattgaggaaatttgcaagaaaataagaatgcctttgaaataccttaaagactgacttaatatcatttgaataaccgtttgatctcttgcattgccaggtgtgattatttagtgggaggtagtgatttctttaagacagactctatttagaatgaagtttctctcagttttatgcagctttggaaagagctcaagatcctgcttgtccacattcccaccg

SEQ ID NO: 135716 - DNA, 1077 bp, Homo sapiens
tgccttggttgcaagctgaagttagattttaactagtacatagtcagtagcaaggtattttgagcaaggctctgctggcccagtgacttgccaggtagatacattgcttcctaacggcaggtgtttgagtacagctatatcatagctgtaggttataggcgaattgatagtgatgccaggatttgcattgttcctttttttttttttaagtatgtttatgtggaggggagggatacatgaaacaggatggcaacatggataattgctggagctggctcacaaaagtttattgtatggttctctctactcttgggtatgttcgaacatttccataatagagttaaattaaaaataatacaactggtttcacaacagtgtgaatctacttaataccagtgaactgcatgtttaaaaatggtgaagatggtaactgttttatgtgttttttaaacaatttttaaaaatggttaggatggtaaatattatgttacagatattttaccacaattaaaaaatacatagcttacctacaaagggggtaatcagaccctgtccagcagccacagaacctattgccgaagcctctcaagacacgttttcatggaataaaaggttaggagaaatcctaggctcctgctgtggtcctgaaagggaagttctaggcaaaatattagaaccagacctgtttcctagcttgttttctaagaggaatcctgaatagtgggatcctttcaaagtgttataaataaaagcgttcttttctagcattcaccagccacttatataatgctataatccttagtttcttcatctacaaatagggataataatatttataccttatagtagttacagagtttaagtgagataatgaatattttaaaatctagcaccatttctctctccacacttctgaagatcctccttcagaactaggtttgcctagatgacaggttggtaggtgcagcaagccaccatggcagtcgtgtacctatggaacaaacctacatgttctgcacttggttaaagtaaaattaaaaaaagaactaggtttgtaaagtacagttgatctttgaa

SEQ ID NO: 135717 - DNA, 1051 bp, Homo sapiens
caaacttctaaattaagaccaaaacacttctgatattaaacattgaagtaaatgtgagctatacatacatttaagaaagattaatagaaacaagataattatttacctgcttgttccatttcagggccttgggtggctggcagctatcccagcagcttagggtgccaggcagaaaccaaccctggacaggacgccatcccatcacagggcacactcacacacacccgctcagactgggacaatttagacataccagttcacctaacgtgcatgtctttgggatgtaggaggaaatcagagtgtacggagaagacccacacagacatggggagagcctgcagaccccacacagacagtggccccagctgggaatggattttttttcctgtcatcgatgttaatgaaatgtgttgaacaaaacattatttgaggacctgctgtatgttggtctcagttagtcatgatgagatgggtctgtggacccagtggatggatccactgtaaactagaccttggccagggctccatttattacctgctccccatgtgcccccactcggaacgggggcatcctgaagcctcaggtctctgagaatcagtgttaactctaagaagtggctctctgcagctgacgctgactctgcgtgagctgacagctggagcccacgtgttgactgtcctcccacagctgggtagcattcctgagggggagctgagcaggcgtctctgtgtctcccaccctctttcgtcctcagctgtgatactgttgctgtatggctaagatcaagaatacctgtattcatttctcccccttcccctagtattctttttggtacagcctttcaacatggtaaataagggtctgtaaggaaaaacttgaattttttaaaaaaaaaaaaacatgaataacaactgatgttaaactatggtgttatttatccagcagatttaggtaaggcacggtggtagactctagaaatacagagagcccttgttctcaggaatttacagtcaagctggggatttggaacatcctgcatatgaaaataaa

SEQ ID NO: 135718 - DNA, 1154 bp, Homo sapiens
tggttagcaaatatttattgtacctactctgtgtcaggcatgtttctaggccccaaggatataaacatgggcaggacagacattgtcccatctttgttaagcttttcatttcgggggtgggaggagaccaaacaagcacccctcaacaaattaataaattaacgccataatttgtagttatgcttagtgctaggaagggactacagagtggggtaaggtatgggagtgggggatactgttaaatagggtgatcaaagagggcttctctgaggagccaatatgaggcagagacttgacgaatgaggaggagaaagaccagtgaagagccggggggatcccaaggggtgactgctctggggatcctttctctagctggtggacgttcttatgccaccacttccatgattttcaggctttcttcacagttcacacttgcttccaggataggaggaatgtaaccagccagcctcgacaagtagcttgtgtctgttgcttgcatgcacaggggccatatttttcaaaaagaaggtcactacagggacagctgcttttagtgatgcaagccagagttttgactatttggcagaatgcttcttaagggccattattctatctgttgtttctcatgtgtcgatttggtgattctgcaaatctcaactttcagctctctaaagtctaatgggccttgtaacttgtcattttccctgcatggattgtctactgaggcaagatgtttggcgagaagtaaaagactttctaatggtcccataagactggagccaaaaagtatttgttgctaactctctcttgacaaaagtcagttcttagtccatctgttcaccatttgttaatttgcattggcttgaaacctgtttacaggtgacatgctattgtgaggacacttagaaactattttaggcattagggcaatcaacagactgttctcatgccaaaaaaaaaaaaaaagagcgagaggtgttcacaactgtcattataaatttataataaatcactcaaaatagtttcaaagagaaaagtggttactgtgtcctaagaatacaacatagaaatgatttcctatacttagtagcctatttcctgtgaaaattgactgctgccttttcacatcattgagctttttgggcttacattat

SEQ ID NO: 135719 - DNA, 1044 bp, Homo sapiens
ggagggagaaatgataaaacacgaagctcctgaaaagaaaggactggcctttcttcccctcttttaggtgcacgctggttttaaaaacctctttctcagcagtgctcttactattttggctctcagcagttagcttttctggagcggaatagctgagggcaagagtacctggtgtgtgatggcagtgttagaagctgaatttttcaaagaagcagagactccactagacttagagccactcccttgggtcagggccttggagagccaggcagcgctgtcacgaggggcaccgctgtctttgagacaacgtggctctggcaccagtgcacactcccctgaagagggggcagaggcccgaatcccctaacactggtcaggcttgtgccacctccaacagatggaccagtaacaccttttcacatccctccctgtctttgaaaaccaggacataagtcaccagtttgttgtcttctgcctttgggaaatcctcacattttctgtgtgggaagcacagccagcccatgtcactccacccttttctacctcctgccactctagtagcagttcacataccatagcctgtataccttgatttgcaatttttgggccatgctctgctcccctcccccgcccccacacacaccgacacttttttttgcaagggtaatacaaaatgcagctcacaggcctatttcagactttattaaaacatcatttcccctgccttgttcccagatttctgtgcttaatcatagaaagccagcttgttcaaatatacattattcttgcttggaaaactcttggcttgtcttcctccccacctccttccctattttgtaaccttgcttcaccgaggcccttcttattaaatatcataatttgctcattggagagttatttgtaaacttaattaactctctgtcagtgtttgagttaattttctccctttcgttttagcctccctggccatggtttttcatactctgtcctgtgtctgttaaagactttgtaaatagttttgaaatgccagttggtgatatatgg

SEQ ID NO: 135720 - DNA, 1467 bp, Homo sapiens
ttatgctctataaaagtttattatagaccattcaagctaaaacaatatagtttgaaagtatgccacatcaacttcacttaccagctactagcagtgtcagtataaaaagcaagatcttacaaccaaagtcaaaaggtgtaaagtgtggttatttttataccttagcatcacctccagttctaaccatgctggctgagactgagacataccctcccatagccactccttggccctcaagggacagggcctgcaggcatgtgctgtgaataaggcaccgttggcccttttagctctgacttacttttcatttggagaacttatgtctgaagttaaggttcagcatccatccatcaaggtttcacccacatccttttgccgcccccctttctatcctaaagtgtcctttagtgttggagaaatggctgtagatgcagaaaggctcttgtatcagtccattagttgatgaagaaagagctacttgtagggtgacaggagatgaaaagaaacttaaaacttgtagacactgtcctctgaaagaaaaaagggatttgttgttgttgttgttgtttgagatggagtcttgctctgtcacccaggctggagtgcagtggtgtgatctccactcactgcaacctccgctttgtgggttcaagtgattctcctgcctcagcctcccaagtagctgagattacaggcacctgccaccatgcctggctaatttttgtatttttagtagaggcgggatctcaccatattggccaggctgatcttgaactcctgaccttcagtgatctgcccgtcccagcctcccagtgtgctgggattacaggcatgagccactgcgcccagctgggaaatgtttgaaacattttgtttgaaaactgaattttccagttgagcaacacagtgtgcttggtggggaccgtaaagggtttcctgtagaagcttggaaagggcggcccttgaaggaagcttctatagaaatggagccatcatgtgggaccgtgcagtggtcacagtcgggtgggagggggagtagtaaattttgccgtctctctgcacatttgtccaactgatgagaaaggcctttgagagttggcctacatcaaatttgccttatgacagggatatctgtatcttacaggtgtacatggagctggcagccaaagaggtcaagcttgtgtctacagctttttgtgaacactcatcttcttccactgtgtctgtctgccagtggtgacgtgtctgcatttcgacaagatggtgtgtcactgcctcccccaaaacagggggccacccatttcctcattctcccattaatctctacgcatgggggtcatacctatgctaatcagtgattcttctacaaaaaaaatggaaactgaatttttgttaatttgtttctgtttttctaccttgaaaccaacttcccagcagcattaggtaactagatcaagtccaagctct

SEQ ID NO: 135721 - DNA, 1020 bp, Homo sapiens
gtttactaacaagttccttttgtttgggtgctatgtggtgtggcgtacatgtgtgtatgggctttttttgttgattgggaactagaatatatattttaggaatgattttggaagctcttttattatactgtgctgcctctttgaataattgttgttagaattgttggttgtttaactgtatgcagggttgtgccccctccagtaatccattgtcattttcctcgtttctgtggttttttttccccttaggtcttgagtaagagctaaagcttgagagtttttctggtgtgcagaattttttctttgaatttctctttgagggtgttttagtattctttggtttgaagtggaaccgtgggagctgctttgtgattcaggaaggtgatttatcatgggttactaaagaaagaacttgaaccttgaatgcatacatttagcctgtaaagcctttccccaaaactctggactgccagtgacagaaacccagctgggtctagatttagccaaaaaaaaaagcatggggccttcattggttcaaggaactaaaatgttcagggagttacttctctgtggctgaactcaggaggatcagggtgcttgggtgggtggcaggaacatcactctcctgccctctctaggactgctttcctttgttgtcctgatgctctccaagggataaaaaacatgactcagcagctgtggatatacatagttcttatacctggtgacctcccagtgtccatgtcaggctctgaaaaaggattctggcccaaacttgataggtgccctctgagatgattcactgcacccgtgggtgggatcctcagctcagagcacctgaaacacaggaaatggggttccttggagttgggagagagggagttcccggaagggatggatgcagggcagttggagaaatcacagatgtctgttgcagttttttaggccagacgtgggactgttccagctctacacagataggtgtttggaaaaggaagccatgttgatgtattccatggg

SEQ ID NO: 135722 - DNA, 1021 bp, Homo sapiens
gcaactcatctgttggaagaagtgggtcattactgccggagtttcctcgagtccagatcttgcggatggcatcccctggtgtcgttcagggtgatgctctgtcctctgtctttcctgtgcgctcacagctgggtctagaggcttgatctgattcaggttcagttgctttggcttcgggtgggggtgtgttcttctagagacgctcactgtctgctggcctctcagtgggaagttctgggctggtgcggctcagtgcctggagctatgcattcatcagggactgcaaattctctcgtgaaatgcttctataaaaagaagcttcccctcatcaactttcggttaccccgaggtacagtttatataggacaggcaggataaatgcttgattctttccctttatttaccagttttcagaataatgagtcgcctataaatatttgaatgaatggatgaataatacacctgtgaatgaactgacgggggtgtgggagttgggggttctatctgttgccctcaagggcgtggctgtgggccacaacctgacagcagaggtccagcctgaagccaggtgcctttctacacaatgaagtgcagcccatggccaagtctctgtctacaccaggtgctggcagcagcctctgtcacccatcaacccacatcagtcaaaggctagggtgatcagaagctgcattactaagaatctagcatctgggacaaggcagtatcatcactctccccaactgagatgtgaggaatccttgaaaccagcatcagagcagagaggagagccgcgcagtgactgcaggtgtggcctttggaacacggcgttgatctctctgcaggaaggggaatcaaggagtttctggcctaaaggttgggctggtggcctccagggtttcttcctgggcagcccaacaccctcctgggcccctcctgggaggcgctcctttccccagaggccaggccaggctgcccacaagctctctgacatctctgccctctcggtgtctccccaggtgca

SEQ ID NO: 135723 - DNA, 1022 bp, Homo sapiens
tcctccactcccctgcaaaggagctatggaggggggccaccccacaacacagcagccccagacatgctcagtggcctctgctgagtttctgccacctgtcggagtcatagctctttggagatgggaaggacagcgacccctctagttgcccagagaggggaaggggctgacccaggccacaccagtgccagggcggggaaggtggggctgggacgtgtttgatcccaaggaaggaagccagagtcttctctccaggcctggccaccctgggaagtccccacctgccgtccagccgcgggctcacgtggacccagtgtggggagcatcccctggggagtgtggagatgctccctgcgaggccgggagagtgggggtccgagaagacggcgcccacacgtagccctgaccgcgcgcccgtgcccgtgtccgtccagagtgtaactgcaaccagataggctccgtgcacgaccggtgcaacgagaccggcttctgcgagtgccgcgagggcgcggcgggccccaagtgcgacgactgcctccccacgcactactggcgccagggctgctaccgtgagtgcgcgccgtcccccgtgggcggggcctgcggaaaggggacggggcaggaccgaggcagtgggcggggcctagtgggacggggcaggggcggtggactgggcctagcaagacggggcagggccggggaagtgggtggggcctagtgggacggggaagaggcggtgggcggggcctcgcgagacggggcagggccggggcagtgggtggggcctagtgagagcggggcagggttgggatagttggcaggggcctggtgagatggggccgacccgggggcggtggacggggcctagcgagacggagctggcaggtgggcggggacaggatgctgctgaggtccggggccgggccgaggggcgggtccaagagctcggggcggggcctgatgcgacctgaggcacggtggtgcctggtgggaactacgagaaagaccgagctggggttggt

SEQ ID NO: 135724 - DNA, 4212 bp, Homo sapiens
tctactaaaaatacaaaaaattagccgggcgtggtggcgggtgcctgtagtcccagctactcgggaggttgaggcaggagaatggcgtgaacccgggaggtggaggttgcagtgagccaagatcgcgccactgcactccagcctggcaacagagtgagtctctgtctcaaaaaaaaaaaaaaaaaaaacaaaagttgaagttctccattataggttgtgaccaggtcttatttttaggaatgggactttatcattttttatttgaatttattttttcctttcatccttgtctgacgagtaatgaatcttgagaatatgttcatacaataatatgtattatttgttcagaaatgaaagctggaactctatgcttcccaagcagtgtctctttggggtgtaattatttctcccttctcattgtttcaaggaaaaccagcattggaatcagctgattcaggatgctcagaagcgtggtgccattattaagacctgtgacaaaaactatagacatgatgcagtgaagattctgaaactcaagcctgtgctgcagagaagtctcactcaccctcctaccatagccccagaggggtccagaccccagggtggtttgcccagcagcaagctagacagtggatttgccaagacatctgttgctgcttctctataccacacaccctctgactccaaggaaattactcttactgttacttcaaaggaccctgaaagacctcctgttcatgaccaacttcaggacccacgactgctgaagaggatgggcattgaggtcaaaggaggaatattcctttgggatccacaaccctcgagcccccagcatcctggagcaacacctcctacgggcgagccgggcttccctgtcgttcaccaggacctgagccatatacagcagcccgctgctgtagtggctgctctgagcagccacaaacctcccgtgcggggcgaacctccagctgccagtcccgaggcttccacgtgtcagagcaaatgtgatgacccggaagaggagctctgtcacaggagagaggccagggctttcagtgaaggggagcaggagaagtgtggttccgagacccatcacaccaggaggaactctaggtgggacaagaggacactggagcaggaggacagcagttccaagaaaagaaagcttttataggaaagcccagtgacatgggccagcagccacagcatattgtaaactgaagatgaccagctcgtgggaccatctagataagcttgttttttgtaaggagtttgtgtgctgttggaaaacatggaaaatgcatccttaacacctgagcctctggtcatcttcagtattttctgtcatttgcaaaagctttcagagggcattgtgtatccgtaataatgtccttgaagtcagagactggaaatgttgatctcttagtcttctatagacaaggaggtcagactggagtgaatgttgtaaaagttgaaatgtatatttgtatagcaaataacaaaatccttttaaaatttaatctagtagaccgcttttctttccccctgtttaaaatgttaatcagttttcaacagaacaaactttatattaccaaaaaaaaaaagatgggaggagggcgggtcctttcaaccattgttagagcaagacagataattatttaacagcctagcttggaataagctgagttagtgctggtgggtcaggtgtctctggctctattaaaaaaagcaaaaacccccccaaaaacctggagtctcctaggggacactttgggcagcacggttatgttaggtaaagtcttgctgacatggtgcatttttagatagagtgcattggcccagggtattatatttctgtgatgagttcatttacctgtttcagtatgcacatagttccctagctaaaattcctaatcttcttgagagagaagaatatggagtgaaagaataattcttgagctatcattcaaatgctcccagcatattgtgagccttgtgtgactggtgaggtacagacatttggttgccaaatgctagattagcgctgggtcagctgtggaagaatcgcctcagcttacagattgtcagacagatctaactagttttccagaaagcctgggaagctgtgtgttcaacatttcccaagggattctgatcaccaggcagcttgggaaccactggggcaggccaaatagaatattttgggcgggaaagaagcacccgatttaaaatgaagcgtaaccagaggagttcagaactgggaagagagtggtagacttcctgtgatcttcagaaatcatctacctggtaaaaatacatgctgtttagaatatctgataggtgtttccagctactattagaggtgatagtgcttttgtgggggaaaaaattggtcatggtgaatggagatcgaggaagctcgggacaagggaggggtgggctgcctgattttgtccagttttccaaatatccacgcagtgaactggagtatcctaaacatgagaatgtacagttgacagttgtaaaaactagggatctgtagtgaatgctgtgcagccccatatctcatttgggggtaggaaaatagctgaagattcatgtgcattatttgacatttcctttgtcatctgctttttaagcaaaaaagggttttgtgttagaaattctacttgagcagattataaagagctttaaaaaacaactttcggttgccaaaagtttgagcatttgatttcattacctgtgtctccctcactggtgtccagacggtcaactgaatactcctgaaacccagggagcaggtgacttcctggagtgctttgtccccagagtcagccactgcttcctctgtgggggtggagagtttgtctttggccatgcagtgtgcgacagttcaggacgggtagggatgggtcccattctgtctgggtcaagggctctatcagcttcttccatgtgcctttgggaagaaatctcgttactttaagtttgctttcctgttatcttgatgaagtgcccattttagcagacacttgtagtgctgaccacttagggaatgtacaaactcctaagcttctaaagggaggcatggcaaaaacgttggggtcaggatgtctctcacgctgctcatgttaatactattaacacatgatttgagaaataagttttctctaaaatgcatattttgccgccacacactgaacaatattatttccagtgaagtttgatgcctgttcttacgttgtgttcacctgttggttcaccactcagcagatctgattctgcaagaattaatggtagaactagatcatcctttctaacagacgagcctgtgtcctgtgacggcctttcacagcggaatgcagttgtacctcacattacttttgaaacttcactcgttccagttggtacaagtatttgccaaagccatttcctatgttcaccgtggcccctcctgatgtggctgtcagcgcagcgttgttgaacagggctattctttttacaaggtgtgaagtgtggctcttcgcttcgtctttgccatggcattaaaagaaagttccctgtcttctttcaatattagttatttcaaatgaatatgtgctacttaaaagcttgttttgtttctttgtatataatttgccttggatttattgtgcacagtttgttgagttgtatgtttttgtgaattatcaggagtaaatttgacaagtacatgtgaataacctcctgtaaatgaattttataacaaaaatgtactgaactattttttaaagttgtgcagattagcaattttttgctatagctttgacttttctatgctgtgaattaatagctgcgatttggcaaacagccctgttgtctttgttaaaccctaaattttaagaggaaatggcagaattaaaagcagaaacaagaagatggacatggattagaggttatgtattatgaagtaaactacaaggtactaacatcatttcgtctgccatttggtttgctttatgctgaaattacttggtggggatttgtgcaattcagatataaaaagtttcattatccagcccggccctccttcctagctccttttggaatcttctctgtacagtaatgaggtgcattgaggccagctgtgctgtttagttacagactgaagtttggtccaacagaaatatgtgctgatcattaggctggaattggggtggaggtgagatagga

SEQ ID NO: 135725 - DNA, 1116 bp, Homo sapiens
catggaaaaattagggtggtggtccatgcctgtagtcctagccacttaggaggctgagacggagctcaggtgttcaagttactgtgagctatgaatatgctggtgcactccagcctggacaagagtgaggctagactgtcaaaaaccaaaaaactaagccggacgcggtggctcacgcctgtaatcccagcactttgggaggccgaggcgggcggatcatgaggtcaggagatggagaccacagtgaaacccagtctctactaaaaatacaaaaaattagctgggcatggtggcgggcacctgtagtcccagctactcaggaggctgaggcaggagaatggcgtgaacccgggaggcagagcttgcagtgaactgagatcgcgccactgcactccagcctgggcgacagagtgagactccgtctcaaaaaaaaaaaaccaaaaaactagtttataaatatgtatacttaataattatcttcctttttccagtaaatatgtttctcttttgtaaatagaccagcagaagtagacactgtggatgcattccagggtcggcagaaggattgtgttattgttacgtgtgtcagagcaaatagcatccaaggttcaattgggtgagttactgtcattgttgctcttttatacttgtatacattgttgcttgtttatagttcaggattaggttcattatcactgttagagaacaccatttgcttttttaattttcttttgtgaaaacctgtgtaatactatgaaagtttctcttttaagttgtgaaatagacccactgttagatcttggtgcaatcttggcccactgcatcctccacctcctgggttcaagcgattcttctgcatcagcctcccgagtagctgggactacaggcatgtgctaccacgcccagctaatttttgtatttttctgtagagacagtgttttgccaggttgcccaggctggtctcaaactcctgagctcaagtgctccacccactttggcctcccaaaatgctgggattacaggcgtgagtcactgcgcccggccttggtgtcttttatattaacccatttcatagtgtgaatctgttcttttatttaataagattcaaataaataa

SEQ ID NO: 135726 - DNA, 1055 bp, Homo sapiens
ctggtgaattctatcaaatattaaaagaagaatgaacacaagtcattctcacatgcttccaataaatagaacactcagattcattttttgaagccagtattacactgataccaaagccaagggaaagtatcacaagaaaactacagatccaaatcctttatgactagatacaaaaatcctcaacaaaatagtgacaaactgaattcagcaggttattacaaggatttatacatcaagaccaagtgggatttatcccaggaatgcaagattgcttcaacatatgaaaatcaatatgatataccatattagaagaatgaggagacccacataatcagctcagtagatacaaaaaaaagttgcacggaacccaaaatgctttgatgatttaaaaaaaaaaaaagaatacaaaggaactttttttattaataaaaggcatttacaaaaaactcatagctaacgttatacttcatggtaagaatgaaagcctttcctctaagatcaggagagatgtttgaaactcttaatgctttttttcaacattgtactagaggttttagccagagcagttaagtaaggaaaataaataaaaagcatctttactggaaagaaaaaagtaaaactctctcttcataggtggcatgatcttatttctagaaaccctaacaaagccattcaaaggcactattagagataataagcttagcaggatacaagattaatatgtgaaagttgattatattttgatgcaactagcaatgaacaatctgaaaaggaagttgaaacaattccatttacaatagcatcaaaaagaataaaacacttcggaataaatagaaccaaagaagtataagacttgtacgctgaaaactgcaaaacgttgttgaaaggaattaaagaacacctaaataggccgggtgcagtggctcatgcctgtaatcccagcactttgggaggcccaggtgggtggatcacctgaggtcaggagttcaagaccagcctggccaacatggtaaaatcttgtctctactaattatacaaaaatcagttgggcatgg

SEQ ID NO: 135727 - DNA, 2004 bp, Homo sapiens
gcagttattccagttgggttaagtactgtgaaggctaagtataaattcagttgaatgaaaatgtgaaagggaggaaggaagtagtgacagaggttggatggtattgggttgtgaataagggcatgtgttcaggtggtctgtatatgacagcaaagaggagtggtgttgctagaagcagcaatgtcagaggagctggggattcttgtgagagagtaggggaggaatggtctaggggcagcatttgttggcacggatacaagtgccactctgtcatgaagtaggaggaaacacaaatcccacttctacatcatgggatggctgcagagcaggtggcgtcctcaggcgagaatcaggcgttagataagatacagaggtggaagtagggaacactcattgaagaggttacacatacagaggagttgttggccatgggattgtagtgctggagggactgcagcctaaaggttttaatgaggcctcttggaggagagcagaggattgcgagttaagccgcagagcatcatgaggatttcagggatggaagagatcgctagctgattgggttgtccatttagtaagtctcaaagttaggagaatgggtatttaaggctcgtaaagcaaggcgggtaaggtagcctcaggaatcaagggatggggcagtgcatcccctggtcttggtgcattttgggtccggtatggtcatgagggagcatgtgttttcaggaggggttgagagtgcaggatatgaggctgctgaggactacaaagaggacatgaacctgctccagggccccatgttgttcaactggggtcaagtgggacacatccttcacattgagtctgtgtggatggcagctgctcggttgtgtggtgtgtgttgtatgcagccagtggtgagggacaaggaagatcatacatgtaaagcattttctcagtgttcggaagatagttaatccttaattcatgttagctatctcttattcacatctttgttcttattaatactgctgttcttaatactgctctccctgtttcaacagatgaagaaagtggtgcctaaacttcagttgatttcaaactcttttctctctacaacttcatttttcactgggcatttcacatgtattcatatttaccatagtattttcacatttattcatatataccatattaatggtcattgtaacagcctcttggagtcactgctagctgaataaaagatgaagcctatctgcctgccctttactataatgggaaacaaactcagtggaacttaagttagcaattagcctgctattagttttgataacactgtgttttctttttccatcttgtttagctcatatataaatgttcaagaaataaaactggtgatggaaataattaagcttattaaagacaaaagaaaggatgttagttttcgaaacattggcataataactcattacaaggcccagaagacgatgattcagaaggatttggacaaagagttcgatagaaaagggtgaggcatttttataaatatttccaattttcttgttgaattagaatgagaggatatagaaggaaagaagaaaagggaaactcttaaggagtggtctgtgcaaattggtgatacggcacgaggaagctgggatgctgctggctttcatagacttgtgctgtgtggctcctgggtagacaggttacttcctggcagttggaatgtcaacattctccttggcagtggaattgactaagaaacttgccaggtctttaccttttagttccatgacttgttcatctgaattcttgttctagcaagactaaaagtaacatttcactttaaataaatgatttaacccttgtattgcctttatgtatagaatgaaaatcatgtttttgtttccttcttacctcagcagtaaaattaaagattaaatattggagatccataaccttaaaatcatcttaacttagaagcacacagactaccaaaatcgaatctagaaaacaatagaaaat

SEQ ID NO: 135728 - DNA, 1018 bp, Homo sapiens
ttgtagcatcaaaatagcatcagttgtctttcacaagatcatatctctttcattagcagtatatgagtagaaaagacctccacatatattcaagattcatggcattttggccaggtgtggtggctcattcctgttatcccagctactcaggaggccagagacatgagaatcgcttgaacctgggaggtgaaggatgcagtgagctgagatcacgccactgcactccagcctgggtgacagagcgagactgtgtctccaaaaaaaaaaaaaaaaaaaaaaaaaaaaaaaaaagattcatggcattttgaggctcagagtcagaaacaccttttttctctgaagctgtggttggtaatcttatgctacctgaacgttgccatatacgtattagatctcagtaattgtgtttataatagtgggaaagatataaatgaattcttggaaactgttgctttattttgcccctcacagaaagcacaggagtatggctacgaccagtcaatgatggctcgcttctgcagactgctggaagagaatgtagaacacaacatgatcagcaggctgcccattctacagctcactgttcagtacaggatgcatccagacatatgcctcttcccttctaattatgtttataacagaaacttaaaaacaaataggtgagttccccttattgtttgtgaccttattttgttgtagtttagctacttatgaagaatagacattttactgtcgtcttaggtcttgtcataaaaagcataaatcatgaagggttaataattttgtcctgttataatagccatcatgttgaatacagcaaagcacataaaaaagaaaaggggaaaaagtcacctatatttatactacccagaaataatcactggtaacattttggtatatccactttcagcagtcctttttttttttttttttttttttgaagacagggtctcattctgtcactcacacaggatgagtgcagtggcacacagtcctggctcactgcagcttcgacctc

SEQ ID NO: 135729 - DNA, 1007 bp, Homo sapiens
tacataacttccttttctgtttccccaaagaaaagattaaaaattaggttttgtgagctaacgcagataaacttttgaggatttagggaaaattggcatgtatctattaataattattttatgctttcacaaacctgtttaaaatcacacatataaataggttaagaagtaatgcctttcttccactcccatagtttgtgaaacaagtttattcaggctttgcacgtcttcagtgccagtatctttcacatcactcatgaagattccatcatcttagtgaagttttcagcacatttttacttcagggttatttaagataaagtactttttgaaacttttcttttttaattatactttaagttctagggtacatgttcacaacatgcaggtttgttacatatgtatacatgtgccatgttggtgtgctgcacccattaactcgtcatttacattaggtgtatctcctaatgctatccctccccctcccctttttgaaactttctgtgttgctgccatcggaaagtagatcccaaggcacaactgtggtaacatcaagacagtttatcccacttgtcacttaggtcactgtttttcagattgcagaatataacccattatttggtttgtgaaatccatttagcacagcttcggcgttcctaattcaaaaatttgaaatgcttcaccatctgaaacttcccaagtgctgactttatgcttaaagttcacgctcgaaggatatgctcattggagtattttggatttttggattagggatggtcaacacataagtcgagtctgtttccttcactggaaattaagtcctgtgagacttcatcttattcactctagtggtcttagcacttcaaattatagatgcttagtacatattagatggatgaatgaagaattttgtcttcaaaaggcttgtttacagtggcattcaatatgtctgtctgtgagggtgtacccccagaaataattgttaaaatctgtgttacatttccttt

SEQ ID NO: 135730 - DNA, 1045 bp, Homo sapiens
taaaagaaaaacttcagaaataaagagaagaatcctaccctcctcatttttgtttaaatatgtacaaattgaggaaaacatgaagttaaattaattttggagtacatttccatttttagaatttggtattctagtgttaatacaagaacatgtctgtgcccttcacatcatctgaaagtgaaggtacaggggaaaaaaagactcaattacaagctctgactttgggaagagaagaaccagactgtagtctactcttctctgttggttttttttaatctcatgaaagattctcctggaaatgcacattagaatcaggatccagtagatgttttgaagtaatctgaagaggttttgaaatttaatgaaatgtgtattttttactaataacatagattatttatacagataattgagcagtggcttcataaataatcctagagaacagatcattttcaaagcatttttgttgaagcttggaatgaatgcaggtggttatcgttagtggtttttgatttcggaattattcagaatgatagtgcagttctttgtatgacatttgagcgcaggtacatgatcatgttagagtgtggcccagaagcacacccgtcacccagtgaaaacccgtgtgtgtagggaagaactgctgcaggtaactttgttcacggagaataatgaagagcaaattctgtatcccatttctttaaatgatgcaggatttcattgaagggccttggcatatagtgaaaagagagattgttaatgggcctcaactttactgcctacttcaatgattgataaaaacaacaaaaattagaaaaaaaaaatccatttgtgctgtttaaattgttgtacaaataaaacaggctattttgagaaaataattacaaagttcatttccataaggtgccttttttgaccacctgtttctagtggtaattacagtgaaagtgagtatttttaacagatattgctaggcatttgtgtgtttattcgtctttttcagtatgtatatattgagtgccaccataattcaggcactgtttag

SEQ ID NO: 135731 - DNA, 1012 bp, Homo sapiens
cctacctacatatatctgactacaggaaggattgtaatctactttgaccaaatcaaaccctggataaaaatttttaatgtgcttaaatcatattctgtgtttcagccgcgaagcacacattctttctgctttgtgattatcttaaatgtttctgctgtttcctagatttgagggtttcccctaacttttactaaatatttttctgtcataaatctattttaataaatagtgagtgttttatagtaaacataggcctgtcatagtcaaggattgatgtacagctgaatattgatttaacctttgttctcttaggttcaaggacgcccacagaaaacacagagtatcatcatcttagagtcccatatcatctgctgcacgttgagcacaagtggtggtttactacttgagtctgctttccgtgggcaagggggtgtccccttcagctgtgtcattgttgatgaggtcagtgaacggtcagccatacaactttgactactactatgaggagtaagtcttagatgaattgtggctgctgaaatgttgaggaaatgtgttttttttttttgcatctgattttcacttgctattacctgtgtattcccttatgtagaaatatactccttaatgaccctccatagtgaaagtggattttccagtattgggggttagtcttgaggatgactgatggtttctaacaaaatctctgctgagtgactgtctcactcctgcttagaatatctctggtaaccttttgaagtagttttaatataattttggatagctttgagccacagtatgttcacctgatgtcttttattcctagttcactctttgagcaaacatttattgggtacgtactgtttgtcagaacgtagagtcagaagacaaaagagatggagcaggagataccagagaattgagtgatcaggagacccaagatccagttttcaccagaaggaaaggacaaaaagtggaaatgattaaatagttgaagaaaatgtcattgaattta

SEQ ID NO: 135732 - DNA, 1098 bp, Homo sapiens
tcccaaagtgccaggattacaggcatgagtccctgcacatggccttgcatttggcttataggctgtactgccttatattaaagctatactgagtttattagttgcctttcagttgcatgttgagcccagttcaaattaggttagacagaaagggaattagcttcagtatgggtggatccagagggtcacatgatatcatttctccactccataatttgtttttctgtgtgtcagccatttcttctgagaaaggtgagtgtcagcatctcagggcttccaccatctcagctttgaaaccccagagggagagaaagtctttctcttagcatccatatatccaaagaagcagttagtttagtccctgggtgagcaagcaggtctaatccctatttttaagaagatgggtgcatgattggccaggcctgtgttagatgcccatcactgtggccagaggaatggttggggtgtgatttacagcctcatttgaatcacctggaagttaagggtggcgtgatgctcccagtgctggaatgctaagcagacagctcacgtgcagcgcacagaacacagctgagtcttacgcagcagcatacagagtgtgtcaggactccagtggtaaagaggaaataagctgggtaaatacatttttcattggtgaaatacaggctcttttaaaattagaggtagtccattggaaggcatttaaaaatgcttagtttagttttaattgtgacatttgaatttttttccagaggcaagaattagatgaaaacatttccaaagtttctaaggaaaggcaggaacttgcttctaaaattaaagaggtaagtagttcacctgtagcattttcttgatttttttttttttctttttaaaatttaagtatgactgttcagacaagctatgggcttttatttatttattttggagacagagtctcactctgtctctcaggctggggtgcagtggcatgatctcagctcactgcaacctcagtctcccatgtggctgggattacaggcgtgcaccaccatgcctggctaatttttttttttttttttttttgaggtgaagtcttgctctgtcaccagactggag

SEQ ID NO: 135733 - DNA, 1070 bp, Homo sapiens
gtataagaagtttgtggtgtagtccctggtgtctggttaattggaagttcatgtttgctcccttctctgattattaacatatttacttagaaatatagatactatgtatagagacaggattgatcagcagtgtccttattagtccttaactgtgattcttatcaacaggaaactgtggagatataaatttagtacgactgggtccagaaaagtctattaatagtgaggttctaaagttcagtttggacagccaagtaaaccacagaatgagtaagtactgaatgtggtatatactagtgttttctctgttttgtttggtggaaaatgacttgggcactaaaggtaatttgaagcctccagaattagtctggctttgggaactaattttccttctcattgtgttgtatatgtgtgtgagtttgttagaattagaatagcatataattttttatttgttatttttattagaaaaagagttaccttctcatgttcaggcgatgcataaaagaaaggaatttctagattatcagctggatgagctttcccggcagcgagctctatgccgaggtggacgggaaatacaggtatctttgcatttcttgaataataactcaggtatacgaactagttaacaagttttttttgagacagagtcttgctctgtcttccaggctggagtgcagtagcacaatcctgactcactgcagcctcaccttcctgggttcaggtgatcctcctgcctcagcctcccgagtaggtgggattacaaggttgtgccggcacacctggctaattttctgtatttttaatggagatggggtttcaccatgttggccaggctagtctcgaactcccggcctcaagttgatctgcccacctcagcatcccaaagtgctgggattacaggcatgagccattgcgaccagcctaattaatgagtatttaatgccctttatttattggggaatggcatgattcatgtataaaaatgtgtactaagacactaaaaatgtgtctcagattaacacatttctttctgctttttttttttttgtccttttggttttaat

SEQ ID NO: 135734 - DNA, 2104 bp, Homo sapiens
ttcccctggcatacatgctttttccactgtatcacatgtgctaggaaataaatagtcttgggatgttttcactaaggagaaaattgactaaagaaggaaaaaaacagagtagtaaatagaagaaaagttgtggattagtaaatgcaatttattgtgattatctttgtaagaataaaaaataaaagtacagttgtatttgtaagtacttgaagcgttacagacactaattagtaattagtaagtaattagctttctttccagtagtgaacgtgctttttagattaaaggtcactttggtgtccttgtcttgtctgaccataaccaaagcttttgtctcatgcattgaaagaaatttggacaggtctttttcatgttcttcctttcaaattccactacagaaacagcaactcattctcaaaaatgtgttttttatatagattgcgtacttaagagatttcaatgaagatcaaaagaaagcaatagaaactgcatatgctatggtgaaacactcaccatcagttgccaaaatctgcttgattcatggaccacctggaacaggaaaatcaaaaactattgttggcctcctctatcgtctactgacagaggtaggtatgggtgagggcactgatgctgttaactagctgtatcattttactttacttgagttaactgacatgtaaataagtattaacatgccatttcctctttgatttgtatatattttttatattgtgtgtaactgtgtcagagaaaagggtggcagagggagggaaggttatgggaaataaaaagaggaaaaaaccactatcttatgtgaaacaaatcgtaaggactagaatgatggtcttcaggcttcacggtaggtcacgtagaatgctgtgaatgctgggctgcattttggttggattgtggttttttgttttttttttttgagacagtgtctcgctgtcatccaggttagggtacagtggcacgatcttgactcacagcaacctctgcctcccaggtcaagtgattctcctgcctcagcctcccgagtacctccctagtggctgggattacaggcgtacaccaccacccacagctaatttttgtatttttagtagagatggggtttcgccatgttggccaggctggtctcgagctcctgacctcaagtgatccgcccgcctcggcctcccgaagtgctgggattacaggcgtgagccactgtgcctggcttggattgagtattcattaaagtaagtggatgataaagtaaggctcagagcagttatgacaaatttttttgctggagtaattttaaatatcagtgttagatgtagatgcttttatttatttttaactttattacgagaactttcaaaaatacatggaagtaaagacaaactttaaagctatgtaatagagctcacccatattttttgtgtgtttgtttggtatgtatatgtggcaaattgtagaaccagaggaaggggcattcagacgaaaactccaatgccaaaatcaaacaaaaccgtgtcctcgtgtgtgcaccttccaatgcagctgttgatgaactcatgaaaaaaattatccttgaattcaaagaaaaatgtaaagacaagaagaatcctttaggtatgatacttttgtggattttaaatttgtttttgttttcagtgttaagtgtaggcaactttgaatgacaaaggaaagagcaggccagtcctggtaatagcttctacttgaatctgtggcttgtgagttcatttagcaagtatttcattgaacatttaccctgtgccagggcctgtgccaggtactgaggtttcatcagtgaagtcttcaaggagacacacggcctagtgaggaagtggagaggtcagtacagagtgataagttccacagtgaggctaaaatgtggggtgttccacacaccttagggggaccctgattcagttgtgtgagggttagagaagggcagttaggagttagccacaggcagtagagggttagggagtacttgagcagcagagattgccataaaaaaaaagaatcagggcaagagagcctcagatggttcttgaggttcccagagcattaggtggcggtgaaagatgag

SEQ ID NO: 135735 - DNA, 1050 bp, Homo sapiens
tttaccctctgctgagtactgtttactcccttacttcaagtctctgctcaaatatttcatcaggaagaccttctcggaccagcttatctgcctccatccccatcacttcctccctttgtgtgctttcttcagagcacttactaccacctgacatatttatttggttatctgcctccatcttctagaaaataagcctccggaggacagaacattactgggttcaggaagcagtccataaatatttactgggtaaattatgtaaataatatccaaaaatatgttaaaaatacctaattctgcatgacctttacaactaggcagcattattcagtgataactgaagttgctttttctctttcttgatgatagtgcgtaatgggaaaactgagtgttacctttccatccagactcaagagaactttccggccaatttaaacgaacttgtgaattgtattgtaatcagttctctggtaactacacaaaggaagttgaaagccatgtctctgttgggtagtcggaaccaactggctagagctgttctgaatccaaaccctatggacttctgtacaaaagatttactgactacaacatctgagagaattgtgagtgatgatgtatgatactagataatttcatgttaagatgttaaagcatcatattttttagctgctatgtattcctatatgtttacaacaaaaatgtgttcacggtgaacagtttagtgttagttttctttagtattgcaaagtatgtaatttaggttaagtcagctcacttcaggaaaaggtacagtacaataagcgtcgaaggttgctggaagagcaacattaaaatgttaggtcagcagcctacttaatgtgcattaggtgagaagtctcaggtttagtggtgttaaatttacatttgaatgattgatggagaattggccggtattgttggaaatgcaaagatgaagttgtcaactgaacatgtgaagctgtgtataaactctaggaagttaacagagaaatgcaaaaggaaactaactatttagaaactctagagctgtat

SEQ ID NO: 135736 - DNA, 1230 bp, Homo sapiens
aggccaggcacagtggctcacccctgtaatcccagcactttgggaggctgaggcgggcggatcacgaggtcaggagatcgagaccatcctggctaacacagtgaaaccccatctctactaaaaatacaaaaaaattagccgggcgtggtggcgggcgcctccagctatttgggaggctaaggcaggagaatggcgagaacctgggaggctgagcttgcagtgacccgagatcgcgccactgcactccagcctgggcaacacagcgagactccatctcaaaaaaaaaaaaaaaaaaaaaagcagaataaacctaaaggaaagaaaatttattagctacttttcaatattatagttttgtctattttggccttatagcagttttgaagaaaactatattctataattgatatttttaatatttgaagtttttgattggattagattaccattttaaagtatatgcagagtcctttagtgctgtgtatttttgaacttaatacaaggatttaatttcttttaagttaatcttatttaaaataattctattagagttatatgaattccgacttcttcttgtttcatagtttatctggaagaatgtgaactggctaaacagctttatccaaaggaaaacgatttggtgtttttagctcctgagagaataaatgaagagaagaaagatacagagagaaatgacatacaagatctccacgaatatcattctggttatgttcataaatttcgccgcacgtcagtcagtaagtaaataatgaggcattgacaggaaatgtcagatacagtctcatctaataatctacttctcaattgtgtatatcaagtgtatttgatagacatttaccgaacatgtttttgctatgttgattacatggccattcagagtctcttttctagtttttctagacttaactggaaaagaccttgtatttatttttgtaatgttctatccttttgttacatttctttatccatcattgtgtttgctataaaatggaccatttgcagaccatctgttgtttgttaaattacatttcatccttggttttgtggccaattactaatgagatgaccaaacataaaactcactgtaaggcagcttgaggaatctgcttacatcacttccatccgttgtatgtttctccctaggtaatttaataacaaaaatattagcctaaatttaatgaataccagatgtatgcagtgagacttgtc

SEQ ID NO: 135737 - DNA, 1508 bp, Homo sapiens
gagttgccttactgtagggtattctgggtgatacaaactgatcatgactatcatggtccagagtctgaccttactagcagataacacagattcagtattgttttgttcccctgtccatagcataacccttgtggagtcttggttggttaaccagtgcagaagcagttcaacaccaatagtctttgaggataagtttcttcagaggaactgaaagactatttgttgatttaaatacttaatgactaactgttacatttagacaaaaccctccttagggcccaaaaggtaatatatttgttagttttttaaaaagtgaaagctaatatgacttttttatactagtagtcttcctaaatttgggattgggaatagtcttatttctcagaagatccttaagggtacttctgagtttggagctttgacagactgggagatgggtatagagcattttataaactggcaggatgacatgttggtgagaaatccctaaggtctgccacaaatctaggtccttttggacttgtgagctagctgatctggttgggaagtagcattctaccggagctgtccagcagtacgttatgcactgctggaaatgctccacatctgcccacagcggagcagccacaggtggctgttgagcactgcaagtgtgactagtttgaagaacagaatttttattttttaacatttttattaaatgtaaataaccagatgtagctagtggctactgaattgggcaggacagttccagataattgtattaacctgccgtgaatcaatttttagtttttgtcacctagattctagcttctggattttactgttgcttaactttggaaaatgttactatttagcatcactttccagaatgttgctttcttaatttgcttttgtgctttgtataggtggcacaagaatggctcaactctccaaatagagagaatttctatcagttgcaagtacgaaaatttcctgccgattatataaaatactgggagtttgcaggtaagttttttcttacgcaacttggaatatatgatataataattggagatttctaattaagaggagatagcattatttgaatttagggggacacaaattttctaagctaaatttgtgacttcttagaatatgcttaaagtcttaatgaggatagttactggaacaattatgaatgtaaaatttatgatttttttccccactctgtagttagaatactacaggctgaattgtcagtgggggctgggaatgggagagagggtgagtggagggatttggtgggggtgttgcataatagtctttacagattctgagtaaatcttcctggcatctgtcttttcatttcatgattgatccgaaccacataccacttttatatactagttataaatacaccaaacattcagaactctttaaaataaaatgaataagtcctctttttacccccaacccccatccatcctcctctgtagatgtgcttaaaaaaaaatgaggctgggtgc

SEQ ID NO: 135738 - DNA, 3772 bp, Homo sapiens
agcttccagcccaacattttctaaagaaccaatgaaagtgcaagacagtgtattgatcaaagcagataacactatagaaggtgacaataatgagcaaaattatataaaggatgtgaaactagaggaccatctcttagctgggtcatgcttaaagcagagtagtaaaaacatttttactgaaagagctgaagatcaaattaaaataagtacaaggaagcagaagtctgtaaaagagatctcttcatatacaccaaaggactgtacttcaagaaatggtccagaaaggggatgtgacagaggaataatagtatcaacacgtttgttgactgattctagcactgatgctttggaaaaagtgtccacatcgaatgaagatttctctttaaaggatgatgctcttgctaaaacctcaaaacgaaaaactaaggtacagaaagatgaaatctgtgcaaagttatcacatgtaataaagaagcaacacaggaagagtactttggtcgataatactatcaatttagatgaaaatttgactgtatctaacattgagagtttctattcaaggaaagatacaggagttcagaaaggagatggtttcatacacaatctttctttagaccctagtggtgttctggatgataagaatggagaacaaaaatctcaaaacaatgtattgccaaaagagaaacaattaaagaatgaagaattagttattttctctttccatgaaaacaattgtaaaatacaggaatttcatgttgatggtaaagaattgatcccttttacagaaatgaccaatgcttcagagaagaaatcatctccctttaaagatcttatgactgtacctgaatcaagagatgaggagatgagtaatagtaccagtgtgatttattctaacttgacaagagaacaggcccctgacatcagtcctaaatctgacaccttaacggattctcagatagacagagaccttcacaaattatctttactagctcaagccagtgttattacgttcccatccgattcacctcagaactcatcgcagctgcaaaggaaagtaaaagaagataaaagatgtttcacagctaaccaaaataatgttggagatacctcccgtggacaggttattattatttcagattctgatgatgatgatgatgaaagaatcctgagtcttgagaaactcactaaacaggacaaaatatgccttgagagggaacatccagagcagcacgtttcaacagttaatagtaaggaggaaaagaatccagtaaaggaagaaaagacagagactctttttcagtttgaggaatctgattctcagtgttttgagtttgaaagttcatctgaagtgttttcagtttggcaagatcatccagacgataataattcagttcaagatggtgagaaaaaatgtttggctcctatagccaatactacaaatggtcagggttgtacagattatgtatctgaagttgttaaaaaaggagcagagggcattgaagaacacacaagaccacggagtatttctgttgaagaattttgtgaaattgaagtaaaaaagcctaagagaaaacgatctgaaaaaccaatggctgaagatcctgtgaggccttcatcttctgtcagaaatgagggccagtctgatactaataagagagatcttgtgggaaatgattttaaaagtattgatagaaggacttcaactcccaattcacgtattcagagagccactacggtttcacaaaagaagtcttcaaagctttgtacttgtacagaacccatcaggaaagttccagtttctaagacccctaagaaaactcattcagatgccaaaaaaggacagaatagaagttcaaattacctaagttgtagaacaactcctgctatagtgccgccaaagaaatttcgtcagtgtcctgagccaacttcaacagctgagaaacttggcctgaaaaagggtcctcgtaaggcatatgagttgtcccagcggtctttggattatgtagctcaattacgtgatcatggcaaaactgttggagtagttgatacccgaaaaaagactaaattaatttctcctcagaacctgtctgtcagaaataataagaaacttctgactagtcaagaacttcagatgcaaaggcagatcagacccaaatcacaaaaaaatagacgaagactttctgattgtgaaagtacagatgttaaaagagcagggtcacatacagcacagaattctgacatatttgtaccagaatctgataggtcagattataattgtacaggaggaactgaggtacttgccaacagtaacagaaaacagttaataaaatgcatgccttctgaaccagaaaccataaaagcaaaacatgggtctccagcaactgatgatgcttgccctttgaaccagtgtgattctgtagtgttaaatggaacagtaccaacaaatgaagtaattgtctccacttcagaagaccctctgggtggaggtgatccaacagcacgtcatatagagatggcagctttgaaagaaggagagcctgactccagcagtgatgcagaggaagataacttatttttaacccaaaatgatcctgaagatatggatttatgttcacaaatggagaatgacaattataaactcattgaactaattcatggaaaagatacagttgaggttgaagaagattctgtaagtcggcctcagttggaatctttgagtggcacaaagtgtaagtacaaagattgtcttgaaaccacaaaaaaccagggtgaatactgcccaaaacactctgaagtgaaagcagcagatgaagatgtatttcgtaaacctggcttgcctcctcctgcatctaaacctttgagacctaccactaagatttttagctcaaagagtacttcacgaattgctggtctttctaaatctttggaaacttcttcagcactttcaccgtctctaaaaaataagtcaaaggggatacagtcgattttgaaagtaccacagccagttcccctcatagctcagaagccagttggtgaaatgaagaattcgtgcaatgttcttcatcctcagtctccgaataattccaacaggcaaggttgcaaagttccatttggtgaaagcaaatattttccatcttcctctccagtaaacattcttttgtcatcacagtctgtctctgacaccttcgttaaagaggtcttaaaatggaaatatgaaatgtttttgaactttggtcagtgtgggccccctgcaagtctttgtcagtccatctcaagacctgtgcctgtcagatttcacaattatggagattattttaatgtttttttccctttgatggtattgaatacttttgaaacagtaagtatgtgtttcatttgtatgcctctccaaacttttcaagttacctctttaccttgctgagtgaaaatgagagtatagttcaaaaaatcagccaggcgtggttgcgggcacctgtaatcccagctactcgggaggctgaggcagagaattgcttaaacccaggaggcggaggttgcagtgagccgaggtcgcgccactgcactccaacctgggcggcagagtgagactctgtctcaaaagaaaaaacaaaaaaaagtatagttaaattaaaattgaccgtttcgatttagatactggttttagatttcatgttgaacagacatttgtgccagccactgttttagatactggcaatacagaggaaacacttttttttttttttttttttaggtggagttttgctcttgctgc

SEQ ID NO: 135739 - DNA, 1984 bp, Homo sapiens
gttattggaggatgggactacaaagttttggcaggggttgaggagctgaattagaaaaggttgtttctggtatggcaaacagggtgtgaaaagattgtgcttacctagactgttttcttgcccattaagtaatttgtttgccactaaatttttttttttttttacagacgtatcatagtattgcttgcaaaaaatcttgaaaatgtggctgcttttgaaaccctctgtgtgtctgaggactggtggcggcactgctttaaattatttgctccttggcttttagttgggttgctactcaccagataaagaatatgcttaattctcaatatattgtagtatgtttttctaactgtttagtaattcaacgattgtgccattgtatttcagatgatagtgtggatcctttctggccagcgttacactgttttatggtgattctggatcgccttggatctaaggtctggggtcaacttatggatcctattgtggcatttcaaaccattatcaacaacgcaagctacaatagagagatccgacatatacggaacagctctgtaaggttagttcagctaatgtcaggatttaaacatcatctctataagaaagtgtgttccagctagattacttaacaagaggtgtttcttcctttttttcccccttcgtttcagtaatttctatttattcttaatatttaaggaccaagttagaaccggagtcctatttggatgatatggtgacttgcagccagatcgtatacaattataatcctgaaaagaccaaaaaggtataaaacactttgaaaattcagatgctattttattgcctttatattgtgtagactattttgtataatttgttgagttgcagattttgtgatatgtagctgttctcaatctactgctatgtaaaagcccttctcattgaacagcagatgtattgtgtgttggggaagatggactctaactacagtatgcatactttggaaaattaacttataagtacatttagggaagatggaaagtttatggggacatacatggcatgactagaaatcaaaactagctagtggacagaaggtgagagtacataaaggtgttaccaatttgtctttttatgaaaactcaaaattcaatttatattttcactttcttgggagttaggtgtattacgattgtgatataattatatgccacaattataccattgtatagcataataatgatgtggtaaaccaaaataagagagttgagaaacgtatttttcttaacgacttgggtgttgaacctgtcataagtggtgcttatttatctgaacatcagcatttctttcattttaggattctggatggagaacagccatttgcccagattattgtcctaacatgtatgaagaaatggaaacattagccagtgtacttcagtcagatattggtcaagacatgcgtgttcataacagcacatttctatggttcatcccttttgtccagtccctcatggatcttaaggatttgggtgtggcttacatagcacaggttgttaatcatctgtactctgaagtcaaagaagtcctcaaccaaacagatgctgtgtgtgacaaagtcactgaattttttcttctaattttggtatcagtgattgaactgcatagaaataaaaaatgtttgcatttgctgtgggtaagttcccagcaatgggtggaagccgtcgtcaaatgtgccaagcttcctaccactgcgtttacacggagttctgagaaatcatctggaaattgctccaaaggaacagcaatgatatcttcactgtcattgcattccatgccatctaactctgtacaacttgcttatgtgcagctgattagaagtctccttaaagaaggttatcagcttgggcagcagtctctttgcaagcgattctgggataagctcaacttattccttagaggaaatttatctctaggttggcagttgactagtcaggaaacccat

SEQ ID NO: 135740 - DNA, 1013 bp, Homo sapiens
gccaccacgcccggcctcaaaatacttctataccatttccttgattccaaatcttaaggtcacgtgtcataaatggcagtgattttttttttctttcttagtggtatatggaatatggtacatcttaaaattgaaggcatcttatattggtgagatacaagttacatggtagttatgttagaaattgttttctaaccatcttgtactttcacacttgaattagtctagagttctattacttgggagcagttgtgtatgaatatctgagacttaaatgtttgagaaactaaatactatcttgcttcatcttcctgccttgttattcttttgcaaactaaaccaggcattagtatagtattatttcatcaattcaagataactctaaatgatcttacaggtatttgcatgttgctgaccattcttgaggaacaagccatggattccctgttgttgggctcagacaaacaaaatgattttatgcaatcgatacttcacactatggagagggaagcagatggtaataaactttacttgctgaatgttgttgaatatagtgatgatgatgcactttaaaaatgatagtgtcactgcaggaattggtgtatgttgtggagaaaagaatttttctggtttagtaatagattcagactttttattttgttttgttttgttttttgatacgaagtcatactcttgttgcccaggctggagtgcaatggtgcgatgtcagctcactgcaacctccacctcctgggttcaagaaattcccctgtctcagcctcccaagtagctgggactacaggcgtgcaccaccacgcccagctaatttttttgtatttttagtagagacggggtttcaccacgttggtcaggctggtcttgaactcttgatctcaggtgatctgcctgccttggcctcccaaagtgctgggattacaggcatgagacttttaaatcagaaaggacctttataatttaattcaataccttcctttcatagaagaagggaagtt

SEQ ID NO: 135741 - DNA, 1355 bp, Homo sapiens
gattagtttagagcaaatcttagatatcagagcatttcatccacaaaatatttcagtatgtatttctaaaagataaagacttaaaaaaaacgaaaaatattattatatatatattttttgagatggagtcttactcttgtcgcccaggctggagtgcagtggtaggatcttggctcactgcaacctttccccaccaggttcaaacaattctcctgcctcagcctcccaagtagctgggactacaggagtgcaccaccaagtccagctaatttttttgtatttttagtagagacaaggttttgccaagttggcgaggctggtcttgaactcctgacctcaggtgatctgcccgcctcagcctcccaaagtactgaaattacaggtgtgagccactgcacccagccagaaaaatactattattgcatctaaaagaataattacttaatgttgtcttgccagtcagtgtttgaatgaatggaaatgattgtctaaaactgtttattaggggttagtatgttcaaatcaggatcaaataaggtccacacattgcattaattaatatgtcacatgtcttttaaaatatgcagagaatcctgttttcttttctgtgttcttgctgtttgtagaccattgtttattgaattaagtaataaatatattctgcatttaggttcggcgttgggctatcttgactgcaagaaacttggggaaagtggacagagatgattattatgacttacaagaagttttactttgcctttttaaagtcattgagttggggcttttagagagtccagacatttatacttcttctgtcctagagaagggtaaactgattcttctgccctcacacatgtatgatactaccaactacaaaagctattggttaggtgagtattattcctacactaatataattggtattttcgtatagttctgttttttgagacagtctcactctgttgcccaggctggagtgcagtggcaccatctccactcaccgcaagctccacctcccaggttcaagcaattctcctgccttagcctcccgagtagctgtgattacaggcaaacgccaccacacctggctaattttttgtatttttagtagagacggggtttcaccatgttggccaggctggtcttgaactcctgacatcaagtgatctgcccaccctggcctcctaaagtgctgggattacaggcgtgagctaccgcgcccggccctgtagttcctatgagggtcctaaaagggaagtgttctctttggtgatctgatgaaacttactgaagataggattttatagttctcagttcttattctgtcattaagttgacttaactattacatatct

SEQ ID NO: 135742 - DNA, 1976 bp, Homo sapiens
ctggagtgtaatggcatgatctcagctcactgcaacctccacctcctgggttcaagcgattctcctgcctcagccttccgagtagctgggactacaggtgcccaccaccacgcccggctaattttttgtatttttagtagagacggggtttcaccgtgttagccaggatgttctcgatctcctgaccttgtgatccgcccgcctcggcctcccaaagtgctgggattacaggtgtgagccaccgcgcccggcaaaaaagggatctattctaataaggtcagaataatttctaagaacaccctgtgatcaacggatttagcctgtcaggtaaatattgttcctgcatttacaatataagcatttttatgcctcaatttggaaaaataaaaagcaaatttttatttatttacagaatagcccaaggagcctaatttagggaatcttgataaggtgataagatttatgtattttacttatttttttctttttagacgagttatgtgttgaagcactttgtcggatggaacaagccaattgctcctttcaggtgtttgataaacatccagggatctatttgtttttagtccatcccaatgaaatggtgagtgtgagtgttgggcgatagaagggtatattgtgcttttgtacctatagatagctataatagcggtttttggtgtggattttgtttaaaatgtttgctaaaatttttcttgctttaaaatttactacagttaagtagagggcgctctggggtcaaagaagaggggatctcagagggtaggggatacttaccgacaggtgatgcttgatcttaaaagacaaacgggaataacttgatgtcctttcagtatgttgaattgaactcaagaagacctcttctcttgactttctcacctgcttgacccactgcagacacatggagataccggttaaaacatttgaaaagttattttgctgatagattagaattaaaacaagggaaggtagggagggagactgggaaattctggtgctagagatgaagaaggacaaaatccagaacagtgagcaggaacagaagcagatagcattgaaacctgacatagccctttggctaaggtttgagatcttgtcaccttttgtggtaagacagtctgtgcttcaggtctcatgcctaatgccacctagaactgagtgactacattaagccagtagccaggaagggctactctgccaatgtaaggcaagaaaaattacgttttttaaaaaaagcatggtaatgggattgccagtcaagatgatggtgaatttcagtttcctctgggccaaacacataccaatgatattaaaaaaaagcaaaaggaggaaattaaaggggtataatcacattcctccaaaggaaaacttatttctgtggaccagcaatggaacagaaacatgaagtaataaatgagtggaaacctggcctgggtggcggtgggtagctcgggattcagcttgtgcaggacaacaggaattagaagtatactccaggcaaggcaaagaaccaaagccaaactctgcactccaaacaaggggcggatgggggtgcttctttgcctgtgaaagaaggttgccaaagtattaaaaaggttcactggctttttaaaagctgtttacatatggaggaagcaggtctggtcttgtaaccagtgcctgggcgaagcacttgcagccttggtgactgagtctgcctagcccttatgtaaccaaaggttgggagccctgagctgctgatagtagacctagttctggagcaggactctcaaggatggatagaaagcagcccaaatttatatttaggaaggggaggggtagtggtaggagggacacagaattcctccctgtcggatgagcttgcaaaccaaatccctgaaacacacgaggaaagcgcatgctctgacagaacaaagaccagcactgttggtcctttctctaggtttaactctagagga

SEQ ID NO: 135743 - DNA, 1106 bp, Homo sapiens
tgtagcttcagattcttgggctcaagtgatccttttgcttcagcctccagagaagctaggactgtaggcatgcaccacacctagctaatttttctattttttttttttttagtgacagggtcttgctttgctacccaggctggtctcgaactcctgacctgaaacagtcctcctacctcagccttccaaaatgctgggattacagctgtgagccactgtgcctagccaatatctcatactctgtgtactcacttttcataaaagtggccacatttgaatagttttctttaaatctaaaatacaagctctaatactttacatttcagaatttttgtacttaggaaaaggctttctaggtcgtcacattcagtgtattttgttgatgataagacataacgcacactgcccattttattttcctctaggttttatgggaattagaaaccttacgtctcataaatcactttgaaaaatccatgaaggcagaaattggagatgatgatgagttatatatagtagacaataatggagagatgccactgtttgacatcactgggcaagactttgaaaataagcttcgagttcctcttcttgaaatactgaaatatccttacttgcttctacatgaacgtgttagtgagtatcttgatggttcctcaagttatatcagttttattattttagtaccataagaatttaggcttatctatattgcaaatttgtttgctaaacatataattaggatatataattaggacttcattttttttccaacgttttttattttttgagttcaaacacaaaatacctatttttggggcacagttcaaacttatcttgttcagagggtaactgaagattgtttttatttttttttagagacagggtcttgctgtgtctcctaggccgaagtgcagtggcgcagtcatggcccactgcagcctctacctcctgggctcaagtaatactcctgcctgagccttgtgggtagctgggagtacaggcgtgtgccattgcgtccagctaattttatgttgtgtttattgtagagatgaagtttcactgttgcccaggctggtgttgaactcctgggctcaagcagtcct

SEQ ID NO: 135744 - DNA, 1231 bp, Homo sapiens
ctttgagggtgacatcactcctgatgagaatgctgagctaggtccattcagtttatgaaatgaacttaagtttgtagttggtaacttttttccccattccaaaatctgtactttgaaaatattggtaagtctgggtctctatatattttctatcggtactgtgttgttttgagccttctctgtagcacaactttatgttgccttatgatacttattccttatacaatgcttttatttttctgtatttttcgtatgtcaaaaatagaaggatttttttagtttagtgaatcagtgattgataagccagccagcagaagatttgggttttagtgacacattttaaattgaaaccagggtcacaagttgaaagtgtacctattcttgacacacagtaggtctgaagttggttttcttcttgatgtcatcttttctggctgtaggtacagaatgagcacatgttgttggtgtacgccaggtggtgcttccaccattgacttcctaaagcgctatgcttccaacactccgtccggtgaatttcaaacagccgacgaagacctctgctactgcttggagtgtgtggctgagtaccacaaagcaagagatgaattgccattcttgcatgaggtaaaatatattagatgggcaatatttttcagagcttgatagctgggaagagagtaagtttgaactccgttggaagtattcagagaaatgatgatacgatttcaactttgtgggtttttttttttgtttttgttttgtttttgttgttgttagagatggagtctcactctgtcactcaggctggagtgcagtggagtgattatacatatatcattttacacattcgagtatattcttaggacaaattcctgaaagtggaagtgctgtctcatgattttccatgggccacatgggttttcatagtttgttttgctatgttttggagacaaggtctttgctctgttgcccaggctggaagtgcagtggtgcgatcacggttcactgcagcctcaaccttctggactcaagccatcctcccacctcatcctcctgagtagctgggactacaggcatgtgccaccatgctctgctaatttttaaaatttttttgtagagacgaggtcttattattttgcccaggctggtcctgaactcctgagctcaagtgatccttccggtttggccccccagtgttggaattacaggcatgagccaccatgcctggccg

SEQ ID NO: 135745 - DNA, 1031 bp, Homo sapiens
aggactttgtccgtcctccccaacttctggggatctaaggatgtgcccagcaatttgcacgacccaagtgaaacgggggtgactgccttgagggaaaagagctccacaaggagaaggccgagtgtggtatttgataagtgacacagctgaggatcctaggattgatgttacctgcgcgggctaataacttgggggatttttggctcggtgcctagctgtccccgtgagtggggacagccccttgtggaactgggagtcagaattgcagttctgctgtttcctggaagtccacagccaagttgtctaacctatctgggcttcctcatcagccagcagtatctgtctgtaataggatcgataccaggctcagatgggatatagagtataaatgccacttaccaatttcgttttttgttttttaatttcagaaatgttcttttggggccagagtctgggcatatatgaatgcaaatccgtgtttgttcacaactaagcccagctgagacgatcacttttctgtaggccatttgtccaggtaataatttttttttttagcaggagttcagagcaccaaggtaagtgcaatgatggaaacatgtgcagagtcctaaagggacagagaagaaggtcatcagagatagactggaagagaggacgggtcggacaggccccccccccagacgtgatgacactcaggaagagcttgcacactggttgttctcaaatccagctttctcttcgaatcttagtggagttctttaaaagggaaacaattttatccataggatcttttctacttttttttttaagttcctgaggtaagtctgatgtgtattcacagttaagtaccgggcagaggtaggagggtgggtttccaaggccagtggaagagcttccataaaggcagggaataccagtcaccatgaatggttttaggaagagcaagtcaagggaggtaagtgtggaggaaagagatgatgtggaagctggatcatcgcgggccttgtgtgtgttgagctcagcaatttgaa

SEQ ID NO: 135746 - DNA, 1039 bp, Homo sapiens
gttcccagctacttgggaggctgaggtgggagggggaggctgaggtgggaggattgcttgatcctgggagttccaggcttcagtgagtgtgatcgcaccactgcacttcagctggggtgacagagcgagaccctatctcaaaaaaaaaaaaaaaaaaggatacagatttctgggcctcatttcagacctacgtaccaattcctagtctctagaccgagtccagaacctggattttcactaacgagcttgcaggcctgtgctctctcatgcagtctgcacggcactggtatttctcctggacctgccatttgggtgatatcgtaccctgggctgtgatgaaatgcgtctttgcgttcagcagacatcactacccgagtttgaatccttatgaattccaaggcctcgggcaagtctcttaatgtctttatgccttggtttcctcaattgaaaaacaagttaaaaacagtgcctacctcgtaggatttttgcaaggattgaagaagtgaatgtgggtaaaccaattggaaccagaccttacacacagcaataacaagagcagttcatattcattaccagcctcctgtatgcctcgaccttgataagaggccttgtacagacagataactgcacaattaaatttcttttctgtagagatcatcgactacctttatgagacgactctacctttgctgaaggaaaagttagaaaaaatgatggagaaaaaaggcactaaaatccagactcctgcagcacccaagcaagttttcccatttcgagacatcttttattatgaagacgatagtgaaggagaggacatagaaaaagaaagcgaaggccaggcgccatgcatggctcacgcctgtaattccagtactttgggaggccaaggccggtggatcatctgaggtcaggagttcgagaccggcctgaccaacatggtgaagacctgtcactattaaaaatgcaaaaattagccgggtgtggtagtgcacacctgtaatttcaactacttgggaggctgaggcaggagaattgcttg

SEQ ID NO: 135747 - DNA, 1980 bp, Homo sapiens
aagaggatgactaatggtcggcgtatctactatggcatgaatgccctgcgggccaaggtcagccttattgaaaggtatgaaaaatagaaacggatgcctcttaactgtttctgtctctagccaaagagaagttgttaacccagcagagtctgcagtgagattgccaaggtccaaatccctgttccagcactttccgcatgtattgtgggcatatgacctacccttctaagtctcagtttactcatcttaactcatctactgaggatgacgataatcgtacctagctcttagtgctttcaggaggataaaagaaaataacgtgtgaaacatactgtatactccgtgtattttagtctttgaagcatttcatatggatataaattatttacgcccgttggaaaatgggggtaaatgactcaggcagagccctcctgtgctccagcatgagcttgttggtgtcacccttgcttgtctttggttttgtctttgagttccttgtccatgcagggtcccccctaaagtgttgaagggtgacgaggaaaagggagacatgggcccgtttcgtgatgcgtgtgagactagtggacctggcccatgtcgactgaggaacaggaaagagcagcagaagcctgtgggttctggccttgctgtccgccttcattccctctgcctcacacgtgagccctgcctaaggctcactgtgggtttcctgatcctctttcctaggggtggatcggggggtggttatgcccccgcccagtcttccctgctagagaggcagcatagattaccagatccaagaagggcatctcaagtcaagcaggcctgggttccagtgtcggccccacctattagtcatgcaatctggagcccatgactgtgtctcttggcaccatttccctgtctgtagattggggggggagggttactgtaaatgaatttgcgcactttaaggtcttaacttggctcggcgtggtgcctgacgcccataatcccaacactgggaggccaaggcaggaggagcccaggagtttgagaccagcctgagcaacatgtcaagactccatccctacaaaaaatctaaaaaattagccgggcatggtgccacgtgcttatggttccagcttcttgagaggctgaggtgggagagttgcctgagtccaggtggtcgaggctgcagtgagccacgatcacgccactgcagtccagccagggtgacagagcgagaccctgtatcaaaaaaaagaccttcacagtgtctgtcacatagtacagatgtcctcttactgtgtgtctatgttgaatgatgaggtggtgttttttactgtgagaaagcaacatggtttgttgagagaaacaaagggctcagaaagaggaaagaggtcttttcagcccatctctgtagcccaccaactgactgacctggattaaccttgggctgggatgctgagctcactgtgcatgtgtaacgagggagctggaatgcggcgaaagcgcacataccttccagctctcagcactccacgcgtccatgaagatggctatcatgattatttttgcttgaaaatttaatttttattttttctcacaggttgtatgaaataaatgtggaagatactaatgaaatagactgggaagatcttgctagtgccatagggtaagaccatttgtttaatattaaactaattaaaatatagagatgacttaataaatacaataactccctatcatcttacagggctgataatgatgctgcatttggaattttgtataagtggtggttaaaattcagtgtatttgctaggaaaccaatttgttagtgcagaggaaactgtaattttaggagcagtgtatacgtaaaggctctgagctgctaggtagatcaggttttcatgacactaaatacatcactagttggatatgtttttcatttttcttccctttttttagtgtcacatagatcatcacgcctcaggtgtt

SEQ ID NO: 135748 - DNA, 1051 bp, Homo sapiens
aacaaggtagcaatctgttggcagcattagaaaaaaaggggccacgcgcagtggctcatgcgtgtaatcccaacactttgggaggctgaggcaggcagatcacttgagggcaggagttcaagaccagcctggccaatgtggcaaaaccctgtctctaccaaaaatacaaaaattagccaagtgtggtggctcacagccaccagtagtcccagctactcaggaggctgaggcaggagaatcgcttgaacccaggaagtggaggttgcagtgagctgagatcgccccattgcactccagcctgggcaacagagcgaggctctgtctcaaaaaaataaaaaatatatagagagaaaaaagatagaaaactaacatacagagagaaatcacaagtgtagtgatcagtagcagctccacccttctaatgtgctttctgcttctgcggttcctcagatgaagcgaggtaggcatgctcctggctgcgtcagtcacatagagacagtttcagtcctgcttctgccacacattctttgctggatatagcttttccaagacctggagagtcgcggagctggatgtccagctgcagcgaactcctcaaaccagtggttctgcatgctcatgacccccctaccttgcacatgaagggcactcagtggctcttgaataataaataggagtaaaatccagagtagacatattttgtgttaaaagcaaactcctagatcatactgtttatataccttacaactccaggggaataaactccaaagaacagggaatgttggaggaaccagagctctttttacctctatttttagctaaaagaaggaagagtgagggccgggcacggtggctcatacctgtaatcccagcactttgggaggctgaggcaggtggattacaaggtcaggagttcaagaccagactggccaacatagtgaaaccccacctctactaaaaatacaaaaaattagccggcgggatggcgggcatctgtaatcccagctactcgggaggctgaggcaggagaattgcttgaacccaagaggcg

SEQ ID NO: 135749 - DNA, 1078 bp, Homo sapiens
agtgattgctccggctgctgttcagttgagccaggcctctggtctccacttcagtgattgattgataggatgaccaccagtgagacgccaacaggaagtgaagagggctgtgaccgggttccctgacagcctgccccattcagctttccccacgattgctgcgtactgggatgagaataccatttttaatctgatagttcgtttaaacttgtaaaacattttccctttctcctaggtatagcgaaggagatactgagaagttaaagatgtaccattctctccttgggaatgactggaagacgattggtgagatggtggcccgaagtagcctctccgtggccctcaagttctcacagatcagcagtcgtaagtggcagcccccagtgcccacctcgctgaagaaataagccctgacaggcctggttcagccataaccgatccaatgcccggaaatcaccgtagacctgtcttccgcaagagctttgtttcttaagctgttctctatactaatttgtttggtttcctcgtgtgtttagtgaagccatgtgacctttacccactaggctggtttttaccacacttcagtaactgtccgtgcaaatataactgccaagtggaccaggaccccaataaactggtggtgggagagcctgggcggagggtcacttccccgcagtggcacgggacacgttgggagggaggcaggcacgcagttcgtgcccgtcaggcggggacttttctcagaaccagtgttggtgacctcctgtctgtgtctcctctttcctaaaaggtttcctttcagaagacagtcctgaccgggttttctgtttagcacaggggctcacacactccggccacacagctagtgccttgcagccagttcttcaagtttccaagaactagaggaaaatcttaaattgtttttttttttaattttgtgaactctagctatctttttttcttttttggaaatctcttgatttttaaatattcatccaaattgttattgaggggaaaatgtaacattctgtggccagaccaaaagcacagccaaacagctgccagtgtgacgctcctt

SEQ ID NO: 135750 - DNA, 1068 bp, Homo sapiens
cacttgagcccaggagttcaaggttgcagtggactttgatcatgccactgcactccagcctgggtgaaaaagcaagaccctatctctaaagaatgcataaataaatttgaaaactattttttaaaaagatagattaaacaggaaaggtcactttggaataggatgacccgggaagacattgacagaagaggtgtggcttgggctgaaccctgaaggaaaggccaaatctgcaagtgcgggcaggagggcgaatgtcaggtgttgggactgttgggccgaggtactgtcattgctgatgaaaaaccaagtcataggtttgcttttgtcattattaacaatacacactttctccctgttccttcccaattctaggtgtcgctattaaatttggcaagttttctgtaaaggaaaataagcagttagagaaaaatgtggaagactttctagccctgacaggcattgagagtgcagacaagctgctgtacacggacagatatcctgaggaaaaatctgtgatcaccaacttaaaaaggagatactcgtttagattacacattggtaagtttagaaacaatcaccctttgaccatccacagccttccagccataaacaagataacccatggtaagtgttagcacggtacctggcccattgcctgcaggcggcgcacattaactgctgtgatggctgatgatattcttttttttttttttgagacggagtcttgttctgttgcccaggctggagtgcagtggtgcaatcttggctcactgcaacctccacctctggggttcaagtgattttcctgcctcagcctcctgagtagctgggactacaggtgcccaccaccacgcccagctaattttttgtatttttagtagagacggggtttcaccttgttagccaggatggtctcgaactcctgacctcgtgatccgcctgcctcggcctcccaaagtgctgggattacaggcgtgagccaccgcgcccagccctgatggtattcttattgccagtctgtactttctgggatttggaatgtgttcatgtctcccaagtttagggtga

SEQ ID NO: 135751 - DNA, 1034 bp, Homo sapiens
attcaagttccagtaaaaagtttgaaaatcacagactgagtcaactccaagatctcatcttgctttaatattctagtagcctaagtgagagccattttaagaaaagtttaaggccaggcgtggtggctcatgcctgtaatcccagcactttgggaggccaaggtgggtgagtcacttgaggccaggagttcgagaccagcctagccaacatggcgaaaccctgtctctactaaaaatacaaaagttagccgggcgtggtggcgcgtacctgtagtcccagctactctggaggctgaggcaggagaatcgcttgaaccgggaggcagaagttgcagtgagctgagatcgcaccattgcactccagcctggcgacagagcaagcctctgtctcacgaaaaaaaagaaggaaaaattttaaagttatgaggtcaagtgatgtgttaatgttagtcaacccaattttctaaccccttaggttagaacctgcaaatgaagaacacaatgtggaaacagctgaagattccgaaataagatacttatctgcagattcaggagatgccgatgattcagatgcggatttgggttctgccgtgaaacagcttcaggagttcattcctaacatcaaggacagggccaccagcacaatcaagcggatgtaccgggacgacttggaacggtttaaggaatttaaagcacaaggtgagcttgtggggccttagtgtttgttgaacttcctgtatgcagagctagcacctaactttcttttatggatgattcagatttatagatcgacaagaagcattctttctcctccttcacctctatctcctaccagaattgtccaagctgtaaaattagcaaaataaagtgcacttgcttttcctcttcttgcccagtttctggtaaaggtggccaggaagaatggggctaaagagaccagataattaattcccactaagaagagaagggacgagaggttaattggttgagacactggaaatgatacaacagttatataaaattaaaatgctgtc

SEQ ID NO: 135752 - DNA, 1118 bp, Homo sapiens
ccaggctgtgcccgacgtggggaagcgcgcccaaaccagcccgcgggccggctccccggcgacctcaaggatgccagaggccaggagctccggcccggacctcacgcgatggaggaagcagcagcagcctgtgcgccgcacggtcagccaggtctgcccgcccccgcggcggcccctgaccgtggcggacatccgttccggcatggagaacgagcggctgggggtcgtgcgggactccatgtttcagaaccctctcatcgtcaaggtgagcaccccacgcccaccgcgctttcgctgtcgccggctccgggcacctgcgccgccgggggtccccacccgcagcgccctggccccgcggcccggggtccgagcgcagcgtgggaagctccagctctggtccagacaggcctggacccccatgcaggtcgcgtcgcctctctcagcctcggtttccccatcctcacagtgggatgataatggcaccactaaagggactgattgggaagattgaatagggtaatttctgcgggacctcgggacagcgcctgacatggggtaaggctgcaatgggtgctgctgtggtttcccacagagtgaacccacagggtgacagataggtcgcacacgcccagtctaagtcgtggctgccagccctcccagggtaaaggccgcctctccggttccgctgcacgcctggggtacgtctatgcagcggtggctccgtgtctgtcctggaagcatcacgtcgaatgttcatttccgttcgatcatactaatttcttacccaaattacaaccctaagagaaaaaaagcataatctttggcctaggaggctccgcagacaagaatgagggagctgcggtttcgggctggatcactttcccttccattacacttccctcctccccacctttagcctcgcttcccgctgatgggaaaccaacactgctgtggcggccacaccttcccgggggccactggagaagtcaggctgaggcttgggggtcagggagcaagcctcgaggcgaatttatcttgcgccgctggagggcagtgcgcctttaaaaatgcgccccgcgtcccaggtgcgggagtggaaggcgcaggtggtaaccgtg

SEQ ID NO: 135753 - DNA, 1062 bp, Homo sapiens
agctttgtttccctggtgcaccaacttccaaggattttgtttggtttggttttgttttcctcagcatgaactaatctaagatttaaaacaaaattgattgagtacaccagaaattaagctcacagtgggccagggccccatcacagactctatgctctcattgtggcactaaatacagcatttcagggaagcaaataaatatgctttataaagaaaacagctgtatttttccacccagtcactcaaaggcacgtcagggttcgggcaagaaactgacagacatgggtcaatgaacaggaaggtcaacatgagtagcacacaggagggagaatggccaccaaaaggattgtggaaaacacataatgagccaaaaagagggatttttgatcttttatatgaaccaaacaatacatatttgggagaccagtgaactcagaagcatacaagataaatttctttgtgtggatcgaaatcttttgtgtttgtccagaagaatgaaagtggaggctcagaactctttgatttcaaggtatgtgtggcattagtgagaggacacaccgctgccaggtggctggttgtttgtaaccaatagcacagcgtctaagctgtgccgtggcgtcagagaagcagccccagggagccaaagctcggatgccacagcctcccacaaagatggggcacccaaaaaggcaacgagagaggtgatctttcggccacagcatttctgttgagggaattagaaaatttactggcagctttattagttaattttactggacaatagtgaatttggccgtgtcaccacattaaaatgccatcataatattcccattatgtagaatcgcatttatattttccatctgcttcccaggagatctttaagagccaagatattggctttttttttcctttttatgcatttaagactgctaatgaacccatcagccaaagagcaaatatttattgaacacctacaatgtgcaagggaccggaggaaacacaagaggttgaagactttgtgtccaagaagttgtagtctgatcagagagaaccagactttgc

SEQ ID NO: 135754 - DNA, 1013 bp, Homo sapiens
cacgtgcacctacggccagaagttgactgcacaaggctgaaaccaatgcagccaagacatccatggctgttaaaaaaagagttaggaggccgggtgtggtggctcacgcctgtaatcgcagcactttgggaggcagaggcaggcagatcatgaggtcaggagatggagaccatcctggctaacacggtgaaatctgtctcctaaaattacaaaaattagccggcatggcctcgggtgcctgtagtcccagctactcaggaggctgaggcaggagaatcacttgaaccagggaggcagaagttgcagtgggctgagatcgtgccactgcactccagcctgggcgacagagcaagactccatctcaaaacaaaaaaaaaagagttaggaagagggagcagccctggcctggcctggtccagaaagacctgtggaattgctggagggctgagaagaggagggacaggtgtagacaatggctagacaaggtgagaaattggctgccatgagcttgggtgcatttttaggggaagtctggaggaagcacactaccaagaaggcggcagagggaggttcctgggaaagggatgctgggatcaggtgaggaccgctcaaggagccttcactttgggtgtcaccacttgaaagtttaaagaagagactcgggataaagacgcatagataccgggtttcccacggatgttggatttcaggttattccaaacgtgcgcatctgccggccagggagccaggatggctgggggcaaaacctccatcaaggctgagcagagcggcctcccccttttcaaaggaaaggcatcccctcctcctctcccaaacacggctcccttcttctccccacctccctaatcagagagagcaaattgttatcagattagcgccagcaatgaaaagcacagtcccgctcaccctcgcagttagttagcatttagatagactgggactggggcccacacaataggcatcaaagcccagctcagggcggcgggagggat

SEQ ID NO: 135755 - DNA, 1051 bp, Homo sapiens
ggggtctcaccaagttgttgctcaggctggtcttgaactcctgagctcaagtgatccacctgcctcagcctcccaaagtgctgggattacaggcacctggccccaggcagatctttaaaaagacccatgactggcccctactgggacagcaactcagggcaatccttcttatgtgtgcaggagctgactgagccccctaaaccggtcacccccacccctgaagatgaggaagatgaggccaaggtttgcgtattctctggatgaagccctcggcctgggtccagttgtgtgatcctgaggactcgctcccacgcatgcccgccacactcagagccctaggaactgacaggcggccgcatcttaagacggggacgggggtgggggggcggggggagaaaggattaaaatcgagatttcgctattatttttctctgataaaagtgcagcgaggaatagctcgactgtgtcactgcctagtttttcttttgtgttttttgcttcctgcttcaatatcttcctccagctgctcatgtctccttttcttttctcctcactttgatctattcgttttccccagaaatggggtttataaatcattgtaatgcagccttgggaaagatggtgcttagtgcagggagaaatacatcgccgctaacagccccggcagggagaaaaactctcgccttgttgctggaatctggcgacaggttactgatggtatttgctttttatgtctgcacgcgtgccatcggggcagggccgtggggagcgttccgcacgccaccttggtaatatttcaagtctcctccggcagtcgaaaacaaactgctcctgcctgctctcaaggaggcagagagagaaagggaagggagacgcgaaggcggggaaggagcataaagacgcgtgcctgtgattctctggatcccaccccagataaaatcagctcctaaaacacccctttccctccctgaaaccctctgcacatttggattgacttaattaatctggtgtcccagatcgtcaggaccgactctcccaggcacagttagga

SEQ ID NO: 135756 - DNA, 1059 bp, Homo sapiens
ccttaaatcagaacataaagagggaccccgttatcccggagccaggggcgcttgcacagatccgggcccctggacgggcctgagatgcgcagaagtgcagcttacggtcgcagcgacaagcttttgatttcttcttcaccgacaggcctctccacctttgtctccctggcgggggaggggggggggtgtgtatggaaggctcagctcatccccactttcccgcatcttcttttctccacatatggaatttcgactgaattttcccatcgttgctgcatctgtccacttcatcttgcctgtgtgggctaggtttcatcctaacagtgatcagcagaagaaaatgtttattcctcttcataggtcaggtccgcacaggacagagtgaaatggagacagtgagttggggaattagcattgggtagctcagcactgtccggtggaactttctggagggagctctccctcctgtgtccagtagggtcactacaagccgcatggctagtgagacttaattataattaatttaaatctaaatagcacttgcggctggcaggtgtcgtgttaggcggcacagatgtagccaggcaagctggaaaattcaaaggagacgcttctgttggtgataccttgttatacctggaaccactgtttccagcaggctaacactaaaacactgaggcatgtgcaaggaaataaaagggtgaaaaaagcatgaaatggttgaacccttttgaagtcacactcttcctccaagtacactcaggggtgaggatagtcgcagacttgataaccagaccagatcgtgggagaaaatttccttcggggtaaaaatgaaaagatagtctgggtaaattgtgacttgcccttctggtggcagcccagtctacagccctgaaactatttttttttttttttttgagacagagtctcgctctgttgcccaggctggagtgcagtggcgttatcttggctcactgcaagctccgcctcccaggttcatgccattctcctgcctcagcctcccgagtagctgggactacaggcgcccgccaccacgcc

SEQ ID NO: 135757 - DNA, 1048 bp, Homo sapiens
tgtggttttccaagcctctgttctgtttggctttctgttggacagtcatacacttacgaacgcctcgggacatcattcatttattcactcactcactcgttcacccaaacacgtaattataaaactgcgactccggatcccttcatcccaggaaggagcgtgactcaagtgaaatgggataaatgtgggggctggtggggcgcagggatgcggctagttcacattgctcaagtatgcagggatcaaaggccaccgttggaatgttccaagacctttgaagcttgcaacaaaggggtttctaagaaagttcagcccttaggaccagggggggaatgcacagatggagctgctgggggttggtggcagggccactcagttcgggtggcggcggtagagaatgattagggaattaccaagttattgaccaacaggcacacagggccaaaggttgagaagaaggcaggcaaaatggtgcgcgtgactcagggcaggttgtttggggggtatcagaaatgcctggaggaagttttctctgaaatagtcaaaattggatccgacggcttatgtctttccaactgatctactaatcatatttcttcaaattttatatccctgacccttgtaaaaggattgcattgaaggcgtgttttaagctgcattttaataagtcaataagaaagctcaaaattatttaaagcttcttaaagaggattatatttgatttcttgtgggaattctggggtgtggaagagaaagaggctcagtccttctgaggttgtttaacatgaaggaaaatgcatcatttcagacaaaaacttttaactgttttgttgttccaatagagatgatttaggacaaggagactttcattatctgctggctgcattaaccgagcctgaggtcttccagcgagaagaaactgcattttaaactttccagcaaatgtgaggccctcctttgcagtttattccctaacctttaaaatgagagttttctgatattctgaaaagggcagttggattccccaggtatctggaagagcccagcc

SEQ ID NO: 135758 - DNA, 1032 bp, Homo sapiens
ctgccattgcttaactgtactttttgcaagacagtgaatttcataagagcagggctgtgtgtctgatctgttcaccctagaacttccagcacagagggcttagcgctgagtgggtacaaaataaatatttgtggaatgaaagtatgagcaaacctcccattgggattttttttttttgtagtctaaagcttccacatgtttcagcagttattgattcccaggcaaccacactaaaaagcagagattgaggcacacacctgctccttgctccctgcctgagggtggcagccagctcctgagtctgtctgtcattcccctgccagctgaaactctgcccacctgcacctgccttgagggaggcagagtctctcccagagaagtcacattttaattaacttccccggcagtcactggagaggccggatcattttcataaacaaatgagaggccagagctttgtctgtaactcagagagcatagtatggaaggaattcaaaacaagccaccctgcagggtccccatgcacccgcctgaaactcagagccccatcactcttgaggaacattggggtctgggatttgagatggaaaagaagcggaagaaaaatgatcaactgttgtgtaaagaagagccaatggtctcaaagtaggctgtatgaactgcatgtctgtgtacccctaaaattcaaaacctaactttggatgggatggcgttagcaggtgggtcttttaggagatgattagatcatgaaagcagagcccttgtgatggaatttgtgcccttaaatgaagaggaagaaagctaactctatctctgctctctgccacgtgaagatacaacaagaaggcggccatctgcaaaccaagaagagagccctcaccaagacactgggtctgttggtgtctagatcttggacttcccagcctccagaactttgagaaataaatgtctattgttgaagccacccagtcaatgataatttgctatggcagcctaagctgactaagacatagtattttacccactcattta

SEQ ID NO: 135759 - DNA, 1042 bp, Homo sapiens
acctctgaggtgccagattatgtaaaaccaattaagctcctgctttgtttgtttgtttgttttttcagacagagtcttgctctgtcacccaggctggagtgtagtggcacaatctctgctcactacaacctccacctccgtggctcaagcgattcttctgcctcagccccaccgagtagctgtgattacaggtgcctgccatcacgcctggctaatttttgcatttttagtagaaacagagtttcaccatattgaccaggctggtctcaaactcctgacctcaggtgatccacccgcctcagcctcccaaagtgctgggattgcaggcatgagccactgtgcccggccaagctcctgctttcatccctgtagcaagtcagctcgtcggcatactgatccatgtagaatggggggtatctgtatttacagaggaagtgtcaactccatcagggcctctgaatcattcttcccattgccctatttccgcatgtgacacattccattcctgcacttggtgccctacacagtgacgtaagatgattcttattccgatgcaaggaagcgacaggattcttaaaatacatcactggtgcagagacccttgggaggggccgtagatctggcatctgtccttcctgggttcggatacacctttgtgggggtcggcccatcttcattttaactggacaagccttgtggagaggcagaggcggcagggtggacaggctagaagcccgcttggggggtgtagcagagagttaactttccagccagctatgatttgtaagagagcttaaaggtgggaaagaaaatccttttcttagattcagcagctttcactaatcagctgcatctctgggtgtcactgcttggctggctgctgagatatatttttttccctccatctcctgttctattagggagccaggggcccaggagacccgaagcagggttagtcttccacgaacagaggagtctgatcccagcgttcagagcacaaaagcttgtaaatcaaactgttagcttaatagcttgggccatt

SEQ ID NO: 135760 - DNA, 1046 bp, Homo sapiens
tttttaaactgtattttatttttttaagatggagtctcactctgttgcccaggctggagtgcagtggcacaattttggctcactgcatccacctcctgggttcaagcaattcttctgcctcagcctcctgagtagctgggattacagacatccgccaccacgcccggctaatttttgtatttttagtagagacagggttttgccatgttggccaggctggtctcgaactcctggcctccagtgatccgcccaccttggcctcccaaagtgccgggattacaggcatgagccaccacgcccggcccaagcctgggtgctttcgtgagttatcccatttcatgtcaataactctcaataaccccacatggtagagatgagctgccctgtctctgaggcaaggaggctaaggctcggaagcttaaagtcacgtgcccaaggttaatagctagcatgtggccaggtggggacttggactctggctggctgcctccaagcctcaggccctgaaagagctgataaacactaaagacttgcaactgaggtcgggggccagtgcagggctaaatgcgggcccgggaaggaaagtgcagggcggtcaggaatgagggattttatgagtgtccagagtgtcgtggccgggcctgctccggctgatttaagccctggcaataaaccaaacttcccactgccccaaaagcctctagaccttgataaaacctcgggcatcttttaaattgcagtttggccccaaggctaaaaaggaaagaggcggctgatcccggattcaggcttactgcgttaaaagtgggaggctgaggctgagtccagcaggagggctgggtctgtctgtgggctgggcagccatgcagagtggctccaggtcccagcctgcctcatgcccgccccaggtctgcatctgtgaagtggggatggcaacagagaggaccaagtgcaatcatgcgtgtgaagcgcgtggcacaggcctggctaggggacggtcatggagcaacaaagcctctgggagggacgaggccctggaagctgct

SEQ ID NO: 135761 - DNA, 1051 bp, Homo sapiens
acttcctaggctcaggtgatcccccacctcagcctcccaagtagttgggactacaggtgcacaccaccatgcccggctaattttttttatgttttgtagagatggggttttaccatattgcctaggctggtcttgaactcctgggctcaagagatctgcccgccttggcctcccaaagtgttaggatcacaggcatgagccactatgcccagcccttaaataccttgtttcaccttgcgtgcaatccgccagataccttcaaatcacttggaaggagacagggtacaactactgaagaaagtaaaacacttcttccacttagagtttaagctgagcaaagcagagatcttcagggtgcctgaatcttggatgcattcctaagggctgtgttgcctcatccccagactcctgacccactcatctgtccatccgtccatccatctgtccattcattcatctatccaaccatctatctatccatccatctatgcatgcatgcatgcatccatccatccacccatccatccatccatccatccatccatccatccatccatccatccatcctcagccatctgtccatctgtttgttcatccaaccatccagccaagatttgtttggtgtctactgggtgcctctaaaagtagagttaccccaagacatttgaaggcctcctgtctgcggacatttccctagaaccatgcccacaatatggcattaacatctttgctatctagctgaggacacttagctctaatagtcctatttgtgacttgtcaggcttagcctcgtcaaccacagaaaggttctgctccttcttaaaagataccagaaaaaaatccttcctggtcattattccaataagataaaaggggaataacaacaccaaacctcgttgcagtacactccaccccgatgggccgaggacaccaaacatctgagtgtgtccccagcttccctggcagtaactcagaagttgttcaacagcctatattaatgagcaataaagtactgacgggcactgcatggacggctcagcaaaggacttaa

SEQ ID NO: 135762 - DNA, 1050 bp, Homo sapiens
tcatccaactgggctattttttaaagtgactctttttaaaaacagctttattgagatataattcacataccataaacctcaccaattttagcctgttcttaggattgtacaacccacctccacaccctaagtttagaacatttcatcacccccaaaagaaactttatagccattagcagtcactcctattcctcttccctagcctctggcaaccactaatctatttcctgttggtgtggctttccctattttggactcttcatataaatggaattatacaatgtgaggtcttttgtgactggctgctttcattcccttagcatcatgttttcaaggttcatccacgttatagcacagaggaccgcttcattcctttccagggaatagtattcctttgtatggatggaccacatttttgttacccattcatcagttgatggaccttgggttgtttccacttttgactattatgagtaatgcttctagaacattcatgtacagtttttgtgtggatgtatgttttcatttctcttgggtgtatacctaagagtagaatttctgggtgatacgggagctctatgtttagccttttggagaactgccaaagtgtttccaacttggctgtaccatttttgattcccaccagcacgtatgggtgttccaatttctccatatcctcaccaacacttgttgttgtctgtcatttttattctagccgttgtagggggagtgaagtcccatctcattgtgattttgatttgtgtttccgtgatggctcatgatgttgttgagcatcttttcatgtgtttatttgtttatctcctttggagaaatgtctgttcctatcttttgccttttttttttttttttttttgcaagacagagtctcactctgacgcgcaggctggagtgcagtggcgcgatctcggctcactgcaacctccgcctcccgggttcatgccattcttctgcctcggcctcccgagtagctgggactacagatgcccgccaccacacccagctaatttttttgtatttttagtagagatc

SEQ ID NO: 135763 - DNA, 1043 bp, Homo sapiens
tgcaagggagacagattcaaagagtgggagcctcttcagttaagattttgtgcaatcggtatctcagcctgccctttcttctcaagaaatggtggtgggtgaagaccccgcctcgcctcctggtgtccactgtgtctgttacatcacctccaagtgctacaaaatccatcccattaacagcacaacatcctcctgcctcagcatttctcctttgggataacctaagggcggcacagggtggaaagggtttgggctcacgtgctcattcctgcatctgggcttctatccatctgttaattcgtgaaatgcatgtttattgaacacaactctgtgtcagatgtgggggatatggcagtaaaccagagagactcggctctaccctcgtggagcttttattctagagggagagcagacatccagcagtaactacacagctatttcattacaatggacagaaggctggggagtgcgcagtgagaacaaattgggtgggtcctggggaagagatgcatacagggggtctcgaaggatgggttgggattccagggcaaaggggggtagcgtggctgctggccctggggtccaagagagctcaactttgtgaggggatgcggcggccaggtagagggtgggcagggcaggtcctgtttggatttgcaggagcagccaaaggctctgcagtgggttcaggataaagcaggacccatgcctaggacagccacagggtgcttgtcgagaatccaggccagggttgaccaccccggagtggttagctaagcccacggcgctgcaggttagggtgaagaaaggtgacagaagaagaaaaatgtggggagagaggatgaaatattaaaagggggtagagggaagataaggaggggcttgtagggaaagtctctgtgctcggggccacgtggaatccccctcggactgtgtttatcatttcacagacgagggaacagaggcctagggcagagtgtggttcagggctgcccccatagggaattggtgacccccaacctctggactcttaagttctggat

SEQ ID NO: 135764 - DNA, 1037 bp, Homo sapiens
ggcccctgcagcacagtctgcagccgacaccctgctttggccgtgggaaaacattaaaatggagaaaaacccaaaaaggtgtacagcgggacagcaagacttcccagaaagtttaaaatctctctgggtcttcgagtggaacctggaagccccgggtggcagtggattgatgtccagttcttgtcagaggaggcttgtgaaaaataactgcgcctttgcctgaataccacgtccccaagaatcagaggggccacagcccttctcctccatgggaggccctggagcctgatagaaatcagtggtgtggggcactgtagagactagccagctcccgacggaaggggtctgtgtcttgtattgatcccatcagtgcccggcactcccttcacccaggtgctgacgtgccggggttgagctggcaccccgggatgtgatgtaagaacgccctgcgcgtcagcctggaacgggcttgattgctgcccttaactgtgttctgaagtttcacagcttggcttcagcctatcagcgcatacattggcatgaattttgtgaattagggtgttaaaaactggaattgaatttgtacaaaaagagaatatatttatcactaattattttcttaatgtaggaatgtaccgttaaaaaggaccaaaagtttttggtctgggtcaaaaaatacgaatgtgttctcaggctcgtggtccctcttattttcttctggaaacacgaggttgcatttacatgcattgctccctctttcatgtccactgaaaactcactctctcagggctaattgatttactgttggctttttattatttgcctttgaagtcaaaaggcaccagtatcccaagctttttttccctatcgaatcctgtcttgtcttcaagaaaggtctgggggtctttgtattgtgacccaggccacagctgcccgccccccgcccccgacccaccccgccctgcccctgcattgtgttttctgggaggtttgaaagaggccccctggagcatattgatttcccaataaatgtaaga

SEQ ID NO: 135765 - DNA, 1052 bp, Homo sapiens
ttgtttcagatcttcttttcctgcagaggttggcttgaatgtgtcttcctgtatgttgcaatagaaaacaccattgtatgactgtcaccctgtcctctggagtgtgattagaaacaggtattattgctttagctcgtttataatgggtttctacaagctttcacagtcaggttaacaacacactattagtcttatttctaattcttgggttttaaaggcattgttacatttattttgaccacagtttcagttcagtttattctctgattacagcaaagaaaatgctctaaatgtagtagcagaacgtaacatatgtctttgtgagaactccatgacactatagtatcctaagacattgccgttttggtattgaaggagttgccagcaaggaagtgtggatttattggtaattgttttattgttgttgctttggttaaaatcctgtcttaagaaacattgttttactcttcagttttcataatcattcttcttatgtatgattgaacatctacaaatttcctcctctgatcttccgatcaaatggtaaaattgccatcttttcagaacagttatcaggattcgacatcggaaattgattttcaacctttggcattttctgagtgacttagggtagggagagacctccctctaacacccgggtttgtgtgggctgcagaaagctgctggtctaatcctagatgcagacattgaccaggctgtgccctgggtttgggttttgtagggtcagaaatatgtttaagagttttttccgttcataaagagctatctggctgtcatcccagccttcactgtggaaccctggagggctgcgtggaacttgctggactctgctcccgcagggctgagtcctgaagccctcaggagcccatgaggaggccagttgctttaagctgcttaggggttactgggaagctgccgtgagctttcactgcttcatgttgttgagtgtgacggtgggtttttccctgtcctttggcaaaccgctgtatcatacacctcatttgccatcagagcatgagggtgtatagttc

SEQ ID NO: 135766 - DNA, 1158 bp, Homo sapiens
ggtcttatttccattgtttggcctctgtgagattcaaacgctgtgtgtacatgatttgcaaacatagaagtgatgttattgatcagaccaggccttagttcacatgacaatatgccacatatctgaggatgactcctgtctcctccccttttctctttttcgtgctgttaataataacactagtcagcatttactgagtactttcctaacaggctgtgtgctgaatagagtgttagctcattaatcgttgtaagtgaataacgtgggacttagagaaataagtaccttggccgaacttccagaatcagttctacagcctgtatgaggttgtgccaggacccctgctcagaggggcttgtttctggtgtgcctgtctcaggctgtacgaaggcccagctgcattttggtctgtactgttgcagcctgtcctctggatggctcggctccacccatcctatctgcccaggttcttttcaaagtctggttcgtgaaagtatccagacttacaatggaaactgcccagcaagaagtatggggcaatcacgtctgttagtgcaggggatgataatggcagggatggcggctccactgatggatgctcagcagtggccaggcactggcccccatgatggatggccattgtggtcctcacttcaatcatgatgttatccctgttttacagaggaggaaactgcccatgatggcaccactgtccactgggcagagccgcgattcgaacccagacctctggtttcaggttgaaacttgccaactgaatccctgtccatttgcatatgtgacagttatgccaccctaccttctaacagcaagacctgacatctgtcccagttcaagctcaccttgccagcgtaggcccatccctttggtctcctagactgttgttattttgtcagccagtgtattagctgttcctgcagatgtggtagacatgcctcatgatttcatccagttcacccacagtgtcaaacaggacaggcccagagggctgcgctctggggtgtggggctgggattctgcctcaagctggtccttctcagtcagtattttcagtgtgtaatcataacagttccaagcacaactcactgctgccatgttcaccctgtattctccatcttaacagtaattcataaggctttc

SEQ ID NO: 135767 - DNA, 1019 bp, Homo sapiens
tcacagtgaccctgagcttcctccacacctgggtcacctgcagacagcgggaaccacagggcgtgctttcagtcatgcagtcagggctgacaacaaagaacaggaacccagccagcctctcccgggacgatgctggagacgggcacattcactgctggagctgcccaagcactggaattagtagatgtggctggcctagcacaaaccgctaggtccagatgcggccgtgtgcaacaggagagtaccagctcttcattagctcgtccttgctcagagctcttctagttcatatcatttgagagatcaagaaagaacatgacagtcccccaggtctccccttctgcacgcaggatagttttagtcatcccaaacccctcctgtattacagccgactacctcctctcctcttctaatctaactctactttcattaagttgctttctgcaacaggaaggtgtgtatcccggacccctccacactcttcttcatgatgtcagagcctttccatcttgttataacctgtacgaaatgacttcaagtctttttcagatatctccacgttggtcccaatgttatagctacggtccaaaatgcagagtaatttgttaactacttaatagtcaaaatgagggatacagttgagaaccagcatcccagagcgacagcatgtgacactttgtgcatgtcagttttaagtgctcgtggcggtggcagcagcatctcttttgagggcttacgtgtgttctctgctgagctgagtcctccatgcacattatctcactgaggcctcatccagtccctgtgaccaaggcaggatccgcagtggccagtgtagaactcggagcccggtcatgtgattctgagtcttagagatcctgaagcccaaactctcagccaagggccgtgtccgctttctcgcctgccccgtctggaagctgctggtttctagaatctgtattgggtgaaatagcaagtatatgaacacaaggagataactactcgtgtaaccaaagaaatgg

SEQ ID NO: 135768 - DNA, 1063 bp, Homo sapiens
tagagatggaaattagagatgaaggccagagctggaaatattagacctaagcagttcctatttgaaggcacaaagaaaaacgagaaagaacagtactgaggaagagccatagaccatgaacccaattcctaggaaatttatgaaagagagaggtgttgacttaatattcagaccctttgttggataagttggctcctgggatcaccatacattagatgtagacttcacagttcacgttgagtaataagcagtgtatggctgaagggggtttgtaatcactggtactttttatcatgggatgtcttggccagagactgaccatgtctaatgagacttactccatgctggagtatgcacagggtttttttgttagttgcctgctattttgagaagagtgccaggctggcttaccaatatcggaacactgtagcatcctttctttttataaatagaaatgctttaaaaaccattcatttgacaaatatttatcaaatcgggcactattctgagtgcttggaatgcatgcgagatcaaaacaaaaatccttgctttgtgaagccaacatgttagtggggtgcaggggcagcagacagtgaacataataaacataacagattagtccatttaaaggtgacaagagctatggaataagtagaaggagatgggggaggtgaaggggtgacatagcagagtgcatttttaatggggtcagagtgagcctcattgtgtaggtgatacttgagcaaaaacctgaagtgggatgagccccgtggctctctaaaggaagggcattctgggcagtgggagctggtgcagacgagctcgaggaaggcagtgtgggtggaaagggggtgctggccaaggcagaatcacgtaggactttgggtcttggtcggaatgaagggggagcagaagtgtgggatctgacttaggtttgaaagagatcacctggctgctgtgtgagaatagactctagcgggggcaagtgtgaaagctgggagcctggctgaggagcaattgtggtcaccagaaaatatagatgaaaaaatgggttagtcagcaa

SEQ ID NO: 135769 - DNA, 1096 bp, Homo sapiens
tggtgattttttttttttttttttttaagaaaagctgagtaagtttgggctttcatgatataactggttaacttagaaagctaaattaaccatcctacgttgtaggtgtcatgttggtgaagacctggcttgctgagccaagtttaacttgaattcagaggaaaaagaaaaactaaactaaattgactgtgttactaattatcacatagatatacacaacccgagagagtattttatgtgtgattcatgtcagtagtaagaagaataaagtagatgctggatacaacttttaaatctgttatgcgtaagaaataacgtgtgtcttaattgctgtcctcaatttgagcagttctctagcatgtgaactaatgccaggcatgtaaatgtgggttcagtagctaggcctttcgttcagatagccagacacctcattacagtgcccctctccttcacccagcgtgattgaagcccatggtaaatgtccctttggcacatacatttttgggcttctgtgaacagaaagaaagcgagtgaagcatctgtaaaatgtatatttcatatttaggtatataaaacatatatagctatgtctgggtgtgtgaatgttcacctacctacaaagagaataaatttgatctttcaactttactgggaagcactcagaaggttctagggaccatgggggtaaaactcagcttggcaataaagtgattaaaacaaaacccttccattttgcttaaaaataccttggaagttggcaatatcaaggtgcaggctttcacaaaaacctcccacctttgctattactttttataataaaaatagtccagcctatttatcttagactcatctgttgcttcttgataggtgtgaaatcttcatcatcaaagtatacacacacccaaccatgtttttcctacaagcgtttttgtcctgtgaaatatacctgtaaacttatcccaacaaaggagccgttgctggcattgcgagatcttaaaataagttcagagccccctgctcatcctttctgatggcctgtgttttccaagatcagtaggatgttagagacaaaggtgcattgcgtgcggatggatgg

SEQ ID NO: 135770 - DNA, 2018 bp, Homo sapiens
cctgtattctaatccagctacctgaagagatgggggtagggggttactagatccttgctgctctctgaggccagaaagcaaaatcctaagtaaatactttgcacttcactcccacagcgaatgccttgaggggagatgttccagaacacacctcaaggccagcttgttaggcgttgctcatggttgtgggcggggggtgataatccatgaatgtgttcctcaagtggtttttcagataaaatgtaaatcaataaaacatgctagaagagttcagagttctttacattacacaactgataattactgtttaagttcctaggctaacctgtggattcttttagcaaagggtgttgtgactccctcatcaatgggttctgtagaatttgcccctaaatcagaatttttaaccacaagaggactgcagtaggtccctgagccccctgaagttgtatgcaggactgtgtgtgtgtgtgtgtgtgtgtgtgtgtgtgtgtgtgtgtgtgtgtgtgtgtgtgtacacgtactgggcatatacgtgtatgcccgaatgtgcatgtactgtgggcgggtgaactctcagagtttgcattaaattatcaaacatatccaggaccccagaaaggttcagaaactcagtgttaaaccatattcttttctttgttaaaggatgttgcagctcggggcttagatctccctcaagtcacgtggattgttcaggtaattttttagttgttaaggtgtaagctttaggcaggaatatatgatcatgagtagatgcattggctttaagtagaataattattattatcctcttgggtgttgccctggtaaccaggcagcaaaccagccttatctgttcaattcccctgacatctttccttaacccagcccacctcaccactgcagcaaaacagccagaatgtgcgttcacgagagggaggtggcaggctctcctgcttctagactaattcgtgtcacaaaccaaaatttcaacaacctgaaaataatgggaattacctcggtccctgggaggcctcattgtgtccagaaggagatggctcagctgtccgagagccgtgtccgtgtacgttgacctgcagggagcaattaagttcctgacagcatcttacacatacctctagccttagacgctttgccagagggtacaggtgttagcactagagtctggtggttttagttttgttttttcttttcattagtctacagaatggtatttttaagcccttttgtgtcggggctgggggacatgccctgttgacgtgagtcatggtttattcacattttagtgggattgcatgcctgtcactggccaggatgtctgatctgctcactgcagatgatcactttagaactggaggcattgtgtcttctttcctgctggccacagagtgaactgaagataaggcaatgacaattttaatgtatgggaggccagacatacagaattgatcatttagagcttatattgtgaatattgattcatttaatatgcctagcctcccatacattatattgaccttggccctcatctctctgatatgtgtagcatcaaagggaaaacatagggaagaatgagtggatggtcaattagctttaatgatgacaaagttattgccaaagaaaacatacaatgctttgcattatccattgtaatgagtgatagagtctgctcttttctctgagttggcagtgctctccgtgcaagcagaagcatgtccctacctgcagggaacctgcccctcacctgcccgcattctgtagaatggccgtcattctgaaggactgagtggggctgctgcaggctggtggggaccagctcctggggcctgctcctggtggcctggcatcagaggtagaccctgcccacagagcagggagccccttcatccttacaccctccagtgtcctctggacacctcaccctgtggccttgtctaccaaggaagtaggccaaggtcatgtggtcatcctggagaaatttacccccacctgcctac

SEQ ID NO: 135771 - DNA, 1574 bp, Homo sapiens
tgtttgcatttctatcccagtgtctagcacagagcaggcatgcagtaggcgcttggttttgtagatcaaattgggggcgctagacagggcccaagaaacttgatgttaagagctaccagtgtgtgtgtttttctaaagacagagattaatagacttgctcactgggaataagtttttcattcatctggtgttatctgagaagtgaatgttctggactgtgaatattgaaatagaaagcagtaggaacctttggggtggagtttgggttattataggaacagaatattttatctttgacccataacatgctggatttatccctcagaaattgttgagtctcctagtatgcaaacactttacagacatgagtgagttgtaagccttaaagaaaactccaggtatctgaagttctgttgtttgtatttttagtagctctgcgtggaagaaaagattattctttctgaaatagttaatataattctcaggtcaaaagcatacaatcactttccttgttctgtctggctgatgatacctgcaggcacgtggtatcagctagacaaagaatgccattgtcttggcaaagcacagtacctcccagccctctgcgccctgccagtcccaggtgccacatggaaagagaactctccctcgcccacagcctgatttctctaaagccctcagtctttgttcattttctagtccaggtcactccagcatgccgatattctggggactctctttgctgtgtagtgaagatgactggagaagagctgggtggggttcatttctctcggttgctgggccagaacaggagggccggttcccagtcgtgggaagttcttcgcttcctctcggtgttcctggctcttctgccatgcttgtttgctctagctgatgcttctagcatatgagagctgcggggcgagtgggacacacacgctgtaatagatcatgcctgggtcgggggagatgctgccactctgcgtccttttaagcagcctgttgcttgccaggctatccgaacactctccaggagcctccttggtgttaatgaggaacgagggccacttcaggacgagacagatggagaactggcttcttttgataaagaagaatcgtgctgttaatcgttacatggggattttcccccctttatactgtgccttttgccattttaatttatcatcccgagatccttttaacaaggccagaatgaatgtctttatgaaaatttggaaatagcagtgtgctcacacagaagttcacaattacgctgtttccttcatggttaaaaagtcccccaccccattttccttcttgctaggaacagttaagggtgcatgtgtgtgtttcatttcattttcattataaacatctcaaaagcagggacctttttagtttcatgcagctcgcaagtcctgataatgtggctttgtgtaatgtggctgttcaatgaaggtgtggctatggtaagatggagtctaggcagagcatagctgggggcaaaagaaatcagtgtgtgaaagacgaggagtcctcacacattcacaatgtaatttcgtgtcttctggaaa

SEQ ID NO: 135772 - DNA, 1007 bp, Homo sapiens
gtgcctgccctggtagtgtctcacaaaaatgcaccctcaaagcgcctgctacttggctgtagcctcaagtccggtcctgtaagtacagggtcatcttagaagatgtaaagaatccgcttcttcctctttcctggcaaacctctctgtgcctgaaaatagctctagcagtaggagatggagagagctagggagatgtaagcctaccttgctggagtttgtctctgagttgtaaggctctatttttccttgtttttgtaggaaagaacagcagtgtttcaggaattttcacattccagaagaggcgtccttctttgcacggtacgtatcctcctgtgttccatgtgaaggctgatacatttctgtgatggctgtgtaatctttcgtctcttgacagtttgtcctgtggtcagtcctacagggcccaggaacactaggggccccttggtggggctggcctctttgcacctctttcttgttacctgacagggctgcagatagccagccaccaccgtgcagaagacttggcaatttgctcactaatagtggcagctgttggtctgaaaatgtgtgaatcttggagatttctatccaccaaaaacttgtaaattacagctatcgggagtaattagagctgagaaagtctttccacaacaaaatgactctgattgcctctgcttaccttttcttaaaggaaaatcggtgcatttgggccgattttatttgctgctgtctccgactatcatttgtcctgtgatttcagggcctgctccctcagcctcaggctctgcagtccgggatagctgcctcctccagcacaacactgaccttttaaactcatgcctcttgtgctcttttgagattaaaaactcaaaccttcagtgttctctacccccaggctggggattcactttaccgtagttgttgctatctccaaagattaaaatgccttctctgttccatcttggatgatgtaacttaatccccagctggttattggagaagtccct

SEQ ID NO: 135773 - DNA, 1047 bp, Homo sapiens
tgtggtccctcacagttccctatgttctaatttttgagggatgattcacgaagaagggattctgtggtcaagaaagtttgagaaatgccccacatccctcccttggatattctcagggcacattaacacaataaaggccctgagagggctgcttatagcaaaaacgcttttgtgaaacctttgaaatccaagatttgccataacttacttgaccaaagaacccttttgggaggtgggggtgggcgcagtatctgttgctatcttttggacgctgttccataggtgagtgtttatagaatggctatggaaagatacgttggtagatctccctgcaacacacacgttggcactagggcggatcagtgctgggacttggtgatacccatggggtaacatacgtagtcctaacatacatgggtgggtgctgtatgggggtacgcttttgtgaccagtttcatggtgtgtttgttgtctgctttgcccttcttacttttatccaaggtgtaacgcggctagctgatatcagtttgcatgatccagtcagtatttctgtcctggacaagagccatgaccagttgaacccaaaggacaaagcggtccaggaggtctgtcctccaccagctggcgacaagctggacagctttgcaataccagagagtctcaagcagcatgtgactgtggttcccagcaaactgaggcttgtctgcctagcggccttcatccttcagaaatgcaaggtgggactgtgggctagagccgacttgattcagggaagaaaggcctgctttcttgtgttaagccattgggagcaatgagttgagacaccaaaaatcagaggttttccaacttatgtctgcattccggatgcagactttgatatacatcctttcagtcaggttttaggattatggtaaaaactcagaggtcaatgatagccatgatgttcagcttgaaatgttctcgatacctttcctgggactgatattaggaacatcacaggtggcgggaacagctggatgtgaggcagacgtaggggcttgtgctcat

SEQ ID NO: 135774 - DNA, 1861 bp, Homo sapiens
tagaagtgttgtctttaccctctttgcccaaactgacaggttgcagaaccagtctaagaacaaggtatattagattctgtgtataggattttttttcttcttaaatcttaacttgaggtccaagtttggatcctaatcacattaaattgtctttaaaaaaaaaaaaagggggatcctgttcatcatctataacttttaaaatttttacagctagctctacaaagctttgacactgtccagaaactgcttaaggtaaggcaaaccatgagttccatttcatcttgcttgctgactttgaggaaggatttaatatactacagtctattctttattttcaaagagataagaattatttccttttgcctggatatctctgctctctctaggcagtttataggtttttactgatctaaacctaccaatttctagcttagctgaattatcagtgactcctggtgcataaagtcctgcaatttgttcatcatagtcactagcaagccacatacagaaattcacaggtacagcctgatggtgatccagtagaaagcaacttagctgcaagtaggatttgtttaagaaaggagagtgaaggcttcagaatcaaagccagccagctcaccaaattggatcatgaattgatccatcctttcttttattaggggtggagagtagggaagggtgttgcttgggtttttatcttaaccccaaaaatggcagtagacttactgacatgtgttttcagttcaggctctgtgggaaaagaaaggcaagctacttgaatgatttaagaagctcacatttctctctcactgtggtagaagctagttatatacctataattcaagttactgctgatagtgaacatgggtgtagcaatgcctaggaattgtgtctgcacaataacaccttatacaatgagaagcaccagttttctcccatgccttgtttaaggaaagggaatttggaatcaatgtctgatgttagtaaagggggctttgcactgactgtggtctgctgtctttctgtagcctttcacctggattgtgcctggagtgttaatgggaggagagaagagaaaatcagaaaaggccaggtaggaagaggtttgttggttgttgtttccttcttgaatgtgtcctgccttcctattcagtaaggctgggtccttctaaacctgctgagagctttgtctcaggctctgcttcctagtcccggtgcacagggacagattgagtcagtggggagcggtcacctctagacggtgctgttttttaaaatattaaacctacaaacaggtttccttctgatgttgctagtaacagtgctgtcaacttcttaactcccacctacccaatgctctatagcatccctggtttagtatacatccacctgcatgccactcatttttgtggacattaagagtttggggttttgttgtttgcttttacaaaaacaagatcattcacttatataatgctttgtaacttgctttttacaaccgaatatgtttgttcctttattaggatttgtaatgggtgtcagttgaaaatcgttgcaacaagtaaatctcaaattgtcttcattcttttgaaaacatttttattgtattatagcttaataatcagtactcaataatgatgcatgtagtctataactgaggagtaaatatgaaacctgaaacctcaaagcattggttaggattagactcagctgtgaataacaacaataataacaaataacagtggcacaaacaatatacaagttttatttttctttcacatttaagaaatctgacagagccagtccaaggctggcctggtgctccagtgtcggggaccaagctctttctgtctttttgtgc

SEQ ID NO: 135775 - DNA, 1089 bp, Homo sapiens
tcccttggagttcattgtaaaatgatttgacctgtaaaaagcttatctggagggcacagcaaatttaaggcacccaacagatccttaaattactttggtgatggcgtgagaacggactgcttttctgtgttcacactcttcagttattttggctctgattttttttttaacatcatatccatcctccctcacttacttgtgccctgtgaggaattgatttttctttcttcttctctatgtagtaacaccttttgaaatgtcagaatctcctaacgtcacacagcggcacgttgctgctgttgtactagcatatttaccattcctagcctgcgttcagtgtagtctcacaaagtcgatgttgagtacagacaactctggtttgaattccaaatccttttcttcttttgggtaaatgtttcttatgcaaaacacgaaaaccatacttgtaattgaatttgctgttaactctgtgcttagctttggcagtaacgttgttttgttcattcattcagtgtctttgagcactttgaatgtgcaaggcaccattggcttaggggcctttttcggattactttggtttcttctgttttttttattaatactttttagatataatgtaccatatatgttttaaaaatttcaaagagtaccaaaaatatatatagcgaaaagtaaagtcatctattcccactttcccttagtggcacagtttgcttctcaagatgccatggtggttattaccagtctcttgtatatcctcctggggaaattctctgcatatcaagcaaatttgaggatgtgtaattcctcttaccaattttgtgaagttttttgtttttctgttttgcttggtttgatacatgagtggttgctttgttatgcaggatgttctgtgccttgctttggtttctttgatgtgttttgggctccttaattagcaccatattgggctaccttgttctttttgatgactgcctagcatttcattgtatgtatgtatgtaccgtgaattactgactcattctcttattggttggtggaatttatattatgttcagtattttgctacaaacaaggccacttaaatac

SEQ ID NO: 135776 - DNA, 1030 bp, Homo sapiens
ggaataaagggtgaccaagatgataaaggatctaaagttgtgtcctgtttgaaatattgagtccaaagaagaaagaaaagagagttatgtgatatatgaaggaatgttatgtgttaagaggaagtaagcttgttctgtgttgctgcagaaagtatacctcagactattaggtagatgttcaaggatgcagatcttgcataaatgtcagagacagcttcctgattcctagaatgggtcatgaacagaatgggctgcctcatgggatgcaggaggtgtgcagggagaggctgccagtccacctgcccgggactgtcaggaagtccatgtatggcgggagtggcctttaagagtttttgtgctccaggagtcctgggtctgtaaatcaggtgaagtctgcacatttcatactgtcttgcaaatgattcaacaaacctgaaacttgatttcatctctttctttaatctgaaaattcataaacttgagattttgtaaaaaataaatttgtaagatggaatatgtccgtttttactttattaatattagatatttgaagttgtatttaattacttaggtaaaagaatccttagggaacaaagaactgttgttattggtaggttagtctgaagctgacagtcatggctaaagaaagccgacatgtaaaaccaagtcattatttcaagcaaagaggaaaataacatattctgagagaacccaaaactccagaataacaagcactggctactcaagggatgcttttatattcatttgtaaatcagaaaagaaggccaaagaaaatagaggaattggatgttccttctcctaggggaagtttggacatcatgcatttaagcacattcctgtaatggaaataagaagcaacaggcaagagatccctagtgctgtgtagcctgtaatccgcaatcaggcagagactcggggactcagagactcgaaaggcaagggaggtaggaagtaattgtggtagaggtgatggatggagcagcattctcatttggaatgggaacagggc

SEQ ID NO: 135777 - DNA, 1002 bp, Homo sapiens
ctctcaaaacctttgaagaggcagctgctcagctcctggaatcttcagttcaaaacctttttaagcaggtagatttaatagacctagtacgctggaagattttaaaagataaacatatccctcaatttttacaagaagctttggaaaaaaagattgaaagcagtggagtcacctatttttggcgttttaagcttttcctcctgaggattttatatcagtcaatgcagaaaaccccttcagaagccttgtggaaacccacccatgaggactcaaaaatcttactagtggattcgcctgggatgggcaatgctgacgatgaacagcaggaagaaggcacttcttccaaacaggtggtgaagcaaggcctgcaggagaggagcaaggaaggagatgtagaggagcccactgatgactcgctccccacgactggagatgctggaggccgtgagccaatggaagagaaactcctggaaatccaagggaaaatcgaagctgtggagatgcacttgaccagggaacacatgaagcgagtcttaggagaagtgtatctgcacacctggatcacagaaaacactagcatccccacccgcggactctgtaactttttaatgtctgatgaagagtatgatgacagaactgcacgggtaggtgtttattaacaaaaactctgaaattgtaaagcctgctttcttcatgagaaagaaatgacctaaattgagttcctgaagctcaacttttgctttgacattttttaggtaatttatttgcttgaggtgcagggtaataaataggaagcgtggattaatgcagaggatgcattcatagcatataaagaatattttgattcttcttcacactggccttgttagatatgcaaagtttgcaggatgagctttccagactggattagctcagaggctgcatttagctgagtagtatgtgatgggcaatcatggctgtagaaatatggtgcccatgctccctgcccttcctcttttgcaa

SEQ ID NO: 135778 - DNA, 1014 bp, Homo sapiens
taagaactttttgtcccaagaactaatatttgctgctttggaaggactatcactcccattgagaatgtgtgagtcagaataacacagttgagagttcagcttgccgagatcagggctactgagaacaaatagcaatccttccttatgtaaaattgagatatatctgggccgggcacagtggtcatgcctgtgaccccagcactttgggaggccagggtgtgaggatcgcttgagcccaggagttcaaggccagcctgagcaacatggtgagaccctgtctctacataaagtaaaaaaaaaaaaaaaaaaaaaaaattatcctggtgtggtggcacaggcctgtagtcctagctacttgggaggctgatgggggagccatgttctcaccactgcactctagccggggcaacagcgagaccctgtcttaaaaaggaaaaagaaaaaatagaggtatgtatgggaggaattctgagtagtttttgtcactgtatcattatcaggatgtttggcctgtctagaatagcagagtgagtttggtcatctttgctgttagggaccatatgttagaattcttaagactgaaaagaaaaaaggccaaaaattaatgggatttaaatttgtagaggatatacagaagaggtaagatagctggcttaccaacttctgagctagtaagacaccctttgaaacgtaagtgaactaattttagtgaattaatccaaaatcttgtggattcatccataagaggttaagcagaaatggattcgaaactagaagggcgctatcactagtaagagaagacaactcttgagggttgtgtatcccagcctccaaattacatatccagtgaagttttaaaaaaaaaaaaagaattggattcaagttttcttttcagacttttatttttaaacagtataatctttttttttttttttttttttttactgagatggagtctcactgtgtcaacccaggctgatgtgcagtggcgcaatctcggctcactgcaacctc

SEQ ID NO: 135779 - DNA, 1072 bp, Homo sapiens
tggccatgggtctttgggccatcagaatagacatttgtacagttctgcaaagagagcagtattccacataatattttgcctatagagattatgctttttcttcttaaagtcaaaacattataaataatagctaaatactttgtcttctaacagaactctgaaatccttgtttcagaagcaactaaaacaaggcaagtaataagattttggttttcagaacagttttctccttagtggttacagtttaccctgttatcacagagtacctgaataaatttattttatttagctagttgacacaggttgaaactctagttcttttatttttcagacagtataatcaggatttgtggaaatgcaaatctcctgtcttctgtaaaatattgctcttttctttttttctttattttttaattttccctttgtgtttgtaggctttttcttcaggaaatcctgcacttacactaaactttgctgactactttgtcttactaggtgctgattggacatatctcaaagaagatgaacaaacagactttccctgagcactgtagtttgtgtaaagagatcttgccattcacagatcgcaaacaggcagtctgttccaatggccacatttggctccggtaagccattttaaaagtttctacttctgctcatttttcagttttgtgtagcacaaactactgtatgtgacagaatagcaactttatgccagttatctgttgcccttgccaatttgttggagaaaagctgctattataaagcctgatgtggacttttttcatcagtgtcactcaagcaagttggcctttaaagacagttttttactgcttaatatataggagttttcttgttttatttgttcattttcctaattgaacaaattatggctcctcttcctagcctcactctaagaccttggtgtgtcctcatgttactggacctgtgggctgcatttggcacaattactccctccttgaagcactttcatcacctgccttccgggacacagcactccctggtttttgtcctgtctctgactcttcattctcagttgtctttgctgatg

SEQ ID NO: 135780 - DNA, 1032 bp, Homo sapiens
gaggatctcccaaatttttttgtatgtctctctaggagtaaacatggcaacagtttttctagaacgtggactcactgcagggactggacccaatggcattgttaagaccctaaaatctagccaccacctgcctcccccaggtttccacacacccagttggaaggcctttccctgcccttgtccctgtctcacacccatggaggttaagctacagagctggggaaacaggagattttgagttaatggcagcctcacaaatagtgcttctgaatttctctgagggtcagcatacctcatgggagtgtgttgctcagtgcaaccttggaaaagtgggaatggcaccagacgtttttcaggtgcctcttgcaattcaaacttacatcctctataccgtcctaaaatttgcctgatcttatttggtagatttcaagttgctttcagctgtgaccgtaataactgtttcaggaactggagaaatagtggaagtgctattgccgcgctgcatgtaaagcacaggagcaaagattcgatacaattagaccctttaagctacaacgtggttgcatttggggagtctgatacccacataggtatcacattttctctgcctggggttaatttgttcttattattctaggtaagaaattgatagcttgttatgcttggtactcattctgaaatccctgtgtgtccaccaggcagacttcaagcaatctctacctactattatatctgccaaaactaccaattatttttcaatgtcagaagttattagagccactggcaaagctcatggttgaatatgacatttttctgcttttccctctaagaagtttttgagaatgttaatgttgaagtatgcaggctggacctaccagcaagtttaacacgttaattaggttaaaaagaatattaaaaggcaataattaaatatttcaattattttgtaattataatggtatcaaataagatgcaaaagaagttgatgcttattggtgcttaagagaattacaatactggttttatgagcat

SEQ ID NO: 135781 - DNA, 1192 bp, Homo sapiens
cgtgaacctgggaggcggaggttgcagtgagccgaggttgcgccaccgcactccagcctgggcgacagagcgagactccgtctcaaaaaaaaaagaagttaaagcaagaagagagagaggaagtctcagtaatatattggctgattcccttggggttagtaagtggcagggtccatgggtaccagtgaaaaaaggaccaaccagtaaaatccaaattaaacagcaaagctctccgccgacggagctcctggctctgagttacaatttcccaccaggaggcctccagggtggttttgaacatcccctgggtttgaggctggcttttgtgagctgtctacacttgtgtttagtggccctgggctgggtccctatggcctgggcaggacgagcggctcccctggtgctctcctggtgcgcctggggctcactcacgtgctgcagcaccttgcgcggcaacttctcggagtgggcgatccattctttcattaagtctaggatgagggggatgaggctgaccacgccgccgtagtggttccgggcctcgtcacagctgaggtggttcaccacatcatgagggtatctgcaggacggcagggggccaggtgaacccatgctcccgggacttgccatgccgtggcaagcagctgccacacctcaggcacagcagagtcacctggggaggctttagaactggacacacagcacgctgaggcgctctgtccccagagattctggcagaccaggcctggggtgccacaagccccaggtaattctggtgtgaaagacaggagatgcaaaccactgccccatggtccgtagaaacctgggttaggggtgaggaactggctggctcatccctctggctcttctcaccctggtatctacagagcttccccaggctctggcccactgtgctgcaggctcccgggctgtcaggatgaggagccctcagtgccagtgctgctgcccctgggaggcggctctggtgtccacttctttgcatgtcagtgaggatctctgtgggcttctgggggcaactgctctgggctctacacccccttctccacctgcctggtgctaacacccgtgagacacctggtgtcctgccatgtctacgatggttgtaaagaaaaggttttgttgaatccgagtcattccaataaatgagtggagactgggatttcctgcccgg

SEQ ID NO: 135782 - DNA, 1050 bp, Homo sapiens
tggtactgaattgtcagatgtggagtattagtgacaccacacatttaattcagctttgtccaaaggaaagcttaaaacccaatacagtctagtttcctggttccgttttagaaaaggaaaacgtgaacaaacttagaaagggaaggaaatcccatcagtgaatcctgaaactggttttaagtgctttccttctcctcatgcccaagagatctgtgccatagaacaagataccaggcacttaaagccttttcctgaattggaaaggaaaagaggcccaagtgcaaaagaaaaaacattttagaaacggacagcttataaaaataaagggaagaaaggaggcagcatggagagaggcctgtgctagaagctccatggacgtgtctgcacagggtcctcagctcatccatgcggcctgggtgtccttttactcagctttataacaaatgtggctccaagctcaggtgcctttgagttctaggaggctgtgggttttattcaactacggttgggagaatgagacctggagtcatgttgaaggtgcccaacctaaaaatgtaggctttcatgttgcaaagaactccagagtcagtagttaggtttggtttggttttggacatgataaacctgccaagagtcaacaggtcacttgatcatgctgcagtgggtagttctaaggatggaaaggtgacagtattactctcgagaggcaattcagtcctgggcaaaggtattagtacaataagcgttaagggcagagtctaccttgaaaccaattaagcagcttggtattcataaatattgggattggatggcctccatccagaaatcactatgggtgagcatacctgtctcagctgtttggccaatgtgcataacctactcggatccccacctgacactaaccagagtcagcacaggccccgaggagcccgaagtctgctgctgtgcagcatggaattcctttaaaaaggtgcactacagttttagcggggagggggataggaagacgcagagcaaatgagctccggagtccctgcaggtgaataaaca

SEQ ID NO: 135783 - DNA, 2263 bp, Homo sapiens
tgaaccccggaggcggaggtttcagtgggccgagatcacgccactgcactccagcccggtcaacagagcaagactctgtctccaaaaaaaagaaaaggaaaagaaaacctttcccagatgatcccaccatacttctcatcacccctgttggccaggcctgtcctgtgcccatccctagcctagtcattgcctcaacccagtcaggatttgctcctgaacctggagctagggttgctcttgttccatccaaaggaggaggaagagtgagtggtggggaatcaggtgggaacagttggtaggggtagctgtaaggattagtgagagtgcacggatgttcctggttcaatgctttgcatgattatccatgaataagtcctgttgtttatgacgaaggccagatagatgcgttcatccaccctgtgctgaagtcgagccatttagcacagctggaacagccgcattatccgagagccagttctgagtttcaatcagttgcgttctataacaaggaagcattgggcttaccagacagcatcaaggcagggcgccttcgtgaaagctcatctccttgctgtttatggtttattatcttttttaaaaaacaaatatatggcaagttttgtgttttgtatattttaccacggtaaacatacacacacaaatgtaacacaggcttaaaaaaataccctttccgccttctttctgagcattagtgtgtacttgctctgggtttcaagctgttccaatctgtcggcagcaggccatctgccttagcacgatcaacaaaccttgtcagggcatccagtctgcaaaggctgctttgcttgagcagacctgctccattggcattccattctgtagcctcacctgcgctattgtcaggagggggagaaaaggagaaaggaaagcaagtgacctgcggtaccactggactgaaatgataactggatagtggcgtattttcacttggtgttttgtatatgtatatgttcgcatagttgattgtactattcacacagtcttgtagtctgctttttaatctttttactgacaccatatcattttttaaaaagacttagaaatataggatgtattttaatttacttaactgttcccctgacattagacttaaacgatgtttccaggtttttgctcttataaatatgctgtgatgattatttttgtgcaaaatctctatttatgtttcacatgatttgcttggggatagatttcaaggaagggttactaggataatactaccagcttactttccataaagttgtactagtttatatttctgttatcagtatactaaaatgccttctcagtccttcttacattgtcttttcaaaatggatacagcatgtttattttttataagtactaattccagtcttttttttttttttttttcaggaagtagaaatgatgaaagccgcctatcggaaagagctagaaaaaaacagaagccatgttctccagcagactcagaggcttgatacctcccaaaaacggattttggaactggaatctcacctggccaagaaagaccaccttcttttggaacagaagaaatatctagaggatgtcaaactccaggcaaggtaactttcatcaggaaaggcttttgtgtttttattaagtggaacttcctatattctggctggtctgtatctttcagaggacagctgcaggccgcagagagcaggtatgaggctcagaaaaggataacccaggtgtttgaattggagatcttagatttatatggcaggttggagaaagatggcctcctgaaaaaacttgaagaagaaaaagcagaagcagctgaagcagcagaagaaaggtaggaacaaagaactgattcatgaccttgggactaagctgccaattccagcataaggactgtgtcacgtggtgtgggaagcagttactgctgactagacaggctgcaacactcagctcactccgtgtcagagacccactctgacgttcctttcctcaaaacgcccagtgatctcttcgtgttcgtgttcctggccttgagtccctccatatggccacaggaagtgttcacacttaagattgccacctactatccctagttgtgatttaggtttctcttgatgagatctcttgagtccagtattataaaacagagagtgggctagcggagttcagtgtcagtgtgagtgagtgtcagtgtaattccacatcctccgaatgtggacagtccaatcaccagctccttttttcctccccggct

SEQ ID NO: 135784 - DNA, 1011 bp, Homo sapiens
cgtgattcctccttctttgggaatcactgcacttcatacatcattttgtcaagaacggtgagttttccctagggctttatgccactgggccttggtggtatacctgtccaccttctccaggtgttctgtgggtggtcagtttgatggactgcatttgtgctgtcccctttgcaaagcacagttctgaagtgtgtttctgtctatttttgttgtccttgggtaccatcctccccacctgccattatgtcagggactgtgaacccatgggactggtttattttgccttaacattgaaatagtgtgctcctagctgattccctgtttaatgacgtctatgtgctagttttatgtcgtcggatttttcactttgctcatgttttttggttagctctcaaacagtgagtcggtccagcagcagatggagttcttgaacaggcagctgttggttcttggggaggtcaacgagctctatttggaacaactgcagaacaagcactcagataccacaaaggtatgccagggctcgggagccagaccttagtggggaaagcgtttcagacccagacagtatgtctcccgcatggcatagagaatggcttgatgacttatttcctaaaagacggagcggcagtcccactactccgtggtccagctatacaagcactttccagccaccatgtgagcttgtttctcctattgggttgctttgaagttaactcacactgaaagcacctaatggtagttggtagagagtaggtgtaaagtgtttcctttctcttccctaggctgcctttcaaagagggagagagaaaaagaaggatgggggaccaattctgtttaacatacctctcaggaccatggatatagagtgctgtacataccatttttttttttccttttaatgttggatttctgcagatggtagttcagtcctggcaacaaggccagcattgggatgatcttacattaattagtgcctcaccagtggtgtcgaggcagaagttttaagtc

SEQ ID NO: 135785 - DNA, 1900 bp, Homo sapiens
ttgctgagcgcccagcacactgcaagcattcagtaaatgctcatcgtttcagtgaacttagtaccatgtttgagagattttattccagtgttggtagtcagacttttgaaagtattggaagcaaactgatccctgagaagatttatttaagcaacttaagatccatttgcttaatgtaaaatttggaaaaccttgacctaaggccaagtaagacagtagtgagctctaagagttttggtctgtagttagttacattttcagggtagcttatgactattcagatgaaatgttcgcagtgtgtgttaaattgcctgtgttggaagacagctaaaatgatgacatttctggtctctgctagaaagatcagttgaagttacaagagaaggacatccagatgtggaaggttagtctgcagaaagaacaagctagatacaatcagctccaggagcagcgtgacactatggtaaccaagctccacagccagatcagacagctgcagcatgaccgagaggaattctacaaccagagccaggaattacaggtataaactgcagcaccaggcaaagccaactgcgagaatgccggagagcagtggggagggaggcagtcagtttccctgggtgtccttgacttgttcagctttactaagctgaatgcttttctctctgaaatcatggcagaaattcttcatggcaggtgaatcttacttaggacagaggttccccaactttgttggttcatatagtagctcccttagtgtctcagtcatttttttttctgcagccaaaaggaaacagttaacagttctgctcattaagtagatctgaataacttagtgagtacgaatgtcctaagaacttagtagctgttcacagataatacacataaattaatttttaaaaaaataattgcaattactaatgcctcgtgtgcacctattgggcactgcatggtatctcagaccttgaaatcagagtggacagtgacaccctcatttcctgttccacactggttttccttgtggtgctttgtatcactgcacccaaaaaaacccggcttcacaaagacgtcatccacagacacagcatcatttccagccagttagtaattcacagagtgtccaacagatggcgctgcgtctccctcgaaaattcagaatctttctgcagcatccctgtgagtttgctgtgtagcctcagggctctttggtgcacagtttgggaactgaggatctaaggtctctttttttcttttgttaaacagtaaggaactcagaaatcaaccataacttactttttaaaactaagacatcaaattctgagggcccaagaaagtagagccgttgagctaaggcattcccagtcctctgtgggctggtggctaggtaggcctgtgatctggcctgttggtgttcctcaaacttcatgtccacgtctctttgggcagacgaagctggaggactgcaggaacatgattgcggagctgcggatagaactgaagaaggccaacaacaaggtgtgtcacactgagctgctgctcagtcaggtttcccaaaaggtaagaagaaatgaggcagacctgaatctgctgaaacaccatttgctaacattcttccttcagacaggttaaagaaatagattacttgagtgtctgtgtcatgggttcccaacaggaagtggttctgctgcccccatagtccctgacatttggcaatgtctggagacattttaggttcatgtttttggtgctgctggtatccagtgggtaggagccagggtgctgccaaatatcctacaatgcacaggcagccccctgcaacaaagaagtatccatcctaaaccctgctctatgtgtatcccatggaactctttcttcataccttgtttacataaatgtcaaa

SEQ ID NO: 135786 - DNA, 1022 bp, Homo sapiens
tcttttgtttcctctcttcctctcagctgcaatatctagagaactttctgagatcaccacagcagaggcagagcctgtggttcctcgaggaggctttgactctcccttttaccgagacagtctcccaggttctcagcggaagacccactcggcagcctccagttctcagggcgccagcgtgaaccctgagcctttacactcctccctggacaagcttgggcctgacacaccaaagcaagcctttactcccatagacctgccctgcggcagtgctgatgaaagccctgcgggagacagggaatgccagacttctttggagaccagtatcttcactcccagtccttgtaaaattccacctccgacgagagtgggctttggaagcgggcagcctcccccgtatgatcatctttttgaggtggcattgccaaagacagcccatcattttgtcatcaggaagactgaggagctgttaaagaaagcaaaaggaaacacagaggaagatggtgtgccctctacctccccaatggaagtgctggacagactgatacagcagggagcagacgcgcacagcaaggagctgaacaagtaagggactggggcactctcttctgtgttaaatggtccattttattgtgaagtacagaaagtgtaagagaggaacaagaatcattcttcacactcccaccttgaggcagctggttctctgctgtttgtcagatgtccttctaggctgttgcatcttcatatatgtgaccatgtgtgacctctgtgcacctaaattgggatgattccttagcagtccatttcaaaatgagtctttttatataggccattttatgcctctgttctatgaggacactcaaatgctttcatatgtgccctctgcaagctgtaggctgaaaatgaggttatggtatttcaaagaatataagaatatttgtcacagtgtttccctctctagctacagattattattattattttctattttggtatcatagttcattaggtggagataaaat

SEQ ID NO: 135787 - DNA, 1092 bp, Homo sapiens
tataaagaaagctgctgggcgtggtcccagcactttgggaggccgaggcaggcagatcatctgaggttgggagttcgtgaccagcctgaccaatgtggagaaaccccgtctgtactaaaaatacaaaaattagccaggcgtggtggtgcatttctgtaatcccagctactctggaggctgaggcaggagaatcgcttgaacccaggaggcggaggttgcagtgagccgagattgtgccattgcactccagcctgggcaacaagagcgaaactccacctcaaaaaaaaagaaaagaaaacatcccaacaatttgagaatcactgcactcggctgacctttaaactactttacaatatgctcgagaacatgtgcaacatttttcgtcttgtgatataaatgatacttatcttttcaggaagagagaatggattctgcaagaccatgtctacacagacaacaccatcttctgaatgacagaggatcaggtaaaatttctgcgttactacaggccttgcttgcctcttctaattgggttatatgtgtttaagaaaagaaagttaaatggaaacaaggaaattctgggatatccaaaatactgaggcctaaacataatgaaacgagtagtgaattctaaacaccaacctaataatatcaaaaacagtttttaagctattgcagtgaagtacctgtattctgacttgactatatctcttttcagagacattaagaactgagaattttatttgctatgggattatttttggtacttttagttatattatttttaatatttcagtcttttgtagtatccccaggacagagccatgtccagccttctctgttcagcatgaagagttattacagacatattctatacagtgtaagcagttttacacttacagggattacactgtatttctttgacttcagttgtctttgtttctcttcagaagagccacctggcagcaaaggttctgtcactctaagtgatcttccagggtttttaggtgatctggcctctgaagaagatagtattgaaaaagataaagaagaaggtaatgtatgtgggattgctatgagttgataaaacct

SEQ ID NO: 135788 - DNA, 1430 bp, Homo sapiens
ctaaccccctgtgttcttctcttccattttagggtgtgctacttctaccccttactccacgtctcggctgatgttgttaaatatgccagggcagctacctcagactctgagttccccatcgacacggctgataactgaaccaccacaagtatggtgtcaactagtgtgcctgctctctcctctgctttctggtgaagctgaccctttgggtcagatttagtatgtggttgggaaaatttcacactgctcatttcaggagtcacttttaaggatccatgatattagcaaagaaagttactgttgcctcttagattcatcttgaagtcttgatttacaaaatgcaacttgtttcttgatacgcttttaataagatgcctttttctagatgaaaaagctaaatttaagctgaacactggccatggatataaacctcgtggatgacttagcattcctttgccactgctgatgtactttattaacttcccaggctactctttggagcccatctatggtttgtggtatgaccactcctccaacttctcctggaaatgtcccacctgatctgtcacacccttacagtaaagtctttggtacaactggtatgtatgtcttaggttggatttgattagttggttttggcctgcctttaatggcaggaggagctctcttttagatctaagggaccacttgctgttgtaaacttgtttttgacacttattgcaaatccctggggctttcagaatgtgtaaagtgaacctaaaaacaaaaaagagagagactgatctagatccccagaaagttaactctagcagctttatttatagtaatagttataggctgaaaaaaaatcggcagtttttctaatagttgggctcagtgttcatatatgttctgcccttgtctctaagcaggtggaaaaggaactcctctgggaaccccagcaacctctcctcctccagccccactctgtcattcggatgactacgtgcacatttcactcccccaggccacagtcacaccccccaggaaggtgcgatccagctcgtctgctatccctctgcccaggcacagtgactcacttgcaagcctcactttgagaagcctaattatgccagatagaattctgacctaaaatgcaatgggtttgaatcagaataattgaaaatggactaacaagctgctctcaaggtgtgatctgccgacccctgggtggttccaaaactctgctttggcagaactcttgtggggaacccagcaggtcaaacctactctcttgattttttttttttttttttttttggagacagggtcttgctctgtcgcccagggtggagtgcagtggcacgatcatggctcactgcagccttgacctcccagactcatgcaatcctcctgcatcagcctcgctagtagctgggactacaggcatg

SEQ ID NO: 135789 - DNA, 1249 bp, Homo sapiens
gctccccttgtctacctgctgctcatctcctgttccagaagtaccagatgctataagttcctcatgattttaaggattctgtagtataatcagttgactcttcactttgagacagtggcagcttaggattctgcttttgtggatttgcagtgtcagttaccacctgcctgtctgttttttagtttcaaaaacttatggttctattccctctctcctgttctcctccttgtgggtttatatttaaaaacaaagaagtctttactgtagacagtgggattccaggaggttgtacagttgagtgcatatgttcaaccaactatattaacttggaaggctcctcagtcagcttatagagagcctcactcaccttggctgggcagattgtttggctttggaagaaggttttaacagtaaagacagacaccaacattaagaggagaaaagagagctagaacaaaaccataatgatagagcagaagaaaatatctaccatagccacagagataagatgtttgtgcatatgtaagcatcaggatgccacagaaaaagaccattttgagactaaaagaactcttcaaaattaaaaatgatagccaaaataaacatttcagtaaaagaattgggagatacttttctgagatataggtaaatagaaagcagaaccaaaggatagagcttggtaatatgagcagaacagagatttagaatgatcagttcaggaagtcccagcatccaattaaaaaaaatttttttttaaagaagagccgggtgcagtggctcacgcctgtaatcctagcactttgggaggcggacgggggaggatctcttgaggtcaggagttcgagaccagcctggccaacatggtgaaacctcctctctactaaaactgcaaaaaattagtcgggcatggtggtgggtgcctgtaatcccagctacttgggaggctgaggcaggagaatcgtttgaacccaggaggcagaggttgcagtgagccgagatcgtgctactgcacgccagcctgggtgacagagcgagaatccatctcagaaaaagagagagaagaaaactttggtggaggaagaaattgtgaaagaaataatacaacaaaaaaaaaatcctaggattgaaggatatgagtttccagattgaaggggcttacctggtgcccagctaaatcaataaaaaagaatgccaccaggtctcaatattgtaaaagtttatagtaccagggattaacctttcagagaaa

SEQ ID NO: 135790 - DNA, 1102 bp, Homo sapiens
gcttgtttgtttgctacttagtatactgtttagataggctgcatttataccttttgtatttaacggcagacagggaaattttgaaaagaaattcagttttcttcctcgccactccaatccctaggcagccactaatctgttttctgtcttaatagatttgcctattctggacattttgtataaatgggatcatataatatgtggtcttttgtgactggcttctttcactcagtataatgttctcaaggttccatctgtgttataacatgtatcagtacttcattccttttaattgtcaactaatattccatcatttggatgttccacaaacattcagccctttataatttgtcaacccaactcttctagccaatgatggagcatgtgcgaattcatccggaattagtgactggatccaaggaccatgaactggaccctcgaaggtatagaaactagtgtcaaaattttaaagaatctttcgagagattgaaaatgtgatctaggaggtaatccctgttgaggtatatttgggaatatagatgttctacttacagaatcagtccacttggaagcactcatacagctaaaatttgtgtgagtttaaaacatactcttcacaggcggaggactaataacatttagcagagtggagaaagttgcagcacaagtgcctgtcccccagaaaggcttacacctcagtagtgccagtgatggggcgatgcaggaggtgaagcatatggctaaaaacaaggggactgcagaaaaacaatttagcatatatataaatctggctttgcaaaatggagaaaggacttcagggagtcctatattaagtatttggagtccctgaggtcctttctccattctgcaaagccagttgactataccatcctccccagggccctacagaggcccccaggtatgttctctggaaaaaccgaacctttgagtcccttgattgaaggattccaggcacagtggagagtggaactgagggtaagactgagcgagggagataaaggaaatttacagactgagctgtgggaggcccagctccttccctctgcttgtctctgcctggtagccaggcttattatgctcc

SEQ ID NO: 135791 - DNA, 1098 bp, Homo sapiens
gtgtataggaagggtgtagggaagacgggaggtgcttggtctgctgtctttgtacatggacagctctgtgactcatgccgaggctcagtggttgctgtttagtgtattctgtcactgtctgcctcacctctgtcgtaggaattgtaaaataaggtagggatttttgtcttacagctctacattggttcataagtagggtcttgatacaaattgtagactgtcgaaagttaagtattgttctcaagtagggaaagttttctgagtttgatttttcattttcagtgtttttgtgtatacttcatactgttccttttttagaagtccactgtatatgaatttgaacccaaagtcaaatggttaagtgttcagatcattgaggtccccaagctaaatatcaccatcataaaatgtaaattctgggatacaaaagtaaatctcaaattttattaaacatttttcacgatagtaattgtattgcattttagtagtcagattttagaagtttggaattttaatataggaaaaatactttgtgggcactaccggctgctaggttactcctgtggtcactatgtcacatgtgtagtatcatctcaactggcacacagcgtcattggtaacatttttggacaaagcagaattcaggaaagtttctggtagatggttttctggaaggaaccttgtacctgggattcatagcttggcaagcctcaaagatccttactcttcaattactaaaaattgttggccgcctttagcaattattcttattttgaaacaaaaaaaaccccagcttttaatagcatttttcttttttcatggggtactcttgtttatacttttgtcctcatttttaagacatttttggccaggtgtggtggctcacacccgtaatcccagcactttgggaggccaaggtgggaggatcacatgaggtcaggagttcgagaccagcctggccaacatggtaaaaccccatctctacgaaaaatacaaaaattagccaggcatggtggtgtgcgcctataatctcagctactcgggaggctgaggcaggagaatcacttgaacccaggagatggaggttgcagtgggcca

SEQ ID NO: 135792 - DNA, 1064 bp, Homo sapiens
gtatgatccctcttttctggagggccagcctgcctgcagcactgttcacaggcttgcaggtgccactgaagagaccagtggagtttaatgtctggaatgtgttccacgtggaaatataattactctgtcatctggaacaagcgattttaattgttagagagttcctcagtccactagtttgactttggccatggtcgtacatttaagaacttggttcaagttttttccatgtttagggtaattaggtgtccatagtatatgaggctcagctttcatactctattcaactctggaatggctgccaaagaagctgattaaatcttaccagttctgagcagggtgtttttgcctcttgtgtgccaggtgccaggataggccctaggtgtcccagatggttcctgtcctcatggagtttaccatctagtgatcagattgtacctaaatatagtttgaaggacccatattttaaaagcaaacaaaaatgtatttatatatactcatttagcatggatatttaatacaagttaatttggacagaaagtagggtaaaagggggaagaaaatagaaaaatgatagctgttcacaaacattttatgtctcttttgtagtaaacttaagtcatgctgcctgaaggcagaattaggctttgcacatttatttaagaaatactggccaggtgcagtggctcacgtctgtaatactagcaccttgggaggccttggtgggaggattgcgtgaggctaggagtttgggaacagcctgggcaacatagtgagaccccatctttaaaactaaaagaaaccgattagtcgggcctggtggagtgcatctgtattcctagctactcgggaggctgaggtgggaggatcacttgagcctaggagtttgaggttgcagtgagctatgatggctccactgtactctagcctaagagtgagaccctgtctctaaaaaagaaagagagaaagaaagaaaaagaaaagattttaacttctagtcattcaatcaagaagtgccagacagcatggtagctgcttgaaatacagtactgagtaagctgcgg

SEQ ID NO: 135793 - DNA, 1384 bp, Homo sapiens
tctcttctaccctttatgtcccatcatcaccaaaaaaattcatacagacatgggattttggatatggcttcaggtaatttatggacgcagcttgaaacccagctgatcattttagatagattactgctctaaaaatggacttaggctttattaaaaaacttttttttttttttaactagtagtcaggaaaggcccaagtcagaaggtggccttatgtactgtctgggttataaattactttgttaaatttctgtagtgtacccaggtatgtaacctgctacgtgcttgtcaggcttggcattcggtctgtgctggtacctttagcacctggcagaattccactgggccttttccccaaggtttatgcactctatatatttttttccttttgaacctcaaaggaggtatattaatgaatgaatgttttttaccttcatccttctttttcctagaccagtggttctgaacctttagtggacgtcagaattacctagaaggccccacccccaaagtatccaattccgagatctagtgaaaggcctgagaatttacatttctaacaaatacccaggctcctgctcgtggtgccaggaccacattttgagaaccactgccctagactatcaaactatacccttcttccctagaatacttctattttggtcctataaacctgaaacctaaagatatctcacagtttgcttgtatctcttttaggagaagctctgcgtagtgtctttttgaaatatacatggtatctgtttggcctgtattatcttagtaaataatgttgttcatgttaatagaaagtcaaaacgtaagcattatttattgaagagatacgccttaccaaaattaagctctggccttacacttaagttactagaagattcttcacctttgggataggctataagctttagcaaaccatccatcaaggcccctgatggcagaaattctgaatggagaatctggcaagttggagctctcctgccccagtttgtccttgagagggactccaactactaagacctattcaatcacacatgactacacatgttggcaggttttaccatcagctgttttactctcacatagtaagtagttatttcctacccttttttccttccttctaggcactgataggaagagagaatgggagcaagtatcttaccctttttagatgcatttgtgctgaaggcgtcttggttcacttgatagaatattaccctaagaagtcacctgagagttcctgagccagagcggaacattaacttaacagtgtaacatttctgctctatctaactgtacctgataataaaatagtctatccatgcctggacctgtgtctgaattgtccttgaatttttatggataaaaaatt

SEQ ID NO: 135794 - DNA, 2510 bp, Homo sapiens
gattacaggtgtgagccactgcgtgtggcatggccctatttttaaaaatttttagagacaagatctctctatgttgcccaggctggtcttgaactcctgggctcaagcaatcctgtctcagcctcccaaactgctgggattacaggcatgagccacagtgcctgaccaggtaaacctatttttaatattttgacgctgggcacggtggctcacgcctgtaatcctagcactttgggaggctgaggtaggtggatcacctgaggtcagcagttcgaaaccagcctggccaacatggtgaaaccccatctctcctaaaaataccaaaattatccaggcatgtagcctgtagtcccagctacttgggaggctgaggcaggagaatcgcttgaacttgggaggcagaggctgcagtgagccgagctcgtgccattgcactccagcctgggtggcagagggagactctgtctcaaaataaataaataataataatattttgctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagacttcatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgcccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaaggtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacatggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaagtttgagacccattaaaaaagttaaatgagaaaaaaaaataataataataataataataataatattttgagaaactgccatactgtttccacagtggctgcaccatttacattcctctttttatgttttacacatctgctgtttggtgaaattttctacagagtagcttttaactctgagcgctgtacttcctttgaccctggacttcacgcccaaacatcagtaaactgtcacagaaggtagtaataatgtgtattcctggaagccatttctacatgggatgatcagtgataactatt

SEQ ID NO: 135795 - DNA, 1195 bp, Homo sapiens
aatattattattattattattattattatttttttttctcatttaacttttttaatgggtctcaaacttctgtgacaaatttttggtcaagttgtttccattaaaaagtactgattttaaaaactaataacttaaaactgccacacgcaaaaaagaaaaccaaagtggtccacaaaacattctcctttccttctgaaggttttacgatgcattgttatcattaaccagtcttttactactaaacttaaatggccaattgaaacaaacagttctgagaccgttcttccaccactgattaagagtggggtggcaggtattagggataatattcatttagccttctgagctttctgggcagacttggtgaccttgccagctccagcagccttcttgtccactgctttgatgacacccaccgcaactgtctgtctcatatcacgaacagcaaagcgacccaaaggtggatagtctgagaagctctcaacacacatgggcttgccaggaaccatatcaacaatggcagcatcaccagacttcaagaatttagggccatcttccagctttttaccagaacggcgatcaatcttttccttcagctcagcaaacttgcatgcaatgtgagccatgtggcaatccaatacaggggcatagccggcgcttatttggcctggatggttcaggataatcacctgagcagtgaagccagctgcttccattggtgggtcatttttgctgtcaccagcaacgttgccacgacgaacatccttgacagacacattcttgaccttgaagcccacattgtccccaggaagagcttcactcaaagcttcatggtgcatttcgacagattttacttccgttgtaacgttgactggagcaaaggtgaccaccataccgggtttgagaacaccagtctccactcggccaacaggaacagtaccaataccaccaattttgtagacatcctggagaggcaggcgcaagggcttgtcagttgggcgagttggtggtaggatgcagtccagagcctcaagcagcgtggttccactggcattgccatccttacgggtgactttccatcccttgaaccaaggcatgttagcacttggctccagcatgttgtcaccattccaaccagaaattggcacaaatgctactgtgtcggggttgtagccaattttcttaatgtaagtgc

SEQ ID NO: 135796 - DNA, 1001 bp, Homo sapiens
gtaattgccaggaacagcctttttctccccaggggacagaggggaagggactgtgggggagacccctaggagcttttttttttttttttttgagacggagtctggctccgtcgcccaggctggagtgcagtggcgcgatctcggctcactgtaacctccgcctcccgggttcaagcagttctcctgcctcagcctcctgagtagctgggattatagacacccaccaccacgcccggctaatttttgtttttttttttttagtagagttggggtttcaccatgttggccaggctggtctcgaactcctgacctcaggtgatccacccagctcggcctcccaaagtgctgggattacaggtgtgagccactgcgcccggctcctaggggcttttttttcattccatccacaaatgtgagccacagcctgggcactggtgccaggaatgcaactctgcagccccacagggtgtgttgcactgccgtatcctcattacccggggtagaaaactgaggcacggggagatgaagctctgttgacttacctgagagggatagactgttatgttgttaggattagaggtagtgatggttgacatcttattctctgccacgtacggctctaggtgccttacttagagtccgtcctctttagaaccctaccaggtaggaactgtcagagtctgtattttacgggggaaggaacttgttcgaggtcacacagcaagtggggcagctggaggatgctatgtgtaagttctttacatgtaccagaacttgaagtgtctctttagagaagttttccctgattgccctaactaaagtggccactggcaattatctgcctcctcatcctgttaattccaatctgaaaatgttttaaaatgtttattctgacaaaggcttatacatataaaacatttaagaaaaaaggaaaaaaaaatttactgtctctcgtcctcttgaccctaagactgtcaactccatgagagtggggacttctt

SEQ ID NO: 135797 - DNA, 1003 bp, Homo sapiens
ggccactaccggtccccgcattttggtggtagtggtcccccgggcccagctgtcttttcttttatgtctttgtcttgtgtctttatttctgcagtctcgtctccacacacagggagaaaaacccaccgaccctgtggggctggtccctacaaagataagggtgatagtatctcccctcaagtgttgccagaaggaccaactaatgccccacaccgagcaggcacttgatggatgatggcatttacttagaaggaaggagacgattctcattttttccaccagataaaaactaagatacatgggtttaaaaaatgggccttttgggaattaagggcccagaatgaaacatgagcctcctggcctttcctggatcaccgtcaggcttttattgagagaggagcagctccccactggctgcttggcttgtcattgcttcactctgtctcctttggccttgccacagatctacgcagaccccaccaagaggctggagctgtacttccggcccaaggacccatactgccacccagtgtgcgccaaccgcttcagtaccagcagcctgctgctccgcatcaggaagagaacgaggcggcagaaaggggtgctgggcactgaggcccactccgaggtcacatttgacatggagatccttggcatcatctccaccatttacaaatttcagggtaactgaaatctgctcttgcaatgtctggttatttcagggctggccatcctagctgcctgcaggagctgtgtgggtcatctgcaccagtggagggggccaggatatgcccaggggctgtggggacacagcagggcacaggccccatccaggaggcagcctttcttccctccagccaacagttccccagagactgcaggttcattgctgcccaatcttcagcattcttaagctagaaatctcctaatttttaatgaaaccattgtgtgggaccaaataaaactggtcagtagacctccagtctttcccccaccacagtgt

SEQ ID NO: 135798 - DNA, 1021 bp, Homo sapiens
tggtagaaatgcaccaggtcagaacctgcatttagcaagatcccagcagattcatatgcatgttactaggttggtgcaaaggtaattgcaggttttacagttaaaagtaacattcatctaagaagcactgacctggactccatcctcacctatcatgtagctccccacctccccaaaataattttcatgtaagtgacttagactgcatggagccaactttgcagaggcatttgggaagggtgtgttttcctgccaccctcaccctgcagcctccaccacatggcccactcagcacctccctaagcagatgtgggtgtcggtgtgtggcagctgcccattcctggactcaatgtctgccatctgcccacctctctttctagggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccggtaaggcccccctccatgcagcctcggttctctatcctgaaaatgggatggtccgggcacggaggctcacacactgggcgtggtggtgcacacctgtaattccagctactcgggaggctgaggctggagaatcacttgaacccaggaggcggaggttgcagtgagccaagatcgcgtcactgcactccagcccgggtgacagagtgagactttgtctcccaaaaaaaaaaaaaaaaaaaaaaagaaaatgggatgacagtagtactacccaacagacgtattgggattgaatttaaaaagtgtgtgcagttctcagcacagggctgagtacagaacagggccttagtaagcggtggcctgtgtgatcgccaggttggcctcagtcctgaggacagtgcaaagaacgtgactgtgggacatgtgggttcctgctgagaaatgt

SEQ ID NO: 135799 - DNA, 1026 bp, Homo sapiens
gcttcggtctctgtcatagccccggtgcccagaacagagcctggcctgtgagaggtactcagcaagtgtccatgggccccacacagatttaggggagcaagattactgccaacagatgagcaaaatgaaagggcctttttttctttttctttttgaaaggcggagtcttgctctgtccacccaggctggagtgcagtggcgcgatcttggctcactgcaacctctgcttcctgggttaaaacaattctcctacctcagcctcctgagtagttgggactgcaggcgcccaccagtacgcccagcttatttttgtatttttagcagaaatgaggtttcaccatattggccaggctggtctcgaactcctggcctccagtgatccgcccacctcagcctcccaaggtgctgggattacaggtgtgagccacagtgtccagcccgaaaaggactttgaaaactgggccagaggtgatggtgtttgttgaataattgttccatagcatgttttaagcttccaaaaatgcagccctcaagagaatgggcttgggcctagtgtagtggctcacacctgtaattccagtgatttgagaggctaaagtaggaggatcacttgaggccaaaagtttgagaccagcctgggcaatatagcaagactctgtctctacaaaaaaaactaaaaaagttagctgggcatggtggcgtgcacctgtatagccctagctactcgggaggctgaggtggaaagattggttgagcccaggattttgaggctgcagtgaatatgatcacaccactgcactccagcctgggtgacagaacaaaaccctgtctcaataaacaaaacaaaaaacaaacagaaaaaagagcggactctgtggactgatgggacccatgcccaggtgcctcccttgctctgtgagaaaggcaggtgcaagaccagattctgtggaatagaaataaatggtggtgtgataacagaagcctagaaaagtctggaagatttggggctcagagcagttttctttg

SEQ ID NO: 135800 - DNA, 1010 bp, Homo sapiens
gccccggagtcacccgtgggcggcacggggggggccccggagtcacccgtgggcggcacggggggggccccggagtcacccgtgggcggcacggggggggccccggagtcacccgtgggcggcacggggggggccccggagtcacccgtgggcggcacggggggggccccggagtcacccgtgggcggcacgggggcggtctcggagtcacccgtggggggcacgggagtggcctcggagtcccctgtggggggcacaggggtggcctcctggtcggtcactgtgggcagcgccagataggtgagggtccagtagcgcaggaagttggttctcaggctccgcttcatggagctgctgcccatcttcttggtgatctccaggtagccgctgttttccgtagtgtagggttcccagtgtgtgggcacagccgagtcgcccatgttggggtccctgcagagtgagaagaggctgtgcaggggctggggactcccagggggctgaagccctgctctccacctgcacgcctgagccatccccgccctctgagctggccctgggcaccatgcccctcactgcatactgggcactggctgtgcacgtgcatgggcttggggctctgccagtaactctcatcctcaaacacacatggattccgatgcagggggaggttaagtgacttgcccaaagtccctccactggcaaatgagggaacaaggcctcgtggtgggaggcccttctcggctgtggccctccgccctgcactcaacccacgtcttaccctgttttggcaaagttggtccagtaggcgatcatggccttagagactgtcctgtcttggggccggtagcccgtgggggtggcgaagggcttcccgaaaacgtactgaatgtcatctgcatggtcggcccccacccatttggggtagacgggcatccgagagggatgggaaaacaggtaggcgtaggtcttggcactcctggaggggagagaccacccaagtaggcagggtg

SEQ ID NO: 135801 - DNA, 1050 bp, Homo sapiens
tgggcagccagcactgcagtatgggcaggacggggtgaccctctgccagctcaggccaagccggggggttctggagtcagtccctgtttaaacaagagtcatcaggttttgtgaggacctcagcagagtctgtcctcaggcaggagtcattgagaggggtccttggagttctggagctgtattggaggggatctgaggtctgtggctcaagacagtccttgtatgggctctcaagcggtaggggtatcctgcagggcccccaggagcatccctgatcacccctctgcccctccccaccagagctgaagatccctgaaaacgccaacgtcttctatgccatgaactctaccgccaactatgactttgtcctcaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatgga

SEQ ID NO: 135802 - DNA, 1013 bp, Homo sapiens
gcagcggggacatcgctgacgcgctcagcgtgcactcggccggctcctctagctccgacgtggaggagatcaacatcagcttcgtcccggagtctcctgatggccaggaaaagaaggtgactgcctgcccttctccccaatatcctttcccatctccccactccaaatccatgcatggggccaggaagccctggatcctgaacacagcttctagaaggttccccatctggcagctggcctggggtgcccccacagggcagtgggatctgctgatcttaccgtctccctcagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtaagccggcgggggtggcctgggtgcctccctccactggcggcaaatgcaccctgaacacagtgcaccatccctgccctcccggggtctaccttgtagttggcggggaaggacagatgtcagccaggtacagaaatgaagaaggtagtgatcagggacaaggctggcctgagggcagagggggaggaaaggagcagccgtgcaaagcccccaggagctgaaggggcggtgctgtaggggaggtgaggtcagggaagtatccagggcctggccacataggccctgagccctgccaggacctcgactttctcggggaggaagacaggagcaatgatggctggcttctctgtctggtgtgggctggtaccagagccgcaggggtgttggttaggaggccgctgtggcaaccaggctgggagccctggaaggggccagcagggtcagagtctagacaggatttggagacagcagatgggaat

SEQ ID NO: 135803 - DNA, 1112 bp, Homo sapiens
tgcggctcctgcccccacaccggcccagtctgtccccgggaggccaggctcctgacgctacctctgtctgctctacacacccaaggagagggcagcctgcctaccccagggacaggagctgcaggggatgccaggggccaggtggccagacctgggaggcagatttggaggccccatgtggcttccctaccctgccccgagaagagacactgaccagagaaccctgtagaattcttcccatggcaccccattagctgtggcggataccccagatgactgaggagaactttcagtgactaatggattcacgaggcctcagagggagtcaagtgtcactgcctggtgcccctggcatacccggtcagtgaaatggcatctagggcccccctcctgcgtggacacacacagagttccctacaggggagcatcgcagggggctcctgggacacctgtccctctccctccgtggcacagctccactgggggccctggcatgcacgagaagcccagaggacggtaccctgatcagtgaccaaacgggtaaaggcagatggggcagagcctctggctaggacagaagagcctgttctgagtccctggggggcccagggcaagtcactgcccatctcagggccatagtttcctcatctagaaaatggaggaatgccagccctggggtgctgaccttatggaaggttcaagggagaaaggagtgtgcagccataacaggactgtagcgcagagtctctgaggccctgcgaggcaggtggagtttttttatttgtttagagaaggagtctcgctctgtctcccaggctggagtgcaatggcgtgatctcggctcactgcaatccccacctcctgggttcaagggattctcctgcctcagcttcccaagtagctgggattataggtgtgcaccaccaacccaggtaatttttgtattttttagtagagatggggtttcactgtgttggccaggctggtcttaaactcctgacctcaagtgatccacctgccttggccttccaaaatgctgggattacaggcgtgagccaccgcaccatgcagcaggcggagttctcatccgcactttccagagggggaggcag

SEQ ID NO: 135804 - DNA, 1787 bp, Homo sapiens
cggggcaggtggccttcagatggacaggggccggctcaggagcccagcctggctcaggggagcccaggcctctgactctgctgccacccacctgtccccagtgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgagggtgaggaggactggggtgggtgccagagggtgaatgaggaggggtcggtgctgggccacacgaagaggaggctccagggtctggtgctgggtcaggggcccagatgagcctcagaccacacaggcagggaccacaggcaggagagtggcctggtacacgttttgtgggttcggggagagaggcttctctggaagccggggctgttctgtgtctttggaaaggcacaggaaaggctggcatgttgttgaacttttctcctcttgcagctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcaccagttccatcattacagccttcctggccttcacctgtggttgcagagaacgggctgagtgaggagaagcctcacctcttggtgttccctccagatctggtggcagagcagtttacactgatggatgcggtgagcagctcagcttggcagggcaggggtgggcctgccttctggcagcatctgctgtcccagacctaccatttgctgatccagagctgatgttctggtcaaatcccagctctgctgctacacaccaagtaaccaggtcgttccttaaccccaagtcctcagtttacctctggacagtagagatgaggtcacccctatcctccagagtgactgtgcagattctagatggaacagacaggaagctcagcaggcctggcctgtgggagcggagggtgctcaccaaggtgcatccatgggtcacccccatctgttcaggaggctcaccagcctcagcactcattaggcacttggtgtgtcctggagcctatggcagacactggacaaagcccttagttgtagcgcccacagcagatgtgcgtctggatggggagcagactgaggcggggggatggggggtgggcaggcgtgagccgcctgttggagctggggcttggtgaggctgcgcgaggcggtgctcctcttcttcccaccagcgttctgtcccgggtcacttgtgtgctgggcaccctgcatggacacgggataaaacccagagatccccacaaggctcaagctgcatcctcagcttccccagcaccagcccagactgctggggcaggaccaggtgacatttagcctcctccccaggaactgttcaagaaggtggtgccctaccactgcctgggctccatctggtcccagcgggacaagaagggcaaggagcacctggcgcccaccatccgcgccactgtcacccagttcaacagt

SEQ ID NO: 135805 - DNA, 1012 bp, Homo sapiens
gcagctcgggctttgtgtgctgggagggtccggcggagcgctcacagtggccgtgcaggttccctctctccgtccctgaggaactgagggagaggcagagctgagccccacccctgcctgggggtcttgtcttccctctctctggccctggcgctccttgcccagcctcagcactgagatccagacctcgactgctatttagaaatcaaaggggaagcttctggctgggtcaggaaaaccaggatcctggcaggagaggaggccactgccggaaactgaacacaatgaccatttaccaagggcccaagggagggggcggggaagtccctgtccctcctgccaacaccccccgtcctggggctggtttcctggtgtctatgtggcctgccagagctgacgctgcgcacttggtccctgtcctctctggaaaccaccagacagtttctgccttcccccgcatccctgtttccctacctagcttccacccggtgcttccctctgggctgccagatctcctcacatctgggcttccgcttatcttcccgattctaagccaagccaccaatgacccagcttggcctgcacagttcttgctttctggaggtgacctggtccgtgcccccatctctggacaggctgttgctttggccagacaaaaagtgcaggttgtgggccaccccctcacttcatctgccttagaccaaccctacagagtaggtgccaacaccaccttctaggaagctagggggtcagagaagggaagtctctgacctaaacacccgtgcagccagcaagggccgcagccaggatttaagcatgggctgtgttctctgtggcacctactgtgtgcaggagccaccaggagtcagaggaagcccaggcagcccagaagccctgaggtcaggtgagcagtagggaagcttatggctcagaggaaggcaaaagtgctttgggccacaggacgctggggagagctacctggaggaagcaagcccagaactggaccccacag

SEQ ID NO: 135806 - DNA, 1095 bp, Homo sapiens
tctatgtgtgtgtgtgtgtgcctgtgtctctgtctctatgtgtctctgtgggtctgtgtgtgtgtctgtgtctctgtctctatgtatgtgtctctgtgtgtgtgtgtctgtgtctctgtctctatgtgtgtgtctgtgtgtgcatctctgtgtatctttgtgtctgtgtgtgtgtgtgtctgtgtctctgtctctctgtgtgtctctgtgtgtgcatctctgtgtatctttgtgtctctgtgtgtgtgtgtgtgtctgtgtctctgtctctatgtgtgtgtctctgtgtgtgcatctctgtgtatctttgtgtctctgtgtgtgtgtgtgtgtctgtgtctctgtctctatgtgtgtgtctctgtgtgcatctctgtgtatctttgtgtgtctgtgtgtgtgtgtgtgtgtctgtgtctctgtctctctgtgtgtgtctctgtgtgtgcatctctgtgtatctttgtgtctctgtgtgtgtgtgtgtgtctgtgtctctgtctctatgtgtgtgtctctgtgtgtgcatctctgtgtatctttgtgtctgtctgtgtgtgtgtgtctcatgtacagccagagcagtgatcaggcttcccagaagttgggaggtgagtcccaaaggtaggggaacaaggcaggaagaggaactttgtaaaaacagacaccggccagagggactggctaagtaacgccctcccccgccctggctcctgtagatgatatagtcagatgggagggagccaggccagccgcgttggggggtttagtgtgatgaattctttactcttcaccactccagcctccttggggccacccctcgccccagcacccaggaccttcaaggccagaatagtggtgattcctctatgtcctcatgagtcacttgtccttctgggctataaaacgggtgggcgcttgttcccaggcccatcactcagcgaaggagataaagagagcagaggagataaagtcagtggcaggcagcttctggactttcagtttccggaggcattgggagcttggccccagaagaaagggatgggaggaggagcttagggccgagggcagtgtctcggtcacctctttgtggcc

SEQ ID NO: 135807 - DNA, 1061 bp, Homo sapiens
taggccaaaggtgatttttatgtgttgtgtttttccctggtctatcgctggcacttgaatagtgcccggcacctagtaggtgttcagtaaattcgcgtggtctggctgtgtgaatatagttgtgccccgggccctctctgtggtctgcagacagtgcaggctacaaactctgttactgatcctcatctccttcagtagagaaatggacattgtttagaaactctatggcagttgacattgctgcaacatttcacctgcattttacagaagtatcagctggccttgaattcaaaataagaactctggttcttccctgcagaggatgccaccttggggtgccatttttttgacacggagcatgtgccaggccctatcttgagtgcttcccatccagtgtttcatttcagcatgcagtctttttgaggcagagatgttccctgttgatgggctagaaccaaggctcagcaagggaaaggaacctgcctggctcacccagctccacccagccaggaagtgacaggatgagggtttggcccaagactcctgacactgtaggccccagctcccagccactgcttggatccttacagttagacgttgggttcctcctggagctggacctgggggcaggcagggttggggaggggagctgcggtgcccttggcagggctgggtcctgctgggctcaaagccaatgggagcggctggggcagggcctggattcttggatcctcagcttcttggcaacctgcgtgactcagtgggctggtaataggggccggcgggcaggcagccagtgcaggggagccctgcggtgggtgaatcagccagttgctgaattactgtcctgcctggggtggtgccaagccccaactgccaaaataagcacagcccctctttgcctttctctccccactccagggtggcccaccttccacatgccttggcaggtgtgtcctgtggctctgctgctcctgggagtccccgggtctccctagcctggagcaggggaaaggtcctccccactggggtgtgtagccttccacaagtcattctgcggc

SEQ ID NO: 135808 - DNA, 1048 bp, Homo sapiens
ctcccagggcagccaagccagggtgaggaagtggagaggaaagggaacgggaagcattgtggcatccccctaagaatgacaagccccagaaaaaagggagtgttcccgtggcaacccagagcagttgcttggcaactgctggcccccaaaatacttgcctgcaggaaggctccgggctggggctttccgatgggctttccgatggctcacttccaacccccaccagcgcacacccacccctggcccaaaaagaagactctgaggctgaaagagaaaatgcagagaccagggtccaggaccttcattagagcctggggaggaaggggcctgacctgctgagtttcctcagatacttctcatggccctccaccctgacacaggacccagtagactctgcccctggatccttcctgagggacaccccagtccactcccccctccccatctccccactctgccagccacccggcatcaagccagtcccctagcaacagaggccgcttcctggatacctgagtgagagttgacagtggcagaatgtcagaaaacgcaaggtcagaaagcacagcgatggctcggtgccagccagagtgtgtggggccatggggtaccacgtgtggtaccgtgtgctttgccgccctgcagccgtgggctccctggcctggggctggatggcatgccaggttgtggttgggctgggtacagcccttggaacaggggactgtggttctgggccaactttgataccgactgactatgtgaccttagtgtgtcccttctcgctggcctcagtttccccattggtggcccatctacccctctgcctgtgtgtttaccgttcagtgcataaacattgccctgtgaattatgtcacctactggggccttggggcaggagagtgaggggaccaggaccaggccgccactgcccttcctcctcacatgtcggcatccacctcggccatcaggcccctggtcctcaggtgaggcaggtggctttggagcaggacacctgggtccaaattccagctcagcgcttattgctgggc

SEQ ID NO: 135809 - DNA, 1001 bp, Homo sapiens
acccaaagacctgcagccaccagtgcttcactagcgtgcagaccagccctgtcccgcctccctgtcagtcaggcgaattcaaccggaaaagggacgtggaaaggccactgtgaactgcagagggctgtgcacacagtagcacacaggatctcacagtaacgcggcatgggaacagtgagacagggggaggggaggcgcagttacaaaggcagggcccggcaggcttgccacgttctgcagccgtgcctttgcggggcaggctctgaagcctcagcccgactcagagtgcctgaaccctgccgcgccagtcccccgtttattgcatattgcccttaacgtagcatttctaataccctggtgtgaaggcgccctagaccccttttctctggtcacaggggtcctgggtcctttgatgtctcccaaccacatgtagccaattcctcactcaggcccccagagtgagcctttgaaatggaacaggtctaggctccctcggtttcctgcaccccaaagtgagccgcactctcaggggactagccacctccttcttaagagggtttggggcagtttataataaagggggcgtgtgctcaaccctagctagggtgattttttttgttttgtttttgttttttttgagaccgagtttcgctcttgtcacccaggctggagttcagtggcgtgatcttggctcactgcaacctctggctcccaggttcaagcgattctcctgcctcagactcccaagtagctgggattacaggtgcccgccacacccagttaatttttgtatttttagtagagacggggtttcaccgtgttggccaggcttgtctcaaactcctggcctcaagtgatccacctgcctcgacctcccaaagtgctgggattacaggtgtgagccactgtgcccggccactaaggtggtttttacctgcacatccagcctgcctgtgtccccagtgtctgttccatcaggcagtggggacacaggcagactg

SEQ ID NO: 135810 - DNA, 1018 bp, Homo sapiens
ctagacccctcctctgcccttgtctctcccatgaccccacctggccttcctttaggagctgccgcttggcagccttcctctgggcctctgggactccttcctggaacttcctggggccctaaagcatgaccagatgatgaatggtccacctagggtcaggtgacccccttgtccaatgagttttggcctgggggcagggctgtgtcaaccacacccccctccatgcccccagcatctagctcaacttgccttcccttgattcgtccacttacctgcttcttcactactttcttctctgtgatcctcaatgttcctgcctgtaaaatgggcatgcttatgcagatcaaagatcataagaattcttagaacgtcgctgggcacttagaaattgctcagtaaaagttcacctggcctaggagcataagaatctctaccaggaacatgcttacaacagccgtaagaggctggtactagcattttgggaattggacaaatgaggacccagagggccagagcagagtgacatcttgagatggggagctggtaagtggaccccagcctggctgaccccagcacacagtggggaccctggcaggctgctggtgtagcagtgggtgaccgggtgatcatcactaggtacactcatttcatccagtccttcctggagtcagccgaggagttcttcatgcgtgggtaccgggtgcactactacatcttcactgacaaccctgcagccgttcccggggtcccgctgggtccccaccggcttctcagctccatccccatccagggtcactcccactgggaggagacatccatgcgccggatggagaccatcagccagcacattgctaagagggctcaccgggaggtggactacctcttctgccttgatgtggacatggtgtttcggaacccgtggggccctgagaccttgggagacctggtggctgccattcacccaagctactacgccgttccccgccagcagttcccctatgagcgcaggcgtgtttcc

SEQ ID NO: 135811 - DNA, 1007 bp, Homo sapiens
ccacgcttcgttctcaggaacaaaacctgaggcagccctttggatgccctcacagccttgcttctctcagcctaggttcccatttggggacttcaggaccccagagccactaggacttccttgggaagcccgttagcccagggtgggtcccaccaggacagtagggaaacagttgtttccctagccatttccgaatagcccatcattccgagtcatcatctctgtttgctgccttcctggccagccaggtggaagaaagtttccaagctaggtctggcccgttggggatctcagcagtggggcaggagggtgcctgatttcggggagtcctgacccgagcctgttgtcagagttgggaggggctctgagcagtgttgggcaggccgggtctcccatcccgaggccagcgttcctgtgcagagccccatccactggttcttgccctgagccacatatgtctgtgccatgggctgagtgccacgacaggcccgtgtgacagctgctgcccacgcatgtggaagctaggtgggactcattcctaattctgccgttgtaatgagacttgattaaaacaccgccacttttttgcattgctgctctttcttcctcattccttgtcagtccaggaccatccttggtctcccagcagttgtccgagcagcagctcctcagctctgcctggacagcctggcccaaggtcactctctcctcattggcacctggtaggtccccagtattcagtgaatggacctgctgccatcattgcacatccaggcacctgtgcctctgctggcatctcatcctcactgctaccagagccggtgctcctagtgccggtattttagagaggagaggatgtggacttagaaggggtgaggtgtaccacggccacagagctaggaagtgaagtggcaggaatcagaacttgaacctgatggaagtctagacccagtgtcttttggtgccaggctcaccttagaaatgcagaagtcacaacactgggcagg

SEQ ID NO: 135812 - DNA, 2879 bp, Homo sapiens
aatggtggtcaagtgcatgacacagcctggcacctgggaagtgatcaggaaatggtcgcgaaaaaaaacttaaatcatcccttcactcatccaacagtttaccaaatgccaagcaagtgacaacggttcctaccaaacagggctcccacagcccaaaaagaccgggccaagataagcccccatccctgcacctagcacagcaagcagcgtgggttgcctctatttgtcttgagcaaaggtgcatgttgtctcccatggccagaacaagagagggtggaattgaaccttgtcagaggtctggctgacagcgcttaggtctgtagatggcaccacagacaggttgtggccagtgtggacatcctgggtagatgacagttaccgtaagctgggctgggccgggccaggggtggggatgccttggctgggttgatttctaggttttcttgttttcccccagattgaggacgagacgcaggtgtcacgggccactcagggtgaacaggacaattacgagatgcatgtgcgagccgccaacatcgtgagtggccagggtggagggcacggcctgggctccaagagcatcagtcccctcaggtttcctgggtggagtggagggggctctggggctggtctggtcttcttcccccgagaaggagcagaaggaggcaaatgtagagatgctttggtttcaccactcggcagctttaaagaatgaggtgggggcaaatcatttctcaggagactgtcctcacgtggggcacttggaggagggctgggcagagagccacccatgcccgtcctgtagccgtgcagtggccagaaagagggtagcccttcctgctaactcaggagttcctaaggtcagttgtgagtgaaaagacaaacagccgaatggaactgtaggcgccattggattccttcggatcacaggagaaacacagcaagcagataattccgcaggtgcacgtccagggctcaaaatgcatggaaaaaggtcccacaggagctctgcccagctggcagccatgttaatcctaccccggggcaggaggcaaaatgggatcgcagttttatctgtggggtttgagtttttcatgagcagaatgtacacctgcataattggactggaggccagtcctgcaggagtggaagccagaggctgacgagaggggagggcctgccctgcagaactgacatcccagttttctcacttaattctcacacatgaacctgtggaggtcaggggtagagtcccactttgcagatgaggaagctgaggctcctagagaggccatcccttgcccagcatcagctacttgtaggcaaggccgctgtcccccctcaccctgtgcccgccctggttctgatggccacaggtccgagccggcgagtccctgatgaagctggtgtccgacctcaagcagttcctgatcctcaatgacttcccctccgtgaacgaggccattgaccagcgcaaccagcagctgcgcacactgcaggaggagtgcgaccggaagctcatcacgctgcgagacgagatctccattgacctctacgagctggaggaggagtattactcgtccaggtataaatagcgctggactccccatgcagagcgggagcctgcctacctgggcctggccagcaggcagggctgccttctgctttttcaaattcttgctggtcttagcagtggagccatgcctgggtttcagagcagagctcctggccagagcgtttgaccgacagacaattcacatccatatgccagggccctgggcctttcccacagtgcaatgtgatgaaaaccacaggactcacgccagtcggataggccgagtctggagaagggaggcgcctggctgtatcccccgcaggccctcttccgagagccttcctcctcgggcagtgcgttctggggctgtgctgctcctgttaccttctgaatccatatgtagagatttcagccaaggctgggccagccttttttgggcagtcaggtccacacctatgtccagggcaccagggatgcaattccatgtggatgtcaccaaaccccagtgtggaggcagggacagtcatgggaatgtgggggatgaagcccaggcagggaatggccttgaaagccattggagctccaattcgtgacccactcagccttatccacggagctggagccaacctacgtgccaggccccatgctgggtcccagggatgcagaagggtcaaaacccatcatcctgacccttgtggggctccgtaagaagctgaaaccttcgaccgtttgagctggaggggccctgagaaatcagagtctacgtatcatttacttagggggaaacttaggctggagacagggaggccttccactctgccccattagcttagaaaatcaagattcagtccagcagatgcagagtccatgtccatcttgtgccttctcctggacaaacctttccttcctggtggtggatttaaaatactcctttctgcccattggccatgctgggagccacagctatccagagccagcatgacctggggcttggtttccctgccctgggctcagtggcactgctgagctgcagcagtcctagagttttccagggggttctgagggaatctttggtccccagtactcattaactcagcagacatgaggcagcatttcctccacactagggtggctgagaggggtcctggggtgtttcagacccttctgggcatctccttccacagctgttcagtttgtcggtctctttgaggcagccaccgtccctgagggcccctgcacagagcagctgtgggcctgtaattcagcctgcctgccttgccttggggcagggagagagggaacctgctcacggccctgcagcaga

SEQ ID NO: 135813 - DNA, 2888 bp, Homo sapiens
cggagccctagcgtctctcgggcttgctgggggccgctccagaggccttgtgagcgacgagttctgagcccgcccctgttgcttctagagcctgtggggccgcgactcagaggagtcatgagtccggggtgtctcctgggtgggcgacgcgaagagagcgtggtctcgggcttagccttgctctggccactcggggttcccggggctgcatgcttgtgcggctgaatgtgagatgctcctgtcgaggggtggtgctggggggttgcagaaagctgctcgccagcttagttcaggcaggtgctgtcagcgtcccttgttttggaggagccagcctgagccctacccccgacgaagcgagtggaggcggcggtttaactgacgttttctttctgcccagccgaaaggaaagaaggccaagggaaagaaggtggctccggccccagctgtcgtgaagaagcaggaggctaagaaagtggtgaatcccctgtttgagaaaaggcctaagaattttggcattggtaagtaacaaacggcagaatgaaaacggtctatgtttttctcaagggaaggtggtaattgggttgtgttgtatcttgtaggttttagtgggtgtaaagtggtcgcagtccttaatttgtgtctcttagagacgggggcaatgatacatgcttcttgctttcattgggagttgctgagcgagcattcagctcaatatggtagtggccttgaattcagcttagccatctggaaacaagtacagtagcagtgtcgcagcgaggtactaggactgcaattctgctgtacttcgtggcaccttggcttcttgttagatgaggaaaagcatcgtgctctttgttctcaggtgtttgtgtgcagatgatgtaaaagaatatttgctatctgagagatggtgatgacattttaaaccaccaagatcgctgatgcaccaacacccttcctagtggccccagacatgaacttgacatggaatttgagcctcactcggtgtcaccctttacttctcaggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacaggtgaggttctgtggcgtggaaaggagtttctcaggcaaggattccttatttcatccagaacatgagggggatggtcttaggcttcttgaactgcagttgtcattaaattatagtcatatagcaggaccgcagtccagcatttgttattaagtgttaagtgacaaggattagaaccttgactccaagcctaaactgaagagtgtttttccagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggtgagtaggccccaccttagggtgaacactgggggcgggctgttgcagtgatgtaaaatttcttggcctgaaattactgtgaagagtaaaaccgagctttttaacactgagtcagcagctgagcccagcagcttcttgtgactagagcaggccctgtgagtgctcacaaagtggttgtgtgttctaggagttaacaccgtcaccaccttggtggagaacaagaaagctcagctggtggtgattgcacacgacgtggatcccatcgaggtgcgtttgcctgttgactgctaacccaagggcttctggcagtaccaggaagagagagtagacctaatgccaagtcagtgatgggaccgaagtgggtgagggcagtactgacacagatccaacacatgcgtggctcttgcaatgatgtgaatctctcactgaattcaaccttgaagtgcgaatccatgagctttttaaccctgagcaattgttacaagctaactgaaatttgctgcttttggtcaaaatacagtcttcagctaatgctttcttccagctggttgtcttcttgcctgccctgtgtcgtaaaatgggggtcccttactgcattatcaagggaaaggcaagactgggacgtctagtccacaggaagacctgcaccactgtcgccttcacacaggtgaactcgtaagtacacagcctggccccaaacttccccccagttcatttaatccatgcctcacagttgtttccttttgccttaaaggccaatcttttagtttaagaaatatatttatctgaacttttgccaatgatggttaagaatttcttcacctgaataaaccatgtggtcagcattgcatctgaggcaaaagactgtcttgagctaaaaggtatttttgcattctaaaagggaaactaaggcaaaaaacccacttttgtttcccctcctgccttttagggaagacaaaggcgctttggctaagctggtggaagctatcaggaccaattacaatgacagatacgatgaggtaagaggcagctttacaccaaaatactgtcattcacaaatctttctcccaaataactggctggcttaacctatgagaagttctatctgacgatcagcttggaacagccaaacagaattaacgcaactaataaccttgaaaatctcagaaaacagtaagccaagctaactgcctctttttgtcttttcagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataata

SEQ ID NO: 135814 - DNA, 1090 bp, Homo sapiens
ggtggtcgtttgaaaaagtgccctgaatgatttgtctgctctctccctagaatatgccctacagagataggtatattcagccacattttccattcagggtagcaaacagtatgccagatttggcttgcagatggggttttggcccacatattttttaaaatttcacataaaatattcattgaggagtccagatttttagcctctcttgtaaagttggactctggcagtgcagatccacattcccacatggcatcaaagttcccctttgaagagcacgccctttgcctttctccttcacttgtctggccctggtgggctgtgtagtctgccaccctcaggggattcgttttccagccaaaccttgctcggccactgttcttatctccatgcagcccaatggaactgaaaaatctggagtataggccagtgaaggtcagggggtgctttgaccattccaaggagctgtatatgatgccccggaccatggtggaccctgtccgggaggcccgggagggcggcctcatctcctcctcaactcagagtggggcctatgtggtcactcccttccactgcaccgacctggggtgagtaggacatgtgggagctggctgtcctggcagaggcagtcagggtatactaatttacatcactatttccttcacaatccccaaccttggtaggaccctggggaacccaagatacccaggagattcaattccttgcatagtttaagtccctaattgtgacattgacttaatcttctcagccagctcatttatgactggataatttctgtatgttgacctctgaagggaaaggagggattcgtgaaacaggggccctgcctctggagaactgtctagttgcccacacattagatgatggcaagctatgaggggccagcaagaggacttcaagagaaaggaccccagccctaccttgagggagtggaggcaggggtggctccctagagggctatttgggagttaagagatgggaagaacattccaggcaaagcaaatgacaggtacaggagcacctgtgtgattaactagggaactggaggattcacgtaaaaatgaaaatacct

SEQ ID NO: 135815 - DNA, 1039 bp, Homo sapiens
acacgaccacaattccactgaaagcattttaatacggaacttgtcactcccagggagcctccgctcagccggcagttggttcatttcaatccccacgacaacccttcaaagtgcagggcagacagcaggtggctctgcccaggcgcctggatcacagcccggcctgcagccctcacctgggcgcggggagaccctgaggacgctcctccaggcggcgctggccggggcctgcggacacggacgggcgggctgagctccgggacccctccccgcgccccgcaccccgcaccccgcaccccgcaccccgcaccccgcacccggcgctcacccgtcccagccccgccgcccgcagccccagctgcaacgcagccaccgccgccatcgcacccggccccgcgggcgcttccgggacgcaggaggcatctgcatccggggcgccgctgagtcccgcccagagccccgcccccggctccaggttctgcgagcggcttccgccgggctgctccgcgggcgcgtcggccatgagcgagttgccgggcgacgtgcgggcgtttctgcgggagcacccgagcctgcggctccagacggacgcccgcaaggttcgcagcgcgggaggggaacggagtggcggagaagggcgcagttgggatgaggggctgaggggagggcaggggagaggagagggcaggggagaggggagaggggagagcaggagagaggggagggcaggggagagggcgcggcgggatcaggggaggagagggaagggggcgcggcaggagggggcaccagggagcggagccctggccctcctgacgtcctgcccgcccacgcgtccgcaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgtaggtggtccgcggcggcgcggggaggcccagggcaattag

SEQ ID NO: 135816 - DNA, 1069 bp, Homo sapiens
acacccactgcagtgctcctggcctggtctctgggtcatccgggctgtgcacactagcccagccagtcctttggagcctacctcagccaacacatttttgcctcagacttccatggaccctggcttctccctggggtgctgttcccccgaccccactgccaccacatccctccagcctcagcctcgagcgaatccctcagcgagtctccccagccctcctgtctccgcaagcccaccccacatccctcgcccagtttctttcacacctcgcattgccacgcacactcactcactcccgagcctgcttctggctctgtgcctgcctgcactaaaagctgtggggtcaggggccatcatccctctcttcactgtgccaaaaaacaggcctgatgcatcaacacggatcgctgaaggacgacctgccttcaagcacgctccatctggggcaaggcgggcatgcactcagatggcgatgcactgatgggggtccactgggacttacatttacacagagctcgctggtaccgccggccctgggtgtgcctcagcacgtgttctgggcacttgttgatgtgccgcagggtgagtttgcagaacaactggtgcctacagagcagagagaccaaatttgtagggacagttcacagcaaggattcagactggtggctgtgtcttggactcatccctggacagtctaccatgcggcttggacatcgggcttttaaaggctcccggagcaattccactctgaagctgggtggggaaccgtctgacccaggccgactgcagcctcttaatgtttaccggaaaagcacgcatggcagcctcactgactgctccaggatgagttcatgcaagaggatggctccacctggagcaagggctcaatgaatggaaacatcctatctctgttttgacgattattacaaagcctagctcccagctaaatcaaagaccccttctggggttaagggaagaacccaacgctgttcacaacctcaggtgacaaatcacaagcctctactcatctgggaagcagccacaccccacaggacaaacctcaggtgag

SEQ ID NO: 135817 - DNA, 1992 bp, Homo sapiens
ggcctggatggctgggtgggccaagaagcacttgggaatttagttatggattagagattcatcttggtaaatcacagcctgttactagttgggaacttcagtcttccccaaaccttccacatttcaaagctggtgctttattgcctcctgcctccctttggcttttatctccctacttgcaccagcagccgtctcagcagtagctacatcagcctgatggatagagacttcatgacgtgcagcagctggaacttttgtttataaagcatctcttttcctcacatttattttgaatttcttacgtttcaacctatgcagattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagt

SEQ ID NO: 135818 - DNA, 1044 bp, Homo sapiens
agacagttcttccagggtagcccagggaagccaaaagattggacccccctgtctaaattgtgcctcttagaaacaggttctgaagaggatgttgcagagcccctagaatagtagagactgaagccgtctcttctgacccttatttcacgggtgtggggactccgggtctgagtggaggacagacctgaccacggggacccagctggtcaacactgaagctgtgactaggactcggttgtgtgtgtgttcaggtagcctgtcactgtcgagttgtaaagatacctctgtctcctgagctatgtaaggttttacatgggtgtaactcgagtctgaggtcctgtgcgcatgcctgcctggtcctgcttggcagatcactgggtttggagaaagggaagtaagggccttcttatactggcagcaaggtctccctgcacctggtctcacagacaggccagatcctggtgaggcttagcttccagcccacatatctgttcctcaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctgtaagtattcctacttgcctgaaccggtctggtttcctgtgaatgctgtccctcccccaccccctccctgctcacccctccctggttgggtattaaccacagcctgggggagctgctgaaatggagcaaacttttttttttttttttttgagacggagtctcgctctgtcccccaggctggagtgcagtgcgtgatctcggctcaccgcaagttccgcctcccgggttcacgccattctcctgcctcagcctcccgagcagctgggactacaggcgcctgccaacacgcctggctaattttttgtatttttagtagagacagggtttcaccgtgttagccaggatggtctcgatctcc

SEQ ID NO: 135819 - DNA, 1061 bp, Homo sapiens
acctctaagtgccttttcagatgtcattctgtgattccaacttgtaaatgcctttgaccgaaaagagcagctctgtgtcttgtggcagtgccaccttggaagactgtagttgcctgccgaggcactgggggaaatcacggtagcagagtgttagggctgctgccctataggatctgccccagagggcctaacgtcaagtcatgcatctccgggactgatccttggattgttgcatgtgtccagactcacagggtagcgctcaggagcaagcactgagagccccctagtctgccctgggaaggcaccggggctgacaagagctcttgccttccacagcgtctgttcctcacacaccccgcccaaggacgtgcctggcagcggcctggtgctccccgccgcagccacctcacccttgggtttctgtggccctgcagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgagtgagtggctttgcgggtggtcaggattcactgggcgtcttgttccatgatcgttagcagttgggaggctgtgtgtgaactcgggggtctcctggactgctgtcccccctccattcccctcttctccagctcagctgtgccaggccaggagtccggttctgcaagccttggtggggacgcttagtctctagccctgagctcactgctttagagcttgctaaggaaataggacatggtccctgtcagggacccaaagcaggagatgctggagtctggctggcagtccacagtagagcagttaattgcctacctcaggtgggtggctgacttgggagctgattgtgggaaacagcccattctttatgacggcaagggctccactttctggtgtttgtgataagtctagtcagcttaccatgtgtggtccttgcctatcatta

SEQ ID NO: 135820 - DNA, 1073 bp, Homo sapiens
aactgacactgcagggcgcagtgggtttggggagaatggccacctggctttgtaatctctgcctccgttctctgccacatgggagccaatctgcagtgctgacctagtcagggccccacctgacaggctggagggtgacctgaacacccaggggcgtggtaactgagatgggcagcttcagcagtgtctaggactttgaagcaactttaaaaaatgctgaaaaataagaaacacgcatatcttcctttgttccaacagtaggtttagtcagccctaggaggcctgtgcagctgacgttcgctcgcctcccgtgggggtcagcctctcgggtgctctttagactctggcttcccaacatgcgttggtggatgggtcccctgatctttctccgaaggacttgctgtgttacagtatttctttcactttatatctcagttttgcatgggtgataagagaaaagtgcatggggtgaacctgcgtgacatttgtacctggcatccgatagtgcatgttggctacctaacccagccgtcataaatgacctgactcacagcacagcaggaagtcataaatgttttctttccctttgacatttgacagtgatttcacacacttgcgtttcattgctgttgaaacagctgtccatcccatttgttagtgtgttttaatttgctcgagattatgcaggctttgacaaaatcccagcgctttctagccattagcggtaccagcttcatgctgcgctgacggttgctgcacacacagtccccacgtcagatcctgagcttgcaggggagagctccgtcgggctgggaagcgccagccctggtttgcaacagcacacatgcgctgtccagagcctggggcctcctcctgctgctctggagattttcggataactgtaaacgtgatcttactattcagtcaaccatgtggccctctaggtgtggcaccctggctgtcacctaagccaacccttgttctgtcagggtactctgggcgtcactgggcaggctgggaggtccaggcccttggcacctcagccatgtgtgacctgcaggctggggtcaagt

SEQ ID NO: 135821 - DNA, 1030 bp, Homo sapiens
gagtcgacctctcccaggttactgaggggaggccaaacctgctcaggctcctagacttgcctgtgaccaagaccaagaaaagccgggtcttggtccccagcgcccccagcccctggtgttgctcttctggcacaagtcaagggaagagcactagcgggtgaaggggctgctcacatacaaaacccaagtgggttaggaccatatctgtaaggcaccatatctgtaaggcagcgcaggctgccgccgtcagatgatctccttaagagtccgtctaggtggtggcagagcatggctgtgggagcttccatgcccttttgtgggcagcttgggagggcagctacttgtactcgcccaaaccccaatcagacagatgcaggcaagtaaacagggttcgaagtcaaaatatggcttcttgtggacagaatctgaccaagcccaggtggggctttgtttctctttattcacatagtacttaaagctgccagaccaggcttttacatgaaaatgacctaatttgaagccgatagaggattaccatggaagtcactgatcagataaagtgacacatccattttttcacatcttcagaaaacaagagcaaaactgaagtgacaagatttgaccagaaagtgtgggctgctgaaagcaagacctaagtaagcttagtttcccaggcccagtgtcttccagtattatgacaatgacattaagtctttcactgggccgggtccatgatagacattccttttgtgaacttcttgactgtaggaggttggccagagcgtcaccatcttcagatgggcagagggaggttggctggccgcactggcttgtggtggcctggagactgagtccgcatcctgttaccccaaaggctgggttcctcactgcttggttgactgatctttccttctggcctgcagaggctggtccacggggacgagcagtctggttagtttctgctggcaggctccccacagttgcatctcttgtctctctgcctctggcatcaagctgcttgctctggcag

SEQ ID NO: 135822 - DNA, 1032 bp, Homo sapiens
tagcgaccgcgtacgggcgagcgtccacccctggccccaccccgcgtgggtcagtgggacccgcgggatcctccccgcccgaacggcgccctcgaggcactcaggcgtccctcccgcgcgctggccccagacccccaggtccccgcccccttaaaagggacgcgttccgccgggccgggagggaccgcagggcctgcgcgcggcgggcggggcctccagcgtgagaggcgtggcgtcgagcgcggcgggcgtggcttcgagcggatgggtcgggaggctggggatggcgcgtggcccctttaagacgcaccggggcgggcccgggcggcgcgcggcccctttaaggcttggcctacgtggcagccgctggagccgcagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccaggtgcggcctgcgggctcctcccccggccccggtcccgacccaggccgcccgggccgctccggagtcggcctcccagcgcagggcgccaggcccgggccgccccctgactccttgttcccacagagggacccccccgcccgggccctctgtcccggctggacagccccaaacccggcctccgggcccagtctcccctgcccgctgggccgctcccggagcccgggcctcggcgccctgcctggctagccgcccccaccctccagccagcccggggcgcgggctgtgggggtttcttcccgggccggcggcgcgagtcctggcgttgggtcgggtctgaggctcgcggggagcgcctcggcgtttggagctgctggggggtccccgcacgtttttcctctcactggggctcccggaggcgggctgggagctcggggacgaacgggggccgggggtcctcccagaggaaagggggcgcgctggcgtgcg

SEQ ID NO: 135823 - DNA, 1102 bp, Homo sapiens
acttggctcgggccacccttggtctaatcacccctgttcggggggtacaagtggggttggtggtggggtggtccccagaagcaggcaaggctgcctctggagcccagggcctagggcaacacatctctacccatttttgtgggggcagttttgtttttatttccatttgggaaattgtcaagtaaatcatgaggttgaataggcagaaccacgctgccaggcggctctaaaagtttctcagtgcctacactcaacatatgctctcctccagccatgagccgactttgcagactgtgtggagcactttattcctctcctcagaggtggttctcgcagccacccctgccaggggcccacaaggcacttctcccaggggggtgggtggatgtggtggcttcgagtcaccctccgtagtggcattgcaggcctgaccatttgtcttaggtctgaccaggggtaggagcggggctgcctcctcacagaatgatggtgatgtgtgtgttgcaaaaaaccgcttctttgtgttgattttccaggagaagagcttgaagttgttcagaaggaagtggcagagatgctgaagggcagaattctagtggggcacgctctgcataatgacctaaaggtactgggctctctcctggggactcagcctgcccctgctccgtgggtgttacactcacgcccttgctgtgttggggagttttaacaatgtgtgggtttgtgctctatgttgggaatactttggtaataatatcagataccgcgtgctgagttcttactgtgttttaggagccatgccaggctcttgttttgagagcccccagcgaaactggggtacccataccagagcagctggcaaccccgccctaatgagaaatgaaggtgctgataccccttttacctggaggaaggcctaatgtccagttgtcccatccgtgaccagggtccctccacaggaaacaagtttatcctggcagatgccctgtggcccatgttcaggttacgcttgcctaaccatcaccctggccctgggagcttgcctttgccttctttctggcgtcccgaggaaaatcccgcctggggcagcccctggttcttc

SEQ ID NO: 135824 - DNA, 1096 bp, Homo sapiens
ttcggcgggtacgctggtctcagggagtggggtctgctggggatgcttagccgtggagggcggggcttcttcaaggaagaggatgctttcctctccctgaggtgaatgaggcaagcacctcccagggtcctgctaagaaccaggaccacacagagcttgtcacgtgggtgcaaatgagtgaggggcagagagcttttctctgctgacacttagtccatggatccctggggctctgacctggagccctgtggcctgccgtgtttattaaactacagcctttggttacccttcagcctgacaagagccttagccttggactgtgagatggtgggcgtgggccctaagggggaggagagcatggccgcccgtgtgtccatcgtgaaccagtatgggaagtgcgtttatgacaagtacgtcaaaccaactgagcccgtgacggactataggacagcggtcagtgggattcggcctgagaacctcaagcagggtatgtcatccacagctcaggaacttagaagggaaagtagtaactggattcgttttctcccttttgttcccttttctgtctgagaccactcactgcagctggttttgatgcgtcttgtctccttttggggcgatgggttttaaaatacaaaaggcatccttagacggctttacacccatttatgccttgcacttcattgcctcctgtccgctgacttcaagaccaggccagtagctgggcacggtggctcatgcctgtagtcccagctactcaggaggctgaggagggaggattgcttgaacccaggagttcaagtccagcctggacaacatagcgagacctcatttctaaaaaaaattattatttttttttgagatggagttttgctcttgttgcccaggctgaagtgcaatggcacaatctgggctcactgcaacctccgcctcctgggttcaagcgattctcctgcctcagcctcccgagtagctgggattacaggcatatgccaccacacccgactaattttttattttaagtagagacagggtttctccacattggtcaggctggtcttgaactcccgaactcaggtgatccgcctgcctccgc

SEQ ID NO: 135825 - DNA, 1036 bp, Homo sapiens
gttccaaaaagaagcccaaaattatccagcaaaacaaaaaagagacctcgcctcaagtgaagggagaggagatgccggcaggaaaagaccaggaggccagcaggggctctgttccttcaggttccaagatggacaggagggcgccagtacctcgcaccaaggccagtggaacagagcacaataagaaaggaaccaaggaaaggacaaatggtgatattgttccagaacgaggggacatcgagcataagaagcggaaagctaaggaggcagccccagccccacccaccgagtaagtatgggccacctcaccactgagaaccgaggcacagcgacttcaccaaggcctgtctccttatggaggctggtggcctcaccgcagtctctccatcactttaccctgatgtcgtctgttcctttgtttactcgctgttacttgttttcccctagagtgtgcgcatgataaggcagggcctgcttcttccgagcgttgagcagagctcagcatttagtgggtgccagtacacgtgtgtggaaggaaagcgtgctgaagccagaaagacccaagtatgaggcctgtccctgcttctcgccagttgggtggtttggggcaagtttctgacgtcctctgtgccttgtggtagtcatggtggcatcataaggagattgtgaggttggcactcttggctcagtgcctggtgattacttcaaccctgtgatggagccaggtgtggtggctgttgcctgtgatcccagctccttgggaggccaaggtgggaggatcacttgatcccaggaggttgaggctgcagtgagctgtgattgcactactgcctccagcccgggtgacggagcaagactctcaaaaaaacaagtgaaaagaataaaccctgtgctggccacccacgtggggtggaccgggagtcagtggccttctctgaatggttcagctggaggtgacgtgttcataagttacagctggcttcatgttgcctgggtgttcaggacacagtcgctgatggctgaggaatgagccatt

SEQ ID NO: 135826 - DNA, 1010 bp, Homo sapiens
gtctgccgggcgcctcccggggcggaggaatggcggggccgccgggagccggcgtcctggggttgccatggttacccgctcgggcctgggcgccttggtaccccgggctgggctgggctggcgcttctgggaacattcccggagggaccagaaaccccagggcgggggggcggcgggggcgggggtggggcaccggcctggggcacgtgactgagccctccccccgctccccaggggcttttgtgagactttctcggtgatgctcacggggcgcatgcccacctggcccgtactaaagcgtcaactgttgacttgggcgtaggtgacggcagccacattgctaacctttgggcaaggattgtttgtaagggaggcgggtgcacggctggctagatttctggcaggaagccactgggcggaagtttgctgagggtcaggtggtgtcagggcacaggtggcccctggggccgcggggcagtgagctgagggcccggcctctccctgggtcctctgtccgctctcatatctcccccgttgctgctgccttagccgcctgtcaccggccttcctccccttctccgcacgcatcccagtcacagaccctgaccttaggctgccagggaagctaggctcttaagcacagccagaaaaggacaaagagggaggcaggtcagctccaggagtgaatggaagccgtacagctggccttccagggaaagacaagtctgtctgagtgataccctttcctttcctgtctgccctcaatcttgtggattactggagtgggcaaggtcttagagaatgtctgtcgaggatgtctgcaggttttaaacagtgcctgcctggcagagagggctagctctgggcctgggcagggcaggccccatcagcaatcctgccagaaggaccaccttttcagggtcaccttgggttccacagcctttccaggtgggtagagggtggagggaggttgaggcaggagggtgctgggctaggagtgtgctgccctc

SEQ ID NO: 135827 - DNA, 1037 bp, Homo sapiens
caaaacgtgccccagtggttctgcgcccaggaactcagctgtcgctgtgccgtagtcactggaaggttcagaggtatatgagcatgtgtggcagcatccgtgcagtggagagaaagtgggaagcgtctggaattttggtccgtccactgggagttgttaaccagatgatagtaggtctgtaggacatgtttctctgcagcctttccgaagagtgggttcatctagatgtcctgacgtgaagggggagaagcaggttgcagagcagaaaatgtggttgccctctaaatacacttgttaaaaattttcccatttctaacaatgaaatcaatatgtaatacttctcctctcagtcataagaaggaactaatttcaggataagcttaatacacggaaactcctagaataatgcctctagtgcataggaggctggtggcagctgtattcattattgtctaggttatctttagaaagaagtctagatgcaagcttgcttccccttcagagaggcccggtagttttgatggtaagagcacaagccacatgcttagttctggagccatcttgtgccatatctaaatcacgaagaacacaggatcacaaagctcttatctacacgcagtgtcatgtccttaggggttcaaaaaactgtattttaaaaatgctagacatcatagaaattcattcacaataatttggaatatagaacaatgttactcgaagcccgctgcctgctaatcttctgatgtgtgtgcttcctgtctgcaggcattttttaaaagcctgcttttaacacagttataaccattatgaataagtttgtatcctgccttttttcacttagagtaatgatataagcatttgaacatcaccacagactttataacattctttcaatacaggaatattcattcagctggatgtatcatgctgttcttaatttcttaactggtgtaaatcgaggtgtgataaacatgtgtctgctaaaactttttctgtgtttatgatgatttccttaatatctattttcaggtgtggaa

SEQ ID NO: 135828 - DNA, 1008 bp, Homo sapiens
acttctgcgtggcccagtcttgccccgtcacggcctgcagcaaggatagcaaaaacatggctggtgggagccccttcccctcccaggtctgcaccgggcattgtactcagttgccaccctctctcctgcagagcccagactgaggctggttccttcgcagcccagcatcccagggagcctgggccattctcagaggggacaagacaggcctttgccaccccagcagttgtctctggggaaatcagaatgcctgcaggtcacacctgggtcacagggcaggaaccgggcagtggtcaggagggctgtgggcatggggctggtgctccacgtgacgctgcctctctctctccccaggggcgatgcgatctcctatgccaggatccagcagcagaggcagcaggcggatgaggagaagctcgcggagaccctggagggggagctgtgaagggctgggcgcccctccctccctgtcccctcttctggctctgtgtgggtccaagtgaggcctggactgtccacgctgaggcacagcctggagaggggcctttgcacgtgtccctacacctggagtcctctgctcctttctccagactggcttaagccaggagccactggctgctggtgtgagggtctgggctgctggacttgaggcagagcctgcagcagctgtgtggacactacccagccctactcctctgctgggtgggtctgcagatctcacaccacagacagggctgcctgtgacctgctgtgacctgggagcagcttcccctggagatgctggtcctggcttgaggggaggggcaagtgggaccctgccacctgggcactgagcagagggacctcccccagctctcttagcaggtggagccccagggcctgggacagcctgccgctgccagcaacctcccactgctgcctagggtgcagcgcccactgtcaccctgccttctgaagaagcccacagggctcctaaggtgcaccccggtacctggaactgcagccttg

SEQ ID NO: 135829 - DNA, 1027 bp, Homo sapiens
gaaatgccccacatcccaggacaccagccatcaggaaggcagctcttcctcacccagaaagaggcaattatttcctctcagcagcctggccccaggagcccccttccctctctggggctctgcctctccttttgtgccctgccatggagccccagggccggggcagcccctctctgcccagggaaggcaccgccctcaaagacaaggcttggccgggcagtgaccttccctgagcggaggggtggcttgagcaggacacttcttgcccttactcaaaaacgaaatggccagtttccagaggcgtcgggggaacggctgacgaagtcacaatcgttatgttctcaattgttttcctcctcttactttctctcctgcctcgtttggacaggccagtggcattcgcccttgaggtccctcgcagccccggccccccgggcccgcccacacctctggcttcctctgtgcatcctgtgaagtctgtttctgatgcgttggcgtggggggtgggctgggtggggtggggatgagggcccagccctcatgattccatttcccaattcctttctggtctccatcctctctgtagatatgtagatctctttgaaacgaagtaagcacccatccctcccagctcactcggctccaccgtggggacctgctgggggagccgctggctccctgaggaaagtgaaagccaataaaacatctcccacactctcgtgcagcgtcttccgtcctcccgggtgtccaggccgtccacacccacgctcttcaaccttctgggaggggcttcctcccaccccgcaggaggcagagtcagcttctccttccggatgcagccagtcaggccagggctctgcccggcggggccgagagctcctctctggcttgggggcacagcagtgggccacgtttgattttgagtttcccggtggctatccatcttccagcattgagaactaccagagtggactctgaacccctggacagagggttgtgggggggacaggctgggtcccctgggaca

SEQ ID NO: 135830 - DNA, 1051 bp, Homo sapiens
gtggccctgaccttgggtttaattgctgtaaaggaagaacagcttccctgagtggcctagcctgccctcctcatagcagctgcagcaaaagtgccaggcgtcaccagctgtgccaggctggaggtgacaccctcctcctgcctaagagcacctgcacctggggctgactggctcccgagcgcttgctggggagcccgagccagggtgtgggatggggagcatgcagaggccaagctgtctagaaggctgttccagccgcccctgccccgagggattcgagccggattggcccccagcctcggcgctgctctggccgctgtgcttgcccgggtccggggaagccaccgtgttgctgctgtttcccaggcatctggaattgctggggtgggaggtgtgttgtccggtggaagtcatattggctgccagaccttggctttgccggaccccagatgcccatgtccaactcaagatcacatggacacgaactgcacctgctctggggcaatgcctgggttcagaaaggagtccctggcacagggatgagtttgcccacagggcaggtagcaagaccaagaccccctcctccagagaagcaggcagacgtgagccctgtacctaccaacagagagtgatcctcatccccacctctgctcctaggtctcgctggactttgtgaagagcggggactatgccctggagagaatgggggtgacctatggtgcccaggctcacctgaagtcgcccttcgaccccaacaacaagagggtgaagggaatctactgagggctcagaccacatgccccatcccatgctgtccatccattctcacaggtcccaaatggccctgggtcccaggaccctggacccagccagaacttgtgccctccctgtccttagcctaggcctagtcctgcgaaaacccccaaaccagatacggacagagaccaagatggcccatcctgtggtcactgactggaaggcagtctctaatccaccccaatcctcccagaaagcaaacctgtaagtgtcttgggctcagggaccatggctt

SEQ ID NO: 135831 - DNA, 1377 bp, Homo sapiens
ccctggccaccctaagattctgcatatgtctgtggcctcttcatcccaacaccccatctggacctctagctttgacccatgtctctcagtacctatccatccaagcaccagagctccctgtgccaccaattagaaaatgcccagctttctctgtgagctgcaagctgcacagggcaggtggatggggcttcagagggccagttaaccttggctcccagtgctgacccttccattgtccagtggccggagcagctctgccttcacctatcagtctgccccttggaggccctcaagtctgacccattttttacccaactgccctatagaagtgtcaaggctactgaggcttaggtagcccacctagggggctgggaccactggttctcaaagtggtccttgtgtgattggcattaaaagtgcctgaagctgtaatttaataagcacatacctgggctctttcccagatccaggtattttctatacagcattaagttttagaacaactagtttgagtattactggataattcctgtcaatttgaccctgttaccattatgaaacgtcttttcttttctctggcatttattcttgctgtagtctccttgatctgcttttgtgacaccagctttcttgggattactgctttgtgtggcatattattttctctcatactacttaaacttttctatttccttatatttaaaatggatttcttataaatagttggggaagccagtctggtctgacagtctttggcttttaataggcatatatagcccatttacatttaatgtaattactgagctgtttgggtttaaattatctaactttattttctagttgtcacatctactccttttttcttctttcctgcctacttttgaattaatcaatatatttttaattctacttcccctgccctacattggtttgttagttacacactttttttcttaagtggtaaccttagactagaggttaccttaaatgagtacttttttactatttcccagacaatgcaaggaaggaccttgcgacttttgattgcatccattttcctcccaacttttgtgcaagcgttctcatgtatcttaattctatatatattcaaaccttagaagacattgtttttgtttttttgtttttgggatatatatatatatatatatatatatatttatttatactttaagttctagggtacatgtgcacaatgtgcaggtttgttacatatgtatacatgtgccatgttggtgtgctgcacccattaactaacctaatttacattaggtatgtctcctaatgctatccctccccctccccctccagtgtgatgttccccttcctgtgtccaagtgttctcattgttcagttccc

SEQ ID NO: 135832 - DNA, 1052 bp, Homo sapiens
ctcctctgaggagcatccttggaaaccctggctgactcctggtccactctgtgcccttcctctctatggagatgttctcaggtgcccagagatgacaccaccacggtcatgacccccgcccgtgttgccatgggattctccttccaagggcttgcaggcccctcagttgttcctgcccagggagccttaagatagtaacttggcgcatggtctaacagcacgcgtcattttccccctttgtgtggagaatgatgagaccaatattggcccaattagccagctgtgcgtcttttatgtttggaggatgtttatttccaagcaggcactggcgaataatctctcggacgccagtttgctccgcgtgggtttattgccagcagctgctatgtggaaggtggggatccagcggagctggaatgaggagacagggacctggtagggcaggtcacaggccctcagacccccaggctcccaagagtgggtgagatgccacttgccaaccgtggaggcttttgatgccattggcttcccccaaagaaataggaaatttctcagaaagctgatttcagtgttttcctttagtgtgggagtaaccagctggtggtggagaagcagaaagctggggaaacaaatccctaaagaggccttgcccactctgctggcatcctgctgggagagacaggcaggtgcagggctgggggtctcacagcccccaaactgactgttaagagcaggtttctctgcttgtcctcgaagggtctcgactgagttttgttccccgccataaccggggggtctcccccgagggatggtggccctttgtggaggcagcagggcctccagtttgccttcccggggagcctggctgggtagctgttagggctggaagactgagccatggccctgctgctgggggctcccctcgcctccccggagctggcctgagaggtcccgaggcggccggcgagccgtctggacttgggaatgagctctgactggtcaaggccagttcactccccaagttgtttgaaagctgggcgtcctgcaggtaa

SEQ ID NO: 135833 - DNA, 1050 bp, Homo sapiens
gattgcccaactcctattcattctacaaaacccaacccacaggtcaccttctctaagaggcagcccccaaccctaccaggctgaattgaagttcaccttcaccagatgcttagaaaggacagcaggacagtctctgccaccaactttcccttgtcttcctgcttctgtttctcactgctgagataaacgctccataagggtcattcataaaggagcagagcacagagaggacacctaactaggcctgggcctggttcactgtggtaggaggaagggctggggataatgaggtcccgagagcattcacgattcccatactggaggatctgagccataggtccatacgctgttcgacaatccctgctcctgtcccctgagagccaggccctgggctttgccgcttcatctcagccctcacaactctgcaaggtgggtgctccagcccccattttgcagttgcacaaattaaggctcagagagggtaggtgacttgccggaggtcacacagcatgcctcacatagcagagggggaaatgaaaccctgtgctgtggcccgggacattcccctgggcctagtccttgtgacctggcccaggggctgttcttttttggttcctgaatatttttagatggtgggaggctcttttactgcttagaaagaagcccccaaaaagagggagttacggccaggagggacagtccggtggacgggtctccttccgggaatctggtagctggggcctgtgcaggtacccgcctatgtggcttggcgagctgggtgactctcatgccctctctgagccctggtttccccacctgtagaaaaagcaaggcctccctccctcatgggtcgtggtgagggtctgccagggcgtgtgagaacaagctccctgatgtgtaaagcggttcttgtctgtctgtctgtctatctctccgtccgtccttccccacatgcacaccatccagttcccagccggcttcttcagaggctcgatgcgccttctctctgctgcccccaccccagtcccctggggatgaagcaccctgagg

SEQ ID NO: 135834 - DNA, 1058 bp, Homo sapiens
gttgtgaattttcaaagctggagctggggaaatggtctaatcagaagccaggtctattagtattacagtttaaagattgcttgaattgtaaaggaaagaggtttagttgactcagttccaccggactggggaggccccaggaaacttatagtcatggtggaaggggaagcaaacacgcttttcttcacatggcagcagcaagaagggcagagcaaaaggaggaaagccccttataaaaccatcagatctcgtgagaactcactcactatcatgagaatggtatgagcgatacgagggtcaccgcctccatgattcaatgacctccttccaggtccctcccacagcacatggggattatgggaactacagttcaagatgagatttgggtggggacacagccagaccatatcaccaggcacaggagtgaggagaaggaagggacatttggagcagaacgcacctgttctttgctttgggcccatagccagatgcccaacatgaaggtcaccttgaatgtctaaaggactccgctgactgcccagaccccagacactctgcagctgtttggggaaagtcaaagactggctcacagatgcagcttgtctcccagggaacctgcaaatgtggttttaggacaccagcgaggggcaccgtgtgagtgcctgtgtgctttcattcattcacacgatcatcgttcattccatcgtcagctggttcctaaacactctctgtgtgtcaggcttggaaccaggagctggaaacatattaagatgaagacacatttcctgcctcccaagacccaggccccatggggagtgtggaagccgaaggacagtttcagggcagtgtggtgggattacagcggagccacgtcaaaaaataagaagggacaaacgaaattaatcataagaatgtattttataggctgggcatagtggcttacacctgtaatcccagcacttcactttgggattgcttgaggccagaagttcgagaccagcctgggcaacatagatcctgtcactgcactccagcctgagcgacagagcaagacctca

SEQ ID NO: 135835 - DNA, 1054 bp, Homo sapiens
acaagcggtcgtgctccccattgaaccccacgtttgaggccccacagtcctcatggaagcacagtaaggcgtgagctgtccgggctcgtcccctagaacccaggcacctgctacctgcctgggaaggagggcagctgtgtttagggtcctctctttgctactctggtctttgtcttaaaaaccaaatctggctgccggctcctcagggccctccaagaaagcaaacccaagctgtcgtccctctagctgagatcctgagggtctgcactgacagacctgtgcttgctaccctcagcttggagacccctgcgcgtccaatgtgcccctccctctggactgtggggccaccatgcagctgtaggcacagtgagtggcacaggtggtgccctgcagacgccatcgtttctagcagattttcacagaagtcctgagggcaaggataggagcctgatttattatcccaaagcgagattcaagctgttccttctccctgaatcagtgacaaatggccgcccatgccagccccacgcaggtgccccgtaattccccggggaaggacgggaggagagtgaaggagctctttggaagcaggagctgtgtttcctctgctcttccttcggggtttgggtttgggcacccctgtagggtgttctgttttctggtctgtgtcctctggctggtgacttatttggctgtagcactgggactgtgattgtcctgcccagaattgagctcatggggaaggcctgttgggggctgggggagctccttgagcaagcagtggctcaggggcaggagtggggagtgggtgctgaggaagcttggggagtgggattggatgggtcgtttgggaggaggggctgctgcccaacgcgggctctgctggggatttctctgcactcagcacttggggcttctctgcttcctgtgcggacatctgcttcgtcccctcggcggtgcagtgggaaactctgcttcccgaagccgggcacgaggaaatgcatgctcaggaaggctctggtgggaggagagggatgcagccgcccctggggag

SEQ ID NO: 135836 - DNA, 1114 bp, Homo sapiens
gggctctcctggaaacctgctctctgctgggactggcatccctgtctcaccagggctgataaatccatcagccacctggagtgtgtccatcccagtggactcagagagaatactgtgattgactagtgatgcctgccatgggcaggggatggaagggtagtggctgctcctagacaggccctggggttgctgtccctgtcacagccgatcctccaacgtgaggccccgtcacactagggagactgccaaggcctcggccacccagctgacccttcatttcccagcagacaagtcggcaggaagtgcagggagggggaagagggccttcagctgctgcgtcacccagtcccccttggcagcctagagaggagagagatctcgcctgaggtgacacagcagattggtggttgcagagaacccccagtgcggccccccattctggccctcccaccccagctctccgagtagggatcctgcctgcagctcccagcttccgagtgtttgctggaggaaggtctgcattttaaacttgttgccttgggcgtgccatgcgggctgttcctcctgggtctcagaccagagcccctgccatccagcccgtggattcagtccccggcctggcccagcgcgtccacgcttctgcctctggccagggtgggacacacgtgcagacaagccgctgtggcccatgtccgcccacccaaaactgcccagcctggcttgtgtgatccggcgactgtgccagacgcgagagcgggggaagctcaggaagccgtttgtgtgctgccctcctgcaacagacctccactggcccagggaaggaaactgctgtgttcagggagaggtaaaaaaaaggaacggtgtttccagtagctgacagagcgttccatgttcacaggaggatctcagagctgtcctggttggggctgctgaggaacccgggagctgtctggggccctcatgggcaccgtcgggcacagagagtgctgacctgcaggcctggagtctggaagcttgggcagacccaagccttgcctcagtttcctcctcgtgaatcagacctgtcgtgtctgcgttcctgtgccatagtcctcattagtcactctgtccacct

SEQ ID NO: 135837 - DNA, 1050 bp, Homo sapiens
atcatttactcaggcgaaagagtattttgtgcctagaggcccagagagggcttctgttcacaccccggtactctggggccttcttggggaggtgagcttcacggggccctcagcactgactcagcagcttggacagtagtggtgcattgagaagcttgcggggaggacggagccctggctgcacacctggcacccgacggccccgtggccggttgctgtgtcctgggagcagcgggcatgtcgtccgactccactgggagagggtgtgctgcatgcctgcatgcctgtgcccacgtgcctggtgcccacgtttgggctcggctggacacgtgctttgttgcaggggctgctttcctgcaagtgcatttgccgtcctgagcctgctcactcatcgaattccacgtggtcgtctgggagtgattccgggtgcttcctggtttgaatttcacgggaccctggaggacatgaactcagaaagtgaggcgttgatggtcgcttttattggtatattagatgcattgaggttttgaaagggaggacttgggattcttctgtgtctttttaatgtcttagagcgtctagaaatagcatttgctcttcagttctctagaggggtctcccagaagaacaaagctgtgtgtggcagagtggttccctttagaatgcggagctctgggggagagcctggcgcttgggctggagccggcccaccaggacacgggctggagccccattcgctcatctgtgatttggggcacagaatttacccggataggaagcagctcaaaatacaagctggttccacccctttcccagtaagaggattttaagtttcttggtcaacatgattttataagcttttagggatagatgaagtagttcaacatttacttaaatatttaatttgctcaatcgtttacatctttaaaaacatgaaaataacatgttcttgtaagttgcccttttttactcagtgtgtgaaatgggtttcttcaaactcttcccctggctttcaagctcagggtctctgcctccccgagccctctccgg

SEQ ID NO: 135838 - DNA, 1195 bp, Homo sapiens
caaaattagcctggtgtggtggtgcacgcctgtaatcccagctacttgggaggctgaggtaggggaatcgcttgaacccaggaggcggaggttgcagtgagccgagatcgcaccactgcacttcagcctgggcgacagaacaagactctgtctcaaaacaaacaaacaaacaaacaaacacacacacacacatggcggctgcttcttgggaggcttaggagcccaggggttgagaatgggacttttggactcagatgggcctggatttgaggtctgcctgtgtgtttattaaaggcgcgacctcgggcatgctacatgactctgtgggcctcagctttcttacccacgaaatggacataacagtatcagccacgtggagttgtgaggcaggaacgaatgagctgccgtgaaggacttggcactgtcctggcactagttggggctcagagattccaggctgactcttacaatgggtgccaccgagaaggagtctgccgcctttccagggcccctggcctgggtttctgagtgtttcctggtggtggtggtagcccgggctagcagctgggcctgggtccggaccagcagatgaaagtgcgggaaatgcagacacaaggctcggagccagcgccgccttcctgctctctggttcgcttttctgccgccgcagagagtgcgctcctttgtttaaaaatagtttctagccgagctggaggcaccgagtcctctttagcatttccgacggtttccctattaatgtcactggaggaaaccaccctgagatgcctttcaagtggaaaaggagagctgtcctaatactgtgggcatatcattaggaaaagcaaattaaatcatgtttaatggtgttagagtctcaatcactttggaaaatggagttggtgaagcagggaaatgagaaattgctgacctcctgtggaaggaggtcagtgaaggagaatctgggagttgtgctcgtggaagtggcgatgggccggggcttagggggctggggattcagccgggagggtggggggaccagggcgggggaccagggtctccaggaggctgcgtcagttctctctcccactgtcctggtctccctcgggagggtgtgggtccagctagccttttctgtccacagggttctctctctgggatctgttcggtcctgtccttgggggcccagcataggtca

SEQ ID NO: 135839 - DNA, 1243 bp, Homo sapiens
ctgcgttgatgaatgtgtcccgcaggctctgtctggccaggggagaacacagcagtaaccttggggtattgatccagcaccccttatctccacacccaggccccgaggctgcatgtgtttgttcatttcctcttcgtatttgttcattaatttgctgagtgcagaagactctgtgctcacccgaggcctttctgccagtcggtctgatgactctgagatgctaatgctgcggtgagttcatttgcactccctgccttaatgctggcagtgagacgtgctagtctttgtagcagcatccactccacactaattacttattaaaatgcagtcgctcctcgctggggtggggagctgcctcaggctcccggcagagcccggcgcaggggctgttggcaaaggccttcagagtttctgcttgaaaacatttcctcttttatctgctagttgttgtcatttcaggacgttattcacccacccactttcagatgaacttgacaaccagatatgctgcacatgggcacagacacacacatgcacgcacacacacagacatacacacatgcacgcacacacacacacacacacggagtcggtaagcccatcggatgctgacccgccgttttataactggggatgggagaggtttttctctgctttcctttccaggcgggagccatgcccgtcattaacttcacactggacaagggtggagggtggttcaattttggtagccgagtccctacaggtctgatgagctgcgtgcctggaggtcaggctcagcccactgtgcttcatgtgaggtggctgagcctggcgcgccaggccaggaagcctatgggtctttgcctcaaccctgctcacaggatcctaggaggctgtgatttcaagacctgagttcaagctctgggagcggccttggcccatgagtggatcccttgatctccatgccagtggtgtgaggtagggattcttgctcctgtgccaggaaatgtggtgccaggttgggaacttgtacctgcttgagggtcattactgttggctttttatagaaggctgaggggtgaaggaatagaaaccagagtgataaacgcagaggggaggatctgggggccgcttggagtggggccaactccagacagaaaggcaagggtgcagggggtgagttggggtgctgggtgtgggtgtgtggccaagacctcaagagcagtgtttcagtgaatgccaggccccacgggccacctag

SEQ ID NO: 135840 - DNA, 2135 bp, Homo sapiens
gtctccctctcccagggatggccccatgtggaggctggtttgaccagtgttttccctgctcatggccctcacttgctgcttaagggcggtctccgcccactggcccttgggttttttcttctgccttccctttgggacaggtgtagagggtttccttaacccaggaggagcattgggaggggacccaccatgagtcagcctggttccctctgctcctggcccctgccacctggggagacctgggcagcaggcagatggacccctggaaaccctccaggttttggagccctgggaagcctgccaggtggtccactgcacctgccttctggtgcctcctctcatccaggctcggtggagccaggcgggccctggaggaggcaggcgggtgagagcaaagcttccgtcagacctggacgcgagttggactctgtagatacttggtctcgttgagcctttgtttctgcagggatcaaatgaagcttgagactgtccccttggaggtgttgctgtaaaggactcggtgaaaaaatgaacggcaggtcctagtcatttttattagcattttcttcctcttcactcaccccgcaagttccagtaggaactaaaggatccagaaggtttattccggaagtgtttctcttctggctgctttcctggtatttttttcaaagggttgcattaaagagattaggttttggctcaaataagttgtgtccggcttcctgtgctgcccggggtgggcgtgctggggccgagttatggccgagcgtgaagggtgagtccgcagcccttgctgatgggagccgttggccctgctccccgccacggcctgtagatcctttcctgttttcctctgtgccctgtgtctgggcggtttgtccagttgcccagctgggaaggagtgtggagaagcccatgggtcgccagctctggcggcttcttccaggggctggtttgccccagcttggaatccggtcgggcatttggagggaggattctggtgaggctgcggggtttctgtggcttgcttctgagattctggtccctggactctgcagatcatgatagttccgaccgtagggactctgatctcattgcgagctgggactgagcacaggtctgcgggagggaaggaaggcaccccggcagcgcactgactgtttaccatgtgccgtggtgtcgcctgtgttatccccacctaagcaactggtgcacggtaacatggctgtgagtttcttgggtcctcaaaccctcgctgtcctccctccccaggtgcctggtcatggcattgtcattgggatccgtccagctccttcgcggggccctgggcaggtggctttccctgagcctgatgtcctctcctgtgacgtgaggacagtggtcccgcttcccctgttgatcagagcctcctgggcaccgggtcacaggcagctctttgttagggctggagcggggtgagcagagcgtgatgaggatgctgttgctctctccctttgtggggatagttgccattgacagtgtgcacttgcaccctaggtcaggggacaaagggacagactcgttcaggaggtgagggctgcacttctgggcagaggacagggaaggcagctgggcagaagggagggaagaaaggaggggagaagggaagagggaaggacgtgtttctcctgagcagcacagggtgctccctgcctgcaggaggggggccccctgggcgcaggtgcttctggttgtcagagggaaagctctgtcctccctggtccctgccccttgctccccctcgctgctgtggagctgcttcagcccctcctgctgctgggctctctggctgccccctgcctggaaggttctccccagagctgctggtgccttcccgctctcctgcaggcccttactcagctctggcccagcagggcctgccctgatggcaccttgccctgtgcggggacaggtttccgagtgaagtctgatgctgcttctctggtgtcccagcccaggccaccctgcctggccccaggaacccgcggtgctggctgggcagtgcacttcactccagcctcactcggggcggaatgaaccttcccagaggaaatcgctaggccgcttctcttgctcgagttaaagagcagcgcgca

SEQ ID NO: 135841 - DNA, 1083 bp, Homo sapiens
ttttggttgtcctttatatattagggaaatgcaagtaaggtctatagataagataaccgtgtggtgtccatgttaatttcctggttttgctgtaggtactgtgattatggaagaggatgtccttgttcttaggaattacacactcaggtatttagggataaaggagtgtcattactgtagttaatctcgagtgttcagaaacacacacacacacacacacacacacacacacacacgcacgtggacagagagggactctaggataaaacagatgagtctgttgtctatgaacagcagccgacccctgccaggatgggaggagtggcctgaggcagaaggggctggggtgagcactgcctgctgtgaggcagggtgaggggtcagcaggggcgtatgtcctggctgggggaccctccgctcccagggcgttctcagtgctgcttggtttacgctcttaggctctgattctgacgtgcactatgtctaagtctgtccatttgtctaaatttccagtgagcagggacaggctctctgaactgctcttggagctgggcagtttgtccataggggacggttattgatgaggatgacaatcctgggctcttattgggctgtgtgtgccacaccctcccctcgcgaatccccgtgctgagctggattggggggctgatggctcccacaccccagtgcccactctggtcatcagggcacatgattaatcccgtgaggcaggtggcggtagaaaaccaggcctggcataaccactcaccctggtctccctgctggagtcagcagacaggattccaacctggggcccgagtgattccagagcgtgccccccgggccacctcacctgctgccttataagtttccttaccaagctgtttctccacgaggactgggcagatggccgttccgccccagccaagccttccgcccctgtggcacgtcaggcgcagtgagggccgagagctcactggttggcagtgggcagagaggagatgacccatgcattgatttgggaattctggcttttgtgctccctccacccttccactgtagttggcacctgccactctctgg

SEQ ID NO: 135842 - DNA, 1046 bp, Homo sapiens
gtgagctgtgccattgctggaagaccttctctccttctagcctggttcttcctgtaggagctggtataggggctccctccccttggcagcctccttgggtttcaccctctccccaccctgtcctccacgcgctttgaacctcgatctcactcctccactgttccaggtttctctctggcctcgtgtaatgaaactctttgtttcatcacacgatacccttgctgctccttctgcaaaactcagcagctggacagctggagagtgtgaaggatgatcctaatgacagacccagtgtgtctggagcacctttgtgtggctgccccccttccaggtctgagcccctccaaggcagggccacggctgggcttcctcctctctgggtccctcagaaccttgtgccttcattcgagaaataataaataaataaatatataataaataaataataataaaataaataaatataataataataaaaccctgctgtgtgccacgcaggctttgtgcctccaaggggagggaggagaacaggccggggctgtccctgctctcatgaggcttctggtcacgcaaggaccccagtggatgttgatgaggtgcttggtgactgaaaagcgacatggaagtgcccgaagggcccctggtgccagcagaaggggctgggctggtgtagccgaggtccacaacacagggctgccgggagcagaggagggaatgctggttgcaaagaagacaagggcgtcttttctttttttgggggggatagattttattgtctaaaaaaatttgaaaatatctcagtcattggaaaagttatgagtacaacacaggtaactttttcttgaaccatttgagggtaagtatggggcatcagtgcgtttactgcaaacaagggcattctcctctgtaaccacagcactgctgtctccatccagccaacagcatcaatccgtctccatccagccaacagcagcaatccgtgacccgtccacttctccacaattgtcccagcaaatgcccttcatagcatagagcagcctcaggac

SEQ ID NO: 135843 - DNA, 1242 bp, Homo sapiens
gaccctgacagcccacggcgggtacactgagcagctgcattggtgctgtcacttttttaaggctttctgtccagacttcaacactggtttcttttcagagtttcgaaggattaatgacttcctcagcgcccttgctggcgggctgagggtgacagtcacgtccgtttcttctgtattagaaggctgcggtgattcaattagattgtcccactgctgagacctgtagggcagcttctaacatgcttttttcaaggggagaggagtagtgacaagtcgtgtgtcggaattggatttgagaacactctgaatgacccctggaggccgagggggcaggcttcgggcgtgaactgaactccagacccctctttgtgttgggcagtgtcatcttgcttacaaactgtaagacacatttttttgtgtgtttgtttttgttgttgttcttttgcagcactcacgcctctgacagtcttttgggaaagagtaacacccacatacagaatttgtcacatccagagtagcactgttccttaatactggcataatgcttccaggaagtttttcttttttatatttaaaatgttacttttctgtatgatgtgcatgcaagtttaccgtaacttttcttaaactttttagtgccgtttctagtatattcctgtaaatgtcagttactgaaaatgagtccaatgtaagtagtttagcttgtttattgcaatgctggcctcaacacaacagaataaaaatggtagaaagtactctttgatgtttctggtaatcatggacccttctcctggggcatttgttttgttttcataataaaaagcaaaaaaaaaaaaaaaaaaaaagactgttttttttttttgcattttcctgtgctttctgtgggggctcccagcctctctcctggagcctggaaatgtctggaagcacctggtctggaacagccttcactggtccacagcaagggtgctgagctccccacacttgacatcctgtaactcttggcaaaaacacccagagcatccaaaaggggccccaaaaaaccatttaaaggcaggatgcagtggctcgtgcctgtgatcacagcactttgggaggctgaggcaggaggatggcctgaggccaggagtttgaggctgcagtaagccatgattgcatcactgcactccagcctggacaacatctcttaaaaaataataataatcaaaccattaagtagctcttgtcctgagccctggcagg

SEQ ID NO: 135844 - DNA, 1100 bp, Homo sapiens
ggctgggcctaagcgaagggtcatcgcagccccagcccggagcgtggagcccttggggggtggtcgggtgggatgtgcgttctccgctcgtggtgatgtcaggagctcctcggagggaacagagcggctgtgtatgcagcctgcaggtttccatacactgaagcttttacctcaactttaaaaaaaaaaaaagaagaaaagatttaaaaaaaaaaaaaaaggagactttttttgtaaggttcggcaattttctacggaagtccagcccgctgtgagtccccgcctggctagcgctgcccctgctgctgctgccgcgccacccttgggaaccacttcccgagcttatgtgtatataaatagttatttattaacatcattggtcatttttaaaaaaaagaaaataagaaaaaaccgcagaagaaatgcattcacacagtcgcagagatgcaggccttgccagtggtgtgccgggcgcgggtcctgtctggcggcggcctgtcgtctccaggtgctaactcctgccaccgcgcggtgctcacccacgtctgttcgcgcgctcgcccctgggtttgttgggttttttggtttttttctttgtggtttttttttttttttttttttgtatgaaacttggaggcttacaggtatagacagctttcagctacagcacattctaattttttattttgtttagttcttttgtattcacttctggtctctttaagactgttttaaaagaaatcaatttagggaaccccagttatataatataaactttgtaatctgagagaaaaaatgtatagtaaatctaagtcttgatttttaactttctattgtaaaaaataataatatacagagtttaatagaaggtgatgttttggttttgttttcccagaggctgccatatggtctttgagtacggggatgtcccaaactggcccaccaatgagcatggcggctccggccaggaatgccagagttagcctcccaggcttgcgggtggacatgcctgctccctgccagcctccagtggcctggccaggccctcccgagcctgtctgccctccccaggggtggaggagtctctgggccccaggagg

SEQ ID NO: 135845 - DNA, 1018 bp, Homo sapiens
cagtgtcgagacagggcccatgaccctgcccgctgaaggggtctgtctcctgtagtcactctttggacgccccaggcagagtaagcgctccagaaacgccagcagctggtgttcctgtcgctgctggtggccatgtgactggtggatgtttttgatgggcagcctttctcgcatccatcatttcctgttagtagtctgcattcatttttttcctgtctcaagtatattcagatagtcttgttgacctgattaatttcaataaatacttattaaacgactgggtcaggaagtgggtgggtcgtggcacccagtgtgatggtgtcacgctggcatggacgacatgccgccaagcgggtcaagaagcgggtgtgcgagcgcatctccctgcccatgtctccacagagaagcccggctcagcaccctcagggggcccgtccaggctcagcagcagcagctcctccgagtctgggagcagcagctccagcgggtccagctctgacagcagtgactcagaatgaactggcttcggacagaacaggacagatggatgtcgcacacgccgagactctgccgtacccctctgtggttcatattactacttctgttccatggtgtgcaggtctgcttcttaattcagtgttatgatatcttccagtttttgctttcataggtcagagatctatcttgtgtgtgcgttagacttgatgagaaggtgtgaactctgcagaaagtctcttcttcatcactgaattcagtcacttggagatgacaacttcaaatgctaacccgatgaccccagaaaaccgtgtgagattcgtaccgaagaaccttgtggaatccctttgcttaggcccaacctggtcgatagctcgagaaagaattttttccaaggaaatgtctcggatatgggtactgtatttgaaagctgttagctttgtcaacacgcattgtccttgtcatttgggccccgagctctgaccctcgtgtctgacgcggccacctctttctggaggggctg

SEQ ID NO: 135846 - DNA, 1025 bp, Homo sapiens
gcaccggcccaggcttccctgaagtcagtggcaggaacgagtcactgctggggtctgcaggtctggcagagtaggagggagggcagacccgaggcagcccttgtggcagcccccataggctgtcaagtgagtgcagggctcacttgaacttgcatgtggcctctcgggtgtgcatgggcctcacttgctccttttcctggatggaatgtctgtgtggtcatggtgcgtctgacccacggtaagtcaccgggtcaacttggagggagcgactcaggagtgtcaggcagtggagaccgggcctcctgctcgggcagatggagagcagcggccctggtgaggcaggtccatgaatcagaggctctgccctgcacatgagggacgttggccaaaccgcatcctgtccgtgcacctgtttgcgccataggaatggcctctgtcaccttaggatccaggctttgctcaccctgagggctcagcagatgtgggtggtggtgggtctgtctcatcccagtcatttctgccactcgaagccctggtgacagctttgcatctgtcagctcccagactcatgaaagctgggcagctggcatggatgccagtgtgcagggctggggccttggccacctggatgcagccctggctcctgccccatcggtctgctctgcagtctgagtgcccatttgttccccgacagcagcaagcgggaagaaacaggcagccaagtcgaaagaggagctagctcaggaaaagaagaaggagctggaaaagcgtctgcaggatgtcagcgggcagctgagcagcagcaagaagcccgcccggaaaggtaccgctggcggccgctgtgccacccctctttaggggggtggggggtgtcagcagtaggggtttgagcatcgagcaggcccacgtctgagtgtggcttacctcctgatgagctccatgttcttagacgagctcttgagctcctgaaacctccatttcctggtctgtcactgggggtcataccccaaccctgcagggaggtg

SEQ ID NO: 135847 - DNA, 1083 bp, Homo sapiens
ccgctgccaggctgtgcttcctcccccttctctgctttcctcgtttgcagtatgggacaaatgtcacccactctgagctgtcttgaggtcagattgagaaagatgtgaattgtttccccagacctctggcagccagccagatgcatgatttctgggaccccagattgggagaaaatagagcagggctgtcgagtcaggaggggaacagcatgaatcagggctgcaaggacagcgatggccctgcagtccccagagttgggctggacatttgattttgaagtggcaaggacacacagcagggaagacggctgtgaggtggcagctcctccacccgccctctgtcttccttgcacagaccacccagaggcagggacaggccgtggactcacatgggcagtgcctctcaaggggcctctcccatggaggtggctgcagtggggagggcgaggcgcttggcacaatgccagctgcagggaggccctggattaatgctggttgctggcagtggattgttttaaccccggagtcctgcgtgttatcaaatggcttcccagaaatcactgatgaaaatctcctttgtgtgggcatttaaacttctagagagtccttccttatctgaacaatggtaataataaaaatgttagctgcccacctaatgtagatgacgggttgatgggtgcagcaaactaccgtggcacatgtatacctatgtaacaaacctgcacattctgcacatgtatccccgaacttaaagtataatacattttttttaaaaagttagctgccctcaccgagtccctgttgtgccacccgcgcagtgctgagcctgtggccaggcagctcttccccactgcaggcgaagaagccgaggcggagagggctcatgactcactgggggtcacgggagtgaggggcagagcagggcccaggtgctcctggttcacctcctcacccagctgaggcagctccgacatcgccccaagccccctccaatcccagggcgccacgcagccccagtggtgtgggccgtgcccagcacctgctcagccgcccgctcttttccagctgaaggccgtgcacgag

SEQ ID NO: 135848 - DNA, 1908 bp, Homo sapiens
gccagtggatgccgaggccctggagctgcacgactaccacgacatcatcaagcacccgatggacctcagcaccgtgaaagtacgtggccgcgcggcaggccctgctctgcccatgtcctgcggctctgccgtgggtgctgatgtcttgtgccggctgagtgggggctgtcggggagcagggtctcgcttgccggagaagcgcaccctccaggctggcccccgcagcgccggctgtggctggcaaggctcagcgaggaaggcgtgctctgcctgtgggtcccggagtctgtggctctgttgttgtttattcccatcgaacccgtttagtgatttcattgatttcattcctacctcccattctgtatcatcaggtcagggggtccctagagctgggccactctcacagttggcaaagttttaaagctgcactttgcttccctcaagccccggatacaggcgcctcacagcagacaggagtgaggcggccagtggggatggcctggcttctgtcccctaagtgcctccaagccccaccccctcacaagacggaagcgggacctgggtgggtggcagagctgagaccgagagcctggcctcccccatgccagtcttctcaaggcggcagcctctgcctgggctcttgtgtgcctcacagcaggtcagagtgagtctggtccctatggggggtggtggtgggtgcggcatttgagctgcaccgccccaagccagggtgagctccaccgggtcttccctgagcacctttccagactcctggctggcacctgccctccctctgggagagctccaagccagctcccagggacgtgcaggcagttggcagaggtgtgacctgcctcctccgccaactgccgtgcggccctgggaagagctgctggcagccctgttgggcagttgttttcatcctgggaagccagtcgcagtcattctgcctacctgaggcaggatctgctgatgaaacccttttcttccttgattgactggatctcgggcaggacagacctggctggcccaggccccagagcccggtgcacagtcaggtgaaagtgacgagcggggccgcctggctccactgccgtgggtggggaagctgagggccagagccacgcagcccagaagctgccaggagcctcggctgcagcctccagggctggggtttgtgtgtctctaccatagcacagttaacaggaatttctggaacatcatggggggttccagtgtttgggctggactcaagctcagcttaattccattttggtcaaagggtctgatttgcccttgaaaccataataaagaagctctagaaaaacaattcactttaaagtcatgatctgctttgttcggagcttcccacctctatctgtcctggcatggcatggggagaagccaggtgcagtggcagcacttgctgcccgcgactgtggcccggacgctgcggaaaaggggcagtgaatcagggagagaggcctcaggacctctagattatacagatggagcttttggggatggtttatcccggcacatgctaaaacggaaaactagcttttcccccaacatcagaggcttccaggtcccactgtgcccccgggttctttctgccagcccttccttctggatgggtctcatgtctgagtgcatagggtacgggccctgagttgggggcgccctctgcgggttaggacccggcccctccatctcactggcacctggacaaatgcagcctggaccccacagagcggtcggggtagatttgccttgcccttgcgtgtgtcgtccctcgaggtccccgacaaggtgcctctccttgaagccatcccaggatgggaaactcactccctcgggcacagcgtgacctctctttgccccaactagtgtgttcccagtggccac

SEQ ID NO: 135849 - DNA, 1050 bp, Homo sapiens
agcttgttacttagggaaccgagttcagtaccagctttccatgactccagggtggcccttgactgccaggccatgggactgccttggcttcctcgttccgcctcctatggtctgtggtggggggcctccacttcatgcagggagccctcagccaagatgagccagaccaaccctgcccccaagatgcaggatggggggcatctcagcatggagggttcttctggccggcggtcttggcagcacagagctggtacccgtgttctggctggaggggtggcactggaagcttctggaaatactagtggagcctggtgtgttgaacatcccttccttgtcttgaaggtacacagcaagtggcggccgtgtcctctgtctccccagcgaccccctttcagagcgtgccccccaccgtctcccagacgcccgtcatcgctgccacccctgtaccaaccatcactgcaaacgtcacgtcggtcccagtccccccagctgccgccccacctcctcctgccacacccatcgtccccgtggtccctcctacgccgcctgtcgtcaaggtgagcaccctgagtccggatgggtggggcacctgagcccggccagggttcctgaggtcagggcaggagcagcaggcggggggcccccacctttccctgagtgctggctcttgggagtgtttctctctgcgccctgggagctcaggccgttgttactgacacagatgaggagacctaggcctggggagctgaaggtcacacagctggtaagggagggcctggctgaacttgaaccccagcttctctggccagaagccctggccaaaggcttggtcaaggtggggaagttgtgggagagaagccagggtgggaggggtcccggtcctcccctgctcacactcaggagagtggtgccagctgtacctacctgggtgcgttgtgaggtgccagcacccaagctggccccgcctgtgggctccacatgggagcatggggacctgcctgtcctgctccccacttggctgggagcttttctcagtgggccctgttggtc

SEQ ID NO: 135850 - DNA, 1854 bp, Homo sapiens
cgtcccggactcggggcgtcgctgcggccggggcgcgcagcccggagttggcgcggcccgcgcgccccgcgccagcccggcctccgcgcgccctccctcacggaagggatttttttccccctttcctccgcccgccatctttcgaagggggaacccagggaggacgcggagggggaaggtgcgcgcggcggccccggcctgcggccgtgcgctccgcggggccactttccccgcgcctgttccgccggcctcgctcccgagccgttgctggggcccgcgcctggggaccgtcgccgcgcgccgcggccggggcggggggcaaggccgggctcggccctgggctctgcgcggcctcctcccagagttacgggcccagagctgactttgagcccccctgagttgccggattattgcacccaaaccagggggagacccagttcccgttttgaaatcagcctgaaaatcgcttaatccgggcgagggcgagttggagcgggagggacgggggtgcttcccctccttcccacttttggggggcgccggagtgacaacgtgatacaagcccatccggggagaaatgcgcaccccgaaccgtgtacacccacatggccctggtgggctctctgtgaataaagctggggcgtgcgggaagtcttattccaccggttgctcgttcgggggcagggccgggatgggggcttcgcgcggcctcctttccctggagggcgagaactcggcccgccgagacccaccgggggcagggacccggcgtccatcgtgtgggttcctccgttcgacccaatccttgagtggttgcgatctttaattttggttgaaagctttctgctcagaaatagatactgggatttctcccccttacattaaacttggtcattgtctgcaaaagttaaccaggaggggagactgtagtgcattggtgggcagagtaattgggctggaactgcaagaggcagcttcgtgtgtcccgtcctcccccgccctaccctgtgagaaggaacagaagaggaaaagagttttctttttaccctgctcttttgtaggcttttccccttactcttttctttaaaatggagggttttttttttttcctgggtccatgtagtatgcctggggagatcctggaatctatgcaaagttgtatggcatttttctggggaaagtagtttgttactggcttccaacggggtctaaggaaggtctgaacccctgcaaggggctggcctcgggggttagggagccctccctccgggttcttccctggcagccctgatgcagcctctcatttgcaaataaaggtctgtgtttgccgttttctctgttgaggccttgatgggtgctggtggttactgatcatgaaagataaggcacacgctgtaacaggacgggctgcaggcgagcgaggggcatttctttctgaccttccgggtagcctcagaggcccggtgcctcagcagggcaccgggtgcctggaaagactgtgggagcagctccagcctgagccctgccgttgggacatccggggaggagggatttcaaaagctttctccgagtgggcagtcactccatttttatttttgttttgtttttagaaagtagagtaattactttcctttgacaacagctcgcgcctgcttcggaagtgagtgagctttgaatgaaggacgggacttgcaaacagtgcctgccctacactccgaagtagtcatacccagaaagtgaaagtgggggtgtgcagagcgaagcagccaggcctgctgcagccggtgctaccttcctctaccctcttcctccaggctctggagatgccagccgcgggagccctgtgcaccaggc

SEQ ID NO: 135851 - DNA, 1076 bp, Homo sapiens
atgtggaaattccagcaggcagagctgcctctggcttgctctcatctctgtgttttgtggctcctcactgagtgcgcgagccctgtgagctgttagcatgctggaaggcagcctcgggccagcagcctgtgcatggaggcactggagcccccccatgaggcgtagaccactgggtgcccgtgcttgtgttttcaaacgtggctgtgaacgtgattgcgtcacttggggtgcattttaggatttggatgtgatcccaaatttctacaccctgaagctcagtcttctgtcatttggcgtgttagctttctgtcaggaaaccttttgctgttctttttttaatgtgtccagggctctttgaagaaaactgcattttgtttgcacaaactgctgcattcttacagacttctggataacaaaataagaagcacgcttgagggtggggtctttcattatgatgacaaaaggggagagcgcaggggtgtcagcggagcagctggaaagtattagcaaggacttaggggaattaatagggtcctcaatttggaatggtttgtttgctacagggctcaatatggtagtcaaatgtttttcttttcatcctttttcttggaaatcaattttttaaaatatagtttgtttcttggctccctgttctgcatctcgctcaacagactgcctctgtcaccgggtccctccacccttgtctcctgtgcggccagcgtcagagccatggcgacggaggagaagaagcccgagaccgaggccgccagagcacagccaaccccttcgtcatccgccactcagagcaaggtgcgtgcccaggggccccttggacaccttccgggggcaaatacgcttagagagtctcggaaacatctcaagctcataagcctagtcttccctactcagttaaatgtcactgctaatttttatttactgaccgcatatctggcgaatgcttgttgcctgctgtgtcagggatcccaaatctgtcacctggaggagagagccttttatcaaaaatacagattcttggttctgattgtaagagtctctgtaggaaccagaaaacatct

SEQ ID NO: 135852 - DNA, 2017 bp, Homo sapiens
atcacgaggtcaggagttcgagagcagcctggccaatatggtgaaaccctgtctctattaaaaatacaaaaaaagattagccgggcatggtggcacatgcctgtagtcccagctactcaggaggttgaggcaggagaatcgcttgaacctgggaggcagaagttgcagtgagctgagatcatgccactgcactccagcctgggcgacagagccagacaccgtctcagaaaaacaaaagaagaagaaagaaaagaaattgcccgtggaccctgggagggaggggaaggggactggtcctctcaggcatgtggccgtgctgaatgggttctgagccatgtggttcatgctgatcacctgggactcatgtgggaaaagctcagactttggactctggatgactagacaattgtgtcctgctcttagcctcagatccttttgttttctttcagctgctgataaacttattaaaatttggggcgcgtatgatgggaaatttgagaaaaccatatctggtcacaagctggtaggtttcagccctgtgcggtgaagttgactgttgaacagggtggctctagtgatcaaggggtcagggctgcttcgagagctgtgggttcaggttttaagttttccccgttttttaatttttttatagttatttgcatcttgaacttttaacccaaataacatttgacttccatggaggagtgtctgtgaggctggcagagctgcagaaagcctgctgtttttctcctgggccgtgtgtcttttgtaaggttaacactagtgagaagatttcctgagggcaatggggatgtttgggattttgaccttttgccgatggtcctattttgtcctgtcaagttactgaccctgttttttctccccaagggaatatccgatgtagcctggtcgtcagattctaaccttcttgtttctgcctcagatgacaaaaccttgaagatatgggacgtgagctcggtaagtgacactcagtgcttctctccaggggagaccggctgcagggcacggggcaggtgcgggggactgagttgactgctcagtaagcaacactcagcgctcctctccagggaagactggctgcaggggcatggggcgggggtgggtgggggaggccgagttgacttcggggaacagcaagtcactggcggggcatcaggcatgctttgggatgtcagacattgatgaatgtgacctgactcttacgtttggggaaataagcactggaataatcctaataatactctgttatagggcaagtgtctgaaaaccctgaagggacacagtaattatgtcttttgctgcaacttcaatccccagtccaaccttattgtctcaggatccgtaagtgtggctggggtgtcttccctgggggaggtggtgtcggatgtgggaaggctgttgaatttgcttgtagccactgtggagaaggcaggtgggccctgagtcctttctgtgctgtttgtggggaggatgggctgatagcaggtcttaggttctggggaggtttgtcccctctccttcctgtaaaatcactgtcatctcttttgtgttcagtttgacgaaagcgtgaggatatgggatgtgaaaacagggaagtgcctcaagactttgccagctcactcggatccagtctcggccgtaagtccctctgacacggatggggtggtgtccagcactacgtttctctgacatcggatgtggccagctgtctccctgaggggcgtaagcctggccatggcctgtgcctagctgattcctgctgtcatgccacagtctagagcaatcaggttggaggctgggacttgagaaatgagtcctgtgtgcagtggagggatggcgagggggtggtgaggtgtcagtggggtgccctgtgatgagcaccaaggggccgtttgtgcagacttgggggcagtggccacaggcgttcaggaggtagtgtaccctgaactgatgcacgggacaggaagggcggccaggctgggaagggcactgggag

SEQ ID NO: 135853 - DNA, 1059 bp, Homo sapiens
tcgtgcttggggaatgatttgtccacgtgtgacccgagcctgttccccgctgctggcatctgtgcagtagaattgtgggtgctaacacagtgggctctgcttccagaatgcgtctgtattggcagaaatcacagaaaccctgaaattggaacaatgtaaatgcctggcttgtaccttctgggaatagtccagaagactgcttacaatactcttaaatttttgttttgaaagaagccctctcattgcttgcatgtgtttgcatgagcgtgggcagagcctgcgagaagcactgggctgctgctgcccctctccttggccagggagagtggagagagcaacaggcttcccgctctgtgttgggggtcaactgtggcttgtgtaggagagatccagaggtaccccacacatggtctgcacgtgtgtagcatgtgtggactgttgatgtttgtatggacagtgtttagtctttgtccctagaatataagagaatgactgttaaacaggtgaagcataacttttaaaaaaagatagggaaaagcgtgctagtcctaaaatttatatctgactcccagcagcccgcgtgagatcataacttgtctgcttacgcttttttgttctctttgcttcgaagtcgcatctgggacaccgcctcaggccagtgcctgaagacgctcatcggtgagtgtggctctgtgtgggggctgggtctgtggggagggcctcccctgctgggttcactgcccctgttcttcaccagctcctcctccctcctctgccctgggtccgcccctgcaggaggaaccttcctccgtgtccgaccgttccgccagctccccctgaccgcccgctggctctgttgctccttctggtgcagttttcctgccatggcctttctcttgggccagcctggggctcctccacctgtgctgtcggcctcactccggctgctcactggagtcctctgggcagccccattgcctcctggcttcgggcccctgctgtcgtgccagcctcttggatcattccttgagtgaccggctgagtgcctgcccatctgct

SEQ ID NO: 135854 - DNA, 1983 bp, Homo sapiens
gaaaactctgacctgtacatcgacagcttctgggaaccttgactctttttcagctgtgtgagaagcagcggctctgctctgccctcagggctgcagagtccagctgataggcctggggcattagctgtggatgtgacaacaaacagatgggttctgtgggtgcagatgccccttgcgtcgataaattcttaaaggagaatttccgaggtgattccccagccctctttgctgctggtggagttgtccctctgttgagttgggcattcgccagccttatccatcccctgtgaggcaggtgattcctgagagtgcccatggcctggtgccccaggaggcctgtattcgtaaagtcctggtgtcaaggggcccccgggcctatgggcttgaggtgtcaagaacctgctcacggctggtgtgcgtggctaggccacccttcggggcggcgaggggtggtggtgctggcactgatggtggtggccgacctcactcagatgtcgcacgtgggggatggggagcgggtcccacctcctgtccctgcctggctgtcagcgcccgccgtgtgtcacctgtccgtttttattgcagatgacgacaacccccccgtgtcttttgtgaagttctccccgaacggcaaatacatcctggccgccacgctggacaagtgagtactgcgtgggactgtgggggcgggcatgtggcctccccagccagagacacctgcgtgccagcgtgagcctttggagagcgtgttgtgggcttggcacgggatccaggctcctggtggagcttcggcttctgggcagtggcctgttaggtcggagggcaggcccccgtccatcccttcccgaggctgaacctcaggtccgactataggaggatttagggtccgttttctggttgagcaactgtggccagggcaggcctagccatcccgcatgaaggagtcggcggtccgggggcctccaaggccctttctggttctgacctctgagcatcttgattttacctctcacaaagccactgccctcctgggctgttctctaagctccagctttcccatgcgtgcaccctcagccctgtgggtccgagcctgggccctgatcctctgagggctgtgtggttgggtggtaaaacctgttctggatgtttccagaaccaagaggacttcctcacccttttgaggatgacccgagtcagggacgataacacccatcagcttcctgttaaagtctctcttggaactacaaatacttgcggctgtcacactgtgctctcagacgccaagtcactggactttgagcctgaggggctccttaccctgatggggaagggggttccagccccgctggcttttgcacctggcgctgatggtggctgtgacgtagtggctgcagagttgggtgtggggacagaaggatgcctccagacatgccgcctcacccctctctctgtcttgcagcactctgaagctctgggactacagcaaggggaaggtgagcccccgcaggcttgggcccccatggtgcaccatccctgggtcatggcctctggtggggacagagctggccccggtgatgacaaaggagaggagctcagagagccatctccgctgggtttggtgcgaattcctgaaagacctgggtatttgtagggtggcagtctgcaagttaaatcttcgattgtgtgggtttggtacttgtacttttcagaaataagtgaagtgagtagtgaaacgccttgcttagaacgtagaattacacaaaatcaaggggaaccatgactctgtgaccagcctgtcccctcctgtttcagtgcctgaagacgtacactggccacaagaatgagaaatactgcatatttgccaatttctctgttactggtgggaaggtgagtctcataaccttgaagcgtctcacctgttcccagcttactctcccgagaggtcacacctgttacaggttgctttatactcagagacacttt

SEQ ID NO: 135855 - DNA, 1822 bp, Homo sapiens
gggtccgaggagaagagggacattgtcgataaaggactgaggactgtgaggggtctgactgcagtccttgtgcgcgccagcctctgagccagtcctgctgccgcgctcctccttgtgggcgccgagctgctgttggtgggggcgtgtggggctcctggtctgcaggcagggctggcactccctgtggcctcctgcccctgtcccccaaccggctgtgtcgccctggtaccggctgctgtcccctcgctcccctcccctgggctccctgtgtcgaaggtgggcagtgggtgcttgtcctgtgacctcccaggtggcgggcaggcgctacccgcgtttctggagaaaggtggagctcagtctgggatggcgtccccgacccaggcgcagggatggctctggttctgactgtgtctttgttttcagatgtcgtgatctcaacagcttgtcacccaacagaaaacatcatcgcctctgctgcgctagaaaatgacaaaacaattaaactgtggaagagtgactgctaagtccctttgctcctgcccgcgagagactgtcgggaagttgacccggattggcaagaaacagggtgtcttggaggtggtcccccagatctgcgcctgggggtcaggacagggcctgatttgagcctcctctctgaagatgatttggccgagcggaaggtgtggaccaccggaaagttcttaaaagttgctggtgacatttcttgccaattctaacactgtctagggaagagttcctagtctattgtgttcaaacagagtcaacaaaagtttttaattttttattacagaagggtgaagttcaatttaacatgcgttgtgttttttcagtaaacgttctgtatctttttgatattccatgacccagtgcacgctgtggcctgtcaccgccaccgtggccccgccagctggcctcccctttggcccacgccggccgcccccattctctgctgcgtagatgccctggcccagggccctgactcctccattcccgccagtagctgttcctagtgtattttcgtctttctggaaaacagcattgagtggttgttttctgtgtaaagagccgtttgtgtcttgggagtttgtggcccacatgccgatagcacggtcatcgcacatgactctcccgtttgtctcagtgtccctgcaacaagcagcaccgcagactgtaataaaaggtggggttttgtgaatggttgtggcaagtgcgtccttgtgaagctcgtctccatgtggctttcttggagaaaggctcccctggggcaagagggtggaaggtttctttggacaggaggtgctgaggctggctgcacctgctctctgaagacgccttcctctctaggttcattgttcagtgttgctgggggcggggaacgggggtggggaggttcttagttgcgaaggagccaagctcctgatggacttgcgttgggatgtgggggacacctgtggcatggtaaggctccctgagtcccttactccaggtcagatgccagtgggactcatgcgccctatgagggctgcagggccagtgctgcccctcggactcctcgaggggttgggtgctaagcgcgagcctcgccgtccctgctggagccctcgcctgcctgcccctctgcctgtgctcctggcagtgtggcttcccggtgctcacctgcacagcagttaacagcagaggccgagcgggagcctctggggagcgaggctgaaacctgaacctgcccatggagacagttgtggtgagggttgccacacacagtgagggcggagcagggtggctgagggcacaggtgcctggg

SEQ ID NO: 135856 - DNA, 1050 bp, Homo sapiens
gccccggagcccagccagctctgcctctctcagggcctggagtcctgggggagctcagccagctctgcctttctcagggcctggagtcctggatgaatcctgcaggtttttggttgcaccggcccagggaggaagcggggggtttgtcaggtgggctctcctggaggtcctcgagtggcaggggtgaggaggggattatctgaggcatctggagatgtatatcctgtggtttcccctgcccctctgtttccgatgaggtgtacggatgagtgacctgcactaagaagtgagttgccacagtgaaaatgggttggtttttgtcttcgacgctcagggtctgggcgcctcgcatttgcagtctgttgtgacagacacggggagctccgcgtgccagcctgtggctgccctgctgtgggggtcctggggccggcgaggccccttcagtcttgttctggggggacggcccactccggggagggggtgtgctgtgctgagcgctgtatccctgaatatagtttattttttctacatttgaattctgttgtagatttatgtaaaaatacattctttttgaaaataaaaattttcatgtcttctaatttagtctggtgagaatttcttaacttaaaacgtagctgtctctgtggggtgggagggcggccgccctggggctttgtccccggtggtgggggtggtgtctggtgagccagggtgccccgcaggacagtcctgggtttttacagtaaccttaggaaagtcatctatttgtgctaattattctatgtattttgtattggtttttccactcttaggtatatacctgtgtgctaattactgacagtgttaggcaggtaggcacggatgaggagaggtcctccaaagtcctgctgccaccaccatgctggggcgtatcttccaggatatgcgttataaactaacaggagctttcagatgtgaagagtgtggcgccccccagtttcctgtccctgctgcaggaacttcatcgttgttcatcggctcctcctgttatttcagtacaaatcccagaca

SEQ ID NO: 135857 - DNA, 1055 bp, Homo sapiens
cttctctctttgggcactgaccttccttgcctggaaccttccatggcaccccattgtccccaggatggaggccaggcctccacctagtgtcatgtggctctgtagcctctcccacctcattaggcacctctcactgattttctcatgtctaaaactaactggtgaggtaggctgccccatgcgatgagtgagcgcccctctgagtcacaggctgtatggccctgggctagcaaattcacctcactaggcctcagttgtctcacccataaactgcctgggggaggtcagggaagcttcacagaggaggtgatgtagttgggttttgagggatgagtaggagtttgttgggtgggaagtggggaaggaatcaaggcagagagaatggatggattctttccagggggatctggttctagccaagggtatggggaagggatgcccgtgcgggcgtaagtaggggcttccctggagggtttctgagggtctgactgtgtgaccaggctcctctggcctgccccttgctggctggcttccaggtctgtgctggtggggacccctgtgagcatgaggctatggtcagctggcctgggaataattaaccctgggaggagctcaggctaggggtgggcctcgctgcagcctggccgcccccagctggcctgatgtcccctctccttcctgcccaggtctggagtgtgactcctaccggcgcccatgtgcggtaccccacctcggggccctggctcccagggtgtgtccactactgggaggaacggctggggcccttccctaccacctattcctataccccttggtctgtccctgtagtgccctgtggtcctgccttggtccctgcctctccctgtgggcagcttaggcgccatttgcccgggagccccctgtgtgagtgcaaggctattggatggcttctcgccctctccccacccggagggaggaaaacagctctgaccgtgagcagagtccacgggaggcggtggagctgcccctaccccaccccttcatggactttctgcccaggatcaaggtcgaggtgt

SEQ ID NO: 135858 - DNA, 1607 bp, Homo sapiens
ccagagcccagagatcctccctccaggactctggagacagccgccgttctgccctccctgctgacccctctgccctccctcaggtctgcctggccgcctttctgagaacaaggagccgattgttgtcaccactgctgtctgcctcctgctgtggatgccttgcttggcgctggcagtgcccacaccggcagggacctggggacttggagccggacctaggtcgccggccgtgtgcctggtgtcggggcagggctggtggtcaccccccctggggttggccccgtgggctcagggccctgcctccctgtgccctgtccgtagggaccctctcatgccctctggccagcctggagagctcttggcagaaaggccaggactgaggtggctggcatggcgcctcccgcgctgttcctccctccctgcctggccttcaggggcgcgtcgtcctccccagaccctcctctgtctgcgtgtgagcccgtgagcctgtgtgggcttatgtgtgtggctgggattccagccagggtttgtgcgcgtgagcctctgtctgcgtgtgagcccgtgagcctgtgtgtgagagtgtgtgggtgccatgcctgtgtgagtgtgtgcctgtgtgtgagcctgtgtgtgggtgtgcatgcccacgcccttgtgtgagtgtgtgtgagtctgtgtgtgtgtgtgtgtgagcccgtgtgtgtgtgagtctctgcatacccatggccttttgtgagcctgtgtgtgtgagcctgtgcgtgtgtttctgtgtgagtctctgtgtgtgtgagcctgtgcgtgtgtctgtgtgtgtgcctgtgtgtgtgtgagcctgtgtgtgtgtgtgtctctgtgtgtgtgcctgtgtgtgtttgagcctgtgtgtgtgtgtctatgtgtgagatcccgtgtgtgtctgtgcacacccatgcccttgtgtgagcctgtgtgtatgagtctgtgtgtaagcctctgtgtgtgtgtgtgtgtgagtctgtgtgtgtgtgagcccatgtgtgtgtgtctgtgaacatccatgcccttgtgtgagcctgtgtgtgtctgtgtgtgaacctgtgtgtatgtgagtgtgcacgcctgtgctcttgtgtgagcctgtctgtgtgcacccgtgcatgtgtgttcctctgtgcacatctgtgtccatgtctgagcctgtatctgtgtgcacccatgtctgtgtccctctgtccctgtccctgtgtgagtgtgtatccgtgtgcacttgtgtcctcgtgtctccctgtgcccgtgctgtgtcggcatgtgtgcctgtgtgtgcttctgtgtgtcttgtgccccacaccttctgatggcttgtgcctgcgggtccaggtttgagactggccactgcccgtgctgtccggctccctccttagctaagggtcctgagggctcggggtccaggacaggagaatgagaagctgtagggggctgtggagggctgcaggcagatatatgttctagaaagactttggccatcgtggggatggtggtttggggcagaccagtgatgccacccactgacctttcagccagttcccaggaagtgtcacaggggtgataattgtccagccaggagtgag

SEQ ID NO: 135859 - DNA, 1050 bp, Homo sapiens
tcctttgattagaggccaggaaacccaatcccgcagcctaggcagtggggggacctccttctagagaggccccagcagattatgggattttcacctgcccagccctgggaggtgtcttggacccagagcatttggccttgggaggtggggagggggttcctgccctggagccagggaagctgtctgcggcccacagttcagggccccacacagaccttttacatgctgtgtgacctggggcagcgtgtctctctctctgagtgtcgactttctcatctgtgacgtggggtgagggcacttgctgcccaggtggttgtgagggttgactgaagtaaggcctgtccttcagttcttgcctgggagcagggaaggccctggctggggttgcctctgaacctcagtgtctttgagggctgggaggaggagtttcttcttctgggttctgggggttcatgcaggattgcccgtcagcatcctgcagcccctggaatagggggcgctcagtgtagggcaaaggaacgtgaggagggcatgagtgttgtatctcatgggaagaagcatttttttgggaggagtggttgcaggggcagctagttctggaaccatcctaggacctagaaattgctcggggccaggaagcgagaccagtcactgggtgcaaccttgacataggcttgaggggtcacgtcccctgccctgtccccatcttgctcagtggccagaggagagaccgtgtgcacttggtggactgccacgggcctgggggcctcgggaccaaccctccatccgcccgtccccagccgggcgcggcactgagctgagggagcctgcgttcttccttcaagcagaggatcttctgcaactgtggggaagagtgtttcttcccggaaggcggggccagctggctgggtcagcagatgggctcctctggcgtcttctcaccttctggccggtcattggccctcgtggccctaccacagtggggtgggcatctccccataggccctccccacaggatgcagcccttcctcatggggcctggtcctgctg

SEQ ID NO: 135860 - DNA, 1307 bp, Homo sapiens
gagcaggaggggggcctggtcagtcagagccagcccctgctgtgaccccacacccctgtccggaggagcacaaggctgggggaggacggccaggggcctgcgttgatgggcaggttccaggtatgcggagggtcactggccagcgtggttagggaaagccctccagggggatgctgcgggtgggcttgtgcatgggaaggagcagccggtggggaggtggagaaggacctctcaggccaggggaacggtgtgtgcaaaggccccagagtggggctcactggcaggggctggggcggtcagttcagagctggacattgaggtctggtggccaggagggggctggtgggtgacagagccaggcaggacatggccagaggtgctgggcctgtcctgacagtggtgagcatccttcagaggccgtgagtgctgagtgagggtcctggctgccggtgaggatggaccccaggggcaggaggggagtccgtggccacttaggaggcagaagcagaggtggtcatggccatggctgtggggatggaggagccggtgggtctggttgcagttacagctgtggccaacaggccgggagagagggcttggggtgaccatgtggtttgggcctgcacagtggtgctgtttctagggacatgaggcaccaaggggagtcgagggtgccaggcgcggcagttgcgattgaggtcatgcaggacccctggcaggttacaagagcagtgtgcattgaatgccagagctctgggggagacctggaagcctcccaggaggtgaaaccccagggtctgtggttggagcttggaacattttggcggcaggaccagccagggttttgagaaggaggacagagcagcatttgctggtgcagcgggcatcgtggtgcgatgatcttcaggatgcagggcagtgagagccaggtgcagctcctctgagctcaggctggctgagagggtccctgtagcccagttttgtcccgaggtcccccagggcccatgtggctgcttgtcccctgctgcagatggggaggccagtcacgggcagaatgttgatctgatcccgggggacgcaggtggccgacacgtgggttgagtcttggctgagttcatccaggcttgaacagccaccctgctgtggcactgcgatggagggctggctcctgcccagtgcttcccggcctacgtacgccctgtcctcggggtcctaggctgcatggcacctgcccatccatccgctgtcaaaggcatcacgtgtccgccatgtgctgcctcaggcacaatgcaggattcggtggtcag

SEQ ID NO: 135861 - DNA, 1054 bp, Homo sapiens
caggcctcctttccctggtgacctggaaaagcatggactctgctggcatgtccttccctcctgcccctgccaggtggagcagggtggggcctttggggaagctgcctcaccctcacctggcttccttgccccagccctgcaagggaggggaactgtgtcaggctctcgtaggtgactctccctgggggagttctggggccttgggtaggtcacctcatcaacctcagccttgctctcctcattggtaaaaagcggggaagagtttctaccttggattttggtaagggggagccattgtttagctcccaccgggaacacacctgggatggccttgggctggggattgcatgctggccgggccggggagccaggagttgctgcctgtgctcctgcaatgcccaccagggctttcggggtatatagagcagcacggtctgcgggatggaggcccttcctgctgacacaggaggctggggaaggtccgtggctggagaaggtccgtgccttgcccagaagtgtgtcttatcaccaagagatggcccggtgcactgagcacctactgtatgctagcactgcggtggccgtcctgctcagcggctcttggattagccatccttggctgcctgcaggggaggacgagtgttctcaccgttgtcctgctatggaggggaaggtgacaagcttctctggtggcacctgtgcctcaaagtgttgggaaagggtggttttcccaggtgggggcccctgccctgccccagcctcaccctgcctgaggccctgctcagccaccaccctcgatggccctggtagaaagtgtctcccgacacctccgcaccctgcctgtctcccagcctcagcagccctggaggtggcccaaggcccatgcccatgcccagtgctgggcacccccaggaagctcagaggcccccaggcagagccggggaggcgtgaaggcatagccagggcagaagcagaacaaaagaaaagaaaaaaatccacccccaaacccacccagcccacaccctgaatctccttatctgtgtctccgcagcct

SEQ ID NO: 135862 - DNA, 1048 bp, Homo sapiens
cggggacatgggatgagaggcgtacccactgtgctccccgacatccctgctgctcgctggcccgagggctggctcctgcagcaccatctccacgggaggccgtgggccgcttccaagagggctgctgctgggtgtgccacccaggccccggccacctgccgaggacggagccaggcgtgagcccgtgcaggacagagtggaaacaccgagttctgcctgcacagtccttgggcccttgctggagggctctggctcacgagccaggagatgggcaccagtcctgttaggccgccaccatccactttcctccggcagcaggcaggcaggcaggcaggcaggagccacagctcagggccaacaggcctccctcagcctgggtagggtggagctggagggagggcttcctgggggaggtaacagggaacatatggggaacagcatatgcaaaggcccagagctgggagagttccggggcctgtaatggggaggtcagtagctgagcctgtgcagtcctcagaggccttgtgcagggtctggacttggccctgtgggtgccacccaggaactgacaaggtcttgttccagagacttccccagaggtctgggacctgctttccaggctcctgtttggatgctgttccagcccagcagcactgccctaggccctgccctcccctccccgcccctccctggtcgtctgcaggactgggcagagcccctggaccctgcctgagacaagcagtttccagggcaggcctgggccccggctggggtctcaatggggtgtgctggctttgggaacgttggcaggtctgagcctggcctatgtaagtgctgcttgctcatgtgggtggtgagggctgtgggcagagggccaggagtccccggggcctgctgctgggctcaggggaagggcaggcggagctctggggccaacagccccacgtggcaggggattttcattaagcgttgcgcccactcctaccccatgcccagttctggaaggctcaacagggtccagggagcattcatggaacagctgctgggg

SEQ ID NO: 135863 - DNA, 1049 bp, Homo sapiens
cctagggcaccaagttcagtaagttcactttccccgggggctgttgggtgccatgttctccctgtgccatgtgccctgtgcctgttggatgccacgttctccccatggggaccttttgggagtcgtcattagtgatggaagtaacccaagtcatggccacgggcgagggggtgggggcctcgttgctctgtcctctcccagtccagcatgtggcagggccgtcgggcctcagaggtgtcccctcactcagggagcctggcggtgggccctgtccacccaccccattttcctgagcagcgggaggtgggaaggcatccgtttagggagtcagctaatttcatacctctctggtttctcatctaaagcccagccctcatgggcctggtgtggcaccacaagcccaggctcctgggtaccgtgcccctcctctgcagggcagtgtgtctgtggggcagtttgcttctgtcctgtttctgggatgggcctacactgccctccagggaggccccaaggggtgcaggtgagcagggttggcaacggcagctttgggcaggacgggcactgtgccgcacctgtgcggcaccgggtgtggctggcacggtttggctgctgtctgcctgagcactgcctgtgctggccagtgcgtctcccagtccttgggacagccttgtgggaggcccaggccgccctgagcatggggaccccagggccggaggtgcgacctgagcatggggatcccggggccggaggcgtgacgtgggtctcctcatcccgacctcagctccagacatgtcaccatctcccccgggtttggcattttttggggaaaagcctcccctaaaaactgtacagccagaaaaaagaagaagagaaagggttgtgccaagagccttgtggtgggcatactgggtccgtgccgggcttctcctctcccagttgcccctccttcagcccatgtttccatggtgggcataccgggtctgcaccaggtttctcctctcccagctgcccctccttcagcccatgtttccagactcctccacaaccgt

SEQ ID NO: 135864 - DNA, 1048 bp, Homo sapiens
acaggtgggaatgggggcccactgcctgactccctgggacccagctgggatctggtccttggtcttctgatgtcccgggtcggaaggatgactgtctgtcccatggctatggctttgaggagccccggaggccctgtggggtggtgtccatctgcatgggacgtgggggagcacacgctctgagcttgagcactggctccgccgctgctgggcagtgtgacctcgggcagggctgcgctgagcttggcagggctctctgccctcgccgtgtccactgctgggagcacgtcaggcctccctgcccggctggttccaaggcctttctggtccctgtgtgcagacgaggctcctcacctcgggaccccacattactttcttatttgtgcgctggtttactttgtctctcgccgtggggcatcacctctacaggacaaggccaagcctttgccccgtagacgaagggctcatggtgagcccctcatttgggattctgtagctctgttggggcagcctggtcatgccagggcctttcagggtttcagagtgctgcctgctatgtgacctccctggtcgtccttcctcgccacctgcaagccatccccgtgtgctggctgggccctgggctgcagactggggccagggagatctggacagcagcgtccaccccatgcagttcgctgtgtggcggcgccgggtgggccttgtgcacagcccagctcagaccacggagggtctggggttggaggtggtgtggacatgatgagtgctctcactccaggagagaacgctgccaagagaagggtggctggcccggcgggtggctgctgaggggccatcgcggaaggtgggtggtcagcagagagtacagtgtcccttcttccactgggttccacctgagggagtggcaggagccggagggcttggggaagaggccgcatcagcctcacttgagggctgagtgctgaagacagtgtggggggccctgggctggcaggtgggtcaccctcgctctgggacacgctcaagagagtgccctggagaggggttt

SEQ ID NO: 135865 - DNA, 1032 bp, Homo sapiens
catccttgctgcagggccgtgggggacatagggacaaacctggtgtacaccccgctgactgctgtggttgccccccccagctcagctcacctatgaaccccgtcagcagcagcgaggacatcaagccccccctgggcctcaatggcgtcctcaaggtccccgcccacccctcaggaaacatggcttccttcaccaagcacatctgcgccatctgcggggaccgctcctcaggtaccgctgctgtgggggccaggggctggtgggacagggttgtcaggccattgcagggtctggaggcctccccaaatcaccctcctgtgggccaagcaggacccaaggccagggtgcagggaggcaggtgcctgggccatgccccactcccagggctccgcgaggccattccagggttctcacgtctgtgggacagtgagtgttgggtggggtggggcacagggcagcctgaggcttccggagaggaggtggctgctgatggcaaggtcagcatgggggcagccagtgctgcgcctcctcccttggctgggtctgggcaaggggcccgtgttgtgccactgacccccaacggcctgagagggaagaacgggctgcacagtgcagacacagagcaggtgacttgcctggggccctggtccctggtgggctgggatttgtccctgccccactcctaagctgtcctcggaggagcagagagagtgaggctggggcccagtctgagcccaggcaggggtctggagaccagcaggtccctttctgaggcctggcccgccagctggtagtggcggcgttggatggggggtgggctccctgccggggcggtgggtgctccccagccctgctctgccctgtcccgcaggcaagcactatggagtgtacagctgcgaggggtgcaagggcttcttcaagcggacggtgcgcaaggacctgacctacacctgccgcgacaacaaggactgcctgattgacaagcggcagcggaaccggtgccagtactgccgctaccagaagtgcctggcc

SEQ ID NO: 135866 - DNA, 1023 bp, Homo sapiens
gccggggagggggcaggggttgggggtcccgcagggacacgtgctctgatggggaagacaggcctcacccttgggggttcccagtccgatggaaaagacctagcttccacccagggtcgtcgggggagacattggtctagagggggcagtggctgtcccccattctgcttcctcctcctccctcaggaaggctgcttcccatttccttcctgcctgcctttgcttcctgtgcccaccctccagctctgaaggactgggtgtggaaacagcagggtctggcgtgtgtgcacctatgtgtgcacgtgtgtgcatgtgcgtgcactgcagggatgtggctgacccacaggtctctgctgtgggaagggagccccggctgggctcgagtgtggccctcttgccttctggcctgtgaactgggcaagtgaccttgcctcgcccagtcctcaggttcctcatctgtgatgggctgggggcatcaggaagacccctgcgagcttgggggtggatgagagtgctgtgcgtggctggtggtggggttggagagcagtggtcacgtgtgggtgtgggtgtggtatgtctgtgtggtgtatgggtgtgcgtgtggtgtgtgtgtgatatgtctgtggtgtggtatgtgtggtgtggtatgtctctgtgtgtctgtgtgtgtatgtctgcatggtttgtgtgcacgtgtgtgtgcatggttctcgtgttctgatgccttgctctaggttgaagccctggagggaaggtaagtcactccctttagagactctagcttgctgtgtggcctctggcgctgctctctgggtctctgtctccccacccttaagaggaggccagaatggtttggtggagttcggtcctgcctgtcttgggcccagccctgggctgcacaagggacggaggaaggactcagccattgccactacccaagccagaggagccagtgggcctggggatgcccctcggctccgacatgcctgcctcggagctgtctgcccttccccagaccccctc

SEQ ID NO: 135867 - DNA, 1048 bp, Homo sapiens
ttcacaccattctcctgcctcagcctcccgagtagctggaactacaggcgcccgccaccacgcccggctattttttttgtatttttagtagagacggggtttcaccgtgttagccaggatggtctcgatctcctgacctcgtgatccgcccacctcggcctcccaaagtgctgggattacaggcgtgagccgccgcgcccggcctctctgcacagtctttctccacgagtctagagagccacacacaccagactgggccttctggggaccggatgtcagcttcagctggagcgggaaggctggggaggggcactgcggggtcccttgggcaggggtctgcaacacaggagccgtgggtggggaggagcaggccacctggagaacgtggcccctgaacacgagagccccaacgttagaggtgagtagaggccatgcaccggcacttacagggggattaatgccccagcagcaatgccccagggggtggttcaggtcccagagtcccaagggtgatcctggaacttgacctccatgggatgtgccaagtgcaaaagggtttgtggccgcagacggtgggcaaacggtagttcaaacagtgtccttgagggtctttgccgcaggacttgtcagggcctttaagaagttagtgtacaggagggtccccacgggggctgcagggtgcagtgtgcagtgtgtattgcccacagaagcttctttagaggggtactggggatatggctttgggaagcgaagccccagccacttgcccagctgacagatcctttgtctggctggtagagagatggcgatgacagaggtttcagggttacattctctggggtcccacagcagtgactacagaggccccggcatttcctcgccttttttgcgagtggaatgcaaagtctgccctcagtggcccaggtcttttccatgcccgctgccccatccctctgcagctgtgtgctcctgcctcagagcagacatcgggggtccctcccagctcctgttctgtcccaccctgttctccagcctccttcagatcttc

SEQ ID NO: 135868 - DNA, 1997 bp, Homo sapiens
agaactgcccatgccccttgcccggccctcaccagacctgttccctgcaggttcgctaagctcttgctccgcctgccggctctgcgctccatcgggctcaaatgcctggaacatctcttcttcttcaagctcatcggggacacacccattgacaccttccttatggagatgctggaggcgccgcaccaaatgacttaggcctgcgggcccatcctttgtgcccacccgttctggccaccctgcctggacgccagctgttcttctcagcctgagccctgtccctgcccttctctgcctggcctgtttggactttggggcacagcctgtcactgctctgcctaagagatgtgttgtcaccctccttatttctgttactacttgtctgtggcccagggcagtggctttcctgaggcagcagccttcgtggcaagaactagcgtgagcccagccaggcgcctccccaccgggctctcaggacaccctgccacaccccacggggcttgggcgactacagggtcttcgggccccagccctggagctgcaggagttgggaacggggcttttgtttccgttgctgtttatcgatgctggttttcagaattcctgtgtggccctcctgtctggagtgacatcttcatctgctctgaatactggtgcccagccagcccgtgacagcttccccctaatcaggaggggacagctgggggcgcaagctggtgtgtcatcagcaaagacctcagccgcctcggggatgagaggggactcgtggggcaagcaagctgccctgtgctctgagtgagggggaaggtagcccctttttccaaagataactcacagttttgccctcgagccaatgagaacatgagctgccctctgtgcaaggtttcggggccacctccaggctgcaggggcgggtcactcacccccctgttttctctctgccttggtgttctggtttcagactcccgactccccgttcagaccagagtgccccggcccctccccagcctgagtcttctccttgctctgcggggtgggctgaggcttgtccttgtttcctgcagggctggccctggctcgggcagggtggggcatcaccacctcactggccttgctggaggcacagggctctgcggacctgcagccatctgtgaggcccgcggggatgggaggggaggagggtggcctgttggtttccctcagagggggcaggtggcctggagagagaggggctcaggaactgggagcctcgtgggtggggcagatgctccgcggcctggagtggctctgccggggcattggtgggacccctgctcaggccttctctctggctgccagttgtgtctaaaagactcttggaatctgagaacccggagtcgcagcgccctcgggcctgggccacacgcaggccctggtgggaccacccagcctggtattgtccacggacagcgttgttcacccagagccttacttgggagcctcactgaacgcctgctctggttgaaggtggggtgggggcggggcttggggcctccctggctcagcccagtgcggcctggcgctcctcccgcaggctctgcccccgggctccggtggtgcggggccctctcaggttgaactcgcctcttttgcactggaaggccctccctttggcctgagtacttttcccgttcacgcctcagtcccgtggacccagcctttgtcagtggcaggtgcctgaacagagggtggatgggggggataccggagggggtcttgtcttcccagccgcagtctaggaatgatgcgggggggtggacgccttctccatagtctttccccacctggagcaggggcttcctcagtggtgaggggagctgcctacaggttggaccgggaggcagtggcttggagaggcagctttccagccttggtggggaagaaagtgtccattctttgccttcctggagctcccagccagagctgagcttaggcacccgagtggagcctgcagctga

SEQ ID NO: 135869 - DNA, 2329 bp, Homo sapiens
ccggcaccttcaggcacgctcctcagctggtcacctcccggctttgccgttcagatggggctcctgaggctcaggagtgaagatgccacagagccgggctcccctaggctgcgtcgggcatgcttggaagctggcctgccaggaccttccaccctggggcctgtgtcagccgccggccctccgcaccctggaagcacacggcctctgggaaggacagccctgaccttcggttttccgagcacggtgtttcccaagaattctgggctggcggcctggtggcagtgctggagatgaccccgagcccctccccgtggggcacccaggagggccctgccggaatgtgcagcctgtgggtagtcggctggtgtccctgtcgtggagctggggtgcgtgatctggtgctcgtccacgcaggtgtgtggtgtaaacatgtatgtgctgtacagagagacgcgtgtggagagagccgcacaccagcgccacccaggaaaggcggagcggttaccagtgttttgtgtttatttttaatcaagacgtttcccctgttttcctataaatttgcttcgtgtaagcaagtacataaggaccctcctttggtgaaatccgggttcgaatgaatatctcaaggcaggagatgcatctattttaagatgctttggagcagacagctttagccgttcccaatccttagcaatgccttagctgggacgcatagctaatactttagagaggatgacagatccataaagagagtaaagataagagaaaatgtctaaagcatctggaaaggtaaaaaaaaaaaatctatttttgtacaaatgtaattttatccctcatgtatacttggatatggcggggggagggctgggactgtttcgtttctgcttctagagattgaggtgaaagcttcgtccgagaaacgccaggacagacgatggcagaggagagggctcctgtgacggcggcgaggcttgggaggaaaccgccgcaatgggggtgtcttccctcggggcaggagggtgggcctgaggctttcaagggttttcttccctttcgagtaatttttaaagccttgctctgttgtgtcctgttgccggctctggccttcctgtgactgactgtgaagtggcttctccgtacgattgtctctgaaacatcgtggcctcaggtgccagggtttgatggacagtagcattagaattgtggaaaaggaacacgcaaagggagaagtgtgagaggagaaacaaaatatgagcgtttaaaatacatcgccattcagttcgtttgttccgtgtggggacttttttgtttggagcgggagggcccgcgatcagcccccaccagcccaccctcctgtccaccctacctgccggtcctgtgcggcgaggctggcatcctctgtgggccatactcttgagagttctctccctgtccactgggctctgctgctcctccaaggggcagggggctggggcctccgtgagggcacctctcagcagccgtgggcactgggcctgtgggcgcctgcggagcacgagtgttcccacctgtccctccccaggctgcctaagcatccacgcctctgcagccacgctggcccagatgggcaggaggtgcacccagagggccaaggaacacacgatgtcacccagctgccccaataacaacaagttaatgatgccccatctgcattgtctcctgtgataaacgccctctgtctccatgctgtctggggctgggctgctcccggcctggtttggtcttcgtgcccggagccctctcatgcacctgtgtccagccaggcaccctccccgagaggcaccagacacactgaagatggggagtggggctctgaaggtccaggtcctgccctgtggtggtgggcagaggacagtgtggcctgtgcccagagctagggtggctcccgggtgagacttaaaatggaacggcctgccacctgaaaggcagggacttcctgatggcactcccctcatgagcacacacacattcacacacgtgcatactcaaacacgggcacggacacgctcacatggaccctcgcacccattcatacgcatgcacacaccacgtgctcacacagatgctttggcatgcacacccatgcagaactgctcccgtgcacacacccatcgctgcccttgcacacacccatgcatgctcccatgcacacacacccatacaggctcagttgcacacacccatacacgctcccgtgcacacacccatacacgctttcatatgcacatacatccatattcccatgcacacacacccatacacactcccatgcacacacacccatacatgc

SEQ ID NO: 135870 - DNA, 1053 bp, Homo sapiens
caataatttgtggggagagtcggccaagttttgtgagacttgacaggtatcaaatggttaaatttcctctgactcaatcaagttggctggaaagacatccttttccatcctctgccccctccctccctctccccataaaagagcagtgagtgggaggagctcagaagccccaagaattccccaagccctctccctgctgtggtccagatttgccggaggggttggagttttggttgctacccagggctgtgcccacccagcagtgcggcagccccaggcaggggcgtgctcccagtgccaggctcacagtggtttctccagtgatgttactcctgggctgctcctgcggggctggccagagcctgctcttcaccccgccctgcagatatttctggactccccaccgccacgcctcagccgaacacagctggtgctgcccgtcccgccctgccttctcgctgcctggcctgtctgcctgccctgcctcctccctggaccgccccatcccacctcctgggagatagaccttgataggtggagtaggggctgtgcagagcagtgagctgccccgctggagggcgaggatgagtccccaacacttcccgagggcacccacataggagcctgagccaagctgcatctggaacagtgcaggacctgtccctgctcggtcacgtgacgtggctctgggaatggccttgggagacaatcacacatgggaatggaggggctggcacttgcctggcctgtggtgagcatcagctgcaccatctcactgcaccctcacccgggcctgagaagggacagagcctaggagtcagggggcagggatgccaggcagatgtcttccattcctgctgtggggccctaagccagcaacggcccttcgcctggcatggtcactctttgacttgtcacagttccctcttctcacttcccatcggtttatcagctctccccggggagaaggccagggccctgagctatagtcctggcctgggggcccagtccaaacagggtcctgggagcagagccattccatttggccaacac

SEQ ID NO: 135871 - DNA, 1049 bp, Homo sapiens
agagggcacgtgacaagtgctcgcatgcacacagcaaaatacaacggccgccgccctgccattctcccgatggctgtgaccgcaccgcagggaccacgctcccagggaccacactcctgggtcccgagccagtgccgagtgctgtgtgctcccccttccccctttcacttgggctcccggctgggcttccagggttcagacagccatccttgtctgagggacgagggttctggggaatgagtagatctcatggcacggggtgttgccctaacttgtctgattccagaggctgggccttgatctgctccgccccaccacgatcgtgcaggaagtgggccttcttcctgtgtctcgaggaatttgcagcaaaattgcttgagctggcatctgtgatccaagccctgtcttcaccatctgtttctttgcaggtggcacagaattgctctcagcgtccacaagaaaaatgtcaccttgatcctcgactgtaaaaagaagaccaccaaattcctcgaccgcagcgaccaccccatgatcgacatcaatggcatcatcgtgtttggcacccggatcctggatgaggaggtgtttgaggtgagcaggagggcagaccaacccctgtgcccaccagggcactcctcctgtggagccactgtgactgctgttggaggaggctcctcgggccgggaccggctggcggtccactgtggtcaccgtctctgttggtcagaagcctctgctgccatcctaagagatgtttgtggctttcggaaatggaggggccagagctgctgccgcctgtaggccgcgtggggatggcagtggccgcccttgtcccaagggcccagtacgtgagtctcctgggtgctggctcggaaaggacagggcctttgtccagcctcgtgctgaggctcctggaaacctgcacactcctgccgtctgtatccgaggccatcctgggacaggggcagctgtcctctgggtgagcttgaagggcagagctgggccaccgtgtggacgcaccagggagacctgtgccgacccaactcggg

SEQ ID NO: 135872 - DNA, 1052 bp, Homo sapiens
gtactttccaggctgtttaggaccccggcagggacacctggttccccagagggtggcccaggggatcttgtgactctcccctgatgccctgtcctgccccagaggctgtcattcaagaaggtcaccaaatcctttcaattagatgctctttctgcccagcctttcctctggagagctgtggcatgtgagctcctgagccggcatctcagagcctgcaggcttcacctgcagtgtctgcacacctagcagcttgctgggagcgaggacattccaggcctttccggctggtaccagagctggtaaacctggcgtatgtgaagcagccccaagccagagaacccttgtgcaccactgaggggaagctggtgtccaggctaacagctcatttctctaaccttgccttttttctcctctgcagggtgacgacggagaagttgggcccagggggctgcctggggagcccgtaagtctgtgagctgagtgggacggtgggggctcagtgtggagaaaggctttgtccaaggctcctgctggagcaggatctgggatcagccaggagcttagaagagagagagctcgacctgagaacagacggacctgggcatctcccagggaagccaaagagaggaggcacaggcgaggctggctggcaactccaggaggaagtctgagcctgcctacaggagcaagcctggccctcaagggttgttgtgggggtccaggggcagcgtggtggggtctgggggcattgtggggagtcgggggcagtatgtggggtccatgggcattgtggagggtctgagggcatcgtggtggggtccggggtcagtgtggggtgtccgagggcatgggggtggggggtacaggggcatcattgggagggtccagggtcagcatgggtgggtacaagggcattgtggggggtctgagagcattgtagggggtctaggggcaacatggcagggttcagtggcaccatagggggtccgagggcattgtggggggtcaagggagaagcatgggaggtctgaggtcattatagggggtcaggg

SEQ ID NO: 135873 - DNA, 1031 bp, Homo sapiens
tgcctagattggcaggcgggcgtgtgagtggcttggctgaactcagtcccctgtgagaaatacaaggtttggacatgtgtgagctcttcatggatacaagtgtgcattcaggacaggattttaagccagacaaatagagacctgccaaagacagtggccagcgccaaccctgtgggcagctgagcgacctcactgcggtgctgcttcctgtgtgggtgtttggatattcaccaggtcagagtccctaaatccatctctggtctgtgtgcaccttgcaaacttctagaattaaagagctggtaggtgctacagtcagtgcataaatttgcattcattcccaactctgcaagctgctgtgctttatttaaagggattgtgggacgccaacacaacgtgcacgaggcacagaaaatacaatgtcacagtgcaatgttcatgtctcacctcagttcagctcagcagtgtgtgtccctttctcccaaacaccagccaccctcctatggatatgggcgcgtgggggatggtggcaggggagggagcatgatgaaactccatttggctttctagagctgaagcctgtgaaatgcttaggaaatatttattgagtagagaggatggataaagagataggtggctgggtgagtggaggggtgtggataggtaggcagatggatgaatgggtaggtatgtgggtgtgtaggcagatggatagacagatagatgggttggtgggaagagaggtggatgaatggatgggtgggcaggtggggtagatacatagatggatggatgagtgggcaggtaaatagacaagtggatgaatggaggggtgggtttataggtaggcaaatcgatgaatgggtaggtgggtaggtagacacatggatagacataggtgggctgcttggcagagaggtggatgaatggatgggtgggcaggtaagtagacaggtcgatgaatggaggggtgggtttataggtaggcaaatcgatggatgaatggatgggtgggcaggtaagtagacaggtgg

SEQ ID NO: 135874 - DNA, 1113 bp, Homo sapiens
ccgaggagcttagatggatgctccagatgtccagggcatcagcactgtgggtcacgggacacaacacaaacctgactcaagcccagacctgccaggcaccacatgccccagtcacacataggagctactcacagcctttctgcagcctctgggtgtctggccctgcccaaggacatttcgttcactgctgcacctggctggtggcacaacccacaacacagacctcaggccaaaagggcgaggccgtgtgcttccccttgagccatggtagtggtggttcatgtgtgtgagatggagccctggcctccttcatctttgccatcacagctcttcagagcctcccgttcaggacactgagcacagcctttgcccgcatgagccttcagtggcatcgtcactgcagaatgaagcctgcagcactgcctggctttctggacagggttgatgctttgtaccaagttcggggaatgacggagagtgtgggtgccctctgatctagtaggttgggcttcccgaatgtccacaggaagctgagggctgggctgtccttgcaaagggacccttcctcttttgttgactgcagaagcctcacttaggttacccagaagcctctgggcgctggcttgccttctgcgcctcggtgaacagatgctgcctcccaggtttcgcccttggccgcccttcttttgccttgggctttggacttggtagtcttgggtgcagtccattcacttaaacagcacatgcatcgcgagtcctttctcagtgctgggtgttctgccaggctctgaggactctggtggtcaaagcagacatccctctggcatccagagtggaacaccacctggtaagcagcactcagaggagtggtggctgtgatgatgaaggacaagggtgagtcagggaaaggtcataggcaccagggtctgacccagaaggtccagggaggcctcctggagcagtgacatttttgctgagccctgcaggagggacagaagtggataggtgaggtatggaaagcaggcagagctgtggggtcaggaggtgaggagccgggggccggcacagggccgagcccggcaagggagacgtgggagtgggctgtgggctgca

SEQ ID NO: 135875 - DNA, 1893 bp, Homo sapiens
ccccacctccgacctgtgcagggggactcttgggacatccaccggggttaaatgcatgctctgatcagccatatttcctccaacacttgcccgggcaagcgcagccctgggtaggagacaggacaccagcctgggttttggagccagacagattgtggggggtgattggtaaaccccaagacccccaactgttcttaaccaccggccatctgtctccctcttccccagaccaagaaaggctaccagaagacggttctggagatcgacacccccaaagtggagcaggtgcccatcgtggacatcatgttcaatgacttcggtgaagcgtcacagaaatttggatttgaagtggggccggcttgcttcatgggctaggagccgccgagcccgggctcccgagagcaacctcgtgacctcagcatgccattcgttcgtgagtgtcccgtgcacgtcctgaccctggacagtgaaggcttctccctcccctcccacctgacttcatctacgcctcggcaccacggggtgtgggaccccagcccggagagaacagagggaaggagccgcgcccccacctggagctgaatcacatgacctagctgcaccccagcgcctgggcccgccccacgctctgtccacacccacgcgccccgggagcggggccatgcctccagccccccagctcgcccgacccatcctgttcgtgaataggtctcaggggttgggggagggactgccagatttggacactatatttttttctaaattcaacttgaagatgtgtatttcccctgaccttcaaaaaatgttccaaggtaagcctcgtaaaggtcatcccaccatcaccaaagcctccgtttttaacaacctccaacacgatccatttagaggccaaatgtcattctgcaggtgccttcccgatggattaaaggtgcttatgtttttgtgagttttaagtaaatatttgtattgtattgttataaatgttaagtgtgcctggctttcaatcatgcacggaaacccagtctcagtcccacggacagaatgggcgaggcatggattctgggttgcagtaccgttctgattagaaataggaagtctccccacccccgccctggccaagaacgtgcaataaattggaagtttgccccggggcagcaagaatttatgctgccattgaaaagcaggtaccagtgccccttttcagacagtttttgattcgctctagactttttttttttttaatagggaaaaaatttgataattttcttttttctacatgcacttaagactaaaacacaggtttggattaattttatttgcttcctttttccgcttttcttcccgcagagcctgatgggagaatgtccagggcagggaaaccacattttttgtaggtgataactcaatgaaaattggtgcttattttttacacttctctcttgtggctctcttgtggtgctatctatctgttttaaggtctccttgaaggcgcactggggaccctggccatgcctcgttctccctgctttctttatcctgttattgcctccacagtctgttgccaaggactctaagatcaatgcacgtcactttcctttccactgggcaggatagccaagcacactccctcctgcgctctcccgccccggtgcgtccactcccgagggctgttatgaggactgggttgtgcctacttgatttgaaaacacacacaagcaataaaaagcctcttcctgcattgtctgtggtgtgaccatagcagattatatttggttcctgaatgtttgtggtgctaatttctgtgtttgttccaagccgttcagtcatgccatgcgctgcctcggtagatggagtaatgtacaatgaactccatgagtctctccagggctgcct

SEQ ID NO: 135876 - DNA, 1469 bp, Homo sapiens
ccttctcctgaggtccaggaaattccaagtcggggaacagcttcccgcccaaggaacagctttccacacaagcctgttccaccccactttggaagtgctcgccgggtctttggaagtgctcactgggtctttggaagtcctcactgggtctttggagtactcactgggtctttggagtgctcaccgggtctttggagtgctcaccaggtctttggaagtgctcactgggtctttggagtgctcgctgggtctttggaaatgctcactgggtctttggagtgctcgctgggtctttggagtgctcgctgtgtctttggagtgctcgctgtgtctttggagtgctcaccaggtctttagagtgcttactgggtctttggagtgctcactgggtctttggagtgctcgctgggtctttggaatgctcgctgggtctttggaatgctcgctggatctttggaagtgctcactgggtctttggagtgcttgctgggtctttggaaatgctcactgggtctttggagtactcactgggtctttggaatgctcactgggtctttggagtactcactggctctttggagtgctcactgggtctttggaaatgctcactgggtctctggagtactcactgggtctctggagtgctcactgggtctttggagtgctcgccgtgtctttggagtgctcgccgtgtctttggagtgctcgccgggtctttggagtgctcgccgggtctttggagtgctcaccgggtctttggagtgctcactgtgtctttggagtgcttactgggtctttggagtgctcgccgggtctttggagtgctctctgtgtctttggaagtgctcactgggtctttggaaatgctcgccgggtctttggcatgctcgccgggtctttggagtactcactggatctttggattactcactggatctttggaagtgctcactggatctttggaagtgctcactgggtctttggagtgctcaccgggcctttggaagtgctcaccgggtctttggagtactcgttgtgtctttggagtgctcaccgagtctttggagtacttaccgggtctttggagtactcactgggtctttggagtgctcgctgtgtctttggagtactcactgggtctttggagtgctcactgggtctttggaagtgctcacttggtctttggagtactcactgggtctttggagtactcactggatctttggaagtgctcacggggtctttggagtgctttctgggtctttggagtgctcactgggtctttggagtgctcagtgggtctttggagtactcactggatctttggaagtgctcactgggtctttggagtactcactgggtctttggaagtgctcaccaccgggtctgctctctccacaggtgtggtacatggacggctatcacaacaaccgcttcgtacgtgagtacaagtccatggttgacttcat

SEQ ID NO: 135877 - DNA, 1036 bp, Homo sapiens
ctccgacgagttgtagctccctcctcctggaagccaagggcccacgtcctcaccacaaagggactcctgtgaaactgctgccaaaaagataccaataacactaacaataccgatcttgaaaaatcatcagcagtgcggattctgacatcgagggatggcattacctccgtgtttctccctttcgagccggcgggccacagacgtcggaagaaactcccgtatttgcagctggaactgcagcccacggcgccccggttttcctccccgccctgtccctctctggtcaaacaacatactaaagaggcgaggcaatgactgttggccagttctcaccggggaaaaacccactgttaggatggcatgaacatttccttagatcgtggtcagctccgaggaatgtggcgtccaggctctttgagagccatgggctgcacccggccgtaggctagtgtaactcgcatcccattgcagtgccgtttcttgactgtgttgctgtctcttagattaaccgtgctgaggctccacatagctcctggacctgtgtctagtacatactgaagcgatggtcagagtgtgtagagtgaagttgctgtgcccacattgtttgaactcgcgtaccccgtagatacattgtgcaacgttcttctgttattcccttgaggtggtaacttcgtatgttcagtttatgcgatgattgttgtaaatgcaatgccgtagtttggattaataagtggatggtttttgtttctaaaaagaaaaaaaaaatcagtgttcacccttatagagacatagtcaagttcatgttgataataatcaaaggaattactctcttcttgttaaattagctaaatcatgtaaccgcagataggaagggctcgcctggggaaactctggtttccgatgggacaggaaagtcatacgggcaacagtatgcggaaagtacgttttttaagtaaaaaacaaaggcaaactttgtactatccagttatctaaggaacaataaaaacattaggagatctttttgcttcacttgtca

SEQ ID NO: 135878 - DNA, 1051 bp, Homo sapiens
tccccactgggtgtggacttgggggaaagctggaggccacttacattggcctttcagctcctggaaaacaccaagcactttcctgacccacacaaatatcttgtagatgctgtatcctctactgagactgtggttctgctcatcttacatgcatacctgtacgcatggacacatgtctgtccacctcacatgcaaacctgtacacaatggacacatgtctgtccacctcacatgcaaacctgtacatgtggacacatgtctgtccacctcacatgcaaacctgtacatgtggacacatgtctgtccacctcacatgcaaacctgtacatgtggacacatgtctgtccacctcacatgcaaacctgtacacatggacacatgtctgtccacctcacatgcatacctgcacacgtggacacaagtctcttcatctgacatgcaaacttgtacacatggacatgtctgctcatctcacacatatacctgtatacatggagacatctgtgttcacctcacatgcaaacctgtacacgaggtggacacatgtctgtccacctcacattcaaacctgtacatgtggacacatgtctgtccacctcacatgcaaacctgtacatgtggacacatgtctgtccacctcacatgcaaacctgtacatgtggacacatgtctgttcatctcacatgcatacctgtacacatggacacatgtctgtccacctcacatgcatacctgtacatgtggacacatgtctgttcatctcacatgcatacctgtacacctggacatgtgtgtgtgtgtagcatatacacacccacacccatacacacccctttggctggatagtgcttcagatttcagtgcaaagattttagcccaaacactgctctctgaagcagatttctctaacccttgggctctctcaaggcaccctgcgttctctccttcacagcacctcccgcaattgcagcttaacaggggatccaggagaggacttccactccagccataaggaaggagcctgtgccacactggctctcttgctgtaaac

SEQ ID NO: 135879 - DNA, 1023 bp, Homo sapiens
ccagggtccacttttgccgcctggcctcaacagccagaccggcggccacaagacccctctctctaaaacaccagacccactgctgggctgcaaaaggaagcgtagaggtggtggccatgtgaggccatccacgcccaagaaaatgcaggaggtggtgaaagacggtagccaggatgccgaccacagccaggggagagctgagcccggccatgagaggcgagacctgcccatccagggcaaagccagtgaggccctgggaggggagggcaccgccaggggccctggcgacactcgcatgtcacagggccagggtaagacagacgaggcaaggcgcctagacgagaaagagagctctgaagacaaaagcagctccctggacagtgacgaggacctggacacagccatcaaggacttgttaaggtccaagcgaaagctcaagaagaggtgcagggagcccagggctgcgtgcaggaagaaggtcaggttcagcacagcccagacgcacttcttggagcagctgggcgggctccggagagactggaaagacaggggcccgccagtgctgaagagctgcctctccaagtccaagagagacagtggcgagggtcctgggaagaaaccccccagtgtctttggcagcacggcagagaggatgaggcaggagggtgccgcgagccaggacgcggccctggccttccgggtgaggagacccgcctccgcctctgcctccgaagggaatccattccccagggagtcccagggcccagctcccagccccggctccctgtctgatgacagcagttcagtggacagcaacgacagcatcgaactggagattaggaagtttttggcggaaaaggccaaggagtcagtgagcagttcagaagttcaggcagagggccccaccgctcttgggacagggggcccagccaggccagaggtgctgtgcaggaaggagcctgccccaccgcctggcgtgtgcacacgcagccagagggccaggggggtcccacatctggccga

SEQ ID NO: 135880 - DNA, 1033 bp, Homo sapiens
gggcgtcgggagcgagagagacaaggggtccgagggccccgcccggggcctgcccagcctgccccttgcgggcttctcgccgctgctgtccacccagctcttccactttggaaagggtgtctcctgggggggcaggcaggctggcctcttcagcccccacctggggctgcctctgcagggcccctccttctcggccttcagggaggcccaggccggacccagccctgtctttggaagcccacacttgctggcaaagaaggacggcggcccctggccaaccaggaaggcacaggcagggctgagtttgcatgacaggaggagctcgggctcggaggaaagcattttagacctgaggtatcgacgaagggtcaacagggatgaccaggagcaggacgccttgggcagtgacgccagtgacttcagcgacacctccacggaggacagtggcggcagctcagtagtgaaggtctaagccctcgagctgtgggttcgcgtcctgggttgcgtgcattcgtggaaagcggcgtagccgtgcgtgtgtgtgatggttccgtggctgcaaggaagggaaacagtctattatacatagccctgtatatatgtacaccaacatgaaacttttatttaacagacgtgtcctggtaaatatgatttttgtagctttttgtaaattatttaaagtgatgtaaaagatatttttggaaaatactgttgttcaattttgtagggtgttcctaactgcagttttctgtgttctgcatacaagtcttagcttaggaaacatttggttcttaccatcacagccaggttcacagaggctctgatgctttttggttgattgctggtgagaatggccggcggtggctgcagtggtagcctgaggaaggccaagctgccctccctgggaatcactcagatgccccaagatgtccgttgggaagctcccaggacagcactttttatacagaggacaccgcctcggccccacgtccttagaggccagagcacatctgaaaactgcaatcacagccgt

SEQ ID NO: 135881 - DNA, 1022 bp, Homo sapiens
ctgcggccccgcgcggatggcgacggaaggggaggccgctcggcctggcctggagggagacctcgctctgccccgcgtcccagccatggcgacatcctcggccgcgctgccccgaatactcggcgcgggtgagcgcgcgcttgcgggaccctggggaggagcatgcgaggaggatgcggaggggcgcggggacccgatggagcggcggggacgtggaggggacccggggcgagcgcggaggggactcggggagggcgcggggacgcggaggggacccgttagggacgcggaggggcccgttggggatgcggtggggagcgggcgtggtgcattcgggactcggcgccaggacctctatctacttccccccaggtgcccgggccccgtcgcgctggttgggctttctcgggaaggcgaccccccggcctgctcggccgagccgcaggacgcttggaagcgcgacggcccttatgatccgcgagtcggaggacagcaccggtaacactgggcgcccagccgagttgggtgggaacgaggagaggccggcagccgcgggggatgcgaaccctagaggggcctgggcgctgcacgcggtcgaaactgcgcgctccgctgggctcctcccactcccgtgctcgccgccgctcggtcctgcctgacgtagcacagcgggctgaggccaccgcctcaccatggatagggtgagagggagcgggcgggccagtggttagcacaggcttcgctccctaggggggtgtcactggaccaccgaggcccggagccccgagctcgcccaggcgggcccaagtgacctgggggcactgggcttggagtctgcccaccttgctggactcctgatggggactttctggctggccacctgagaccacaaggcggggaggtgccagaaagacctgagcaacccgctgggcccctctctttttctcctctgtcttccaagtaagaccaagggacggggttgaccaggttcgaccaggcttacccaggagcaaggtcgggat

SEQ ID NO: 135882 - DNA, 1100 bp, Homo sapiens
gctctgttccccacagagcaaacgcacatggcaacgttggtccgctcagccactggttctgtggtggaacggtggatgtctgcactgtgacatcagctgagtaagtaacaacgactgaggatgccgctgacccagggctggggaaggggactcccagctcagacaggcttggctgtggtttgctttgggaggagagtgaacatcacagggaatggctcatgtcagccccaggagggtgggctggcccctggtccccgggctccttctggccctgcaggcgatagagagcctcaacctgctgccgcttctccttggcccgggtgatggccgtctggaagagcctgcagtagaggtgcacagccagcggagagtcgtcattgccgggtacagggtaggtgatgaggcaggggttgcagttggtgtccacgatgcccactgtggggatgttcatcttggctgcgtctctcacggccacgtgtggctcaaagatgttgttgagcgtgtgcaggaagatgatgaggtccggcaggcggaccgtggggccaaagaggaggcgcgcgttggtcagcatgccgcccctgaagtagcgagtgtgggcgtactcgccacagtcacgggccatgttctcaatcaggtacgagaactgccggttgcggcttataaacaagatgatgcccttgcggtaggccatgtgggcggtgaagttcaaggccagctggaggtgcgtggctgtctgttccaggtcgatgatgtcgtggtccaggcggctcccaaagatgtacggctccataaacctgccagagaccccaccaaggcaagggggatgagagttcacggggccatctccactggctccttgcaggaacacagacgcccaccagggactcccgggctcctctgtgggggcactatgggctgggaagcacaatttgcaacgctccccgtgtgcatggacagcagtgcagacccatccaggccacccctctgcatgcctcgtctcgtggcttaacccctcctaccctctacctcttcccgaaggaatcctaatagaactgaccccatatggatgtgtggacatccaacatgacgccaaaaggaca

SEQ ID NO: 135883 - DNA, 1100 bp, Homo sapiens
atcccccttgccttggtggggtctctggcaggtttatggagccgtacatctttgggagccgcctggaccacgacatcatcgacctggaacagacagccacgcacctccagctggccttgaacttcaccgcccacatggcctaccgcaagggcatcatcttgtttataagccgcaaccggcagttctcgtacctgattgagaacatggcccgtgactgtggcgagtacgcccacactcgctacttcaggggcggcatgctgaccaacgcgcgcctcctctttggccccacggtccgcctgccggacctcatcatcttcctgcacacgctcaacaacatctttgagccacacgtggccgtgagagacgcagccaagatgaacatccccacagtgggcatcgtggacaccaactgcaacccctgcctcatcacctaccctgtacccggcaatgacgactctccgctggctgtgcacctctactgcaggctcttccagacggccatcacccgggccaaggagaagcggcagcaggttgaggctctctatcgcctgcagggccagaaggagcccggggaccaggggccagcccaccctcctggggctgacatgagccattccctgtgatgttcactctcctcccaaagcaaaccacagccaagcctgtctgagctgggagtccccttccccagccctgggtcagcggcatcctcagtcgttgttacttactcagctgatgtcacagtgcagacatccaccgttccaccacagaaccagtggctgagcggaccaacgttgccatgtgcgtttgctctgtggggaacagagcacagagggtgagcgacatgtgcagaacggccccttggctgcagttaggacctcagtggctggtatggccaagctgctagaagatgctgctgtccctgtgatcccagcagccctcccttcaccgtgacccctgacctttgtcaggaaggtgcagtttttcttctcaatctaaatgcctttcaggtgggccgcttccttggctacctggttccagggggctgttttgtaatgagatgctgctggcaggccactcagaggctcccagctgggttggtg

SEQ ID NO: 135884 - DNA, 1037 bp, Homo sapiens
aggcttcctgtagaagatttcagcctggactcctccctgtctcagtaagtgctttgcaagggaggaactgtcttggtggcagacaagggctcttagaggtgtgagagcccttgtttctggggggtcccctcaacccagcatcccctgcagctgggccagggccaccggcacctcccagtacccgctggtgcctctgggtcccaggtgctggggctggagacaggacagtcagtgtgcccccttggagaggagcctgaacttgggaaatgggctccccagaggtgggtggtccgcagcctcaggagaggcggatggcagagcaggggcccttgtcatggtgcctcccagggacaggcaggcaggcagctgctggggcctgggctctggctcagcccaccttggctgcctgtgccggtcgagctcccaggagctgggatgcgctctcggaggctgtgccactccccactgagccgccggggctctgccggtggtgcttcctgacttcagctaagatgtaggtcaaatggaagaggctttgaggccagggcagccaggccctgcgcactcctgggaagccccccgctgccatccaccttcagcgcggtctccaggaggggccccaggcttactgttccatgcacggcaccagcagcagaaaccaccgagcactcagcactcacggctgttgagcatccaggggctgcccggcacccatggtgggacctattattatcccaaaagagtcctggaggctgggaggccagtggccaccaccggacctctatcttcccagcctggggccccatggtgcagagggtgacgggtgtgagatagaagccgtgcccaccacccagggttctcctggccccaccccaggctcccgaggagtcgggtctcagacctgtggaggaaatggatgcgtctgcagccgaggctatagtgtgtgccgccgtggcacggtctggacacagccgatgttcctggacctttggaggcccagctggactcacccttcagccctgagccagcctcacctg

SEQ ID NO: 135885 - DNA, 1122 bp, Homo sapiens
ggacagtcccaggctcagtaagcatgggacccaggctcagtgaatgccaaggacaaagccaggctcagtaaaacaggtgactcaggctcagtgggcactgaggacaaacccagcatttactgacccagggtcagtaaatgctgaggacaaacccaggatcagtaaacaggggacccaggctcagtgagcactgaggacagacccaggctcagtaagcagggaaaccagactttagtgaatgctgaagacagacaggctcagtaagtagggaacccaggctcagtgaatgctgaagacaaactcaggctcagtaagcaggggtcccaggttcagtgagtgctgaggaccgacccaggctctactgctctccacacaattttcccagggatccctgaggacttcctgaccccctctgtctgcttcaccacctgaatctctccctccactgacccatctgtgtccttgctgttttcctggggtggagagtgcacaggccaggtccctggctggctcctgggtgggtgacctagttcatgactgggtcccatgtctccatctgagaccagagagggtctttcacacccacccctatcatgttccagaggggtcagtagatgcctgtgctgagaggggttccgtgggggaaaaccaggtccactgagcctccatctccgttccctccccaccagggcagcgggatagccgctctctggtgtcttcctgagcgtcctgcctcacccactgcaccctccatcccaccctgggcctagagtgggcggcccaggaggaccatggtttcaagactccatctgccctcggccctggcgggggtcagccaaaggccttggtggctaagactgtcctgacatgggagtgagggtcaaggcagaccccagacacacacctggctttgtgtggtacctgcccgcgaggcctgtggggtcaggccccagccccagccccggcctgctccagagctccttccctttcctgactcccaggtcatcgtggccataataagcttcctggagacgatgcttctcatctacctcagctacaaagtgagtgcctgcccgggatggcacctcacagggggtccccaccctccccaccctccccagc

SEQ ID NO: 135886 - DNA, 1395 bp, Homo sapiens
tcacagtgagctctagggcccagaggtggtgggcacaaacacagtcctgaaggcagggccgcccgggcggggcaggggctggctcagagggtctgaccctccgcctggccggcaggactattacgtggtcatcctgtgccccacggagatggatgtccaggtgcgcagagtcctgcagatccctctgtggtcccagcgggtcatctacctccagggctctgcactcaaagaccaggacctcatgcgagccaagtgagtgctggtgggcggagggggtggcatgggggcaccttcctgagtcaggtcggctgctcagggctgaggcattgaccgtcgctctcctggccaatgagagccatgagagcattatagactatccccagggtggaccatctaggtggactgtccagggtggatcgtccggggtggaccatttagggtggatcgtctggggtggaccattcagggtggaccttctgggatggaccatttaggtggaccatacagggtggatcatctggagtgaactgtcaagggtggaccatccagggtggaccatctggggtggaccatctaggatggactgtctggggtggaccattcagggtagaccttctgggatggaccatttagtgtggaccatccagggtggattgtctagggtgggtcatctggggtgaactgtccaggggggaccatccagggtgggtcatctgggatggactgttcagggtggaccatccagtgtagatcatgtggggtggaccatctagggtagactgtccagggtggaccatctggggtgggctgtctggggtgggccattcagagtgaaccatctgggatggatctctagggtggaccatccagggtggatcatctggggtggaccattcaaggtggaccatctagggtggaccatctggggttggtcctctggggtagatcatcaggggcggaccgtctggggtataccctctggggttgtctggggtgggccatccatggtggaccctcttgggtggaccatctggggtggatcgtctggggtggaccatccatggtggaccctcttgggtggaccgtctggggtggatcatccagggtggactgtctggggtggaccctctggggtggattgtctggggtagactgtccggggcctcttgcagtttctctagctcaggtcccaggcccagatgagcaggaccctgcagccaggcccttgtccctgcaccatacccactgtggagcagcccaggcaagcccaacccagctaagtctctgtctcccttttcagggtgaggggcagccttttgcgagctccaccttcccctgctccaagtctagggaaatctttgtcaagttctagggaggctcaaaatagaacagggg

SEQ ID NO: 135887 - DNA, 1123 bp, Homo sapiens
cgcttttgcagtggctcgcactgctgtggccactgctgaccactgaggctcccagcggagggtgttcacagccaggtcccgggccacggagctcccttacttgaagttctccttcagcatagattagacgtgatccactttgctttcttgcttctcacctcgcccccttgcacattgcctgacaccctcatattggccagctgtaatctcgtgactatgggactgaggctcaatcttggcttggggtgtttgaatgtctatagcaaaggaattcataatgggaaatctttttcatttgagaaattgtatgatatttattggttgtgtctactgccaacatttatatccaattctaagatttctgaaaaaaaattcttatcccttgctgctcagaaaaagtttacggaaaacaccagttcactaaaagcaccgaaatctgcaaagcctgtcttccgctagaacaacgtctacaaatgtgaagatgatgacttctggcacgcggtcatgagggtggggaatggcactaggagctgatgtttgcctcatttaaagtaggcaagccgagccaactgcagccatcattcattaagttttgggtagtgctctaatggtttgttcactttaataaagacagattttggtaaagtagaatatttttcattctgagcatgtttgtcccaaaaggtgatgcacttaagctgacagtcccttcagtggttttgttaggtcacggcttgtcctgtctggattctgcatctggaagcgctgcatgctctcagaggagcgtgccgtttcccctgtagatggatacttttgttttgttgcctatttaaaaacaattaagtggttatttgcagttatttcagaactccaagtaagtggatggctttgggttctttctgccttggtcccaatggtgttgatgcttctgtggagcgcggacattcccaggagcaggtgcgtgccagccatggctgccagacactgctgcaactgaccagctgccggaagattctggagccactaacattagttttgcacatattttcttgggagtgttacttgaatctatctcaaactgcagaaaaaatcaaaagatcaataattgggagaaaaagagaca

SEQ ID NO: 135888 - DNA, 3433 bp, Homo sapiens
gtggtgtggcagcaggtggagtcaggtatgagggtccagccagatcccagaactatacaggtgtcaaatagtgcctgcccttaacactaggaacttcttccgttctggcgaatatagtcatttgtcatggagtgggctaattactgtaattttaatcagtgtttagaaaatgtctgagctttaatttgtaggatgataaatagagattaatactgataaatagaaacaaaagctctttgaggtcctcagtaattttgaagggtatcaagaggtcctgggactagagtgtttgagaatcacaaagctgaaattatctctgattttcttctgctctgtggaagagtgagtttaaatctcctgcatatgagaggcgtattctctttgtgtggccggcattctcaccccctggtccatgttgggggtctttggtgtataccgcagcgcacccagtgggccttccctgtgtttcaggcctgcgtcccagccaacaccttttgctctacatcacgctgcgagttgtgaagtggatcccagctctggcgacagcatcagcttggcccgctccatcagcaaagacagtttggcatccaacattgttaatctgaccccacagaaccagccacaccccacggccacgaagagccacgggaagagcctcctgagcaatgtcagtattgaggatgaggaagaggagcttgtggctattgttagagcagacgtggttccccagcaggctgacccggagttccccagggcctcaccccgggccttaggccttacagcaaatgcccggtctccccaaggacagctggacacctcggaaagtaagcctgacagttttttcttggagcctttgatgccagcagttcttaagccagcgaaagagaagcaggtgatcaccaaggaggatgaacggggggaagggagaccgaggagcatcgtgtctaggaggcccagcgagggcccccagcctttggtacgaaggaaaatgactggcagtcgcgacttgaataggacttttaccccgattccatgctcagaattccccatgggcatcgaccccaccgagacaggaccactgtcagtggaaaccgcaggagaggtctgtggtgggcctctggcccttggcggattcgatccgttcccccagggaccatccacggatggcttcttccttcatgtaggcagggccgatgaagacaccgagggaaggttatatgttagttgttcaaaaagccccaactcccacgattcagagccgtggactctcctcaggcaggattctgactcggatgtggtggacatagaggaagccgagcacgatttcatgggtgaggcccatcctgtggttttcagcagatacattggggaggaagagtcggccaaactgcaggaggacatgaaggtgaaggaacatgaagacaaagatgacgccagcggccgctcgagcccctgcctgagcacagcctctcagatgagcagtgtctccatggcgagtgggagcgtgaagatgaccagctttgcggagaggaagctccagagactcaacagctgtgagaccaagtccagcaccagcagctcccagaagaccacgccagatgcgtctgagagctgcccagcccctctgacgacgtggaggcagaagagggagcagagtccgagccagcatggcaaggatcccgccagcctcctggcatctgagctggtacagctgcacatgcagctggaggagaagcgcagggccatcgaggcccagaagaagaagatggaggcgctgtcggcaaggcagcgcctgaagctcggcaaggctgcattcctgcatgtggtgaagaagggcaaggccgaggctgccccacccctcaggccggagcactttgcaaaggagtactctcagcacaacggggaggactgtggggacgctgtttccaaaaccgaagactttctcgtgaaggaggagcagagagaggagctccttcacgagccacaggatgtggacaaagagagcctggcctttgctcagcaacataaagcaaaagaccctgtggctctgcacgagctggagagaaataaggtgatctccgctgccctcctggaggacactgttggggaggttgtcgacgtgaatgaatgtgacctttccatcgagaagcttaacgaaaccatcagtacgctgcagcaggccatcctgaaaatctctcagcagcaagagcagcttctgatgaagtcccccacagtcccagtgccaggctctaagaataactcgcaggaccacaaagtgaaggcaccagtccacttcgtggagccactctctcccacgggcgtggctggccaccgcaaagccccccggctgggtcaaggccggaattcccgttccggaaggccggcggagctgaaggtcccaaaagacaggccacagggctcctcccgaagtaaaaccccaacgcccagtgtagagacgctcccgcacttgagacccttccctgccagcagccaccctcggacgcccacggaccctggcctggacagtgccctggagcccagtggtgacccacatgggaagtgtctcttcgacagttacaggctccatgatgaaagcaatcagcggacacttactctgtcctcttccaaagatgccaacattctttcggagcagatgagcctcaaagaagttctggatgcgagtgtgaaggaggtggggtccagctcctcagatgtctcgggaaaagagagcgtccccgtggaggagcctctgaggagcagggccagcctcattgaagtggacctctccgacctgaaggcccccgacgaggatggggagctggtaagcctcgatggctcggcggaccttgtcagcgaaggcgaccagaagccgggggtcggcttcttcttcaaggtaagggattggtagcatctgtttcaggcactcgtgatgtgttgccaccccacgtgatagtgagttagagaacacagatctgcaccaggctggccagccgctcctgtaagaggccaggggatgtgtgtgtttagctttgtgggccacagagtctctgtcccgaggactccacttggccagaagcagtcccgggcaatacgcatgcaagtgagcgtggtgtggctgagacgactttgttatgagccctgaaactggaatttcatgtgattttcaacatagtttttttttttttgctggttttccagtcaaaaccctgtcatctccctgtcctgccccaaagcgtaaaaagcgttcgtcgttagaatgctctggaggtggccaggcctggcctgtgggctgaagtttgccaacctctgatatagcaacttcaaaaaacattttttgtatgtttttcttgtaattttttccttagatatgaagggaagcgtaaactgaactgttttaatagtcagtgcgtcacatgatgtttgctgtgacgtt

SEQ ID NO: 135889 - DNA, 4669 bp, Homo sapiens
tctgtatctgtgtaattggcctaaacaatacctatgtctaggagtcagaggtgaatcaggtgaagtgggggtctctgggggataattgtggagatacaattgtgcgggacagcaattacctctttaatgcatttctcttctactttaggtaaatcttaaaatgagagagataacagagaaagaagttaaattaaaacaacagttattggaaagtccagctcatcaaaaggtaaagggtaaatttaatttttctggaatgcactaagttaatgttggtcccaattttaaagaattctgttagttcccactatttgcttattctctatttttactcaccaaagaagcagctagtctcttggattcacctggtgggctgattctccacacctcagtgagatgtgaccacggcagcctgccccgcctctcctgggaaggggtgttttgtattgcactttatggtgcgtgagggtatttgggggaattgggaagcttgagtgagggacgtagggcccacctgggtgctagcttccacaagtcaacaaacaagggggaaattgcctgttgctaaagatgccctcgaaaagtccttaagtggctcatgaggtacagcgtagctggtggtgtacctgtgtgcctgtgccatgattctgctggatgaaccctacgtgcctactgaagtagcacgatggctgggctgcaccttccagccattagcctttttcttcctctgacgttattttctcttttgcaagcacatgtgtgactgaattcactcagttcagtgcacacaagatgcagcccgaccatctataaggtctcgcctttgaagggcagtgtgctgccttcccctgttccttcttccccctccagtggcaccagcccctggccatgcatttgttagctgggtgggtgggtgagtcaggccgcctggtatgcctccctcatctggatcttaagcattgagcttcctccctgttcctcagatggtcatgtttaacacatgggtacagactaagcactagacccttcccgcgtcagagctgacttcttgccttttggtacccagcccataccaagtttccgaagttttctttgctactgcaaagaatagtgttgtggaggtgactcgtgatcttccactttaatcatctgctaatacaacatgactatggccacgtacacttagaagactttgcttaccagaggctctcccgcctctgccgtgtaaacgccgtggggaagtgtgtgttacctcgtccacacgtggacctgctctgctgatgctcctctcctgccttccttctctcgcttcctgagcagtctccctccaagtggtattggaagttagtgcctgtaagtgaaccccaagccgccagctgccatctacagagccatcctgtcgcgatcacttgcttccattaaaaactgctcgcacccaaaactgtttttttgttgttgttgtttaaatgtcccaccttggagttatttatatagtacaagaattggcctgattctgagccgaataggccttgtaatatggcactttggaactcttaagttacatttcgcccagtttcctagttacttctttaagtgatcaacgtgcacgtaatgagagggcatttttgtgatagatacagagggaatgagaagtggtctagttgcccaagttactctgtatattttgttctttctgatgttaccttgcctgactgtggtatgtaatgtgacatctgttaggagccatcagctgggtggtccaggtatgcgggtgatgcacctggtggactagggctggagggctgcagagaggggctctcaccagcatgtcagattcctctgttctcctcctcgggtgttgcagccattcctgctgcctcggcctgcatggagtggggaaggggcgtttccttattcccaggcaagggtctgagttaggtcagcctggccacaggctttctggagttaagtgtgaattttcacataaaaagaaaggtgaaaacagcatttggttttccaaccctagttgtgctccacctggtggcccattctggaagcggagccagtttgttaccaggcccctggggagagagtacttggtgccagtggtgcctttctcgggaacttttggatggagatcttgcagagggctttatgcatactccattaactgcctgtgtccttcagtgtcattattgggcccctattttcctttgaagtccatcctcgaggcgatagcagcgggagtaagctgggatacagggctcctttgagcagcggtagattctgctgcagagctcacagatcattttgcctctcttgaaatatattaataagaagaaagaggaaagcattctaaatcaatatagatcttttaactttttgaatcctgaagactgaagagctaaatatcaaagcacttacgtgatttagtcaagggctcacagacttcgtctgtcctgcaggaagtgaggtcacatgagagttttataaaaacagaaacatgttaccaagggtggtgggtcccttaatgcttttttattagatagttcataaccctaactttccgaccccagtgttcagtaaataggtcagtgaggagaagtgtggaaaggcctgggaaagacggacagatttagaggtctaacctcaacactgtacagcctagaggttcacagcacctgatttgcaaggcagctatacaagttcctggactcttgtagttccggagtgtttcacctgaccttaagcccaccccatccatctttaatcaagaaaccatgtgctttcccgcatgcctgtgttcccccctcacgtgtctgctgtctgtgtggaagcctggcctggcgcatgctgtggtgcactgcatgctggaacccgtggagtttgcacgcgtggtacagtatgaggcgggtcacgttttgtagtgtgtgccgtgggctcccgagaaacaagttaaagtgtgtgctgaaatagattttattgacataaaataagccttattgctaaatttaagagaatgtgttacaaatgttttttgctaaacatcagtattgattattctacatgatgtacttattgacataacaacctgaaattcttgattttagacaatttctcctcaagttgattcagctgcatgactctcagaaatcagtcattttttattgtagattgctggttttcttcctctagtttgtatcgtgtattttcctcctgtggagaaaatgtggttggcaagaaatgccatattttaaagctgtatcgtggctgttaatgcagaaaacaccagtgtactgcaggctgtttggcagtggggctggggctgagtgtcctgccctcagtggcctgtgtctgtgctcttgttcgctgacatgcagatacaggggcagatctgagggtttgatggagtgcagaaggccacacgtgtggctttctgtaaatgcagaaacatggaatccttgagcagacacttgtcttctggagcaccttgcatggatttcgcctcctgatgcttcattgccgttaatagagtggtggtggttgtgttatgagaaattttgtctaacctggcttctgaaatttctcaaactaaatattcatgctgttttgtgtttttcttaatgactgaggctagtgatattactcagaaaagtaacagtaacttgggtcttctgagcgtcaggatgttcaccatttaacttgtttctcgttagtgtctagtacgtcggctttcggtagtgtaggtgtgtgttctgtgtcctttcccgtgtgtgcctgcactagtggcagcctctgcttccaggtcagtttagagtagactggctctggtattgctagcaagtagttgctgttacccagtgtagccatgaagcccagctccttggatcttgacatatatgttccaggcaaagtacgtaatccagacgtttctaactctttctagattattgcaattgttctccatgttgtctgttaggcgttatgttaattctcgatctaacagtgtgcctgtaacatatatggtagtgaagagacatcacatgcagagaccgttttccttttatcaactacaggtccgctatcgacgagagcacctttctgctaggcagtcaccctacttcccgttgttggaggatttgatgagagacggcagtgatggtgctgctctcttagctgtgattcactattattgcccagagcagatgaaactggatggtgagtggagaatgcttccctgaaacagatccgaaaaggcttaaaggaaaattatagtgtacattgatccacatatatattaaaaaaaaaaaagagaaagaaaatggaatccttaatataaattgggatgttagcctatagatgaaaaaattgggggatgatgtgctcatacttaacctgcattttatctgatgacaaaactgcactttgaaattagctgggtgtggtggcacacgcctgtggtcccagccactcgggaggctaaggtgagaggatcaccttagcccggggtggggtgggcggggggtggtggagagggagagagaaatggtacttcaaagtatctgagtaatgtgtgaaagtatttgtgactttatctatgtctcagaatgggtagcttttgtaaatccttcctcaattgatttaaatcacctagaacttagtttgagga

SEQ ID NO: 135890 - DNA, 1048 bp, Homo sapiens
actttgttttttgtttgcttgtttttttttggccaaatctgaacctaaagattgtaacattttcctttctattagtttgtgtaggtgtcttttcccatgtcttcccatatcttgggcattattaaaaattacttgcccatttgaaaggtgaaaaatagtgtctttttctatggtaaagacatagaaaaacttaattctgggtaaaattgcagattctgggtaagagcatctgtcccttactctccttctctggtgaatcacttgtttgttatctttgcccgtatttttttgggcaagagggtatgtttctttttcccctgcttggtcacgtttctcatttgctgtgcatttgtaagtgacttttcaggctgttgctggcctctgtgtttctgtggacttggcagataaatagaaggtggtctccttgtaaccagagacatcattttccttccatgctattctcgtttctacctctgtattttaaagaaatacattgtatttccggctcctgactcctcatttgtggacatgatctactgaggtaggattgtgacaaatggcaattacagtgattacagtttccatggccctccactcccctcctcctcattcccctgcggttgcattgacagctttggacacgttcacagtcagacttgatgttcctgtggtcaggcgcccattttcacaactcatgttcctttccttgtattatgctttgtttttcctggagttaatacttggtttagttttcatgaccttttcttttttctcatgcattatttacatttgtattcagtgttttccatattttactgttttcttgccatttccatatgaatttaagttccttacgttagtggtttctccttatgtgactttctcccgggtgcgagtcctcactgcaggatgcgataccggctgaatgcttccaaagcaccttttgcagtgtgaatgcccgggtgtgtaggaagtgcgagttccccgagcaaactctctcacccgcgctgtgttcctaggccctctccggtgtgggttctcagatgct

SEQ ID NO: 135891 - DNA, 1071 bp, Homo sapiens
aggggccatcctctggagccgtgggctctcgtgtggcgcacctggtgcatggatggtgtgaacacggtgtgcggcgaggtggtggagacccgtgcttttgcacactggcgttccttaggaaactgcatatcttttaaagcacatgactgttgtggagaatggggaaaagagagctttcattgagctctttttctcattgggaatgctctgtgaatgctgagattggagtgaggcctgttaataaaaatacttgaagcagactttttacagatgagaaatgtaattgttgcacccattctgttaggttgtttcatgcatactttgtgctaaaataactcagtctgcctttttctcccccaagtatcccacccccatctttctctgaagccttgctactggtgtgccttttccagagcgttctgggtcagggccattctcggtgcctcctgcactgcctttgtttggttgctcccatggcgttcccggtgagactgcgggtgccgtgcggtggttgaagagagtgtcattcctgtcgaatgaggaagctgcactaaggcgtggtgcagctgtagcaggtagagctctggactaggagccagaggcctctggtgggcagttggcctggggcaggtctcctgtctgccttcccacaaccacgacctgggagctgcaccgcctttcctgggagtcccacagggctgttgaggagataagaaaggacagtgtgagacagtgcactgtgggccacagggctggcctgcctgcctgagaacggactcctggttccagacggtcttgaggcttgaccagaaatgccaggcttggaacagtgatggtgcgggggaggcaggtctcaaatctgagtatctcttcagacggaaagggcgagggatgaagaaattaggccagaatgctgagtatgagcaggttccctgcatcagaacctggtaagaggggtgggtttgagggattatagctgctgcctctgcccctagagtgcccacatggcaatggtggatgccctgatgatggcctacactgtggagatgatcagcatcgagaaggtggtgg

SEQ ID NO: 135892 - DNA, 1001 bp, Homo sapiens
aaggtgattatatgaatcactttatattgattaattttaaaagtgggtcaccctatggcaaacgtttctacttggtagattgtaaaagagaaacttaaatcagagccatggttgctttttcctgtctggccaggtttctgcatctgtgaggtaggctctgccattctccctggggctcaccctgcttccatctaatgccagccctccacttacgtgcctgtcccgtctcccactctgcacagagccatcactctgaggggtcccctggggcctttctcctcagctgtgccagtttctgctctcctagggggactgcatcacagttgtctaagtgggaggagagggtggcttggaccaggccggttaggctcgaggtgcccccagacatctacatggagatgtcagataggcagttcagggaagtgatcagggccagaaatgtacatttggggatgactgtgtgtctgtggtatttctagccatgagactgaattaggtcattagggaggagtgagataggaagtgccccttccaatatttggagaagtgaggggcagctggcctaggagatggggatggagcaggcagcgagatgggaggaagaggccaggtaccccgaaaggagaaaggcagctccctccaagagccctgactaggtgggctgctggtgtggtcagttgaataagaggaaggctgagagtgactgtcgcatctttccccgcagccggtgtgaactgctgcaaacgttttcaggttatgggatcccttgctcagtgccctcccctgacttccctccacggcccatgggtggagggaacttggacaaacatgggcccacaggccgcctgtttgtccctggccaccttgctcttgtttcctgggacgtctcactccggcgtgtgcggggtggctctgtgctcacctctgcaggtcagctttccttgagcagtttgtaaggacagcagaagtcttcccgttgtgcttggcattggggcctgttc

SEQ ID NO: 135893 - DNA, 1059 bp, Homo sapiens
ctacacctctccattgcaaagctccccttgggtcccacaggctcatctctcctgtccccgactgccctcctcctccacactactggtttcctgtcttaggaaaagggaccgtcctgctccaggctggcaggaattataagtttggtgtttttgtcgtactgcatcaggcacaggcctgctgctcacgcctcctgggcagtggttccccttcccggggctgcctgcctgtgtcagcctccattgtctctcctggcggtgaccacagcagcctcctgggtccacgctcattctccactcttgtttacggggagctccagcagatgggatctcctcgtcctctggcttgtctgacccccttacttgatgtggtctcattgcattccttgtgtgcccgcctaagcctgtctcgctctgctgacagatcccgcagggcccaggtcctcccagcgcaggcacgcacaagagcctggtgagctaatgaatgaaacatccagtttgcctcttccgcgcaattctgaactgctgtcacttgctgaaattctcttaacagggtcattttcatgttttcctctcgctcctacccacccccctactggctgcttccttccctaagaaacttctccacctgcacatcccactgccccactgccccactcctcagtgcgggactggtgtctcctgcaccccagtcccccagcactcatcctgtgtgacaccctccacattgcgtggaaattacctgttgacttttcagttgtcttacgaggctcagcctgagaacagtgactttatctcttcctgtttgactccctggcatttttgtacattttctggctcacatgggtacttaataattgtcgaatgaatgtgtattaattctaacagtcttactggtttgtagaaaaaacaacaagaaactattagaaatacattgaaggcatcacaaagtttttttttttttttaagtaggtattgattttgatagaacgttaaacgttctagaactgtgcacatccagctctcgcagtagttgctttcactgaagccagttactcatgg

SEQ ID NO: 135894 - DNA, 1458 bp, Homo sapiens
tgtgaagcctgggttttagtccccatctcagggaccagcagtttcatgatataggcaacaagaagagtttacactccggtttgctaacttgacatgatgagcaaaatccctttataatcaactccagagggtcgccatattgtttccttgtagtgacttttcgttaaaatgaaatctgtgctcagagcccctttccacctccagaacttgccctcctgtgtaaaactgtgtaaaaattgagactctttatttaaatttacaggtgaaaccactgcgtgtcttcctccctgtgttggcaggagggcaacagtggttggagtcttggtgtgaagaggctgctcttgatggcagcacacttgtaagcacattgccacatttctgaaggtgatgacttgttcagattattggtttatgagtttagattgtatatttaaatcgtctttggttgttcttgacaagggatttgggtgtttctgacatgggggttacagagcatcttcaaatgcttcctgagcacctgttaggtggtactaaatactgtgggagttgctagttggtccagctagcatgacctttcctctgcagaggtgtcctgagaaccacctgctgcctagttatgtgtgcatctctgtgaggccagggattatggttgtcccacttactgctgtgtccacagtacagagtgctcaaatacttgttgaatggttagcccctaagagcagaggggagggcagctggctacagccctgtgcagaggagaggtgtcttcgggtgtactgagtagattaaccttgttgaggcggaggatttgtggactgaaatagtaagtgattagtttggaaaatagtctggggccagattgtttatggtgctcaggttggctggggatttctttgatgatgttcgcctgggagggtttttaagtagggggatgtcgtgccgagagagcgagcctgggaagatgtttttagcaggtttgagtgggtagaggccatagacaggtgttctacctgagagttgatgtcgttaggctggaaatgccaaagacttgcctgttcttgtttttatttttttgagacagggtcttgctctgttgcccaggctggagtacagtggcatgatcacagcttactgcagccttgacctccttgagctcaagtgatcctcccacctcagcctcccgagttgctaggatcacagctaggaccacaggcctgcacctcctggtccggttaattattattttttgtagaggtggagttttcctgtgttgcccaggcttctcaaactcctgggctcaagcagtgctcctacccaccttggcctcccaaagtgctgggatcacaggtatgagtgagtgagttagtccactgtgcccagatggacttgcctgtctgtcggcagagggaataggaagggtagatagagccaacagatatacaagctgaatctatggag

SEQ ID NO: 135895 - DNA, 1298 bp, Homo sapiens
ttttgtctttttagtagagatggggtttcaccatgttggccatgctggtctcgaactcctgaccccaagtaattcacccaccttggcctcccaaagtgctgggattacaggcatgtgtcaccttccagaggccctggatcttgatagcagcgctttgggactgggtggctggctggggcactgcgctttgggtgtggaccctgccattttgccccctcccacctcttggctgtgtctgccccgctcccctgccactgggtctccctgtggagggtgctggggtgccgctttccctctcatgagcctagggctcctggcccggggtctcaagcccagctctctgggagttgccggcaggactggatggcaggggagcacagggcagggtggcgggggatggagcgctagctcctgaggctcgctccttgtcccctgccaccgatgcagttctaggaggctggaatggtcttgcgtccatgctctgctcttggcctgagcctttgtagctccgctgatccctccatcctcgtcctctgccgtcttctgagaatgtgctgtcactcttccggttctgttcctctcccatcacttttgttctcgtgagtttctactgccatgactgcccttcaggagcttccagaaggagcagagatgagttcgtggttttggcctcggggctcagctgcagcctgggtggttcttctggagtcgcctcccttgccccagccctgccacggtccctgtgtggttgtcgttctgtgacccttgctcctgctctgcccctcacctaccgcttcactcttatttacgtcagagcagacgctgaggacacgtctgctgtccctgggccttgcacagaactctccaggctcccccagctcatcaaggagtttacacctctggctcctaaaggagacggagtctttcttgggcagagctccgctgattcagttgtcatcgtctttttgctgctcttacgttcacctcagactttctgattacgtttctgtgtagaaaaaacaagaccagaaagctccagataaagaggccatactgcgggccaccgccaacctgccctcctacaacatggaccgggccgcggtccagaccaacatgagagacgtgagtgtcagcccagagcggcggcgggtgcatggggtccccgtgtgggggattgctgtgggggggttcctgcggggcggggcagcaagaggagattctctgggaggatttggggaagccggtgagcgggtctgtaggactgcactattttgcattttttctgtaaatcaaaaatt

SEQ ID NO: 135896 - DNA, 1048 bp, Homo sapiens
agccaagctgagagcagtcatgccgagcgctcctcttatccccatctcaggctctctgtgagccagtcttctttctgggcagcctttctggcccctttcatgcgtctgtggaaaaaagaaaaacagctacccaaaacttaggtagatctttaggtcatcaggaaacaatggatctgctgttttcatttaaaattattttccagatctttctagaccaaagaagcaattctggtggccgcgaattgtcagtagggtgtggtatatcagagctgggagcttgcttcaggagtactccatgggctggggatcagctcactggtgctatgatgcttcatttggcatctaccattagtgggaattctttaatttcatccatggtgtaatttcttagctcataagaaaacccagtaaattcctggtgtagcttgggatgccaggtcctatattattagaattacgatttacttattttctaccttgaaatttctatttttccccagtgtgctcatgggagcttagaagatcccaaaagtataacccatcataaattaatccacgctgcctcagagagggtgctgagtgatgccaggaccatcctggaagagaacatccaggaccaaggtaaggctgctgtgggcgggcgggttggcagcaggcatcgtgcactgctgggggcgctggagccaggagggggtggtccacccacaggagtcagtgttctgagctggacacgagcacaaaaacgagatcgactaaaagcattctgtttttcctttattaaaaagagttctgttatagagtatttgtgaaaaacagcagaaattgaaattgaacaagcagcaggcatttgagaagccaaatgtgaattttgcttttagttctgtttcagagcaaagccagagactccaggggttctgcaggtttcaccttcgttgtggtgatgttggcatcccagtgcagtgttagacacacacatccatgtaattgcttatggttttgtgtctggaggcacttgaagagcagacatcagttttgtctgtgtcattca

SEQ ID NO: 135897 - DNA, 1020 bp, Homo sapiens
acctacccaggtgtccctcccttttgttttggaggcctgtgtccttgtccaggggcagccctccttcccaggtgtggccagaagaaccccccatcccaagacttgaaatgtctgttgctcacctctgtccctccagaactcggcttccccatcttcacttgcaaaacaagtgcagccctgcgcccatcagcaccccctccggtgtgcacacaggccagtgagcggtggccgaccagcgcaccccactcccccaacctccacaacccatcaagcggaggccgcctccgctaggggaggaccatgtgctgcaccctggcctggggacctacagggtgtgggttagacgcattcccactgggcggctcctttctgccccgaagcccacccctgtggcgaggccctaggagacctcccgtggggccgcctctacagacagcactcagcctcctgggctgcctccagccaggcccagcacatgcctgccctccagaaaaatacgttgctttccagaaggaggtgggggaccatgggcaggcactgtggacgctaacctcggcccctccacccattcctcagggcccacgtccagggggaccaagacctgcattcctagggctgcaggtggctcagtggtgcagaggcatccagaccttctgctgaactaagaaccacccagcctagagggagcctttctctgcctcttcctcccctgtcttgggcacaggtggggttggagcccccatggggcccgctgggaacctggaccaagccttcctcggagatgggaggaagccgcggggtggagcaggggcaggtaggtgaggttgagctgcacttgagttccctctggagtttccttcatctgccccacacccaaatttgcactttaatttgaccatccctgggggcctggctgctgacagaagggctctctctgccctccactccaaagtgggtgcccccccacccttggccaggacagggagggagccgctggctgctgccggaggtggtggctgc

SEQ ID NO: 135898 - DNA, 1075 bp, Homo sapiens
actcacggggcctctgaatggcccttccgggggccacgagggatgagccgtcctgtctctgccatgaacaagtctctctgcgggttctccgttaaagcccagttgtagcctggaccttgaagctcagctcctgcagagggtgagctgggggccggggaggtggaggctgcgtgaagacattgaggcacctttgcggacgagcttccactcggggcggggtgtttttagccagcagcacccggtgcacggcaaggcagaaatagaagaggcttttttggccgctctggtgctgacagtctctggctcttggggagctgggcaggggctggggaggggcgggtgttccaagcacaaacaacttctgctgtttagaaaaacatctcgagacgaggtggttgtggatggggaattatttctgttggtgaactctttatgtaaatgccacgcaccgtgcggcttctccgcgtgtgtaatcacagcaggctgcaccgggggtgggggtgtgtaattatgttttaaaataccacccgggttgttttgctgtgttccctgagcactcgggtaattctgggcttatcctgcgatgctctgccccaccgggaaatgctgcctgacccctgtagtggccgggcaggggctgtgcacccacctttgaggccccctttctggcctctgttctgttgcagcctctgcttgggtgtccctgggccttgggaagctccccttcctgggactgacaggtgcagtgcgtaccacgctcatcctgggccagtgggtccctggggagggagtgtcagggtgactccagggtgggtggtttcagaccccgcatggttctcaggagtggaacacctgctgccttcagtggggcgcccgctgtggattcaggatgtggggtcctcagaaaccaaggtttcagccccccagggctgggtggcctgcccctccctgacaggcgctgggtgcaaaggtgactctgggaccctccctgcctcctgccctcctcaggctgctccccagcagcccccttggcagcccccccacgccccgaggctcagccacccctgtagagttt

SEQ ID NO: 135899 - DNA, 1066 bp, Homo sapiens
tggcccttcctgagggcagagcacaccgggctccggctcaccacagaggccgtacaggatgtcagtgcttgtggacccggctggctgaggcctccggggaatccgccccatgtgcgctttccctctgcccctgctgacagccaccccagggaaggcaggggaccagccagaggctgctggggaaggctcccaaggcccacccagggcccctgttgggaaggagctctgtccatgggctccagtcccagggcagaaccccagacaggctgggcacccctacagtccctgaggacatcccccattgatggcagccagacagtgccctgccgacaatggcagccagacagggccctgccgacgggttgccgacgggtcagggagctgcaccatggagatggaaacagacccatcgtatccaaacatcttcccagggtcctccctgcacagccccctgctgctccaatgtgaccttgggccttggtgtgtttggggtgatgggagccagggctgggtgtcgggtttgctgggagcacggtgaagcctcgtgacttgtcccatgcatctgcccctgggtgctgggtcagccttaagccctcacatcgcctggacttcgtgagctagaagccctcacgcccacctgccttgatgggtttttggggagtcagcaggaccgcagccaggaagcggctctgtggagtcccggatgtgtgttgggtggggacgggaggcagctgctctggtgagtccttccctccaactcccccgtactcagaccacacgaggtacagtcccattggggctgaggggtggggacaccctcaaggccatgttcctgcagggctttgtccaggccgcaggtgctgcgcggcattctctgcctttgcacgggtgtcgctgatgccagcgaggtggaaagtgggcggctgggaggccaggcctgctcccgcccacctaccatacagtttggctctggatgccacagtctgggtttcttgtcatggtttttctgttcggcaagcccataagtggggcagagaaagggggtgtgtgatttcttggttaaaat

SEQ ID NO: 135900 - DNA, 1054 bp, Homo sapiens
ctgatgtggctgagattcaggtgcctgacctgtcccccagccattcccacgcccctttctgtcccgatgtcggggctgggctggcccctcttgcctcgcacaggtttatggcctaggagtacattcccctggagtcccgtctatgcatccaggtacggttccagggccagtgagcgggccacgtcccacctccaagcctcagttttctcatctgtacagtagggtaatggtatttctcctgcgcttactttaaggattaaatggaaaaacctgtattaaggattgccatttaaagattaaatggaaaagcctgggcctttagttcctgaaatgagagagccagaattatttggagaacctgcccccagatgtgcctgtccccctcatgaattctgcattccgagggactgagcttcgtggaattctggcgtcttctggcctgcaggcgagtggggctggccacaaggttgcggggggtgggggtcctggggacccctgccaggtggtgggtatgcacccggccttggggatgagggtttgagtgggtgcctggtccatcccactctctaccactgtgtctgtaaactcgtgcatggattgtttaaagatagtacggcaaacctcgtgattataaaagtatgattgggccggacgcggtggctcatgcctataatcccagcactttgggaggccgaggcgggtggatcacgaggtcaggagtttgagaccagcctggctaacatggtgaaaccccgtctctactaaaaagaagtacaaaaaaacccaaaacaaaactatgattggactgatattatttacgtggttttcactcccaaaggcacacctttgcgtataaagcacaagtcagtattcatcactgattccttattcacttttcaaactactttcacttaccttttattactttataaataattttaagcacaattttgttgcccccttgcctgctccccggtgtgggggtggccagagtccttggggtcccctcgcatttcccgggtgaccacacagctgccccctgctcaggtgtcac

SEQ ID NO: 135901 - DNA, 1011 bp, Homo sapiens
gaaggcaggcactgcgctttgctgctctgaaggcccatggagggtcctggccacattcagggagtggcttctgaaggtttttagaatgtccaacaagggtccccaggggtgacttggttttctccagcccgaggtgaagggcctggaggcggctcctgcccgtcggagctgccctgcgtggcgcccggactccgggctctgccaacccctcccatcggagctgccctgcgcggtgcccagtctctgggctctgccaacccctcccatcagagccgttctgtgcagtgcccagcctccgggctctgccagcccctcccattggagctgccctgcacggcgcccggcctctgggctctgccaaccccttgtttccacagtgagttcaggattgtggagggacctaccccacctggctacccagcattggcaggtggggactttgcttcagatgtttaagaaaaaaggtaaaagataaagtaattaaacttacagaaaaatgtcaagtattgtacaaagaacattttcccgaacgatttgaggtaaacctcccctgcatacctgtgtgtcttgttccagtgtgggcagagggctgcccgccacccgcctgtacccaccccctggcagccgcctcccaggcccctcctggccttacaccagcagatccagtgcagacccctcagtacagttacttgttgagtctctttaaatttaattaaaaactttttttttttttgagagtcttgctctgtcgcccaggctggagtgcagtggtgcaatcgcagcctcaaactcgggctcaggtgatctccccgcctcagcctctggagtagctgggactataggtgtggatccccacacatggctgatttaaaaaaaatttttgtgcaccaccacatctggctaattaaaaaaatttttttgggtcgggcacagtggttcacacctgtaatcccagctacacaggaggctgaggcacaagaatcacttgaaccctggaggcggaggttgcag

SEQ ID NO: 135902 - DNA, 1123 bp, Homo sapiens
actgcctaagagcagagtgtggtccagctagtggggagctgcgaggatcctgcaggaaagagccactcttgccccttcccatccgttttggcattgaccacttccgggggcctcccctggccactgtccccaaggccccctttccccagtgctgccctagaacaagcactttggcttccccaggtggtgggccccttggaagtatccttgggagggtttgtggaaaagagcccaggagtgcctgcagatcccgccctggactccattttcccgtagtcctggtgctggagtttgtgtccactttcgccagctgattgcctggggagggatccgcatggtgtcctcatactgacgtgggttttgcggctctccccgcaggccgacgcctccccccagggtcagctgcgggctcccaggcctaggcgcccatgacccctacgccaacagccgcctggacaccgccgccgccactgcgacctagcgccgccgccgccggggcccaatgccggtcatgcccattccgcggcgggtgcgctccttccacggcccgcacaccacctgcctgcatgcggcctgcgggcccgtgcgcgcctcccacctggcccgcaccaagtacaacaacttcgacgtgtacatcaagacgcgctggctgtacggcttcatccgcttcctactctactttagctgcagcctgttcactgcggcgctctggggtgcgctggccgccctcttctgcctacagtacctgggcgttcgcgtcctgctgcgcttccagcgcaagctgtcggtgctgctgctgctgctgggccgccggcgcgtggacttccgcctggtgaacgagctgctcgtctatggcatccacgtcaccatgctgctggtcgggggcctgggctggtgcttcatggtcttcgtggacatgtgagggccgtgggtgcgagcttgatgtatcgtcccggcctgtggctgtgttctctccatgggtggggtcggccagcgccttcccttcgcccatcccccaggcagtcgctgctgcccggcgcccacggagagaaaagaaagggctgagacttctgtgatgggggcgcggacaccacccctaggctggcttcctggacccaccctc

SEQ ID NO: 135903 - DNA, 1069 bp, Homo sapiens
tatgagagagagagagactttgacggttgtagatattttttccgctttgcctactttatgttgtataatcatgtgtttactaacaagttgatgacatggatgtattcataagaccatgtaatattgatgtgattgttgtcgcttgagaaaaaaaggcaacagctgattctttcaacaactgtcacagaatggctgggctgagaacgctgcccagggccctgcagctggcgggagaggtgtctggtgggagcggtgtctggtgcgtcagcctgctgcttcgtgtctcactcgagagttgcttctggtttcacactttttaacccctctgtgctttagcagccgtgaccttgccttcattgcttcatccagtgcaggcctgggttattgaagacaccaaagtgtttctcttccagtttgaaaaccaggcaggtttacacgtgggtttcagtgtatttgcctttgaacccttcaaactaaactttagccttttggctggtgttgaatgtctttagctggggtgacctggagtgacctgggacggtgttgtggtttaccgtctccagcttcagcctttccagaaacccttgtggagggcagtgttggctgcaggtttcatcatattgcagtttgaggtcaccactatttggggaacaagcttgcgtcctgctgaggggcaggattttcagcagagcgtcggtggggctgggccgtcgtggaggtggccccaggagtcatatggccatactcagacacaccttgtgtggcctgctcagagctggatgccacctttaggcaatgtttagagtctattttctaaagttttaagtattttaagaggtattgagactaatgaatataatagttcagtaatttaaatgcttatttattttcagtggaaggatttttattaaaaagaagctaattgacatggaaatgtcagtgaaatttcttacctgcaaggaaagtgaacattttgtatttaagtaaactataatgtgcacattttaataaagaaatctgacatttgaaaaaatggtgattcttttgaaatgtgaaccagctctaccag

SEQ ID NO: 135904 - DNA, 1060 bp, Homo sapiens
ctcacggcccacacaagcccataggcagttagccccggctgccggcgcatgtgcactgccgcgcgcccttcatacagtcagtgacggcagaggggaagcccagcgggcgggcaggcggggtcagcacagctcctcgtgaggaaggcagaataaatcagcaagcccccgccagctccatgatgagtcacacaccgtgaccttgcctgtcacctggccggagcgaggccgtgggcgcaggtgggtgagctgcaggcacgggctggagaaaggcatggccgtgggcacaggctgtcctggggagaggcgcaggctagatgcccaccccatggccccttgggtttcctgcctcccatcagagaaacccgagttatgagaggccccatcctaggttcagcccctctgcggatggagtgcttctctttggaggtgcggtgccccccgcggtgggggcgggcccgggtttgggtctgtagctctcaggtggctccttcctcatgcagctgttccctggacggccgccagtcaagaagctgttggagatgctgcaggagtggctggccagccttcccctggacaggatcccctacaacgccgtgcttgacctggtcaacaacaagatgcgggtgagccccagaaccctcgccagccacgctgcaccctccttccctcgccttccttcccttgcccttagctggtgcatctccctgctcggggcccgggctccgctgtgaggaaggggagcagtgacttactgtctccacgacagcatcatggccatggcctcctgtctgccttggcagcgtcatgctgggacttcagtttaaggacagctcaccaaaagtgcactgtgaccacctgtcctttggacaaaatggggttttctcaagcaacgtagtagttgggctttttaaatttttagtaagccaatctgacgaaaactgatgtattcagtaagtgtggcagcctttccagagctttccccaagaccaggtgccagcaggtgccagtctttgctcaggggaccagcaccccaagaggtcctggcactccgtcctgccat

SEQ ID NO: 135905 - DNA, 1024 bp, Homo sapiens
ggaggctcttctcacctttgccctcccctctctcacagcgtgaagcctctgcgggccttcttttcgtcttatttgaagtcattgccggatgtgaggaaaaaatcgcttcccttgcctgaaaagccacacaaagaagaaaattcagaaatcgtggtttggagagaatttgacaagcaagtgttcctcttgaactgaagcccccggagacagtgcgtgtagaccgaaggctgcgtgcttgcagggcgggtttactcagaaacccaccccagccagtgagggccgctcaggagccctcccaggggccctgggagtccgtggggaggagccaggacagggagacttgctgtggagggaaaggttgggcattccctgacgctgccatatcccgtcctaggtcgaagctgtacacggtggacctggagtcagggctacactacctcctgcgggtggagctggcagcccacaagtccctggccggagcagagctgaagacgctcaaggactttgtgactgtcttggccaaggtttgggacggtgctggtctgggctgcatgtgggaatttggctctgcacagagtgggccctggggggcgtcggacactgcgggggctccgccagctccgctgaggtgctctccaccttgctttgtcgcccaggcccacgccccaactcattccacccatttcccgagtgcctcctgcgtccactgctgttcccagcactggggctggggcggtgggtgtagagaggggcgggggtgtgagccgagcacctgctggaaaagcccagctctggctgcctggagagtagatggaggagggagcggaggcccacacacacctcagctggctctcagaggagcgctgcacgggggctggggggagagagagagggagaggcaagggctgtgcagatccaggtggggtgtgcatctgccccaccagccaggttcagggaggggtcctgggagcttcacgctcagcaccatcaccagcacagatgtggtgtctgagaccactgaggg

SEQ ID NO: 135906 - DNA, 1050 bp, Homo sapiens
ctgagcagaaccagacaggagcagggtggctggggaggagcggcagcacgaggcctgctgccccggccacgaagcttccacacgcgggacgggagtgcgaggccgtggggtgtggctgctgtgtgcagggactcacttgaccagtatcagtgttgtggggggcgcgctggttttagaaagtcaagtgcaaattcgcggataagtgttttctttgatgagtttgtaaaattgccgaataagaccgtggtttctgctcatggcgtgtgtgccgtcagttgccttaaagtgcaatgagagtgaagatttgagtgagggtcttgcctgcagggggacagacttcatgcccttttgtgaaaggttccctgcaaggccatgtgtctgcacgtcgtgttttctgagaaactgccagcccctgtggaagtgtcattgtgttctcatcccccaggtgatcttagacctgatcccgtatgaaagcatcgtggtgacccgagcactggacggggacaaagcatttctggagaaacttggtgtttcttcagtcccttcgtgttacctgatctacccaaatgggtcgcatggattgattaacgtgtgagtgcccgggtggggtctgggaactccgtgccgctcggagttaccggacagaggctccgagtagacagtgcaagtctggtgtgagatcgggggagccctggcccctccgcctcgcttccctgggcagatttgggccctggctctcagcccgtgggtattgctgatctgtgctgtgttttcgtggatttctgttttctcactgctgtgtccccgcacctaggaggagcctggcgtggtgacttaccaagagtcgcagaggaaaccgtggctaaaccagcacatgcatgagggctgctgggccggggctttgggagcagccgatgctcctaaaaccctgctctgggtggactcttgggatgcagtttgggtctgtgtctggggctggcagacaagcccacgtgcccacctctgcagaatgagaagtaggggtgggcaccaggccctgcccctcacgtt

SEQ ID NO: 135907 - DNA, 1048 bp, Homo sapiens
tatagaaattcccaataaacagaatgaaaccatgtggaattgtgagccagataaaaggccacagaaatgagacacttcgccaggatgcacgggctgaggagccggggctgtggaggggtccgcccgtgagctgcccacggcggggctgctgggagcacctcctgtttccgcgtcccgtgccgtctgctgcgctgactgggtgagagcatgaacccttcttcctcagttccatgtggtctgaggcttgggcaaggagtggccggggatgcagagagctcgtgtcgcttctccctcatccactgaaagtggcctcaaaacctgaattggtttcacttagccagcgtaagcgggaacggtatttggtcattgtttctgaaagaggtttctttcttttttatttttaaattacagggagaaaaggccagtatctgaaacagagctgtggtatattatgtagaaaaatagcaatctgaaccgctaacacacacaagccttcatatttgtacagagtctggtgatatgttccgtctcttccaggcatgcttttaacagaacctctggagtttgagatcatagctcgctctcagaaaagactcttactctttttacatgatttatagtggaatcattgatttagacaagtgggcagaatcggaatacaaggcaaaaaagagcctcatcagtatctcagtgacaggcagacataacgttccctcccgttcagaaatcactgggcttccggtcacaaggctgtgccagggcagcaccccacgtggctggctccattcctccaggcaggtccatttgctgggtgcctgggtctcgcctctgcacctgcctctcccacggtgcggcgtgccctgccacactgccgactctgctgaggcctccaggctccaggatagccagcacccatcccttgacccagtggtgcccctttaggctgtcccctcaaagtctcagggcctggaaggacccctacagagtgaggagccaggaaatatttgtgaattgttggcagtgcaatttttacatcccagaggaagaa

SEQ ID NO: 135908 - DNA, 1036 bp, Homo sapiens
aggtgtcagcgggaaaagggctcttcggcaggctgtctgcccacacagccctccagtgtgcccgcccacaggcacggggagggggaggttcactgctgcacttgctgggggagtgtttacggagtgcgcctgtgtgtgagtgcgagcccacgtgcgtgtgtgtgagcctgtgtgtgtgcacgcactcaagtgagcaggggcgggcgctaggagggccgagcccttgcccagggtcctatttaagcctcaggcatcccagcattgaggcagcacttggcactttgggcagggcggtggtggccctgggcaccttgtgtcctgcctgcgctctgtgtggccaagcacccagcgtggctccctgctgctgtggagacagcctgtgatccgcgtgagtctggggtccctggggtcctaacaggtggaggctgagggagcacacgggcctctgtgaagccgggtggggtggtcttgggccgggtgcattcccctcctccgcaggagaaactgggcttgtgccaaagcaagagagactagagtcagactgcaggagggactctgaggcctccgggaaggagggagccagggcttggggcaagggagaggttagagcagggaggcggaaccccgagtcccactggatatgttctactgggacataaatgcaggggaaggtggccttggggcccagggtcctgcttctgaggggctccaggagccccaaactatccagagcctttccccgtaccaggcactgagccacggttttgcacctgcagtcgtgggcccctgcccccatgtgagggaggcatcagcccctcaacagctggccccagcctcagggaaggggagggctgcccgacataggaccctgagaggggctctgccatggggcctgggacatggcccctgacgggtcctgcctttcccaggagggaccttgctcagtccacctgggccccgggtcacctgggggagtccagattgggccagaggcagaggccccccgcggctgtgccctaggtcatcatagcccagg

SEQ ID NO: 135909 - DNA, 1457 bp, Homo sapiens
gcctcgggaggacgtggctgtgactgtgagaccggcgtccaggagtgggggcagggtgggcctggcggtgggcacagggccttagctcgcaccaggctggcactgctgctggggctcgggcgggccgcctgccccctgctccgggcccccggcgaggtccacccgctgctcgtccatgcgcttagcctgcaccctctgaatgaggctgaagaagtcctcgtccggcatggtagggccccggggcagtacgtcaggtggcgggcagcgctggtcatcgatcctggaggactgggtggacacagtgcagttggcggcctcacccccccagccccagtggtccggggctggtcagcagcggtggttccagaggccagcgtgcactgttcacgggcttccccctgtccacccaggaaattggttctggggcctgcctcgctctggggtcttgtgctgggagcccgggccctgagcgcagtcttctggtggccccgccaccaacccgcaggagcccagggcaggcccgcccaggaaaagcaggtccagcgattcccactgggcatgggtgtgccaggcccaggagacagtggctagggcggcgttggatgcctgctccccacatctgctgatccccagggacgggcatgcgtggccgtccctctgcccagccctggaaaccagcacagcctgggactgaccctggcaggcctgaggtctcagcttccagagcccgaagtgtggcgccccccagggcttccccttgtgtcaggtggctgaccccgtgggcctcgcctgctccagtgtgcaggccagggggccaaggggttgtctgggcttctctgaagcgcctggagcaggagggacgggagctggcgcaggcatgcgtgtggatgggggactctgggcctcttgggtggggctggtttggaggtggctggtcggacgcctggccccgggccgaggtttcctctctgctgtggggaggacggcagacctggaaacgtgctggcttggttcgtggtgggccaagcggcctccacccccagcctgttcccaagtctacggaccctgaaccccttcccagcaatggctgcaccccacagggatggcgagacccccagagtttgaggtcctagttgggatagcagttggctcagcagtctccactccggccaccctacctggctcacccccacacagatgaggaggtcattcctggcgtggctgccaggctggagccccggccctggctctgccctctggggctggaccctccgcccatgccgtccactgtgtggtccctggatggtccctgtttttgtcccaccagccagctggcagccctggatccccctgccctccccactctgggggtgctatctggcccgtgttttccctgccgggtgtggagggctggtggggaatccctgaggccatgagctccaggacctgtgaccccc

SEQ ID NO: 135910 - DNA, 1034 bp, Homo sapiens
ctcctgccacccgggggtgccgacgccctggggcgcagacttccccgagccgtcgctgacttggcctggaacgaggaatctggtgccctgaaaggcccagccggactgccgggcattggggccgtttgttaagcggcactcattttgcggaggccatgcgggtgctcaccacccccatgcacacgccatctgtgtaacttcaggatctgttctgtttcaccatgtaacacacaatacatgcatgcattgtattagtgttagaaaacacagctgcgtaaataaacagcacgggtgacccgcattcccgctcggacactcgcgcgcagccccgcggccgtccctcctcgctgcggcccgcggtgtcctcggggtgcgagctgcacgtggacgcagggccccctcaggccgccagggggcggcatagcgcagcgcgcccccgacccggaagacggaagcccaagaacgccgcttccgcccggcgcccacttccaagatggcggcggggcggggccggggcagggcggacggagccggcgagcgggatgctgcggactgcgctgcgcggcgcgccgaggttgctgagtcgcgtgcagccccgggcgccctgcctgaggcggctgtggggccgcggggcccgtccagaggtcgcggggaggcggcgggcctgggcctggggctggcggcgctcaagctccgagcaggggccggggcccgcggcggctctggggcgcgtggaggcggcgcactaccagctcgtctacacctgcaaggtaggcgcgcggcgggacggaaccggggacagacccgtatctgacgctacacggcctgcggggagaagcggcccgccggggatccgggaggcggcgtggtcaagtcacaggaaggagtggagccaccccttggggcttctgggagggagcggaggcggaccatgaggaggggtggagccgtccctggggcggggccttcccgggagagggcgaggttgggggtgggtggagctatccctcgggggcggggccttctctggagag

SEQ ID NO: 135911 - DNA, 1053 bp, Homo sapiens
cgctcctggccaccctggccccccaaggcgtccgcaccaccctctcagtaccttcgagggtgggctctgagagtgaggatgaagacctcctgagtgagctggaacttgcagacagggacgggcagccgggctgcacgacagccacatgccccattcaggtagggtgggcgcccagccccacttccccatggcaggcggcggtccctggggtgccctcgcctgcctggagcagtggggtgggggctggtggaagttgcgggcaggaaggctggctgctgggtgtcttaggaggaggaagctggttcctggcctgcccagttgcgtgtagattctgcagaagtggcctccctttggggcagtgtggaaaaggggagaagagaggcctcattctcgtgcaggagcctccggccatcctgatgctgcccagccaggtggccttgtctgagcgagaagctctgggatggacgctgacccggctctgagccgcacacgccacacacacgtgtgctcccagggtgggccatgggcacagtggagggtggtggctgtgtttgtctctggatttctggggtcccaaaggtccctctctgctgtcacctctctgagtgtccttggggagagttttccaatctctgtaggtgaaaccatgtttggaaccctggaaagcatgtggagctggggcccccagagaggcctcctcccctggtgccagggtgcccacttgcagcagctgggaggctggcctccctgagaaaccaccagaagcaggcagcctcagctggacctgtgggcctgtcatagggagtgtggcagagggccttccatctctccccagggttgtgtctcgcaagtccctgggctgaagtgtgggaggaagcaatgtccaagagttggggaggaccccggccagccaggggaagaggccctctgtgccccatccatgtacagcctcctgccctgcctgggtgtgatggctgtcccatgggggagtgggaggcccaccagagggatggcttggatggggtcagagcccccgagggagggagtgcacag

SEQ ID NO: 135912 - DNA, 1077 bp, Homo sapiens
ggtgtctgtcctgcaggaaggctccggttccctgttcatattggctgggggctgccaagagctgctcaacgctggggccctggggccctgggccgcccgagtctcagtcaggggaggcagcagagtggccagcagccctgcggggccaggggtccctgctggcctgggaaggctcaccacagctggtacaggaacagggagaagcccctgggctgtgagcacccaggtgacaggcagggggacactggtcgccacatgtggccctcctatgtgcgtcaggctgaggggctggacgggcagtggggtggggctgggggctgcggggagaaagggtggcgcctcaggcaggccctgcttccgggatgcagcgggggcctgagactgtccgagaccactctcggggcagctcacagagatctggccggggcccagggcaggggcttgggaagcagcaggggctgtgccctcggcctctgagaagacaggagcgaggggcagggcttgcatggtggagagtctcttgtccttggctgaagtcccagcctcctgccaggagccagaagtgccaggtttggctgccgcgggggccccaggcccagagagcggtacatttaagacggtgggacccggggctgggcggccgtgtggggtgtgtggtagagggggctggaggatcacagacgaggagaccagcagctgggacgggagcaccaccgggccccgggtggcctccctggcacgggcctcctgaagccgcttctcctgaagcagctccgacacagtcttgggcttgggccgggggccggttgaagccagcagggacgcctggggtagggtgcgctccacccggctggacgccagtcttcggctccctttgtggctggcactctttgaggcttcttgagccggcacgtttgggaagaggtggcctgtggggaggaaagacccacacttgataagccccaggcatctggcccagggacagcccctcgctgccatcccctcatcaggagggaccatgtggggagcctggggtcttgagccaagagagggtcaagcggcacatcctgggtctcc

SEQ ID NO: 135913 - DNA, 1060 bp, Homo sapiens
gaaagcagctatggttaggttgcctcctgtgtcccgcagctgttccacatcgatactgccggctgcttggaggtcgtccgagagaggaaggccctgccacccaggctgccccaggctggtgctcgggacccaccagttcatcttctgcaggtagcaggcacttggggtgagaagtgaggatggccactgcccgccccggcgttggagtgggtttccacggaggctggctgcccgccccacccgctccaccgcagcccctcagggaggcatctgcacttcccacctgaggggacgcagccttgagaggccctggggaagtcaggcaggtgcaggtcggggctgacactggggcccacgtgcctgttttcccccatagccccgctgggcggtcatggacatgggcgctgtctgccggggatgcctggttcttgcctttctgctccagaaaccaaactcacagaagttcagcgaggcctcctcacccttgagccccgtcacctgggggtggggtgacaaagcagtgtcactcattggaggagcaggaacagcagtggggtacccctgggcctctgtgcttccagcccccccgcctctccctgcagaccccaccctgcccccaaccccccagaagagctcttgagggcacccttaggaggagctgcactggcagggggaacaaggccaggcctttgcctgctgtgcagggcacgacaacgtcccctacccaaggggtcacagccagcagcagcctgcggttcaggagcctccggtgcagagcgtgtctccagcaccgctgcccactctgggtggctctgtgccgtagccactggacatgggatcgggccacatgcttggctccttctgtggccccggagttcctacagaggcgtgtgggaggccagcaccagcccttggggcctcgtcccatttcagggagtggcaggggatagtccagatgctaggagaggtggtccaagccagcagaggacacctgagctgctgactctcctctctttcatttccaggcatcctcaagtgcccagagcaccccaggtaactc

SEQ ID NO: 135914 - DNA, 1037 bp, Homo sapiens
tccactctgatggggccacggcgagtctcctggggaacagcaagcctgtcctggggaagaatctttggatgaaggcatttccatggggtttggcttttgcaggtcactgggcaaaaatagcttctgagctgccccatcggtctggctcccagtgtctgagcaagtggaagatcatgatgggggtgagccactcgctccttctttatctgaaaccagacaatggcctggtcaactggggggtccagcaggcaggaggaggggaggggaggggggcgttcggtttctggtcttggcatttcttcttctgggtggccaagggcaaagggagaccctgcctcggcagcggctgctcttgaccccggaggcgcccccgcttgggcctctccccaaagggctggcctgcttgctgccatcatgggtgaaccgggcttgccaaggcctctaagtagctctttcctcccctcagaagaagcagggtctccggaggcggcggcggagggcccgtcacagcgtccggtggagctctaccagcagcagcggcagcagcagtggcagcagtggagggagcagcagcagcagcagcagcagcagcgaggaggacgagccagagcaggcgcaggccggggagggtgacagagcgctgctgtccccacagtacatggtcccggacatggacctgtgggttcctgccaggcagagcaccagccagccatggagaggaggggcaggggcctggctgggaggccccgctgcctccctcagccctcccaaggggtccagtgccagccagggcggcagcaaggaagcttccaccacagccgcggctcctggagaggagacgagtccggtgcaggtccctgccagggcccacggccctgtcccgaggtctgcccaggcctcccactcagcagacactcgcccggcgggcgcagagaagcaggccctggaggtaggccccggccctgggtgtaccacgggaagtgcactttcggcactcgctcgccagggctgacgcttggggatagtgcagcagcagg

SEQ ID NO: 135915 - DNA, 1054 bp, Homo sapiens
acagtacgggagaacaggaggcagggggagcccgagtccttttgtgggctctggagggatgtgctgggcctgcagggagcacatgtggcctgtgcttgtggtgatgccgtgcaccctgacaggggccacctgccaacgaggacacacgagagaaggctgcccaggggatcaaggctttcgaggagctccttgtgaccaaatgtaagagccctggccggccctgcggcacccctgagcttgggacacctccccatggccctcctttccccagtttctccccaagttctcagacctctctctgttgtgacctcatggctccttcaggccttgaccactgggactggccccttgactcctgcctttccacactgagcaggtcctttccagaacaccagtcacgaggggctagccaggccgcaccccaccctctggctcagtctccccgcccttgtcttgggccgcaaagccctgtggctttacgtgtgagctggcgccaggcctcgggtggagctctgtcagctgggtggaggggccacgtcagtaggtctggcgtgctgcttactcgctgtggggccccccaccactgcctcgggaagtgcacaccaaccgtgggggctgggccgtggagaggatccagacccccagtgatgatgctgtggcttctcctcagggaaaaactgggaaaaggccttgctccgaaagtcagtggtgagtgaccgcctgcagcgattgcttcagcccaagttactgaagtaagtctaaaaccataagtcaaaaacggtcttcaggctgggcatagggctcatgcctggaatcccagcactttgggaggccaaggcaggaggatctcttgaacccagttcaagcccagcctgggcaacatggtgagaccccatctcttcaaaaagtaaaaaaattagctgggtgtggtggtgcacacctgtggtcccagctactcgggaggctgaggtgggaggatcgattgatcccaggaggtcaaagctgcagtgagccatgattgtaccactgcgttccagcctgggtgacagagcga

SEQ ID NO: 135916 - DNA, 1019 bp, Homo sapiens
gagcctaccccaaccccaccagctgctgccctgacaggagacccccccagccttgcttcccacctctcccagacccagggcctgcctctgaggcaacctgctatctttctcctgtggtgagggcctctacatccgtgcctcccatctgaccggctaagctcctgaaggagaggtccgttttctgctaaactttccctgtctctccagtaaagatagcttgtgccatccagtgaaccctgtgtagctttgtcctgtgtgcctggaggtccccagtgtgtggtcagagttttctctatctggctaacccggccttggtccagtgcccaccccgctgtcagggagggaaggtccgctcaccgccagcctcagcctgaggcgctgtcactacctcacaaccccaggtctgcccaagaagcagtggtgagctgcgcccccaccctgcccaagacgctggttaccaacacggtgttgcttgtgtttctgacagattcactgccttctgaggacttggatcctgccgatcccccgatctcggtaactgttggcctgatctggctgtgccactgggtcaggcctgccaccaccttccaaagtagcctgggagggggcgtggtttgaacccatattggtttttctgcattataaaaatgattcacgtttgttataaaaaaattaaaaagcatttgtcattgaaattgtccccagaaataaccactgttaacagcttggtgatcacaccccttgggttttttctgagctcattgctgtatgcctctgtctcctgtgtggcatctgtcacttgcggaaagctgtgagttgtgcacctgcgtcctgcccctcacagctcgcctctctgtgcctcagattcctgtggggcagcggggacgtttacagcacaagtcagttaacacgagcagctatacagaaattagctggtgcagtggcacgtggctgtggacgcagctacttgggtggctgaggcaggaggatcacttgagcccaggaggccgaggctccag

SEQ ID NO: 135917 - DNA, 1014 bp, Homo sapiens
tgtgaacgtttctcaaatgccctctgtggtccggctctgtgtcatgggagagcaggatggccaaagtgggtcacgggctgtgtccttgccctgtagtgactttgccactgcaccccacaccttctacgctgggtggccagtttccatgtggcttggtgtgggagcagagacgggacagtggggcctgtccttgttcatccactccctgcctgtgctggttgcagcctcagagcaggcgggagatgttcttggggcttaggctcctggcagagcacatagcaggagtttgtggggtctgaggttcctgtcccagggttccccgattctgtgcctggcctattaatctttctctggggagcccagtgcccactgccgagcaggctcctgccatcccccatgggcgggtgtgtctgaaggagaatgggatcccggcacggtcttggtttctaacatctcggggtgtgttttggaggcaggcgggagtcatggatgtagatgctgaaagagagaagataacacaggagatcaaggagctggaaaggattttggatcccggctcctcgggctcccacgtggagatctcagaatcaagtctcgagtcagattctgaagcaggtaagccccttgtacctagcctcctggggtcctggtaagaacagctggtctgcctcctgggttcctctcaggcacattagggagtgatggtagccgggtgtggtttctcaggcctgtaaacccagggactcctgaggctgaggtgagagcattgtttgatcccaggagttcatgtccagcctggacaacgcagcaagaccctgtctctaaaaataataataataataataaacgatggctggtgctgcttggaccagacccaattttttgccaacactggtgtctttctgtactccagccagagagcttctgacaattcctcctttgctagcccctgaaccagctggctgtgtgtgtacactgggctctaggcatcccagggtctgggcctggcctcct

SEQ ID NO: 135918 - DNA, 1038 bp, Homo sapiens
gagtagctgctgccacccatcctgatatccatgcttgttttcaggcaactggtttccggagctgagacactgaatcttgttgccgaaatccttaaatctatagacagaatttctgaagttaaagacgaggaggaagactcttgaggacccctgggtgttctcagcatgaagctccgtgtataccctgaggtcaccaccgctcgatctaaatgtgcagttgtgtccttaaatatgcagtcttcacccagagtaaagtgttgatcgcaagagtccagtgtcgtgccctcagccagttcttggccaccacaatgggagcagccctggccgagttgtctctgtggtttctatgcagcccttcttggcgaaattcctgcgatcttatagattctaatgagctcttggaagacattgtcataaaagccagtgattttaagaaaaagagtggttctggaatcaatgttttccagtcccatcccagaacatcagttgtaagataagtacaattggttgtccttgatttcataagtagaacaaacactaaatgtgcctctgagatggccaccccgggcagggacctgtgccttccgccgatgctcagggctccctctggctcccgggtcactcttgtggccccagtgggtggtccctgcagtcatggcctgagtgcgcaggggccaccgcgtggctgctgctgtcctcctccgggacccacggggaccaaggtcacacgttccgtgctgtgaagctgtccagatgtgcctctttggctgggggttctggtggacgtttcaagtggcattttgtacaatgcaggttagaattcaggaatttcaagtatgtgcccgggtctgtcaggtcccagttgcctttctgacggcccccctcagagggacggcgatgagcactaaatgcttttttgactattttcctatagattttttttaaaacttttttttcctcctgttccaattgatagctttcttatttaataaattctgtagttcaccgcactgtctcttctctgctgacttagccagt

SEQ ID NO: 135919 - DNA, 1013 bp, Homo sapiens
gctgggggagacaagaccggcgctcatagaacgctggagctggaagcaacgacaacagcgactttactgcgtgccggggcggccgccgcccacctggaccgctggactcggcccctgccccgctcaccgtcgggaatggcgaggctccgggctcgggacagcggggtggcgcccgggcggcgctggtagcccgacatcgccgccggcccggcggggcacgacctgcctagcccggcagcggcggctccatggccccggctccgcccgtgccgcggcccgcgtcgcccgcccccgtcgcccgcccccgtcgcccgccgctcggccgcccccgcgcctccgagcctctcgccgctgcttccgctccgagcaccgaaagcgcgtgcctgaacgccttgggccgtcggcgagggggaggggaagccgtgggcggaagcggaagtgacgactgaagcggggcggagacgcaagatggcggctgtggtgctggcggcgacgcggttgctgcggggctcgggttcttggggctgttcgcggctgaggtgagccaaaggcgaaccaggcttcggcctggggcgggggcggctcgagtctttctggacgctccgtcttcggtttctacaggtgacatggcgcccgtgggacgggctcgcacttcgggacactggtgtccccgaggcgacgggggccctgccttgctttgcgcctcgagcccggggacgcagtcccatctgtctctcctctccccggctgctgggtcctctccccccctcacttcccgggtcgacgggccttctccgaggccatgcctcatatttgcccccgcgcttcacctaccgcgtgctccttcaggaggctgagccggtgggggcccagctctgttagacccgcagggttctgacaccagggtccaggctctcggttgctgcggtctgtccgttgatctctgacgtttaagaaccctttccgtacccaccgctcctcccacccaagtgaccgggcctgcctttccccac

SEQ ID NO: 135920 - DNA, 1032 bp, Homo sapiens
caagacttcggtggtgctgttggagggcagagctgttaagtgctttatgtgtacaaactgcacttagagtgagttactgttaataagccctgtttttacagagatagcaactaagacccaaaggacggaaccagcttgctccaggtcccgtggctgagcctttgttgtcagcctctgctttgtcttccaaagtctgtagaaataagtcctgtagaaaggcagatgctcacttttaacccagacaaaacataactaaccgcacctaacaggtcatcacaggtttgttgtctcaagcctgttgtaactgggccgctttctctgttttaggtttggacctcctgcgtacagacggtttagtagtggtggtgcctatcccaacatccccctctcttctcccttacctggagtacccaagcctgtttttgctacagttgatggacaggaaaagtttgaaaccaaagtaaccacattggataatgggcttcgcgtggcatctcagaataagtttggacagttttgtacagtaggaagtaagtactgttgtgttgtcgtgggtggtcccgcagttttaacatgcacatgctttagttgactgttagttgtaattagcatgccaattatgaattgtaccctgagtggaaacaaagtgtacgatttcataaatgttgagctacacatatacctgtgaaaccatcagcacaatcaccctcatgtaattaaatctgattatcatgtcatattgacatcttaaaatgtttctcttgattaaatcttattttgaatatctgatgtaacctgtcaattttctttttactactagttcttatcaattcaggatcgagatatgaagcgaaataccttagtggaattgctcactttttggaaaaattggcattttcggtcagtacccagttttgtaattttttagactatacttttgaaggatgtttgagatttttcttgtctataatggttattttaataaattatcaagttgctaagttaatgttaataaaagacttttaagttaaa

SEQ ID NO: 135921 - DNA, 1022 bp, Homo sapiens
agtgggttcgttcagtcaacaggaggctgggatgaaacacttcaccttttgagagagagtatagttacaaaaatctgtatcagaagtggctccattttgactcaagctgtgtgtagctgtgagtcctgcctaccaagcattcacactgtaagacaggaaaagagaaaggggaaaagtgtctgctgttccccgatgaagggtaggaggtgtcccctggcacgcaaagcccaagcgtccctgaaatgtctgctgggccccaacaaaaggtaggtgcccctggcatgcaaagcccaagtgtcccctggctgttgagcagagtgtgagctcagggcctggcattgtccacctggcacgcaaagcccgagcgtcccctggctgttaagcagagtgtgagttcagggcctggcattatgggcttgtgttttcttccagagacaccaccatgtatgctgtgtctgctgatagcaaaggcttggacacggtggttgccttactggctgatgtggttctgcagccccggctaacaggtgtggatcccagccgctggcgtttgaggtgggcttggacatagggaagaccggaaaggtttgcagaagccctgtagccatgagggagagcaccatgtaattggagctttaggccaacacaaagtgacagcgagatctcataagaaatagcgctggggctgggcatggtggctcacacctggaatcccaggactttgggaggctcaggcaggcaaatcgcttgagcccaggagtttgagaccagcctgggcaacatggtgaaaccctgtctctacaaaaaagatacaagaattagctggctgtggttgcttacacttagagtcctagctactcgggaggctgaggtaggaagatcgtttgagcctgggaggttgaggctgcagtgagccatgattgtgccactgccctccagcctgggcaacagagtgaggctttgtctcaaaaaaagaaagaaaggaaaaagaaatagtgctagtagccaggcgtgctggctca

SEQ ID NO: 135922 - DNA, 2048 bp, Homo sapiens
ttttagtagagatggggtttcacagtgctggccaggctggtcttgaactcctgacctcaggtgatccacccacctcggcctcccaaagtgctgggattacaggcgtgagccaccgcacccagcgtgtgcctctgtttctaagcaccttcatgtctggtctcgtgtcctcacagcagcacttgggacagacaggtccagtgtcttcggtgcctttcaccagcaaggaagccagggcttagcaggctcacgtggctgcttcatggctgaggcgggatgtgaggcccaggtcccctagctcctgctccctgtagcagtccccctcactcacacaagcacccagtctgcccctagatgaaggcagaggtgactgccaacagccaccaacaggcgacactcaggccagcacacaagctgtgggtcactgctgtgttcctcatctctgcctgtgcagactcagccctggcctttgggttctcttgcagatgaagaagtcgagatgacgcggatggcggtccagtttgagctggaggacctgaacctgcggcctgacccagagccacttctcaccgagatgattcatgaagtaaaatgtcaaactcgagaatgcccccgcatctcgaacagtggtcctcgggacaccaggggtggtggggagggtgcctccgtgatgttgtccttgcaggttatggatatatacagaacatttttttgttttttgagatgaggtttctccacattgcctacgctggtcttgcactcctgggctcagctcaggtgatcctcctgcctctgcctcccaagtagctgggattacaggcgtgagtcaccgcactcagcttagaacattcttgatttctgagtctgctgtttatacaatgttcgtattttccagtttttatagtaactaggtctttactactaaacacaattaatcttaggctttttgtgaatttgtattctggagaggcagattttactctttataaatacgcacgcagctgctattgccagagtgcaagtaaaatatcagcttgcgtcggattttcccagggctggctgcagatgggcgctggtgctgcttgttggaggaagcctggtcatgctgtcttcagtcacctgtgtctgtggctcttccccattaggcggcttacagggagaacacagttggcctccaccgtttctgccccacagaaaacgtagcaaagatcaaccgagaggtgctgcattcctacctgaggaactactacactcccgaccgcatggtgctggccggcgtgggcgtggagcacgagcatctggtggactgtgcccggaagtacctcctgggggtccagccggcctgggggagcgcagaggccgtggatattgacagatctgtggcccagtacactggggggattgccaaggtgaagtagcgggaacgtctcatggcctcgggtggggaacacgtcccctggcccgtggtgtgacctgtttttgtattgattctgagggtgataggtgttgactgcatgtgtagctttgccttaacacatgctgtagtcccacagcagggcatggactgtgtcccctgctgagaatgagtgctgctaggcctgagagcaacacaaaaggtggatgcggttctttctctaggggagtgggtctgccactgcgtgttgcattttttttttttttttttagagatggagcctcgctctgtcacccaggctggagtgcagtggtgcaatctcggcttactgcaacctccacctcccaggttcaagtgattcttctgcctcaacttcccgagtagctgggattaccaccacgcccggctaaattttgtatagagatggggtttcactatgttggccaggctggtctcgaactcctgacctcatgatctacctgcctcagcctcccaaaatgctgggattacaggcgtaagccaccacgcccagcttatatgtatatacatatgtttttttttttttgtctttttggtagaggtggagttttgccacattgcctaggctggtcttgaactcctggactcaagtgatctg

SEQ ID NO: 135923 - DNA, 1043 bp, Homo sapiens
aagtcctcctcctgcagggacggagggcagagctggctgaaccacccacgccacgtcaggagcaccgtcagacgccagggacggagggcagagctggctgagtcgcccaagccacgtcaggagcgccgctggacgccagggacggagggcagagctggctgagccacccatgccgcgtcaggagcgccgtcggatgccagggacaaagggcagagctagctgagccacccacgctgtgtcacgagcgccgtcagacgccagggacagagggcagagctggctgagtcgcccacactgcatcaggagcattgctggatgccagggacagagggcagagctggctgagccgcccacgccccatcaggagcgctgtcggatgccagggacagagggcagggctggctgagccggccacactgcatcaggaacgccatcagacccagcaccaggactcaccaggaaggagcagctctccagtccaaccatgatgtgcgtgagctcggggatgggggtcgggcccaggctgacattggacatgtctctttctagctgtaaccaagaaaacaagcaagtgtcgccatgtgaaaaacaatgagggctcgcaaaccccagatgagatcatcttcagagtggttacacagaaatccaatgccagccaggcacagtggctcatgcctaaaatcccagcactttgggaggccaaggtgggcagatcacttgagtccaggagttcaagaccagcctaggcaatgtggcaaaactccacctctaccaaaaagacaaaaaaaaaaaaacatatgtatatacatataagctgggcgtggtggcttacgcctgtaatcccagcattttgggaggctgaggcaggtagatcatgaggtcaggagttcgagaccagcctggccaacatagtgaaaccccatctctatacaaaatttagccgggcgtggtggtaatcccagctactcgggaagttgaggcagaagaatcacttgaacctgggaggtggaggttgcagtaagccgagattgcaccactgcact

SEQ ID NO: 135924 - DNA, 1221 bp, Homo sapiens
gggcctcgttttctgtagaaaacagacccacctggaccctatcactcctgtcctggggttcctgggtgcagccctttggccttctctcaccccacccttctgtccatgcggccctcgggggctgggggttttttctgcaggccgtcctaaagtgagttcatcagacacggagctcgctcttctgtaagtgtaactcttcttgggtggctttgtcctatatttttaagtcattgccatgtccccatttactgagaactcaacgtctgtcacttgtggactcacccttggctacacccagtggctgcctttgggcccaggtgcccccatcagcagcacagcgtgagtgagtggtacagaccagccgccccctccgtgtgtttactgatgcagcctcagcgtgggggccgtggcgcgctcgtgtgacacgcgtttgccctctgcactaggcaacgtgaagccggaagatgtgaagagagtcgcttctaagatgctccgagggaagccggcagtggccgccctgggtgacctgactgacctgcccacgtatgagcacatccagaccgccctgtcgagtaaggacgggcgcctgcccaggacgtaccggctcttccggtagaaccgctccccggcctgacagacccagggagctgcagctggagcccgttcccgtgcgtgttagtttggacacgaatttagtctaaaaagctgtctggttgtataaacggtgcaaacaatgtcgccacagcacccacgcggtttgcattcttttggaactcaatgtgccgatcagtggagtcagtatcgagcctgaccaccgcaagccaggaagcaggtgaagtgcccagcgctggagtgcagcgtgccacgaggagggcggtcggtgcttccctcctcgggctgtgggcacatggggccccgcaggttccttggaggagccctgagctgggaggcagcaaaggctgacctatcaaagcctcccggaggccaccgtgctgggtaccaggactcacctctgacaagcaggagaaggtaagggcccggtcagctccaaggagcgcgctccacgcgcgtgcacacagcttccctggtaataaagagctggcatctttcttagcacggtgttttccttctcgcctggggaggggcggttcttaagggctgtctgaattggcagcttttctaacatggaggccttcctccctgtcagtcgtccggtttgac

SEQ ID NO: 135925 - DNA, 1070 bp, Homo sapiens
tactttttaagatgctgctaataaaagttttctattattcactgaattgttgataaccagcgtggttcatcaggtctcaagtatttgtgttttcctcaaaagactcttttccatctaacgctgatctcttgggcagtgaactaggaatgcaggattttatgtatttatttattttgagatggagtcttgctctgctgcccaggctggagtgcagtggcgcaatctcggctcactgcaacctttgcctcctgggttcaagtgattctcctgcctcagcctccccagtagctgggattacaggcgcccgccaccacacccggctaatttttgtaattttagtagagatgcaggggtggtcgcaccatgttggccaggctggtctcgaactcctgaccttgtgatttgcccaccactcagatgatccatctgcctcagcctcccaaagtgctgggattataggagtgagccaccgcacccagccgaatgtaggattttaaagatagcagagatgaaccggacaagatcatagtcagctgttgagggttgagaccaaactttttgcctgtggattttacagcctttcaaacaaggacattgtgagaacgggatatgcatgtatattgttgcttccaggtttcagtctttggccagaaagagattttaagactcaatatatgcatttatttaaaaatataaatatggaaaaataatttaaaagactagattgaatgtccctagattttcacacattcaaagactacattttttcaagagatggaatgggacacaaagcaagaatgaacggttctatactctcgaagaaagaaacccgggacatggtggggatccctggcctaggtgttcaaggtggtggcatcctgaacttccagcagttccctagcccggttccactaatgtcattccgcggctggagttaaagaagcaaacggtctacgtcaccaagaccatgagacggtttcaaaaatggtctacgtcaccaagaccatgagatggtttcacacaataggcttggcctatgagaggaggggaagcagcttcttactcagctg

SEQ ID NO: 135926 - DNA, 1003 bp, Homo sapiens
atttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagcaccttcacctgtggttccctttggtttgctggaagcgagtgagtgcaggtgtccgcaggcctcggcgctgtcctggaccgcacccaggtcctctccggggacctgcacctgcctcgctgggacctgccggactgcggggctgccgggttgggaggggcgtgggagacccgtccgggtc

SEQ ID NO: 135927 - DNA, 1037 bp, Homo sapiens
ctagagtcaacagggttgtgcggctggacccacgtgtgaggcacttttcacttctctctgaggagcactttacgtggaagagggcgtttgtaacccaggccagaacagtttcatattttttggcctggtgtgagagacttaaattccctgggatttggttgctgcaattcttcttttcctcggcaggttttaagctctgcagcgtcactccctggctctgaactcccctcctccaggcctgagggttcccagggaggagaggtaaggagtgccgacgccagggccccccgcagcccaggcctccccagcagctcactgtccaggcgcctcttcctttatggaggggcggtactgggtaggaagaggcagtttagaaacaagagcacctcgaaggtggtgttcctgggggaaaaaaaattgcacttgttttaacaaaactgtttgggagctccaggaggggtgcagggggtttgagttgtcgcctcagtcccggtcctctcccttcaacagcacgggaattgtcttgaattgtgaggtgtcaggaggtgaagctggcttaggccgaggctggacttttcctcccagccctcccctaagctaatggttgtttcgggataacagctttacattaagacaggaatcttaagctaacactggcttttttttcccttttgagttatgttgattctaatggcatcacaaagcttttgaaatggaactgacagcttggattggacagtgacgtgcatgttgactttcgtccgtgttttatgtgtgttcttgctgttttgtagctttcgcgctgtagttcaatgagttcattatcacgtgaagtgagccagcattttaatcaggtacctgcggctggtggtcctcactaacatgagagctggcgtgtgccgcctgtgttcctgagcacgcggtgccggttcgccacgtgcgctttgccactaacctcgcccgttgtctccctcagcgtcacgtgaccaagggtacagggttccttttttttttttttttttttttgagacggagtt

SEQ ID NO: 135928 - DNA, 1072 bp, Homo sapiens
cgttgacgtcctgaacccaagcgggacccagcggagcgagccggctctcgctcctgcggactttgtcgctccactcgcgccactcccaattccttctaacttgttcgtgccaaccccaggtaggtagcacgagcaccagcccctccaggtcagcccccagtctcctgacctttgatcctctttctatgagtctctcctaaatctcccgttaaaagaatgacctggccagcatgcagagagcctggggttggtttgtggttttttttttgatttgcctgtttctgcatgagtgtgccgcgtgtgcagtgtgaaactctcttcctctcggagtgtcttcagtgagaccccagggacgttcgggacggaatgatggcctcctcgctctctcatccccagatgcagaagaaccacagcttccagacgggactggcagggaagggcctgcagcagctaggggcctggccaatccagagcctgccccagagcccaaggtgagcgggtacggtgggaaaggggaaaggtacccagtgaggaggcacctccccatcctgccagacagggccttgccttctgcaagtcagtatccaatgtgtacgtagagtgttccgccttaaacgcctcacacttatgtatggtagagacggaaggtagaatgcagggtgccgggcgggacagagctgtttgggaagacggagatctggggatagtggcggtgatggttgctcagcacggtgaatgtgcttaaaacttaaaaatgattaaagtggcaaattttacagtatgtatattttacaatttttaaaattggaaaaagtaaaattaattactctaagttacagagaaattacctaccgataataaaagttaagtatattttcatccaaaaaaaaaaaacaaaaaacaaatgactcccatgtgaagtagaacagctcagaccagtcgggagtggtggatgatgcctgtaatcccagctctttgggaggctgagctgggcgggtcacctgaggtcaggagttcgagaccagcctggccaacatggtgaaaccccatctctactaaaaaaaaaacaaaa

SEQ ID NO: 135929 - DNA, 1023 bp, Homo sapiens
tctgctccccacctccatcctcctggtgtgtctggatctgctccccacctccatcctggtgtctctatggatctgctccccacctccatcctcctggcgtctctgtggatctgctcccacctccatcctcctggtgtctctgtggatctgccccccacctccatcctcctggtgtctctgtggatctgctcccacctccatcctcctggtgtctctgtggatcgccccccacctccatcctcctggtgtctctgtggatcgccccccacctccatcctcctggtgtctctgtggatctgctccccacctccatcctcctggtgtctctgtggatctgctcccacctccattctcctggtgtctctgtggatctggcgactctggggcctcacagaagtgggtcatgtagaatttgtctttttgccctggcttatttcatggaacataatgttttcaaagttgttctcgtgttttttatatttagggtgaatcctggttctttcgttggctacctggaaagaaaaagacagaagcttatttgccagatgacaagaacaaatcggtgagtgctgtcaaatacgcacgggacgtccgaagaattgtaatgatttttctgtcactttcagagcagacctgagtaggtgtttcctgaagttttgaagtgtcatcattaatcagatgctaattctgtttaggttcagtctgctgaccttttttctttttaaaatcttggcagattgtttgggatgaaaagaaaaaccagtgggtgaatttaaatgagccagaagaggaggtaaattgtcattctagttcctgttgggtgtgaggtgtgagtggagggaacagcctcatgtggccctgtgatatttgggtggctgttgccccttttggagcctcctgactgtgccatcccagtgggtttctgtgcacacagtgggtgtctgaagctgtgtttccctctgcagaagaaagccccgcccccacctccaacctcgatgcccaagactgtgcaagctgccccgc

SEQ ID NO: 135930 - DNA, 1050 bp, Homo sapiens
cattaggtgttttaccctttaaaatactgtgtccctggaaaagtaaaaatgagggttgagctattaaaaattgggacttgacccaggaataaatatttttaaaaatcattgtatctttgagaacacccatcgcccccctctggccagtcttccctcagtgcatgctcacactccgtttcttccagcccggaatctccatcgaacgccctcatttgcattctgagtgctgagtgctcccagacggagctgcttattaagtgcggctggctcttctctagtcaggccaggtagaggctctgggaggcccagtcagggggctgctctccccagcccccttcctgcctccctctggtcaccagagtcatccggcctctcagtgatgtatttaggaaacacgcctggggaattgcatccccctctctctttcggttcctgtgaggagccccaggagagcctgttctgcatttccttgcgacagaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaaggtagtacagcctgcccacggtgcgcctggcggccgggagggtttgggcaggaggcacgcttcccagagcgccatcctcttaattcaccacacatgcaaatagcctcctgatacaaacagccgagtgtctacagtgcacacggcatgatgggtgtctgtgtatttgtgccttcagataataggataatagcccacccaggtcagcatggggacacagcccggcccccagaggtcgcctctggccactacctgtcagacccacccgcaagggaccagacggcagccgctgctttgtcactgtggtgtgtgcctgctgccggctcacagatcctttctcccagccgtggactttgggactgctttcagtgtggggctgggatccgtcaggccccaggagcctccttgcctatctattggcga

SEQ ID NO: 135931 - DNA, 1519 bp, Homo sapiens
tctgttggacctcccttataaaagaaatggggctgtacaaaataacttgtcataaacacgtcgagtgtcagctccttccagtaactcaagctaccctcagtaaccccagacctcttctccaccgttcccatgcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccaggtggggctgcagagatgctgtctcgagagcagaagcagcatggggtgtggtgtttgtggggattggtggaagagattgaagttatttgagcttgaaacaacttacattacttgtcttaacgtagaccagaaattctggaagttacagactggatgggttcagagtctcactacaacagcagtgttaatgccagttccttttgtaacttggctttttgttgtgaagcttaaatggccatttggggcagggcatggtggccatgggtctcctggggtctgtctttagacggccctgctggacgcctggtgagatgcacaggggcaggtcatgaactgtctggaactcgatttggtggatcttgtccctggtctgtgcctatgtctacatgtgtgtatatggacaaagcaaaacataggcctagttttaaaaatgaaagagtgtgcacacatgtgggaagatgttcagccttggtttctgcagatcatgctggtgtggcggtagctgggtgggaaggtggtgtgcctgttgatctgtgcgccacacacacgtcccgccttctcgtgactgagatcatagttgctctctttcccgttgacagggatagtgccgcaggaggcgcctgttggaaactcactttccgagctaagcgaagaaaattttgatggaaaatttgctaatctggtactttgtcacattttcttaaactgtttgttttccataaagttcatcgagtgggcacccagactccttgttgagttgtaagatgatggtagtgaggactatgaaattgtttctaaaattgtttcttaaagtgaaagtgcttctaaatagctttcatccttaaaatatgaagagttggtgaaaacactggcagggaaagatggggaagagagaattcagtagtgtaaaaacagttactttaagtagaagaaatacccaaatatcatgaaatccccttattaattttaattcttccaaaatgggtaccttctctgatttctacatctctttttcttttttttttcttttttttttttttgagacagattcttgctctgtcgcccaggcttgagtgcagtggtgcgatctcggctcactgcaacctccacctcctgggttcaagcagttctgtgcctcagcctcacaagtagctgggactacaggt

SEQ ID NO: 135932 - DNA, 1061 bp, Homo sapiens
aagctatgaaatgtttgcagaatgaaaacttaattgacaaagagtctgcaagtcttctttggaattttattgttctcttatgcagacaaaatggggtatgtttctttctacttctagagtgtttcttcttgctggtcttcatttcgtcttgggaatgctcagcctcccgaaggagcagggcgggatccgcgtggccagctatgggagcctcgagggcccccttaggaagcacactgtagtggctgggtagggagggagagggaacgtgcggttgggatgggatgaggtttcagcccagccttgccagcctttcgggtagttgtgggtctggctgtgtccagggtggggctttgtgcctgtggtggtccaacgcgtcctcacctgagagccgttgttctccttcctgttcctgttgacccaaacagaccgtggtagggaccgacattgcggagcttctgttacgagaccacagaacagtgtggcttcctgggaagtcgcccaatgaagcaaacctgattgatttcacgaatgaggcagtggagcaggtggaagaggaggagtctggtgaggcccagctctctttcctcactggtggtccggcggctgccgccagctcgctcgagagagagaccgagaggttcagggagctgttgctgtatggccgtaagaaggtgcgcctcctcatcatggcacctggcgcctgcacatgtccactgggtcgggcctggtgcggggttgcagccttcagggagggacgtggccccctcttgggagcatccgcgctgcagtgtggggcttcgggtcttgctgtttcctgaacaatgcctgactcttgtatgccatccttctggaggtgttaatgttggtttccttctaactgtttccagtgttggagacctgcagattaaattttcagttattcgataaatgcacatgttgagcacaggccgtgcccctgctgtgtgtgccaaatctcggatgaaatgtgcatgacacaagttgtggcattctcacaaagtcagactcgagtccacagcccagaagtcattgggagttgggag

SEQ ID NO: 135933 - DNA, 1770 bp, Homo sapiens
agcccttttaaagtaaccttttaatattgagattatttttgaaaaccttatgagtcacattaaggagaagaaatagtagtaaaatttacagttaggggattaactagtcaaaagcagcaaccgtgaaagagaactggctgggcacagtggctcacacctgtgatcccagcacttagggaggctgaggtgtgggagaagcacttgagcccaggagttcaagaacagcctgcgaaacatagtaagaccccatctctgtttaagaaaagaagaagaaaaaggacttaataaagaaatcttttagcaccttttctaaaaatattttttccttttaatctaaaacacttgtattgagagaaaaatcagccagttgcctttaggtagctagggccctccagatctcatggcttcctggtgtcgtgctggtttccaggaagaagctgggtttctcgaggagtccttggagcataaagtcctggggtggtgtcgcttctttagtgatatctgaggcatttcttcttttgcatgttactgtattaatcattaattccttgctcacagatccaggtcactgggatcgttaccactacagtgctagagtcagggacccccgcacctatgaccggaggtattggtgtgatgcagagtatgacgcatacaggagagagcactctgccttcggggacaggttggtggagcacccctggggaggcagaggctgggggcagccagggcgcgctagtgcttctctgccctcatgtctgggttttaacaaagagctgtggtagtttgggtgagcatctgcctgatgttttggtccctgtctgaaaggaaggagggagcagaccctcccagggttcccagcttggactgttagaggagaactggcctcagcaagaggactgttcagcacctctgggagcacctgggagattgggctcactctttctcatcgtcccttcttaccggtcgcgccctgcagcccagagaagtgaccacactggagacgcattcgcagtacttctctaacgttgcacgtcagagggccctgagtgtcgggtgtgctgtgttgtgcctcggccccaggggtctcggtctcagctcctgggcagctgcgtggcacatggggacggggcctccggcactcccattcctctgcctctgtcccccggcttcctctaggcccgagaaacgtgacaacaactggaggtacgatcctcgcttcacggggagttttgacgatgaccccgatccgcacagagacccttatggggaagaggtggaccggcgcagcgtccacagcgagcactcggcacggagcctgcacagcgcacacagcctggccagccgccgcagcagcctcagctcccactcgcaccaggtacgcggcggcgcctcacagacacgcggacggttgtgtttagaaccaccatcctgtttgcaatgtacctaaagttttactgctgtgcctggggaattgattttgcccgtttgctttgttttctaagagtcagatttacagaagccacaatgtggctgccggttcctacgaggccccgcttcctccaggctcctttcacggcgattttgcctacggcacctaccgcagcaatttcagcagtggccccggcttcccagagtatggctaccctgccgacaccgtctggcctgccatggagcaaggtgtgtgctcagcaggacagagggataccggctaaccccactggggcggccacccagcctggcatctgaacacgggagtcagggctggga

SEQ ID NO: 135934 - DNA, 2366 bp, Homo sapiens
agaaaatgaggagaatctctcatctgaaaaagcaggcttatctggtcaagcggactttgacgatttctgctccagccctgggctaggccgtccgcccgcacctacacacgtgggggcaggcagcctctgccaggcccttctcccaggccccagcaatgaggctgctggtgatgtgtggggtgacacagcgagcacaggggtgccggatgccagcggctcgcagtatgagaatgttgagaacttagaatttgttcagaatcaagaagttctgccaagtgagcccctcaatttggacccttcctccccgagtgaccagttcagatatgggccccttcctgggccagctgtgcccaggcatggtgctgtgtgccacaccggagcccctgatgccacactgcatacagtgcaccctgacagcgtgtcatccagctatagcagcagaagccacggaaggctctcaggctcagccaggccccaggagctggttggcacattcattcagcaagaagttggaaaacccgaggatgaagcttcaggtagtttttttaagcaaatcgattcttctcccgtaggaggtgaaacagacgagaccactgtgagccagaattaccgtggcagcgtgtcccagccctcaaccccgagccccccgaaacctacaggaatatttcagacaagtgcaaatagttctttcgaaccggtaaaatctcacttagttggggtaaaaccatttgaggcagatcgcgccaacgtggttggtgaagtaagggagacctgtgtccgccagaagcagtgcagaccagctgccgccctgcccgatgcttcccctggcaacctggagcagccaccagacaacatggagaccctctgtgcaccccaggtctgtcccctgcctcttaactccaccacggaagctgtgcacatgcttccgcacgcaggggcaccgcccttggatactgtgtatccagcacccgagaagaggccttcagccaggacccaggggcccgtgaagtgtgagagcccagcaacgactctgtgggcgcaaagtgagctgccagattttggaggcaacgtccttctggcccctgcagccccggcgctttatgtgtgtgcaaaacctcagccacctgttgttcagcctccagaagaggcgatgtccgggcagcagtcacggaacccaagctcggcggccccggtgcagagccgaggtggcattggtgcttctgagaaccttgagaatcctcccaaaatgggagaggaggaggcccttcagtcccaggcgagttctggttatgcaagtttattatcctcaccgcccactgagtctctgcagaatcctccagtcttgattgctcagcctgatcacagctataatctggctcagcccattaacttttctgtgtccttatcgaactctcatgagaagaatcagtcctggagagaggctttggtgggggatagacctgcagtcagcagttgggctctcggtggtgattctggggagaacacttctttgtctgggattccaaccagctctgtccttagcttgtctctgcctagcagtgttgcccaaagtaattttccacaaggttctggtgcttccgaaatggtttctaatcagcctgctaatttgctggttcaaccaccatcccagccagttccagagaacttggttccagaaagtcaaaaggatcgtaaggcaggaagtgctcttcccggatttgctaatagccctgctggaagcacaagtgtggtgttagttccacctgcacacggcaccctggtgcctgatggtaataaggcaaaccattccagtcatcaggaagacacttacggagccctagactttaccttaagcaggactttggaaaatcctgtaaacgtgtacaacccgtcccattctgacagcctcgcttctcagcaaagtgttgccagtcatcccagacaatctgggcctggggcgcctaaccttgaccgtttttatcagcaggtcacgaaagatgcccagggccagcctggcctcgaaagagcccagcaggagctggtgccaccccagcaacaggcttctcccccacaactacccaaagccatgttttcggagctgtcaaatccagaaagtctgcccgcacagggacaggcccagaactcagcacagtcaccagcaagtctggttctggtcgacgcgggtcagcagctgccccctcggcctcctcagtcctctagcgtgtctctggtgtccagtggctccggccaggcagctgtgccgtcagagcagccgtggccacagccagtgcctgcacttgcccccggcccaccgcctcaggacctggccgcctactactactaccggcctttgtacgatgcctacc

SEQ ID NO: 135935 - DNA, 1029 bp, Homo sapiens
gcactttgggaggccgaggcgggtggattatgaggtcaggagatcaagaccatcctggctaacatggtgaaaccccatctctactgaaaagacaaaaaattagcctggcatggtggcaggtgcctgtagtcccagctgctcaggaggctgaggcaggagaatggcatgaacctgggaggcggagcttgcagtgagccgagatcgcaccactgcaccccagtctgggcgacagagcaagactccgtctcaaaaaaaaaaatgtgtggattaaactacagagtcctcccctttggtttaatttttcctttgattggctaaacttatctgtttgttcatgagggtggtgctgacaagaagaaagactgatagaaagaaaagaactttcctaaagatatagtccttgaatttttgccttaagaggccaggttaactattcaagtttgtatctactatgttttatttaaaaactgatggaggtttttgcccctttcttttctgtaagaggtttcttggcaattctgcctgttgttgaaagtgttggaatccagtctgtgccttgtaaagctgctttaagtttcctgggagtttccattccaggcacagttacggctccagttcaaaggtaacatcttgctggtggtcctttcagaccttaagccagtcacagtacaaaaacggagacctatgaagaggtgtgataaaaggcatttagatgaatatatttattttgcagtgctttttaaaaaaatgattgtgtcactttttatttatttatttttttaaaatagagaccgtcttgctctgttgcccaggctggaccgcggtggtataatcatagctcactgcagcctcgaactcatggacacaagtgatcttccttccttaaccccctgagtccctgggactacaggtgtgtgccaccatgtctggctaactttcttcttttgtagagacaaggtcttgctatgttgcccaggctggtctcgacctcctgggctctggcagtccttccaccttgacctcccaaag

SEQ ID NO: 135936 - DNA, 1028 bp, Homo sapiens
acccccagccaccagctacaggtgcctgagcaccccttcctcaccccgtcccctgagtcccctgaccagtggtccagctcgtccccgcattccaacgtctccgactggtccgagggcgtctccagccctcccaccagcatgcagtcccagatcgcccgcattccggaggccttcaagtaaacggcgcgccccacgagaccccggcttcctttcccaagccttcgggcgtctgtgtgcgctctgtggatgccagggccgaccagaggagcctttttaaaacacatgtttttatacaaaataagaacgaggattttaattttttttagtatttatttatgtacttttattttacacagaaacactgcctttttatttatatgtactgttttatctggccccaggtagaaacttttatctattctgagaaaacaagcaagttctgagagccagggttttcctacgtaggatgaaaagattcttctgtgtttataaaatataaacaaagattcatgatttataaatgccatttatttattgattccttttttcaaaatccaaaaagaaatgatgttggagaagggaagttgaacgagcatagtccaaaaagctcctggggcgtccaggccgcgccctttccccgacgcccacccaaccccaagccagcccggccgctccaccagcatcacctgcctgttaggagaagctgcatccagaggcaaacggaggcaaagctggctcaccttccgcacgcggattaatttgcatctgaaataggaaacaagtgaaagcatatgggttagatgttgccatgtgttttagatggtttcttgcaagcatgcttgtgaaaatgtgttctcggagtgtgtatgccaagagtgcacccatggtaccaatcatgaatctttgtttcaggttcagtattatgtagttgttcgttggttatacaagttcttggtccctccagaaccaccccggccccctgcccgttcttgaaatgtaggcatcatgcatgtcaaacatgagatgtg

SEQ ID NO: 135937 - DNA, 1059 bp, Homo sapiens
gaacgggcagggggccggggtggttctggagggaccaagaacttgtataaccaacgaacaactacataatactgaacctgaaacaaagattcatgattggtaccatgggtgcactcttggcatacacactccgagaacacattttcacaagcatgcttgcaagaaaccatctaaaacacatggcaacatctaacccatatgctttcacttgtttcctatttcagatgcaaattaatccgcgtgcggaaggtgagccagctttgcctccgtttgcctctggatgcagcttctcctaacaggcaggtgatgctggtggagcggccgggctggcttggggttgggtgggcgtcggggaaagggcgcggcctggacgccccaggagctttttggactatgctcgttcaacttcccttctccaacatcatttctttttggattttgaaaaaaggaatcaataaataaatggcatttataaatcatgaatctttgtttatattttataaacacagaagaatcttttcatcctacgtaggaaaaccctggctctcagaacttgcttgttttctcagaatagataaaagtttctacctggggccagataaaacagtacatataaataaaaaggcagtgtttctgtgtaaaataaaagtacataaataaatactaaaaaaaattaaaatcctcgttcttattttgtataaaaacatgtgttttaaaaaggctcctctggtcggccctggcatccacagagcgcacacagacgcccgaaggcttgggaaaggaagccggggtctcgtggggcgcgccgtttacttgaaggcctccggaatgcgggcgatctgggactgcatgctggtgggagggctggagacgccctcggaccagtcggagacgttggaatgcggggacgagctggaccactggtcaggggactcaggggacggggtgaggaaggggtgctcaggcacctgtagctggtggctgggggtgttgtccacaggcgaggagtagctgtgctgcgaggggggcgtcaggaactgggctgcggtcacgggtggg

SEQ ID NO: 135938 - DNA, 1323 bp, Homo sapiens
ggacgctggggtggggtcctgaggagcagcctgcctgcccccaccccgcggaggaggttgtactgctgcttcctctggtgatggaaccttggggagggtccccacgcctggcctggcccccctcaccggcccccgccctcatcccccaggaggagacacccctgtttctggccgcccgggagggcagctacgagaccgccaaggtgctgctggaccactttgccaaccgggacatcacggatcatatggaccgcctgccgcgcgacatcgcacaggagcgcatgcatcacgacatcgtgaggctgctggacgagtacaacctggtgcgcagcccgcagctgcacggagccccgctggggggcacgcccaccctgtcgcccccgctctgctcgcccaacggctacctgggcagcctcaagcccggcgtgcagggcaagaaggtccgcaagcccagcagcaaaggcctggcctgtggaagcaaggaggccaaggacctcaaggcacggaggaagaagtcccaggacggcaagggctgcctgctggacagctccggcatgctctcgcccgtggactccctggagtcaccccatggctacctgtcagacgtggcctcgccgccactgctgccctccccgttccagcagtctccgtccgtgcccctcaaccacctgcctgggatgcccgacacccacctgggcatcgggcacctgaacgtggcggccaagcccgagatggcggcgctgggtgggggcggccggctggcctttgagactggcccacctcgtctctcccacctgcctgtggcctctggcaccagcaccgtcctgggctccagcagcggaggggccctgaatttcactgtgggcgggtccaccagtttgaatggtcaatgcgagtggctgtcccggctgcagagcggcatggtgccgaaccaatacaaccctctgcgggggagtgtggcaccaggccccctgagcacacaggccccctccctgcagcatggcatggtaggcccgctgcacagtagccttgctgccagcgccctgtcccagatgatgagctaccagggcctgcccagcacccggctggccacccagcctcacctggtgcagacccagcaggtgcagccacaaaacttacagatgcagcagcagaacctgcagccagcaaacatccagcagcagcaaagcctgcagccgccaccaccaccaccacagccgcaccttggcgtgagctcagcagccagcggccacctgggccggagcttcctgagtggagagccgagccaggcagacgtgcagccactgggccccagcagcctgg

SEQ ID NO: 135939 - DNA, 1375 bp, Homo sapiens
tcattacggctttttttaaagaaaaaaaaagagagagagagaagaattgatcggtgtcatgtgaagtgttgaagtttgtatcttgaaaatccctctaaatcctttgtcttaacagctcagtgcgagtgcagcgatttgaagttgactaatcctccttccttaaaggagaaaaaagtaaaagccgtctccagatagagtcggctggtgcaggagagaatttagcgatagtttgcaattctgattaatcgcgtagaaaatgaccttattttggagggcgggatggaggagagtgggtgaggaggcgcccggacgcggagccagtccgccgccccccggccaccagcctgctgcgtagccgctgcctgatgtccgggcacctgcccctggcccccgtgcccgcaggtgagaccgtggagccgcccccgccggcgcagctgcacttcatgtacgtggcggcggccgcctttgtgcttctgttcttcgtgggctgcggggtgctgctgtcccgcaagcgccggcggcagcatggccagctctggttccctgagggcttcaaagtgtctgaggccagcaagaagaagcggcgggagcccctcggcgaggactccgtgggcctcaagtgagcggacgccgcccctgcttctgggtccccggtgggaggtgggacctggccgagcatcctcaccgggagtctgcccctcccgacccagggcccacctcccacgccaggcccgggccaggggtctctgggggcttcctagggagctcgctcagcctcacttctcgacccctcaccccccaggcccctgaagaacgcttcagacggtgccctcatggacgacaaccagaatgagtggggggacgaggacctggagaccaagaagttccgggtgagtcgcgaggctcccgggctcctgggctcccgggcacctgctgccgggctgccctgacaggctctgctcactccctctatgtagttcgaggagcccgtggttctgcctgacctggacgaccagacagaccaccggcagtggactcagcagcacctggatgccgctgacctgcgcatgtctgccatggcccccacaccgccccagggtgaggttgacgccgactgcatggacgtcaatgtccgcgggcctggtaagggtgccagcagccagggcttccctagccccgtggcccacctgcctctctcccctaagccccgaggctggggtacagttgatactctggaaacttagaattgggggtgagagctttcatccttggggtgtttcccattcagagtagacgtgggggggtcctggagtcctcctgttcttccaccaaccccttcctggggtgataccgcagggccactctgtccctgtaa

SEQ ID NO: 135940 - DNA, 1031 bp, Homo sapiens
tctgtagaatgggttgcagcctgggttggagtaggccccttggcagatgtgcgttctgagctaccggggaaatggccggggcgcgggcacccagctgaccccaatctgtccccagaaccttgtgcactggtgtgactcctcgccctgcaagaacggcggcaaatgctggcagacccacacccagtaccgctgcgagtgccccagcggctggaccggcctttactgcgacgtgcccagcgtgtcctgtgaggtggctgcgcagcgacaaggtaacctgctgtgcccacccagctcgggtcccagcccatcaaggtcctctgtgggcctgggcctcacctgtctaccaccccatcccccgcaggtgttgacgttgcccgcctgtgccagcatggagggctctgtgtggacgcgggcaacacgcaccactgccgctgccaggcgggctacacaggcagctactgtgaggacctggtggacgagtgctcacccagcccctgccagaacggggccacctgcacggactacctgggcggctactcctgcaaggtgggggtccctcctagggtaagggttgtggccggcacgagtgttgccacacaccaggccctggctgggagctggcccagtggagaaaactgaacctgataggcccatgcactgttcagtctcattaggggagggctggggtaatcagggtagactgcctggaagaggtggcctgtggaaagcctgaaggagggtacctatactgagaagtgggatggggttttcccttcccctagattgtgtctgggcttggccaacacctaccctgaggccctcacctctatcctatgggacggggtccacccacccccaacaggcagtgactccggtcaccgaggccccgccagggtctgttgggctgggtctctctccaggtctgacaggagcgaggggcccgtggcttcgctggacctgagggcagctcatgtggccctgtcagccctcacagtggggtgtgggagcactgcatcctggcgccggctgag

SEQ ID NO: 135941 - DNA, 1873 bp, Homo sapiens
gccgcagtcttgggtatgggaagcgctgcggcccccacttttttctttattttgagacagagccttgctctgttgtccaggctggagtgcaatggcatgatctcagctcactgcaacctccacccctcaggttcaagtgattcccctgcctcagcctcccgagtagctgagattacaggcatgtgccaccacacctggctaatttttgtatttttagtatatatggggtgggggagtttcgccatgttggccaggctgatcttgaactcctggcctcaagtgactcagccacccccgcctcccaaagtgctgggattacaggtgtgagccacagcgcccagcctgcccccactaaaggactctgcgagtctgagtggatgggcacctccgccagcccatagggcattgcagacccgggagtgcccaggccccggccgtgctgctcgggcctccctcgacctgcagtgtggtcccccttgcaggtacaagtgcgactgtgaccctgggtggagtgggaccaactgtgacatcaacaacaatgagtgtgaatccaacccttgtgtcaacggcggcacctgcaaagacatgaccagtggctacgtgtgcacctgccgggagggcttcagcggtgagtgggctgcgcgtttctcagtgcagagggccgccctcgagtctggggagctggagacacaggatcgggacccaggtccagccagcaccatgcatggtgtctccctcccgtggcaaagccttagctccaggcctctggctcttggagatgaggaggggcctggggtggggagcaggcccagggctgctgttgtggggccctgccaaggtgcctgggagtgctggacatgccgagtgctgtccccttccctccaggtcccaactgccagaccaacatcaacgagtgtgcgtccaacccatgtctgaaccagggcacgtgtattgacgacgttgccgggtacaagtgcaactgcctgctgccctacacaggtgaggggtgggtggggcctgtgctggagggggcggggcctatgtgggaggggcgggacctgtgctggagagggcggagcctgtgctggagagggtggggccaggggtgggggcggcctgggaagccgtgactggagggtaaagtggtggctttcttggggcggggccttccagaaggttctgcgcctcactgagtgccttaggcccctgcagtatgtgggccttctcccgggggtggggttggcagattagcaaagatacaggatgcctgggagaaaattttcatgcaagcatgtgttttacctggcaagcctgccgcaagacacaggtaagatgcaggtgaatccttagcagggccgggcctgggtcactgggctccgtgctcccggcgcccaccctgctggggtctctgggggccgggcttccccacccccgccagccggacctgagggattcctttgatggcgggctctctttgtgtgagcggaacaaggagccctctgtttgggctgagcggggagggggatgttcccccaactgtccagcccctgctatgaacccagccaaggggatcacaggaaatgatctcctctagaaaagacaaagaagagtccacaagcaccggggtcctggcgctccccaggagcgggcagagggtgctgccacggggcctggtcagggagggcctgcctgggccaggcagccgggctggaggtcccacgcctgcggttcccatgacatccagcagcctgtggccagaacgctgttttctttgaccgaagttaaggacctgggttttctctcctgtgtcagtcagtgaggaccctccctccacggctgggcgcccctgtccctttcagacacgtcgatcggg

SEQ ID NO: 135942 - DNA, 1048 bp, Homo sapiens
cagacagggccctggttggtctgtgtgggccgtttgcaacctggctccaggcagcccctgtgcccagtggggtgtcctggcattgagggccttcagcaccccactcaggccacgcttcctgggccagtcacagggatgcctggatgaacagacaggccctgtgttcgggaattaccctctggtggggtgacgggcaaaggtgcaccccgacgcagcagtgtccacagagcacaaagaggaggcaagactccatggtgctgggcctgcagaggaaggagtgatttaggctggcggtgggtggaggagtcagcccaggaaggcttcctggagggggcggcattgccaccctgcgtcttaggggacagggagctcagggagtggcagctgcccggggccgacagctcctgttccctgcaggtcagtactgtaccgaggatgtggacgagtgccagctgatgccaaatgcctgccagaacggcgggacctgccacaacacccacggtggctacaactgcgtgtgtgtcaacggctggactggtgaggactgcagcgagaacattgatgactgtgccagcgccgcctgcttccacggcgccacctgccatgaccgtgtggcctccttctactgcgagtgtccccatggccgcacaggtgagtgccttgaggcccaggtgggcgcagggggctcacatgggccaggcctgagctgtgtgacctcacccagggactgtggccctcctgcacccaggataacctgaaagggcctttctggtcagggaggccggtggtcgctgtgagtcccccggaacgtcccaagtgtcacgggatgcccgacggggtcacggcgggcagctcctcctggggtgtcagtggggttggaccccagccgtgggtggtgtgccatgcctggcccaggggccgtgcccactgaccgccgctgcctgcccaggtctgctgtgccacctcaacgacgcatgcatcagcaacccctgtaacgagggctccaactgcgacaccaaccctgtcaatggcaaggccatctgcacct

SEQ ID NO: 135943 - DNA, 1052 bp, Homo sapiens
gggtaggctgtcacacccagcacctccaggaggatgtccagctgcctgctgggtggtgcgctttagctttggacaacctcgtgtctgaggcctggcctggccactagctctgtgaccttgggtcatcaggtcatgcaagcctcagtttccccagcatgtcagccgggctgatacacgctggatctcttggtggtgtgtgaggattgcatgagaaccgtgtggagagggcacctggtcagcgctcctttcttccccgccttctccccgttggctgacagtgctggtttccagagcctccttcctgaatgtttaattgattgacgagtgaattcagagaatcctaaaggtgctgcctggtgggctgggcctggcactgcctggggagggacttgccggctctggggaagtccatctcccaggatggctccagctccggggaagtccatctcccagggtggctccagttcacagacacgtttgagcgcctgctgtgtgctgcgttctgctccaggccaggcccccggtggggacagggcagacatggcccctgctcctgtggagttcacttcccagcaaggcgtgagagaggcacctagctcacatgtgggacatgttgggggtgtgccggcccggtggtggcctggcatagctcccggcagccccgtaaagctgtctggatcaggcaccgataagtgagaagaagagacccagagaagtcgccatcagccccagggtcacacagcagtggcagaattcctactagccctgcccctctccttctcccaagcgaatgtccctaaacacagccccagccagcctgagctgccccgtcatttcccgactacaagcggactgggggcgtggcttccccttaaaagaagaggaaggaggctcaggcgggaagtgacttggccctgcagccggcctgggaggctggggagggacggggtagctcctgtcacccggtctggctctttccattgagtcacctgcctcgtcttgggcgtggccaggggaggaacaggttgattctcctcctcatgctgagctga

SEQ ID NO: 135944 - DNA, 1074 bp, Homo sapiens
tcccctttgctggggcctggcgccccctccttcttggcgggaagcctgcttcagtttggcctgacaggcagccgagctcagcccacagagaccccattgtgcacaccccacaagtccaacgagaagatgggacggaagcgcgtcctcaggctcctgcttctgggccgcagagttggaggccagggccacagccgagcccggcttgtggaggcacaggtcagggctcacacagcagtctgggggacattgcagccgcttcggagaaggccccgggctccctccctgggcttgagccccacccaacatacacccctcaggtgcctctgccttcccgttcctgcccatccttctcagaaggcccaggaggtctgtccaggagttagccagggcacctgcaggaggcctggctcccccagcaaggggagaaacccacactgtttctcgaaagagtctggggtgcaggctcttggagccctgccagcctgagtgggaatcctggccccgtggtatccagctgtgaccccggaaagagctttggcttttggtgccatttgctgcctccgctgtagaaggggcatggtcatgatgggcgtcacagtgcctggctcactagtactgggtgaatcatttctttccatcccaaagagaaggaaccttcaccggaagctgccaatcaggtggttgcagggcccgggattggaaaaagtggttttgttggtgcaaaatgccttcccaggaggtcagagtgtcgccgtggcctggtcagccagtggccaggtagaaagcacctggcagcacatgctggtgggcggaggatggttggtctctgggcagctgctgtgcgaggtgtggccgtggtggctgtggtcggagatggtggccttctgagcaggcccagggggtcactgtggcccttggctcttctctagccccctcatcagctccgtcagtgtgagcaaggggtactgaagagggctccaccttttttctctttgttttgaggagagctgggaagagctgcagggaccctatctgtctgggtgagactacgtccttggtctgaaacgctctccc

SEQ ID NO: 135945 - DNA, 1049 bp, Homo sapiens
accaagagctctggacagcgtcaccccccctgtgcccccaggctgtggccccagctgtttgtgcctggcgagggtctggctagctggaagagggggccagcggaggagagagtgggcgccaccgtggggctgtcccaccggtggaggctccagcggagatgagctgggcaggcctcgcggagcaagtgcaaactgcacccgcgtcctgggggcatctgcggggagacttaggggtcatgctttgtgccccaggccacccagaggagaaggccaccccgcctggaggcacaggccatgaggggctctcaggaggtgctgctgatgtggcttctggtgttggcagtgggcggcacagagcacgcctaccggcccgggtgagccaagccctagcctgggagtgctggggtggggggaccgggagccctcagcacctcctagaggcggccctcagcacctgtcggggactccctgggggctcctgctgagggtcctgccccggccacatgttcccatcattcttgggtcctgctctgggactcctgggctgaccccctctccacccccgcagccgtagggtgtgtgctgtccgggctcacggggaccctgtctccgagtcgttcgtgcagcgtgtgtaccagcccttcctcaccacctgcgacgggcaccgggcctgcagcacctaccggtgagtgccccaccacaccgagctcacccagccccagcctcccaagtcggccacacatcagcatgtcaggggcgaggcgggggtgaatcctgggacccaagatgggaaactgaggccagagccatgagagggctgcctgagatgggcgacccagggcggccggagccaaggggttccacgatcacctccagtgtcctaatccttgctcttgccccgacacgtctcaaaggaccgcacctctaagagcatccccatgtttagaggggtcacccatcctgtctgcacccctccacttccgggggactaacccctccctaccctggcatccctggctgcaagttcccatatacacagaatggtgcct

SEQ ID NO: 135946 - DNA, 1040 bp, Homo sapiens
gtcccaggctccagcagggagctcgtaccttccctcagctgagggcccacctggccttgggatgccgttggggtagccagggtgggggtagccaggggtggattcacagagaagatcccagcccatcccatgccagggtctggggagcctcccgaggaaggggaggaggaagaggaggaaggccctgcctggccttccgctcagtcaccccgaggtggtttctggacccccagcatgttgggcaggggcatgggggctgcagggcggcgtgaggggctcagtccagcctggggcgctgggcagtcacgagtctttcttgcaggagcctagggttggatgaggcgaaggtcagagatcactgctccccacagcctccccgcccagctagatctgactggccccttggcctttggtcgcccccgacccccaagcctgggtagcccctctaggcccactgggcccagacccgggaggagggctctggagggtgggggcactcacaggaccccagctgctcctccaggaaggaaatctgctcgctcagggagtcgatgcggccgagctgctggaaggagtgcaccaggaggctgccggggtccgggagcccatgctccagtgcctgcgaggccaggctgtgcagtggggccagcaccagctgcagcttctgtgggtgcagaagggcagtgaccctgggccggcccccgccctctctgctccaccggggtctagggaggacccctgggaagggctccacaagcctccagcccccgcctccgcggcagggctccaagtgtccactagagggggctgccgtggcagaaaagcttgccgcagagtgggtgcctggggcatcaggctggcggggtggtcccagccttggggtccctggcaggagaactagggggacagctggaccactggccagtgggaagactggcaagagctctttgtcctggtggggacaaagatgggggggtggggaggtctcgtctgggtccaggctctgtgtattgtctggggggctgtcaagcttggttcct

SEQ ID NO: 135947 - DNA, 1014 bp, Homo sapiens
atgtggccctgccttgaggggccagtgaccttccccagggtgtgtggggccccatttcctctgctggggtgcagaggctgctctccccgacgtgggtccttcatagcggacgtgagagccagtgccagttcctttccggctgggtcccctgtggggtggatgagggctgggtgggccctggatgtggatttggaagtgggcgccttcccatgctcctagcatccgagttccagaggctctgggttttcctctgttgctggggagacggaggcagggcagccgtccaggtgggtgagccgggcccgggactctgtccgcttcaggggctccctcccctgtgtctcccggtctcctgccccgtgccaggagggcccctccccagcctcctccacaccccacccccaggccttcgcgccccagcctcggctgcgggatctgtgggacccgtgttcatggtggcctcccctgcagcatcatcggctggttcgtgcgaagcttcaagtacttttacgggctccgcttcgaggtgcgggacccgcgcaggctgcaggaggcccgtccctgtgtcatcgtctccaaccaccagagcatcctggacatgatgggtaggccgggcctcgggggtggcttctggggtttgagtggggccggctgagctggggctgtgtggggctgggtcccggggacgaggacacagggctgcctgtgcctgggcgagctcggcctcagtacctccctcagggccagacacagaggctcggaggccacacgacccgtccaggtagccagggagaaggcagggtgccaggcaggcctgtgggtgctcagcagctgtcttccagcgcacgctgtctccccctctctctctgtctctgtctctctgtctcccaggcctcatggaggtccttccggagcgctgcgtgcagatcgccaagcgggagctgctcttcctggggcccgtgggcctcatcatgtacctcgggggcgtcttcttcatcaaccggcagcgctcta

SEQ ID NO: 135948 - DNA, 1094 bp, Homo sapiens
ggcccagaccatggggggcagcgccagagcccgagccaccggcaagccatgatgggggggtcccctgggaccgggagggtgggagcagagcgccagagcctcggtaacctggcagaaggctgtggggagggagcgtggaggggaggtccgggccgggtgacccagggcgggaagggggggccgtgtcggggcggggttggggacagtggcggggcggggcctggtgaggggaccgtgtcggggcgttgttggggacagtgtcggggcggggcgccgcacctagcccttccctgccgcgcgctcctcccccacgccgcgccccgccccgcccagccccgccgccctcgcaataaggggcctgagcgcgcgggggagaagcgggagcgggagcgggagcgagctggcggcgccgtcgggcgccgggccgggccatggagctgtggccgtgtctggccgcggcgctgctgttgctgctgctgctggtgcagctgagccgcgcggccgagttctacgccaaggtcgccctgtactgcgcgctgtgcttcacggtgtccgccgtggcctcgctcgtctgcctgctgcgccacggcggccggacggtggagaacatgaggcaaggccgggggccgccgggaggggccggggaaccgccgcgccgcttccgcttccctaactttcttctgggcttccctccttcctgccccgcccgtcccgccccgctccggggctccggggagagcgcgcctgggccggcggcaggcacaggagggggtcccggagtcagggggtcccggagtcacggggtcaaggagccggcgtcacagtgcccagcaccccaccccccgccctggccccgggcgtctacaccggtttcggcctccgccgcgtccctgcagcccggcgtggggttccgggggtggagcagctttcggagagaaagggggccggtccgcgctgggagaggctcagccctgcttcctgagcggggaaaccgaggccggggcggcggggacttgccccagggctattgatcagggcgcacgacggcgtgggggcacccctcggcctccctccgaccccctcctgactgtccg

SEQ ID NO: 135949 - DNA, 1031 bp, Homo sapiens
gaggtcggcgggcgcgccaggcagcaggtagccccgtagcagtgcgcacaccttggccaggttgggctggatgaggtcgcccttgcactgcctcatgagcctgtcacacggggccctgcagtcgcgcccgtaggtgcagtcggtgctgtgctcgcagcggcggccctgcaggaagcggcgcacggtggcctcgggtgccacctgctgcaggtcggccatcttgaagtcgtaggtggctgtgtagcccacgttggccagtgtggtctcacacatgtagaaagtcccgtaagagccgtggaagagctcctccacgaactccagcaggccgatggcgatcttggcccgccaaggccacgcaggccccagccactgctggagagcaccctgcagggcaggcggcagcagtgggcgcaacaggggtggaagggcggccgcgtgccaggcgccatgcggcacgccctcggtgaggtagaggtccccacagtagcccagcagtctggaggcgtgctccttctcctgcagggacagcagcagcaggaactcgttacgctgcagcagggcccacacggacttggcttccgccagggacacccggttgtccttgttgaagtcagccatgagcaggacctggccaaccagcgccggcagggaaggcaggtctcccaggttcgcctggcgtttgggaccaaaagaaaggaaaagccagctgatttgatgtctgggagcacgacctggcctttacctggtcctcctggcggggtggtctgccggccagaccagcacatctgccaggttaggggtcccagcccacagctacacgggtggaggacgcagccagcaatgtgtcagctcactctgctggcctgtgtggctgctgccagacagacctcccgcctcctggcagccttgggtgcacctggggagctcgggggtgggcacctgggcagagaagcctcagagcttccctgaggatgagaatcggcacagggcagagggcacgcactggctgaagccctgggaagcggcccctt

SEQ ID NO: 135950 - DNA, 1779 bp, Homo sapiens
agtgcagtggcgcgatctcagctcactaccacctctgcctcctgggttcaagcgactttcctgcttcagcctccagagtagctgggattacaggcgccagccactaggccagctaactttttttttttttttttttagagagacgggtttcaccgtgttggccaggctggttttgaactcctgacctcaagtgatctgcccgcctcggcctcccaaaaaacgcagtgtttatgtgatgctcctctgtggtgtttgcaagatttatacaaaattgcggtttctttttttctctaggacgtctgctcactggagatgacacgtgcgtggggtgttgggtaagttggtgcattggagctggaacagggtcaatcctccaatgtaactaagccctcctgtgcaacatcttaagtgactggagggaccagtcggtcttgtgttcacattgaggctagaagctgtctccaggggagtaaaaacggattatttagtcttcaacaggacactgcccctagaggcgttgcagctgtggctgccgtgtcacatctgtgtcattaggtggcagagattagagaggctatgtctacgctcagcgttctgccccgtgaacgtttgaatgtttgatagtctcacactcctgttttgtggacaggcatctgttttccttcgctggtatctgggagagagggtgggccctgtgagtgggctttctaactctcgcgctgggctaggctggcctctaggggtctgaagggatagtgggaaggtggagggtgccttcaccaggagcagccttcatgagtgagttttaagaacctgtgaggatcggtcaggtcaggtgaggtacgcgctggatcatgccgtacaccgtgtcaggatcacgcaggacaggactggggaagggtttgctggcgtctcggttaatagcagtaacggcagccgcttgtgttcttgattctttgccaagcattcttgttatttaacacgggaaggaggtgacttcgcctgtgatggacttccagtgtgagcactggccagagtgaccaggctgaccagcaccagccctgatccaggtaagaggtgaggcggaggcttgccctccttccctgcctgccgggtgcgtgtgagcggctgccctgcggatgctgtcctggacctgttggcaccacagacagttgctctgctgtgcctgtggcctcggggcaaagagaaagtggcgatttctacactcagtgctcgggaaccagtgggcactgagaatggtttatggcctgacattacttgcaaccaaagccaggcagcatttggattttcgcttttggaaaccaccttacctggtttgctccatgagggaggggcagcaacatcgctgggaaccctgaggtgtagatatgtataaatgagctgtgtgtgtatctgaagctcgggcacttgtggggttaccaggagtgtgcgtctcactcccaggcctcgttctggaaacgattctgtaggtctgtctgggaggccttaggcaagtttgattaagaacagtcgagctggataaacaggctgttccttgtccagcactagtcatcccaggggggcgggggcggggctgcaactcctgtgcacaaaggaagggccctgggtaggggtcaggagctgccttgcccagagatgtgtctgggtcactttggaaacaggaatcctctccccaaaatgggtagcaatgggggtacagaggccaaagacgcagctgcatgtcctgcagtgcctgggacgccccgtagtgaagagtga

SEQ ID NO: 135951 - DNA, 1065 bp, Homo sapiens
gggcaagcctccgcctcacctcttacctggatcagggctggtgctggtcagcctggtcactctggccagtgctcacactggaagtccatcacaggcgaagtcacctccttcccgtgttaaataacaagaatgcttggcaaagaatcaagaacacaagcggctgccgttactgctattaaccgagacgccagcaaacccttccccagtcctgtcctgcgtgatcctgacacggtgtacggcatgatccagcgcgtacctcacctgacctgaccgatcctcacaggttcttaaaactcactcatgaaggctgctcctggtgaaggcaccctccaccttcccactatcccttcagacccctagaggccagcctagcccagcgcgagagttagaaagcccactcacagggcccaccctctctcccagataccagcgaaggaaaacagatgcctgtccacaaaacaggagtgtgagactatcaaacattcaaacgttcacggggcagaacgctgagcgtagacatagcctctctaatctctgccacctaatgacacagatgtgacacggcagccacagctgcaacgcctctaggggcagtgtcctgttgaagactaaataatccgtttttactcccctggagacagcttctagcctcaatgtgaacacaagaccgactggtccctccagtcacttaagatgttgcacaggagggcttagttacattggaggattgaccctgttccagctccaatgcaccaacttacccaacaccccacgcacgtgtcatctccagtgagcagacgtcctagagaaaaaaagaaaccgcaattttgtataaatcttgcaaacaccacagaggagcatcacataaacactgcgttttttgggaggccgaggcgggcagatcacttgaggtcaggagttcaaaaccagcctggccaacacggtgaaacccgtctctctaaaaaaaaaaaaaaaaaaagttagctggcctagtggctggcgcctgtaatcccagctactctggaggctgaagcaggaaagtcgcttgaacccaggaggcagagg

SEQ ID NO: 135952 - DNA, 1180 bp, Homo sapiens
ggtgcagtacaacagtgagtgcggcgggccgggggggcgcgggagcgccgcgcgggtctccgaacccaggccccgggcgccgcgcggtggtgggtgtcggtctcacctgcttgccggttgtggggtgcgctgggcccgccgggcgctccgggagcgggggcgcgggccaggggacgcgaggagaggccaggccagggccgggtcctcgcggcccccgagccgcgggtcgtttcccagccgcactcgcctgccgcgtgtcgctcccgccgcgctgtgcagtggagcgggtcggcggcggcggggttggcccggctgcccggcccgggggtgattacataatgccaagcagggcccgccggcccggggcgccgcgcccccgacgctccacggtgcccagccccgggcaccactcacctgcaggaggtgcggggaacccagccggccttggcgctttcagcgggatttttctttgttgacttcctactgagtttgaagacagaatattagctacgccacacattctcgcctttttttttaaaagaagcgtttgtaagagacgtatctagaaaagctccagaaggcacgggctgacttgcgactgtaggagacatcccatttctcgtaggaaggaggagtcatttacggactcctgagtgcctgggacgctccattcctttgttataaattgtgtaaattgtcctcgacctcttatgagtttttccatcttgcgggctctttcccagtagtttttgaaagcttttatgtggttccctgttttgacattgcttccctcttagccatttccgtatgtttctatgaggttttaggacgctacgcctatccagttttttggtcactttaaggggagccttagagcctccgtgatatttccatggtaatgtagaattttaagaactaatgatcagaaagactcttgtgcaggtttaaaagcaagttcatgaattcgcgtgccgtgtgcacggagagaggccgtagttcctggggctggagctagtccaggaggacagtgaagatgtcgccttccttagtcccccggcctgtgagcaagaggaagctgcagaccactcgggccaccctcacccagacacctttagcagtaagcaagataaaacaacttcttaaagataagtctgagcatctaggtatgaaagttggtgtc

SEQ ID NO: 135953 - DNA, 1132 bp, Homo sapiens
cggacccaaggagagcagtgaggaaggtgggtgggggcaccagagtgcggtcagcctgctggagtttgggtagaacgtgggcctcctcccagctgctggccgctggccggggtcctctcctgagtccaggatgctgtgccatgctcctggcagccccctgcaggagctgatgtttgcagtgtggtcctgtccatcagcagggcctcctggagggctggggctcgctgctttgtgagtttctagagaagtcctgtcacccagcttggggtccccgttggcctgagtttgagccactgtctgtcctgtctgtgcaggtaaggagggcaaaaccccctctaaggagaagaagaagaagaagaaaaaaggcaaagaggtactggctactccccttcctggcaggccaggactgggtggcatgcggtcctgggaccagggctgtggcttcctgtgactccatggcgccccatccttgtgctcctcaggaagaagaaaaagctgccaagaagaagagcaaacacaagaagagcaaggacaaggaggagggcaaggaggagcggcgacggcggcagcagcggcccccgcgcagcagggagaggacggctgccgatgagctggaggctttcctggggggcggggccccgggcggccgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctggaagaggccgggcattggtggtccccaggctgggccctgcaggtgctgggccttcaggcccagtgtgagcctgctctgcaagaagggaggggacagctggcttcagccaggctcggtggacaccctggccctctcggggcagagccgccagtgtttctcagggatgtgactgaggcccaggagggacctgtgagggtctgtttacagaggctgggcaggggccgcttggctgtggggtgtgcgctgccccggcacctgcttgccctccgcgctcatctggggccgcagcatgcctatggttccgcttccggccgggagccctgaaca

SEQ ID NO: 135954 - DNA, 1488 bp, Homo sapiens
gacagggtctgagcaggggagtgggcaggtgggggccctcccgggggtggaacaggaagaggcggtgccttactgggcagaccacagtcccagaactctaggtcatctagagccacagcgcccctgtgggtggcatttcgggtggcagagaaggtcacctgaagagaacaggctcttaggacctaagtcagggcccagacccctcctcaaggcccccactcgtccagaccctcccagctcactcggaagtcaccccggatgcggcctgtggtcactgccaactcctgccagccagggccccagggccctgtgctctgccacagggtcagggtctctgcgccatgggtcagctccacccgcagttcagccacatctgcaatgtcaggggtcccagggcagctgcggccctgcttgtccccagctgcccacccgccctccccttgggcaccccccacgagccttgggggtccagggtgcacctccagaggccgcgtggtaccagagcctcagcttgcaagaggaggctgcctctcgcagggttggcgagcgcagggctgcggtggatgcctctttccctcggtgggttccaacggccatgtaccagcctggcgcaggtgagaggtcaggagacggggcagggagcaaggagggtattgggacaggggcgcacagagacttgccctggcctcacccaagtcggtgcccagtgtgtggtctgagtgaggcccaggaccctccagtgcggcccctgccctgtctcggagccagctgtagcctgaggtactaatgtcccgccagccgcaggggtcctgctcgaagtcacaggcgaagggggcgcccagggtgggcgaggccccgtggtaacctgggagagtgggtggtcaggtgtgtgccagacctgctcgcactggccctgcccgcccatctggtcttggctcaccacactgggcctcatctgagcagtccctgcagtcacacacgaagttgcacacggcctggccagggctcctgcagtggttggggacccaggcccagcctgaggaccctgctgctgggaggttgacagccaggtggcctgggggcagggtgaccagccatcccagcctgcctaggactattcagttttagcactggacatcttttgtccggggatgcccctcagaccaggagatggagcagggaggggctgggacccacagagaactcccacccggctcaggaccaagcacagcacgttcctgtttccagccctgaagaggctggggagggggacccggccatggggcaccccaagaaaggtagcaggaacccagagtgcccagcagggaactgggcactgggagggcgacccccaatgggaggcatcgacgggcggcccagggcctccacaagctccacccagtccaagggtggcagatgaaggctggcagagctgggggcacctcctgagccctcttgtcccagactgggaggggagtcgtgcctctt

SEQ ID NO: 135955 - DNA, 1092 bp, Homo sapiens
cgcaggcaagatgcccctgcttgcaggaatcctggagccgcgagctgggcggcaggggctggggggctggggcccggggcccaggaggcagcggctgcagggtggacacctctgtgggggcagaactggtgtcaggaggcagggatggggagtgctgtgcctctccagggcaaggcagggtagggcagagtcagcaggctcacccgagactggtctgcagtggtcagacaggatgaggtcgtccagacccacgacgccccccgggcctgtctgcccggccaggaggatctgagggcagaggggctcagggggtgcccagcctatttccccctggggtctggtccctgtccacccgcagtgggtaccttgtgggttcccctcccctgcccacagtgcggctccccagaccccaccctcttgctgttccctacctggaaggggtaggcgctctggatgtcaacacggtctcggacccaggcggtccccagctcccctcggcgcctccgcagcaggacgggggcccggggggcgccgggccccagagtctgcaggaacagctggaggcagccagcctcagacccactcaggtactgatagaagaccagctgtggaaccaagagctggctgggggcctgcaccggggcagccagcacggagagcagggaggccctgtgagccccacccatctcaccgagcagttggaggtgcctgaggcttggaattcggggctggagagtatagcaggggtgccaggctcggccacggagaccaggaaggagcctgcgggaaaggacgggagtgggccagggccactgggctgtggctgcgtgggcagggcctgggccgggtcctctgtgggcctcaccctgtgcactgttccggctgtggtcacggcgtggccaggaggggcgctcaggaccaccagcgcggtggttccgggaccagccttccgagcggttccatgggcccaggcctgtctcaaagtcggtggctatgtggcggcctagggcaggaggtgggcgtgtcagggccaccaggcagtgcttcctgaagccgtatggccccagctccaggggggccctggcaaccaca

SEQ ID NO: 135956 - DNA, 1030 bp, Homo sapiens
ccaggcctcagcatatcctgagacctgcagcctgtcccagcctgggcggggcaggtgtccggtccctggctagggtctgaccaagtgctggatgtcacgtgaggaagcggggccttgtctggggtggtctacggatcactggtgacagatgccgggagggtgacaccatcctaggaggaggaagaggagctttttttttctttctttcctgagacggagtttcgctcttgtcaaccaggatggagtgcaatggcacgatcttcgctcactgcaacccctgcctccctggttcaagcgattctcctgcctcagcctcccgagtagttgggattacaggttcctgccaccatacccagctaattttttctagttttagttgagacggggtttcaccatgttgggcaggctggtctcaaactcctgacctcaggtgatccgcccacctcaatctcccaaagtgctgggattacaggtgtgagccaccgcgcccggccaaggaggaggagctttgacagtggtggctgggagaggcagggcagggagggcaaggatgggccttgcacaggtgggggctcctccccggggggttgtgtcccgccactgcccgccctccagcgtcacagctgagcacagaggctcctgcccacccatccccaggggctcctaccgcattgaaaaggatgttgtcaaagccaggggctgtggcctctgtgttgctctggaaggggcagctccccttcttctgcagccagcgccgtcccccaagtcccagcagcaccaggagcatgagcaataggagggcactgccaaccacagctggcacagacccgggtgcggctgtgttccctgtgggccatagggacatgtgagccctccaaagcagcccccacatctggggctaaggaggaagcctggggctgcatggtccctcagcctctgctggctcctggggttcacccctatttcaaaggcagagggtattggttctgctaccacaaggatggggcctggcagacaggcagctgctgtc

SEQ ID NO: 135957 - DNA, 1161 bp, Homo sapiens
attagcgcggaccccacagcgcagcacctcaccagctccccgcaccaacgccccggcgcgctctttgaggaaaaagcagagggcgacttaggtacccacgccgtctcagcgccgaccaatcggcgcacgctgcggctcctgcgggctcgctggttggctccggcgtcagtccgtcaggcgcgctcggagcggggcgtatctggccaatggctctcgctacagcttcctgagggctggctggttggctcccatgtccgtccgtcaggcgcacgcggcggagcggcggcggcggcggcggcgttgggggcggtagctgggcgggcccttagttccgggcgcgctgcgaccgttgggtgaggcgagcgcggggtcgggtgcggggtcgggcgcgggcgcggggtcgggtgcggggtcgggcgcggggtcgggcgcaggcgcgggcacctctcagggagactccgggccggagcgggagcgggggcgggagaggccgcggggcgggggcggggccagcccgaggggatttctctgagccgctgggccggaaaccaagtccgagcgtggctggcgcgggaaagttcgggaacgcgcgcggccgtgctcggagcagcgccagggcacggtccggggttttgcgcggggtcgcggctcccagtaccgcctgaggcccgtgggcggcccacccggccctgccccgtcccgggtccgtcgctcccccgcaccctgtcgcccctccacgctcagctgtgggcccctcgtgtccccgaagccccgcaccctcagccggctgcgtgctcgggagggtcaggggcgcctccgacccctgagtttgccagcgccccccagccaggggtcggggaagaccagtgaggctgggggcggagccgactctgctgccttcctgcccagtggctggggagacccaggctgagcctgggtgaaaagtccctctggctgctgggagggtcgggggcagcaaggagccagtgcggggatgggctgcggtggaccgggccgggatcggggccggggcctggtcctggcagtagcaggggatgtttgtggaaggtagagccgagaaaaagaggagttgcaatgtctgcaagaatctggcgtgagcagctgaaggctggtgcttcctaggccaagatgaaggagtca

SEQ ID NO: 135958 - DNA, 1071 bp, Homo sapiens
tgagcctgagtttccatactagcggcgggagatgggactagagggtctccaaggctccctgaagctctgcgattctgcttctctgagtcttgaccgcaggtcagtggggacccggcccctcaccatcgcctgctactgatcaccattggtttggttttgtctcgaggactgttctggaattgaggtgtaacgtgctgtgtgttcttccttagggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcaggtgcatggggcctgcaggctgggaggaggggcaggcaggctaggctggttttagagccacgctgcccagcctggtagctcccagcagagccgggtccagcttagatgtgctccagttatcgatactccctggatttcggaggtttaccacaaagaatgtaaaattaataattttaaaatagcaatttgaaatacgattttggatacatggggttaaatatagtacgtcattacagttaattttatctttttattatttttaatgtgagtactggaaagtttaaagtgccacctactgctcactttttggctgctctaggcagctaagacagccgccttccttgcagcgagtggtctgagaggtgtggcctgtgcacatcggcagcagctcggcctgtcgggagagccggcaatacctgagttactgcagcagatgtccttggcggttcaggcgtgccttcctcacaaacggagtgataaaaacagtgtgctgtgaatactggggtttaaaacatgtcctgttaacatttgcctgctgttggtttcactaaggatgagaaagtttaaactgtggtgtggaggtaggtttttgaactgaagcaaatggtgtttgttttttgcattaggtttcacagtgggttgtt

SEQ ID NO: 135959 - DNA, 1028 bp, Homo sapiens
gagtggagacgaggacacactgatctgatctcctcctgccctcccacctgtgggagccctgagagctatctgcagagggcggcccccaggaccagcatgcggacaccaagccagcgctacatcgccttgtgtccccgggtgaagctgtggctgcccaaatgtcccacgcgagttctactgacgcttcctcctttcgttgctagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggtgcgtggggtggagcagcagcctgtgtggctgcagccatgcggggctgagctggggagctgcgtgctggccactgcggctgcgtcggcccctttgcactcgttccaccccctcggccctttccctggagacacgcgggcggatgtttcttggcagaactgggaatgggtgtgaagttaatgccgaggcctttcaaaagcatttttgtaagccgggcacggcggctcacgcctgtaatcccagcgctttgggaggctgaggcgggcggatcacgaggtccggagttgaagaccagcctggccaacatggtgaaaccccgtctctactaaaaatgcaaaaagttagccaggagtggccaggtgcggcggttcatgcctgtaatcccagcactttgggaggccgaggcgggcagatcacgaggtcaggagctcgagaccatcctggctaacatggtgaaaccctgtctctactaaaaatacaaaaacaaaattagctgggcatggtggcgggcgcctgcagtcccagctactcaggaggctaaggcgggagaatggcgtgaacccaggaggcggagcttgcagtgagccgagattgcgccactgcactccagcccaggcgacagagcgagattccgtctcggaaaaaaaaaaaaaaaaaaaagcc

SEQ ID NO: 135960 - DNA, 1001 bp, Homo sapiens
gatagaatcttaggttctaggatcaaggccgagatgctgtaggcacctttcctgtttgaatttagcctggcactgctcgtgaaactcagcactgggggccatggcagtcctgtgctctggcgccctcgaggcggaaagagacccaagcgtcatctggaggggccgccacattgtgtggtgcctgctgccaaggccttcagcagggaccagaaacaaaactcacactctttcttctctgagttgagactggaaaaatgaaagattgttttaggggaaacttgagggaacagtctgggcagcctgcagggcatggccctgttcctccagggctgggaaagtcagcactgctttctggtggcgaccttccctctgcagctgctggctcagccgattgtatatgctgggagctctgcactaagcgttgggtgaagggtcagcattgtggaggccctgccacggaggtggtcttcttgggagctgcactcaggcaagaggacctgtttgtgtggaacatctgctttaagcaatgctggtgaacacagcttgtgtgcggcacgcgtgcaggctgaggacaggcagaatgggcctgggggcacggtggaggacgaggatggggaggatgggcctgggggcacggtggaggacgaggatggggaggatgggcctgggggcgtgtggaggacagggatggggaggatgggcctgggcacgtggtggaggacggggacggggaggatgggcctgggcatgtggtggaggactaggacggggggaggatgggcctgggggcatgtggaggacgaggatggggaggatgggtctgggggcacgtggtggaggacgaggatggggaggatgggcctgggggcacgaggtggagaggactaggacagggaggatgggcttgggggcacgcggtggaggacgaggatggggaggatgggcctgggggcacgcggtggaggacgaggacggaagggtggtcctggtgctgccacagt

SEQ ID NO: 135961 - DNA, 1029 bp, Homo sapiens
tggcaggccgtgtcgcgggacgagttcctgtggagggagcagttctaccgctactaccaggtggcccgcgacgtgccccgacacccaggtcagtggcgtgtggggcccctacccacgttctgcagccagggccccgggcccctgcgcttgggggtcagcctggctgggggcccgccccgcggccccgcgtgtccatgctcacccccccacaccctgatagaggcctgtcaggacacagcgcaggcgcccctcagagcttggaggccagagggttcattgggtcacttggggggtggggggtacaggggtctctgtgagctacagggttgaatcccccagccgaggcctatgccatgactagtgggttccaggggcaccacggggcctgccaggactgctggggccacactcggctcatggccgtgactgcgaggaaggcccgggcccaggactgacaactgcccacccgcagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaaggtgaggacggccaggtgtcctgcacaccccacccagctctgccgcagcacggaggtcccaggacccaggcgttccaaccaggtggtggtgggggggggggtgggtcaggccagaggtgacagcagcctccctgcatccagcggagggaccacagaggatcaggagcggtgcagggtggccctgagtgctgaggagagggtcccacacacagccgcctgcttcaggggcaggctcctccgctctataccaatgccccccgagtggatgacagtggctggaaggggtccctgctccctggtggcctctgagtagggctggcagagctggggcctcatggctgtgtagtagcaggcccccgccccgcgacctggccaggcgatcactacagccgcccctgcc

SEQ ID NO: 135962 - DNA, 1014 bp, Homo sapiens
tgtcccagttcatccgcaagcatgtggcctcctgcctgctggtctcagacacaagcacggagctctcctacatcctgcccagcgaggccgccaagaagggggctttcgagcgcctcttccaggtgtgagggcgcacgggtcggggggcagttgcaggtggtggaggtgggcgcactcctgcctgggcgtccctgccgcagcctccccctccaccgcccctgcagcacctggagcgcagcctggatgcactgcacctcagcagcttcgggctgatggacacgaccctggaggaagtgttcctcaaggtgtcggaggaggatcagtcgctggagaacagtgaggccggtgaggggcctggaccacttgctcagcccaccccacccacaaggccccagctcgggcctgcgctgtcactcctgcctggtgtctgggggcgccaccctggtcctgggtggaagccaggggacgccccggggttagcctgcggtcctaggtgggtggtcctggtggccagaggtcccggacaggtgtatgagcctgggaactggggtcaagaccggggatgggggtcctgggcaggcctaggggccagtagccctgagtgtcccctcggcccttccactgcggcagatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaaggtgggggtggcagggtgaggctgggacagcaagggagggggagcagggttgcgggggagcggcatgagggcagccagtagggagagggtagcgtgcaaccacctgctcagcctctacctctctgcacagaggtggaggcagaggccc

SEQ ID NO: 135963 - DNA, 1051 bp, Homo sapiens
acggcctggcccggccccctgtcccctaccccagcaccattgaacccgaggcgctgcggcggggcaacatgagctccctgggcttcacgagcaaggagcagcggaacctgggcctcctcgtgcacctcatgaccagcaaccccaaaatcctgtacgcgcctgcgggctctgaggtcgaccgcgtcatcctcaaggtgcacgggtctgggacgctccatgtttgacaggcagagtgggagggggtctctgcaggcctgggacccctgggcagagggtgtcggcagaattgacacgggaggggtacggggtgcagcttcggatgggacacaggctctgcaggtgggggaccagggggtcgcttttcctttcgggagctccaggggctgctgtgggaaggcactggagagtctgctctggcagggtcctccggctgggggtggccggtccagggcagtgctggtggaggaggggtgtgtccagagaccttccagagtgtctcgtgggcgggcagctgggcagtttgggttctgggtgaggggtcctgtctggaacaagcagaggccagggctggacattggcctgggaggggagggcctgtggacgaggccaatcctgggtgtagagggggtccctaggatgagggtgggacagatgagggtggagcattgggtgcttaagggacacatggagacaggtccagcaaaggagctggtgggcacagctgggcagttgggggtccggaggccgtgctgccctgggagtggagggcaaagcaggtttcacctgagcgccgcagaaaggagtggagagcccgggcgtgggactcacgcttgaaatcccagcactttgggaagccatggtgggaggatcgcttgagctcaggagtttgagacaagcccgagcaacatagcggaagcccgtctctaccaaaaatacaaaattagccaggcgtggtggtgggcacctgtaatcccagctacttggagggctgaggcgggaggatcccttgagcctgggaggtggaggctgcagtgagctgggactgcaccac

SEQ ID NO: 135964 - DNA, 1053 bp, Homo sapiens
ccagggctcagagcaggtgggggcctaaggcagacatcctcttgcccagccagggcccgggcgggaccccttgggctgcaccagtccgtgcctgtttatctttcaacatgcactgcaggaaacccaggctgcagtcagctggggtggccatcatcaccatggctggcagaattcccctgggcacctggccttggcggggagcctgggttaggtacatgccctggccaggcacctggagctggctgagtggggtcccatggatcaggcctgcagcccctggcattgagtcactggggacagcagagcagggccaagggaacagggatgtggcatgtggcatgcattagtattagtccccgggggtggttgtcaggaaggtccccactgggcttgggagcagaggctggaatggtggcccctgttccagtggggacaatgctcagggaagggagtgtggcctatgagggcagctggcaagcaggtgggaggtgtgcactgtcctgaccgcaagagtgactcccagctgctggtttgggctgccccccaggacctttttgggtccccaccctacagggctcccagaggcccactgggccacagtggaggtccttagcccatggctggagcaggtggggaactgtttcccccagggaggctgagtccttgccaggcttgtgatgtggggctggggctggctggacactgggcacactcctgctgggtccccactttcctgggaaggatcttggacatcagagctggactcttggggccaagcttggatgacagaggtttgccctgtgtgccatgcgccctgctggggcaggggtgcaccctgggcagagctccaccctgggcagagctcagggtctggagggtgggtgccaaggacctctgtgctgctagcaggctcctccaagctctttgcctcagtttccctgtctgtgagtgtggcctatctcctcttagttagctggacttgggtctacccttgggctacaggctgctcttggtgcagggacagggtcactgtcatgaagtcactgggatggc

SEQ ID NO: 135965 - DNA, 1025 bp, Homo sapiens
tcgccagcgtccgctcggcgcgccccggggacagtgaaggcttggggcgcctctgcagagtcgccagcgcggtgggcgcagccggatgcctctgggagaagagcgcagcgcccgagggtcccccggcctacgaaggctaagccggggtctcggattcgatgtgggcgcgtcgcgtgacgcccggcgaggggcggcccggaggcttcccggcggcggcgcgcgcagggtctcgggcccgggtcggtcccgggcgcggcgcgggcggcgggcgcctcctggcgggcgcggacggagcgcggcgcctttaagcgggggcgggcggggcgcgggcagagtcgctgtcgccgcggccgccggggcggagccagcgcggatcgggtcccggacgcccgagcgccccgcccccgcgcgggcgatgcccagcggcgcggcgggctgcggggcccggcggggcgcgcagaggagcgggccgcggcgctgaggcggcggagcgtggccccgccatgggcttcctgcaccagctgcagctgctgctctggaagaacgtgacgctcaaacgccggagcccggtgagcccaccccacgcgcccgccctcagcccgaggccgcgcgcaccgcggccagaggcgcgctccccgcgcgcacgtgcggacggccgggcgcgcgcagaccccggcgggcgctgggggcggcgcgggcccgagccccctccccgccgggccctgccctcgcctgccggcgctgcggcctccggggaggtggctcggtcgtgtccagtccggtcccgcgtccgctgacatcgcggtgctcggctgagtcacggcacccgcgccctctgcagcgcgctcgctggggccgctgtgggcggggggcaagcggcgctcaggactctggctcgagggaggccctggttcccaggacagaaggcaggcctggggggctccattcagctgcgaggctccatggtccttgggcccagcctccctggggtcccggaggagaccctgtcccttccctccgtccac

SEQ ID NO: 135966 - DNA, 1899 bp, Homo sapiens
ggggtatcagcacaggagcggggactgcctcactccccaggtgccaagttggcgggtgggcccaggtggacctgctggcacaggtttaatgtttaacgtgcccaagtcccggcccactgatactggaggctgctgccccaggttgtggagggtgtgcggtgcctggcgttggctcctgtgcccacctgccactgcggctgctggaactgccttgaaggaaggcggacagcctgagggccctgagtgtcaggttaccaaggaaaccaaaccagccaaccaaggtctggagaaggatgatgccccgtgtggcccccgtggccctgcctgcagtgtgcagtgtggggctgggcagagaggaagagtcctggttagccagaggtgccaccgcagactccccaggcagggttgatggccctgctggggttcccctggctccactggcttgctgtgactggggacattccttagctttgaggcaactcagctatatcccagaggggaaactgaggcagagggccattgccccctcgccccgttctccagcaccaggataagactgattagccacatgtgtcagctggcaccgtggcctgggcccctcatcagcgagatgaaagtgtggttaggaactagggaactagggcctggcctgccatccccagcactgccaacctcggcctcctgaggccctcgggtgccacctggcccctgactgcagcccctggtgtggtggctttgggagtgacctgcctgggttctgtgtctgaggccagtgaggtcagcagactccatcttaggtgtcctcggtgcctgggggacaagccagaggctggaggagcagcatcccttccaggctgcacacttgtcagtgccgggttctggggagagccgcacgggaaggagaggtcgctggcggcatcgtttgctgctccccagagacagacctgggcccttccctctgggactcccaatctggacggggttcctggcttgctgtggggcatgttgaggccggaggctgggcttgtggggctgcacggccctgcccaggagaactcagcactgcctggacggcgagactcagcttctgagctgagggctctatcaggcctggaagtggaccctggggaggggtggggcagggtagttctgataagtcctaggactgttcgcttccgggttctgagccctggcgtcagggaggaagggcatgtccagaacaatggccagaaccaggcccggccagctcggggggtgacgggggcgggtggctggggcagcgctgccgtgtgcaggggccgagccctgcggggccgtgagccggccctgccttctgcttccttcccagatgtagccgcctgtcccgggagcctggactgtgccctgaagaggcgggcaaggtgtcctcctggtgcacatgcctgtgggccctgccttcagcccttccaggaggaccagcaagggctctgtgtgcccaggatgcgccggcctccaggtacgagagcaaagggggaagtcgatggggggatgtccctgcatgaacctctccctgtaagaagcggccggctgggcgcggtggctcatgcctgtaatcccagcactgtgggaggcccaggctgttggatctcatgaggtcaggagttcaagaccagcctggccaacatggtgaaaccccgtctctactaaaaatacaaagtagccgggtgtggtggcacacacctgtagtcccagctactcaggaggctgaggcaggagaattgctttaacccgggaggcggagcttgcagtgagccgattcaccactgcactccagcctgggcgacagtgcgagactctgtctcaaaaaaaaaaaaaaaaaaaaagaaggccgggagcagtggctcacgcctgtaatcccag

SEQ ID NO: 135967 - DNA, 1017 bp, Homo sapiens
ttggggctgcagggagcccccgcccactggggcggctactgcccaaggtacaagaggtggcccggtgcctgggggagctgctggctgcagcctgtgccagccgggtgagtgtaccccaaacccccacacccacgctggggcccaggccagtttagtgcttccccgccctcgtccaggcctgcctaatcctgccctcccgcaggccctgcccccgtcctcctccgggcccccctgccctgccctgacgtccacctcacccccggtctggcagcagcagaccatcctcatgctgaaggagcagaaccgactcctcacccaggtagggcaggcgcgggaggggtgcaggggtgggggtgaggccccgcaggccttgaccaactgtgcacctgcccaggaggtgaccgagaagagtgagcgcatcacgcagctggagcaggagaagtcggcgctcattaagcagctgtttgaggcccgcgccctgagccagcaggacgggggacctctggattccaccttcatctagtccttgtgggccgcgtgggcccccagggccagcctggcactcagcccttcgagggtgggcgccccatcgcacccaccctctctggctggagacccccggcaggcccaggcacagtcccggagtgggcgccttcctgccgcccttgccagatgggctccccaggcctgcccccggctggtccccgcaccgagcgcttgactccgttttggctcctggtgctgacatgggctggggctctcttgagtccgcatagtccgcagctactactgccgctgtcagtggacagtggggtacccctccatgagttagcgtccccccgtttccagcggtgccgccctgggtcccatcttcagggaaaggcactgcccacgccaggctgcacttccaacaacgggcagcagagggcgcggggcggctccgacgcgggtccaagggcagcttcccgctcaaccagggcaccaggacgaggtggctgtagctcggacggacggaag

SEQ ID NO: 135968 - DNA, 1029 bp, Homo sapiens
ctgcccagggcctccgcgcgcctcccagggccactcggcaagaaaaaaaaaaaaaaaatcaaacctcctctcagcctatcagagagcagatgggacgggctcggccaatggccgcggcgcatgttaatgagggctgacgccgcgaggagggccccattcaaaagtagtcgctattgtcgccgtgggctgagctcgccgggccggcccctccgtggggccgcgctgggacgcacgcgggtggacgaggggaccgatcccgggcgcccatggccggggccgccatggccgagcggggccgcgtgcctccccccgcacccgcgcccagcacggaggggctgccgcgcgccttcctgcagagcctgcgcaccctgttcgacatcctggacgaccggcggcgcggctgcgtgcacctgcgcgagatcgagtcccgctggcagggcaccgacgcgcgggagctgccccgcggggtgctggagggcttgcgccaggtggccccggccagcggctacctgaccttcgagcgcttcgtggccggcctgcgcacctccctgctgagcgccgacggcggcccccgggaccccacgcgcgccccggcccggcccggggatcagccgccgccgccgccgcagcgcctggtgttcgctccggccgacgagccgcggacggtcctggagaggaagcccctgcccctgggcgtgcgcgcccctctggccggtcccagcgccgccgcccgcagcccggagcagctgtgcgccccggctgaggcggcgccctgccccgcggagcccgagcggtcccagagcgcggcgctggaaccgagctccagcgcggacgcaggtgagttccggacggcccccgggcaccctcgtagctctcccgggcccgggccagaaaccgcagtcccacagctgctgcccgtgcatttcccacaagggacgggaccggggagcggctcttcgtggactccggatcctggagggcgcctcggcgggtctggagggaaagggcttcatgcttgtcgcggtgagc

SEQ ID NO: 135969 - DNA, 1016 bp, Homo sapiens
gttatcctggagcggaaagacaaagttgccatggccccaggtgtggcccgttcctgagacggggagggaccgcccagactagaactgggagcgtagttgggggtccacgcgcccgggttcgcggctgccccgaggctgtgtggtcctgggttaggcgcctctttttctgggccttgatcgtcatttgtcacatggtacaccaactgggctgtctggttagtgaccagggctgccttaggcacaaggccggggcttcccccgcctccagcacgtcctagactcccagagcgatccctggcgggagccctcgcgatgcccattcccttctccgtctgcagacggcaacgggggcctctactgcgcgctggaggaccacaagatcctggaggacatggagcgccggggagtggagtttgtgcacgtgtactgtgtggacaacatcctggtgcggctggcggaccctgtcttcatcggcttctgtgtgttgcagggcgcagactgtggcgccaaggttagcgcccgactgcgcggcgccccgcacccgaggctggccccgcccctcacggagccccgcccctccgcccagccctcggaacccatccctggtcttggctgcaggtggtggaaaaggcataccccgaggagcccgtgggcgtggtgtgccaggtggacggtgtcccccaggtggtggagtacagcgagatcagtcctgagaccgcacagctacgtgcctccgacgggagcctgctgtacaatgcaggcaacatctgcaaccacttcttcacccgaggcttccttaaggcggtcaccaggtgtgcggcagcaggtggctgcggattgccggccagagccgcctgcgttgaccagggacccgcggggtcccagtgagctgagtgccctgggccacagcggctgtggtcaggagtggctgtggtcaggcacggctgatgggtcggggtggagaatggatcctgagcttgcaaaggcagaggtgctggagatcaggcacaagccgt

SEQ ID NO: 135970 - DNA, 1153 bp, Homo sapiens
ctcaaactcctgacctgtgatctgcccgcctcggcctcgcaaagtgctgggattacaggcgtgagccacctcacccggctatttttttatttttatttttcttatttgtatacatttgtggggtgtgtgtgcaactttggtcagtcaggtcagggcttttaggggatccatcacccaaccaacgttgttcccatttattcacaggctttgaaactgagccccgggcatgaatttagaaagtagcaggacagtttgatttcagggctgggaaagaaaaggacgtttggcttccatctccctgattttctagggccacccctaaatctagctgcctaggctctgcgtgggaggcctgtgggggtgctttctaccccaaatcaggtcctgtcacttggcagtgggatgtgtgctcagggtttggggtgtccagaggaagatgagcttgctgagacaggagctgtggggagccaggtgtgtagagctcagtctcctatcgggactgggggtgctgggggagggctctgggcaggtgctgcaaggagatattgacaagtggactttccctagcttgcccccaaatggagaccctccggccatctgtgagatatcgcccttggtgtcttactctggagaggtgagagctgcccatccctatctggggcttttctggtgtcaggtttggaataccatctggggagaggtggctgctcgggtggagacggcacagctctacctcggttaaccaatggggtcggtggtttaaatttgcagaagactttccaagatatgggttggggtggggtgaggcatccagaggcctttgcaggtcctgggagggcatggggatgagacagcccaggtctgagcccagtgtggggccagtcaggccttggtgggggccttgcggagggaggacaccggcctctgctacctccctgacctcggctgcccttgcccctttctctggtcaggtcagacctgtgcgtgacaggagggtcccctgctggcctagggtcttgagtgtggtcttgggtggccttgcagtgtgtgtctgctcctggccctggaagcctttctgtccccacccctccctgactccaggcagacctgggatcgcacctggggactgtggctcttggtgtggccagagggg

SEQ ID NO: 135971 - DNA, 1044 bp, Homo sapiens
ccagcaaggccacagaaagagcctgatgtccatgatccaggtggctctgagaagcttggcctggacacctgagcctgcggccggtactcctgccttctccccatctatccccaaggcctctgcctctcagcctcttccatggtcggtttaggctgctgagttttctgtgcttccccaagaaccagtgggatcaatgccggcggcctctgtgatggttgctgactaatccgggatttcatgagtcagaggcaccacccctcaccccagctgcctgctgcttctgacggatcttggtgctcaggctgcctggctctccgagtgaggacgcagcctccatatttggtgcactcaggcatggctgggacaagccagctgccccagggttcttcccctggtgattctcgcctgctttctcatctcaggggaggcagtggcacctccctctccctgctgacatgaagagagctatgatatgccactgctgccaactcatcctctgcccccacctcgaaacccacagtccccagtggagggccactactcatccccattggtttcccaggggaggggtgttgtctggaagggcaggttcagatgcagccttccagatttagaggcactgggaggacagtggctgagtggaggcgcccagacctgggcaggcagcaggctcaggcccacaccttgtgatttttgaaaccaaagcccagaagatgatgtttacttctctctccctggctctgcccttcttactgcaaaccatgctgtgccttagggcccttctcatagctgttcctcatggccatgactggaacagggatgcaacctctttctacacaagcacagttagttgggtgaagtctttttttttgtttgttttagacggagtttcactcttgttgcccaggctggagtgaagtggcgtgaccttggctcactgcaacctccaggccagcctcagcctccctagtagctgggactacaggcacccactaccacgcctggctaattctttgtatttttagtagagatggggtttgaccg

SEQ ID NO: 135972 - DNA, 1063 bp, Homo sapiens
tgcaaggtcctggcccaggcgcctgcccctcttggagcggaaaccggaggttccccgtggtgtatgctcccctcggtacagtgagaaatgagcccctcttgattggctcctggtctgttcgtggtggtctcaggccgaagggcattgataaccacatgcggactgtgcatcgcctgggcggtgcctgggctacatctgtgggagtcgcaggagtctttctccactgttgatgaaatgtgacagaaatgtttctgcttttttcttatcctcgtctcatctgcaccactgtattaacgacatctgtagtattgtcccagcaatgttcctactccctgctgagagggaacttctccccattcaaaataaatagagctggccgggcacggtggctcatcccgcgttccacccactacactccagcctaggtgtaacagaatgagaccctgtttccaaaaaaaaaaagaaatagagctgaacactggatcttccagaagaattccttattgtcctcacagtttgtgacagttgagacgttccgtgtgatatattcagtaagaaatgtcattctctgtacctcccttagaaatggaagcaactgtcgagattgcagcggaatatgattctcttcctccttgcctttctgcttttctgtggactcctcttctacatcaacttggctgaccattggaaaggtatcagaaacacgtgtacttgaaaacgatatctgtgttgagggttgattgggcagaagcaatcttgcattctaccttaaacagctccaggaggcatatatggcaacgaattggcaagaaatcaagataaagagaaaggtagagctgtatgtaaccacctggctagaacacagatgttaatttgatgctgtctgactactttctaggtctctggtgtaagtactgatatgtccagcctcccttatagagtaagtcagctggtgggcttgaacactcagcctaaataaccacacaaatttcgtagcactcattagcgtgtgtttggaaaagaccaggcagagttctggtgaggatgtggagaatctcttctc

SEQ ID NO: 135973 - DNA, 1014 bp, Homo sapiens
gcccccgtctgtgtggccatcctggcatcttggggccacctcactgtcactagtgctcctgtttggatgaaagattctctactcctccaccatagaggccccccgcctccggcctctgcagagggatttctcacgattctccaagctctggtctctgacctcaggccagccttgaccctggagcagtgctgtggtcttggctctcaggcacgggagctcaggactgaactgtgtgtttcctgccactcagcagcctgcacctcaggatgatggggccgctttgggtgcagggctgtgccttggccgtgggtatggagcgtgggggtgggaaacatggagccacaaatgtttgacggcagctgacacccttccttctcccccgaagctggaggggagcggtgatcgagcctgagcagggcaccgagctcccttcaagaagagcagaagtgcccaccaagcctcccctgccaccggccaggacacagggcacaccaggtgaggccacacctgcaccccttcctccccgggcgctcaggggctggtggctgatgggtgcaggcttcgtctcagccatggtgggtggcgcccccgccctggtgtgcaccttgcccttcagcatccccctgttgtctgagtcctcacaggctctgcaaccttggtgacaccatgtggctcttggcctgctgtccctgagcacatggctgcagaagaaggtgtgtctgagaggtttgtgtctgggccaggctgccccacgggatccctggagactgctgcccgtgctgtgtcccctgtctcggcctggccagtcccaggcagctctgggggccacttcattctcagcaccgtttgttgggggcctcccaggtgcgggccttcggccaagctcagtgcatgacctgaggcctctttcaacctcatgacaccctctgacacgataagccactcaccctcccgttctccagactgaaaagcagggctgaggacagccacccccagagtcgtttgcttgtctgt

SEQ ID NO: 135974 - DNA, 1452 bp, Homo sapiens
cattgcaaccttggcctcctggtttcaaacgtgggttttttggagacagagtctagtggtgtggcccaggctggagtgcagtggcacgatctcagttcactgcagccttcgcctcccgggttcaagctattctcatgcctcaccctccccagtagttgggaccacaggcatgcgccaccatactcagctaatttttgtgtttttagtagagatggggttttcccatgttgtccaggctggtctctaactcctgggctcaagcaatccacttgcctcagcctcccaaagtgctgggattacaggcatgagccaccacgcccagccaaatgtattttgaagatggatagataataggaaaacgttggagccatccatttgtctctgcatcctttactgttttatgtcatagaatttgaggaagccaggaagtgggtgtcgaagaagttacactttgaaaaggacgtggacgtcaacctgtttgagagcacgatccgcatcctgggggggctcctgagtgcctaccacctgtctggggacagcctcttcctgaggaaagctgtaagtgtcttggggtgtcctgcagggagatggtggactcgcattcaagcagttacccctttagtggacttgtggggacgtgactgtcttcctgtttcctcttcaaatgcactggagtctgtttctgagctcatattcgtgagctgatgaagccactttgatcaccactggccttgtagagacattcactcagtgcagagtgatgcccgtttccttgctgctgtgttgaccccagagagccttcagtgtctccactgaactgcatgaaagggtgtagacgaggcctctgggtgacctgaacgttggttctctactctgctcatataccaggaggattttggaaatcggctaatgcctgccttcagaacaccatccaagattccttactcggatgtgaacatcggtactggagttgcccacccgccacggtggacctccgacagcactgtggccgaggtgaccagcattcagctggagttccgggagctctcccgtctcacaggggataagaagtttcaggtaagggggcaggctttctggctggatgcgcctcccctggagctaccttttgctcatcacagcaggtactgtgtgtgtgtgtgtatgtgcatgtgtgttttcaggttttttactgtgataaaacacacaaaacgcaccaccttaaccatttccaggcgtggtcggtggtgttacattcacgctgttgcaggcgtgcaggtcggtggtgttacacacattcacactgttgcaggcgtgcaggtcggtggtgttacacacatttgggctgttgcaggcgtacaggtcagtggtgttacacacatgctgttgcaggagtacaggtcggtggtgttacacacattcatgctgttgcaggcgtgcaggttggtgctgtta

SEQ ID NO: 135975 - DNA, 1098 bp, Homo sapiens
gcccggtgtgtagcaggtcctcgggcggtgtgtgggggccgggttggagggcctggtccaggcagctccgctgttccatgccaagtgccctcgcgtggcctcccctcccagggtaccagggccgaggcagcgctgggctcccacgttggctgcccgtgcagctgcaggctgagggcagggcctgggatctggggctgaagagaccctctgattccaggaccacctggtgtgcttcctgccagggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaaggtgggcctgggcctgggtcagggtccatcaggaggagggtgctggcagggctggccttgccctgagctctgctccgcccacagccagcagacaggcacaacctgctgcggccagagaccgtggagagcctgttctacctgtaccgcgtcacaggggaccgcaaataccaggactggggctgggagattctgcagagcttcagccgattcacacgggtgagcacctgtcctcgccccgcgtggtcacggccaccgggccacaggcacggctgggctgtggggctcaggctggctccgctcttggtggtggctgtgacctggatccgggaggggcgggcttgccgcagcctcggggtggccacactgcagcttgggggccctggcatccccatccccactgagcttcatggttgtgggacccagagtacttggaggggctgggcacccctcattttcatttctcagggcctgtctagggagggtctctgctgtgggcccagcatccccccagtttaggaggcacacgcacccatgactggggcaccatccccactgtggaccaggccctgttttaggtcacgccctccacgccagagtgtcacttcctggctctgctgtgatcttggcctgaggcccccgctgcctccgctcccaccgtctgccctgtgccctgtgccctgtgcg

SEQ ID NO: 135976 - DNA, 1027 bp, Homo sapiens
cagggggcctcacagttgccgcacagggcacagggcacagggcagacggtgggagcggaggcagcgggggcctcaggccaagatcacagcagagccaggaagtgacactctggcgtggagggcgtgacctaaaacagggcctggtccacagtggggatggtgccccagtcatgggtgcgtgtgcctcctaaactggggggatgctgggcccacagcagagaccctccctagacaggccctgagaaatgaaaatgaggggtgcccagcccctccaagtactctgggtcccacaaccatgaagctcagtggggatggggatgccagggcccccaagctgcagtgtggccaccccgaggctgcggcaagcccgcccctcccggatccaggtcacagccaccaccaagagcggagccagcctgagccccacagcccagccgtgcctgtggcccggtggccgtgaccacgcggggcgaggacaggtgctcacccgtgtgaatcggctgaagctctgcagaatctcccagccccagtcctggtatttgcggtcccctgtgacgcggtacaggtagaacaggctctccacggtctctggccgcagcaggttgtgcctgtctgctggctgtgggcggagcagagctcagggcaaggccagccctgccagcaccctcctcctgatggaccctgacccaggcccaggcccaccttgacctccacgtcccgacggcccggctgggggtaaaggttgaagtgcacgatctcgggactcagccccgtctccatctgccggttcatctggtaacaagtctccatgagctcctgggccagctccatgtggctggcgggcaggccgtggtagacgcccagagccagcgtccctggcaggaagcacaccaggtggtcctggaatcagagggtctcttcagccccagatcccaggccctgccctcagcctgcagctgcacgggcagccaacgtgggagcccagcgctgcctcggccctggtaccctgggaggggaggccacgcga

SEQ ID NO: 135977 - DNA, 1042 bp, Homo sapiens
ctatctggacccctgcctagggtggatggctgctggtgtggggacttcgggtgggcagaggcaccttgctgggtctgtggcattttccaagggcccacgtagcaccggcaaccgccaagtggcccaggctctgaactggctctgggctcctcctcgtctctgctttaatcaggacaccgtgaggacaagtgaggccgtcagtcttggtgtgatgcggggtgggctgggccgctggagcctccgcctgcttcctccagaagacacgaatcatgactcacgattgctgaagcctgagcaggtctctgtgggccgaccagaggggggcttcgaggtggtccctggtactggggtgaccgagtggacagcccagggtgcagctctgcccgggctcgtgaagcctcagatgtccccaatccaagggtctggaggggctgccgtgactccagaggcctgaggctccagggctggctctggtgtttacaagctggactcagggatcctcctggccgccccgcagggggcttggagggctggacggcaagtccgtctagctcacgggcccctccagtggaatgggtcttttcggtggagataaaagttgatttgctctaaccgcgatgtcgcctgtgtctttagggatctccatgactggaaagtctgggcggacgttggggagaaggtattcttcaagtcacgtctcagaattcggtttgctgagactggactctagctgtcccctgctggtgggcagggagaggccacggggaagctccgtgtccctggccccacggggcagatgcttggcgggaggcatccttgcgcctgcgtttcacacagggcctgtttccctgcagggctggcactgaggcgcacagctgagggatacacgggccctcaggtcaggcagctcccagcagcctggcatggctatggccccgagccctgggctgtggtggcagagttgtcctcatcatcactctactgctgtccctatcccagggctgaccctgggccttggctgggttccccccgaccctgaacc

SEQ ID NO: 135978 - DNA, 1034 bp, Homo sapiens
ccaccctgccccgtggagagcgggggggccctcaacagtcaggcccggggctggcagcacagacaccgccgacctccaagcaggtagcctggagggccttcctcactgggacctacagatcccagagccccagatcccctgcaggaccattccgaggggggacaggttggtggccggagcccgcggtgtgtctgtgtgtggccgctgggccccagcgcctctcctccccagggctggtctacaacgcctcgggctccgagcactgctacgacatctaccggctctaccacagctgtgctgaccccactggctgcggcaccggccccgacgccagggcctgggactaccaggtgtgggggtgtgggtggcctggaaccactcgggggcaagggtgggcgtgggctggcctgactcaggctggggcacctgcaggcctgcaccgagatcaacctgaccttcgccagcaacaatgtgaccgatatgttcccggacctgcccttcactgacgagctccgccagcggtactgcctggacacctggggcgtgtggccccggcccgactggctgctgaccagcttctgggggggtggtaaggctgagggggggtgggccagcgtcctgctttctgccccgagctctgcaccccctgcccatggctcacagcccccgtgaggggcccacatcacaactttctctgccccttgcagatctcagagccgccagcaacatcatcttctccaacgggaacctggacccctgggcagggggcggggtgagtcctggcctgggccctatgaccccgttagtttgtttgttttttttttgagacagggtctttctctggcgcccaggctggaatacagtggcgagatcagggttcactgcagccttgacctctgaggctcaagcctcccagtaactgggactacaggcgctcaccaacatgcccagctaatttaaaaaaatatttttttgtagagacacagtctcaccatatcgcccaggctggtctcgaactcttgggctcaaacgat

SEQ ID NO: 135979 - DNA, 1026 bp, Homo sapiens
gcgcccgaaacacgtggggcctggagggaggagcgcgccctggcggccccgtgaccccgcccacgtgacgggcgcccgcggaaggcgacatgggctccgctccctgggccccggtcctgctgctggcgctcgggctgcgcggcctccaggcggggggtgagtggcggcgccccccggcccattccccggtcccggccccgcctctgaggttcgcgtccccccacagcccgcagggccccggaccccggcttccaggagcgcttcttccagcagcgtctggaccacttcaacttcgagcgcttcggcaacaagaccttccctcagcgcttcctggtgtcgggtgagaccccggccccggcccggccgcccccgccgtcccgccgccccccggcaccctcgcctcatccgccctccccacagacaggttctgggtccggggcgaggggcccatcttcttctacactgggaacgagggcgacgtgtgggccttcgccaacaactcggccttcgtcgcggagctggcggccgagcggggggctctactggtcttcgcggagcacgtgggtgccgggcggggtcgcgggcggggtcgcggggcacgtgggtgccgggcggggtcgcgggcgggggtcgcggggcacgcgggtgccgggcggggtcgcgggcgggggtcgcggggcacgcgggtgccgggcggggtcgcgggcgggggtcgcggggcacgcgggtgccgggcggggtcgcggggccgggctcaatggcacgttcccccagcgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaaggtgggcgcctcccccggcctccgcaccccctccctcccctgccccgacccagcgcccccagcccttctccccactcccctctgactcc

SEQ ID NO: 135980 - DNA, 1019 bp, Homo sapiens
tttttgaggcaggctctcgctctgttggagtgcagtggcagaatcctgtctccctgcagcctcggacacctgggcttaggtcttctggcttagtgtccctatgtgctgggattgcaggtgcgcaggccggccttgcgctcgcagctcctgctgctcccaagtaacgttgggtttatttgtttttaaggagtctgacgggcctgtgtttagtacatagcccatcaccactgagtgtagaggcagggtcggtggtgctggcctagatggggccgggactggaatgagtggtgggaggtgcgcgcggggtgtccacactgtgggccacagcagcactcacatcggcaggacgcgggaggacacagtgcggcagattgtggctgggctgacgggggactcggacgggacaggggacctggctgttgagctgtccaagaccgacccggcgagcctggagacaggccaggacagtgaggatgactcaggcgagccagaggactgggtcccggaccctgtggatgccgatccaggttagcttgccccacatggtccctttcaccagtgtggggggcgcttcagccaggccgtccgctctggactcatcccttgtcacagagcttggctgtgtcaggtgtcgctagtgtctcagaggcttgagggtgtcaaaggtcagggcagtgctccgccacctgccagcctgggcaggccggtgatgggctgttttcctctgtggctggtcactctggccgtgggggatgccctgcctcccaccgcttgtgagctgtggggtgtccctgccccgccactgcacctggcagaggagtgaagatgtgggtgacccctgagctctgtactgatttgggcctcaaagtcccgttagggtgccagctcctgctcagagcccatctgtgcctggccctcgtctgcgagggctctgagggctatggggcccaggcctggcccctgccctggcacagatggtaagtcttcaacacatctttagtctctctcagaggaaaacc

SEQ ID NO: 135981 - DNA, 1015 bp, Homo sapiens
cagtggggacctgtagaccacctaccggcatggccagctgtctactcgggtgttgcccctgggaggctgtggtcccgggcactgcatgactgctggcttctgccctggctgtaggcgtcaacacgtgtgacatcatcaccctctatatctctgccatcaaggcgctgcgcgtgctggacccttccatggtcatcctggaggtggcctgtgagcctatccgccgctacctgaggtgagggctgcagctggcccaggagccactgggaccctgggcatcctgctgagctcctcgtggtcctggggggcagccggagggtgtgttcggccgtcaggacacaaggtctcccccggctgggctgagtgcacgggatcaggcccgaggctctttcctttcctcttgcccgtgccgggcacctgtccttgtcacacggtgtcaccgtgccctctgtgtgcagctgccagaggcccaccacagcccttcctcagcctccccatctccagcacagagagaagctcttccacttggcctcgccttggtgctgaccagtccccaaggccgaccaggcaaggggagtgggctctgctgtcctggcctttcccacggcaaggaacagacactcctggggctgttcggtggagaatgtgttgggatgaggaccttgacatggctgcctgggaattcctcaggggtcgcagaggccctggcccggggctggcaggcacagtggcccccaggagccgagcagcaggagccggtggagtctggcccctacctggactcctttggtgctttgtggctgtaactggcctggcttctgagccagttctttgttttttcttttttttttgagatggagtctcactctttcgcccaggctggagtgcagtggcacgatctctgctcactgcaagctccgcctcccgggttcacgccattctcctgcctcagcctcccgagtaactgagactacaggccgccaccaagcctggctaactttttgtatttttaatagag

SEQ ID NO: 135982 - DNA, 1601 bp, Homo sapiens
cgaggaagccagagtcaggcaccacccccgagcgcccggcgcggggcctgcgagccagcgagggctcgggccacggacacccggcctccggcacggagggctctgctcagccgcgcgatgcccgcagcgaggcgggtccaggggcaccccgctgcgagccgggaacccggccctgcggccctcccgacctccccgtcccggctgcgccgctcacacttgaccagctcgttgttgtagttctgcagcgccgcgccctgctgggtcatggtcaacgccgcccggggccccaccaccccaaccgccgcggaagcagcgctgtccgcgcctgcgcacgactcccccacggcgcgccgaactagcgcgtcatcgctgagcgccttgtgcgcgtcatggctgcgcgtgcagacgtgcgtcatcgccgcgcgccgcgccgagcgaatctcggagtcggtgggtgcagatggcggcggcagttgtggtggcggagggggacagcgactcccggcccggacaggagttgttagtggcctggaacaccgtgagcaccggcctggtgccgccggctgcgctggggctggtgaggcctgggaagagaggggcggccccgcgcggagtttccgggaccgtacgcgctttggggccgctaccctcgggttcatacggctctgtccatcatccgcctctgtcctgtcctgccattttccaccacctttccgtttcgtttcgttcagctccgctgacagcccttccatagcttcggcccaacgtccgggcagcacggacagggggcagcggagtttttgcagcctccccctcagcttcttcccttccccgcctctccccacctctatgttgtgttcccctcgcctcacggttttctgcaccccaggtgtcttcccggaccagcggtgcagtcccgccaaaggaagaggagctccgggcggcggtggaggttctgaggggccacgggctacactcggtcctggaggagtggttcgtggaggtgctgcagaacgatctgcaggccaacatctcccctgagttctggaatgccatctcccaatgcgagaactctgcggatgagccccagtgccttttgctactccttgacgcttttggcctgctggagagccgcctggatccctacctgcgtagcctagagctgctggagaaatggactcgcctgggcttgctgatgggcactggtgctcaggggctgcgagaagaagtccacactatgttgcgcggagtcttgttctttagcacccccagaaccttccaagagatgatccagcgtctgtatgggtgcttcttgagagtctatatgcagagtaagaggaagggggaagggggcacagacccggaactggaaggggagctggacagccggtatgcccgtcgccggtactaccggctcctgcagagcccgctgtgtgcagggtgcagcagtgacaagcaacagtgctggtgtcgccaggctctggagcagttccatcagctcagccaggtcttgtgagtagtctgtcccgatggccatgcccttgctccttctggttccccgctgctcccctgggtccagctggcctcagcagaaagctggt

SEQ ID NO: 135983 - DNA, 1082 bp, Homo sapiens
gcctccctggcagggcaggagtgtgggtgccacagagacaagccccttgcagagctgacctggagcccaccatccccatagcctgtgtgagcatgaagcgaggacccccgggtgggctgtgccctgggcttgtcactgatgccagtggaggctggcacctgcccctctcggcacctgagacagtgagggaaggtagctgctgccgtgaagaacaaagatgctctgagcacacacttgctggggctgagctgaggggcacacggaggcaggccctgcccgtggtctggtcagctgtccctgccgccgctacttttctggtctggggctgtagccttggtcaggttcccagcttccctcttgagaacgctgagcaaagtctgggagctctccaggatctggggccagagaagtgagaaggttgttaatgttcacctgttggtaaggtcctaagccccagctgtcctcacactcaggtgctgggacctggctgggggtgctgtagccaagggatcctgtgtgggggaaggcggaagcccaaggggactggcagacggggtggcagggccctcttccctccggaatctgacccaaaacacttcctctccaccctcaaagccaggctgggttagcactggcccgtgctgggtgctctgcccaagacctggctcttcacactgagcagaaataaccacatggctagcgagaaccggataaagaccaggacccaggatgccccaggccccacagacagccccacagtcactcccacagcagcctgggttcctcaatgggcctggccacgctgcccctgcccgaaatgccagcgaggcacagactgcccacagccgggagccccagccggtcctgacgccttgccgtggcaacacccctgccgtgcctatcccctgatgctcggcctggcctcccgagctccaccttgaggtaggcggcctccgtctccgcgatggtccggtcgaactcgttgcgagaggcaatcttgcgtgccaggttctcgttgacgcgggccagcttctctgtcagctgcctcacctcattctgcagccgctgcttctcgtcctcct

SEQ ID NO: 135984 - DNA, 1079 bp, Homo sapiens
tgaggacagctggggcttaggaccttaccaacaggtgaacattaacaaccttctcacttctctggccccagatcctggagagctcccagactttgctcagcgttctcaagagggaagctgggaacctgaccaaggctacagccccagaccagaaaagtagcggcggcagggacagctgaccagaccacgggcagggcctgcctccgtgtgcccctcagctcagccccagcaagtgtgtgctcagagcatctttgttcttcacggcagcagctaccttccctcactgtctcaggtgccgagaggggcaggtgccagcctccactggcatcagtgacaagcccagggcacagcccacccgggggtcctcgcttcatgctcacacaggctatggggatggtgggctccaggtcagctctgcaaggggcttgtctctgtggcacccacactcctgccctgccagggaggctctggttgtctgagcaccatgggggccccctcaccttgtccctcctcagccagcagaggcccagggcaagggacaggaggacaggggttctccttcaccacagaacccaaacctcaggtctcacccctgtggcctgtgattatgaataaagattatctttgtaaagatccgtgccagcctgctgcttgcccgtatcaacagcatggggctgccagacacctgcagagccagagcctgaggctcccccttgggagaggagggaggagggtctggagtggcctccctgtgactgccccactagcctcagggacaccgctgagggtgcccaccctccccaggccagccccaccctgagccctccccagcagggccgccggtcctcttcccctgactggcccacggctcaccctcctctcaggagctctgcttgctcgtcctgttctctgccacaccctggtggccagcataggacccagcccagagagacagctggggatgccaagcatatccagcagctgcctcagattcaggtccctctcagcaaggactggggggagttcacaccccccacccccgtcggttcctcagttgcaagttttgcttggcctgatga

SEQ ID NO: 135985 - DNA, 1078 bp, Homo sapiens
cgagagcctgggcccgctgcgcgagaacccgttcatgctgctggaggccgagcggcggcgcggcgggggcgcggcgggggcgcggctgctggagcggtaccgccgcgtgcctggcgtgcgcgccctccgcgccgacagcgtcctcatcatcgagacggtgcccggcttcccgcccgcgccgcccgccccgggggccgcgcagatccgcgccgccgaggtgctggtgtacggggcgccgcccggccgcgtcagccgcctactggagaggttcgacccgcccgccgcgccgcgccgccgcgggagccccgagcgcgcccgccccccgccgccgccgccgccgcccgcgccgccccggcccccgcccgcggcccccagcccgcccgccgcgcccgggccccgcggtggcggggcgagccccggggcccggcgcagcgacttcctccagaagaccggcagcaactccttcaccgtccacccccggggtctgcaccgcggcgcgggcgcccgcctgctctccaacgggcactcggcccctgagccccgggccggccctgccaaccgcctcgcgggctccccgcctgggtcgggacagtggaagccaaaggtggagtcgggggatccctccctccacccgccccccagccccgggaccccgagtgccactccagcctcaccccctgccagtgccactcctagccagcgccagtgcgtctccgcagccaccagcaccaacgactccttcgagatacggccggcccccaagccagttatggagaccatccccttgggggacctccaggcccgggcgctggccagcctccgcgcaaactctcgaaattctttcatggtcatccccaagagcaaggcctccggggctcctcctcctgaggggaggcagtccgtggagctgccaaagggagacctgggcccggcctccccgagccaggagctcggatcccagccggtgcctggaggggatggtgcgcctgccctcgggaagagccccctggaggtcgaggcacagtgggcagtcgaggagggggcctgtcccaggacagccaccgccctcgctgaccgg

SEQ ID NO: 135986 - DNA, 1047 bp, Homo sapiens
gcgcgggcgagggccacggggagaggagacgcagccccgcgggtggcacgctcggccgggccccggcccgcgctcaacgggcgcgatgctcttctcgctccgggagctggtgcagtggctaggcttcgccaccttcgagatcttcgtgcacctgctggccctgttggtgttctctgtgctgctggcactgcgtgtggatggcctggtcccgggcctctcctggtggaacgtgttcgtgcctttcttcgccgctgacgggctcagcacctacttcaccaccatcgtgtccgtgcgcctcttccaggatggagagaagcggctggcggtgctccgccttttctgggtacttacggtcctgagtctcaagttcgtcttcgagatgctgttgtgccagaagctggcggagcagactcgggagctctggttcggcctcattacgtccccgctcttcattctcctgcagctgctcatgatccgcgcctgtcgggtcaactagcctcaccgaggtgccggagagggagcgctggacaactagaatgttgacctcgagccgaggccctacttgcagcgcaccggaggagaggctctctagtctgaaggcaccgccggcttgcgccgagctgagtgccgggtttccctattccaatcctgtttgaaatggtttcttcagcagggcttaaaagagcagccttcatcctgaaaatgtatttccttttgtttaatgctttgagtagataatcctgaattgaggtcatgaggaggccccccaggccagacagtcctgaacccctctgacacttggaaactgaatataagtaaaatgtccaggtggactctgagtatttcctgtggatcctgggaaagtactgttgcacaaaggctgcaaagctggactcaggaatgtcctccaaccagcagcgctgacctaagagctccctgtgccgtctatccagaccagacttcggtagatgcctttgttagatctatcacatgtaaacgagcttgtatctccttccctgtgccacgagagagattggctttttattc

SEQ ID NO: 135987 - DNA, 1050 bp, Homo sapiens
tcggccctgatgcgccggcaatcccccggccccgacccgggactcaaccctggccgcccgtgaacgcccgcctcgatcggacgccatgcccccacagggcgcgtccctagtgcgtcacttccggtcgacggcggaaggcggaaggcggagcggtccctgcaacccggccggcgggaactgccttctagtttttagtctcagaccagaccaccgggcgcaccccgatgccgagcccgcagcttctggtgctcttcggcagccagacaggcacggctcaggatgtgtcggagagactgggtcgcgaggcccggcgccggcggcttggctgccgggtgcaggccctggactcctacccggtggtgagggctcgctagggcctcggcgtgggggacgagcaggcctggcgtgcccgcctcgcggggtcatcgacccaaaaggcgtcgcattttctctgagagcgggtctttcccttatggcggatttagggaaggaggtttgggaaggggagttcagtttagcacctggaggaggttggaacctgaaagagaagacggtctggctgctcacataaatccctctgccctgtcagcctgagtaaaggagaagggggtcaagttttgggaaggacgcccggtccttacagccggaggtcttacgtgtgtgtgtctttttgttgaggtgaatctgattaacgagcccctggtgatatttgtttgtgcaactacaggccaaggagacccccctgacaacatgaaggtaaggctggcctgatgtggctcctcagatccctgccctcgaccctcaccccgttttcattgcctggcgtctaggtgcagtaaatagctctcctttatctcatgcaccttcagaggtggatttgagagaacgtccgtgagtggggctgggggctccggttgccctctctaataaactcgtcgtagccaccaaatagccttattatccgttttaacctttcttatttttccagggctatctatatgtgcatctagtctgggtcttgtgtgtatttctagactgtatgaccctcag

SEQ ID NO: 135988 - DNA, 1035 bp, Homo sapiens
gcacagtctggtgctggggatccagctgtgaacccagcagccatatttccatcctggcagagttcacactgtagcagaagcagctaacgggcaatgacagtgccagcaaacacctgctgctggggaaagtagcatatgtcacaggagcactgataaggggcatcgagccttatctcacccaaccttggggcccaggcagaggtttctggaagaaaagagtgtaagctgagtcacggaaggatgcgtgagggctagtcaggcaccgaggaagaaggagcagtcagcgcagaggaaaaagatgatttggtttgtgtgaaaagtggaaagcagctcagggtggccaagctgaggagtacactggggcaagaggggaggagaagagaggcaggaagccaggcccagtccaaagagcctgagtaaccacagcaaggcagatgggcttgaaatgaagggttgtcggaactgtaggggtgacacagtcatgttcctaagctagcaaaaccgcactggtctgcaggacagcaggaataatgccatgagatgcacaggacaggcagcagatgctaccgatctgagctgaagtggtggcagaagatagaagtggacacattgcagtggtgtcaggaagagagagtccccgggacatggaacggacccaataggtcaagcagaatcgagacagggatgtgggctctggaaccaagatggatggtggttccatccacagaaatcagagaacacggtgggagtagggggctgtgcaggaagggaacctggagacattgaagtggagaagtgcagtaggactagcgctccaaggaagatcctggggcggagataggtgttgaggtagccacaatacagaagtgtgagaagaggaagctcctctctccccacaggacaggctgcccagaacgttagagcccaggagggcaggagagtgaccaagcagctagaagagagggtgcagcaccccaaggagaggactgggggagtgagtgttccaggaagggctctggcatgtaaagctgcaca

SEQ ID NO: 135989 - DNA, 1962 bp, Homo sapiens
acggctactgcagcttgggggcagcgccctcctgcccgtgtgcctgggcgatgaccagcatgagctggggtgagtctgcgggcgtggtacccgcctccacagtctggtctggccacacgcagggtccgctcaggccagcgcacgtgctccctcccaggcccgacgctgctgtggacccctggctgcgagacttgtgggacagggttctggggctgtacccgccgcctccgggcctcactgagatccctcccggagtcccgtgagtgtgggccccgggtcacccacaggcgcagcagacccaacctggcctggggacctcgccctgggtccctcccgtgtgggtgggcggcccctggggagtgggtcctggtctgaccagcgtgccctcccacagcctgccctccaagttcaccctgctgttcctccaagaggcacccagcacgggctctgaggggcagcgggtagctcaccccggctctcaggagcccccgtcagagtcgaagcccttcctagcacccatgatctccaaccagagagtcaccggcccctcccacttccaggacgttcggctgattgagtttgacatcttgggctctggcatcaggtggggactgctggggaccgaggagggcaaggtgaggtgggccgtgggtctggggttcggaggaggctgggccgggctgcaggggatgacttctatccggggccccgacatcctccctgcggcgtccccacagccctggtggcttcttccacacagctttgctgctggtgatgtggtgctgattcagccctccaactcggctgcccatgtccagcggttctgccaggtgctgggcctggaccctgaccagctcttcatgctgcagccgcgggagccaggtgagcccagcctcggccaccctgactctctgccctctcccgtgccctgggcccccaccccaagggctccgccgcagcccacggaggcctcccactcaccctgcagatgtctcctcccccacgaggctgccccagccctgctccatgcggcacctcgtgtcccactacctggacatcgccagcgtgcctcgccgctccttcttcgaactcctggcctgtctatccctccatgagctggagcgggagaagctgctggagttcagttctgcccaaggccaggaggagctctttgaatactgcaaccggccccgcaggaccatcctggaggtgagatgggagggcggcaggcccagcccctgagctacagccacgctgcagccaccctgagactctctttgcctaggtgctctgtgacttcccgcacacagctgccgccatccctcccgactacctgttggacctcatccccgttatccggccgagggccttctccatcgcctcctcgctgctggtgaggggcctggtggttggagcccaggaccggccctgggaaagctgggaccggggctgtggggttttgtaagcaggggctgccctctgaccaggtgacgttcccccagtcggactgcctctgcgggaggtaggtggggcccacggcccaggcacaggtgagggcagccttgttccaccacccccaccccgccgtcctccccagactcacccctcacggctgcagatcctcgtggctgtagtgcagttccagactcgcctcaaggagccccgccggggcctctgctcctcctggctggcatccctggaccctgggcaaggtgacccctgctcccagggtgggggccgtgggcccatatccccttctctcccatgctcatgcaaatgctgggctagggccccagcagactcagcacaggtctttgatcctcttcatgccacctccttcctgcaataggacctgtccgggtgcccctctgggtgcggcctgggagtctggccttcccagagacaccagacacacctgtgatcatggtggggcctggcactggggtagcccccttccgagca

SEQ ID NO: 135990 - DNA, 1050 bp, Homo sapiens
ctccgggcagggttgttgccagggctccccagctgaacctcaaggacctgtggccaagagcaccctgtatttccctaggaaacttcttgttttttggctgccgctggcgggaccaagacttctactgggaggctgagtggcaggagctggagaagcgggactgtctgaccctcatccctgccttctcccgggaacaggtgtgtatgctcaggggctgggaaaggaggggagggagctccggctcagcccccagccctgttctctgccctacaggagcagaaagtatatgtgcagcaccggctccgggagctggggtcgcttgtgtgggaactgctggaccgccagggtgcatacttctacctggcagggtgagctggcctgcgtgcagcaggagtgggcccagcccctgagtgccaggcctcattgcgccttctgcgacctgcccctctagcaacgccaagtccatgccagcggacgtctcggaagccctgatgtccatcttccaggaggagggtggactctgcagcccggacgcagccgcgtatctagccaggctccagcagacacggcgcttccagacagagacgtgggcctgaggcccgcggctgcccgtgccccctctgacagccatcctcctgggagcccaggaaggcatccacgagggagctcctggccagcagccgtcatcctctcggaccagccagctggtcctctgggaacagccagctcccgagcacagccgcactcctgttgaccctggatcccaccctttgagcctgaccccactgcagcctctgcccagccagccctgcgctcccccaccctgacagtgagctgtgtcctcgtccccccacccccttcccagtcaaggtggtggcctgggccgctccacctcaccggtgcagtgacccaggacggcatcagcagcccagtgagcaccaggggtggcatagggcacccatgaggctgcgctgcactcctctgccctggggccacctcggctgctgcagcctgcccagcagcacattccagtcactgcccccgcactcc

SEQ ID NO: 135991 - DNA, 1029 bp, Homo sapiens
ggccgccgccggagccgccggagccccccgagctgccgggccgaggcgcgggcgccgcgtccgggcctgcctttgagacaacctctgcggcggcggcgcgcggccgggacgccaggctggggcaggtgagcgcagggggcgggggccgggggcggactcagcgcccctccccacgcgacgggggtcggccctcgggaaggtgcgtctggccttggaggcggggaccggggagggggttgggttctgaggcccgcggaggtcgggatcccacggctgaggtcagggtcagaggtcgggcgcccggtcctttgtgcagggcgagggctagggtgggggtggccggggcactgccctcatgccgtctctcacctgcagctcaggcctggcccaggcctcgcctctgctcctgccgcggagcctgccgccccggtcctcctgcagccagcgcttcggctagctgccttccctgggcgccctgtcctggagccatggggcccacccagcccctgcctgccccgatgtcccggcccgcggcctgctgacctcggctgcagggggagccccccccgcgccccctcgccagcctcagcagccagagaccctgggtgagaccctgggccagacccccagcccagggcagcctcccacccctccctgcccccgcctgcctccccctcccccaccccttcctcctcctcccaggactggaccagagaagccactgtggccactggggggggccctgcacccccaactctcgccggctgtccctaggagtccacgggccgtccggggccccccccaggcctggcgggaccaggatgctgccctgtcacctgccccccagccccacacaacgcccccacccacccgaacatccagtctgactggagacagccggatgccctctgaccccgggcccgaggcgggcagtggctggccgggcctcctcatgtcctgcctgaagggtccccatgtcatcctcaagatggaggccatgaagattgtccaccctgaaaagttccctga

SEQ ID NO: 135992 - DNA, 2116 bp, Homo sapiens
tggcggcagcagcggccgggcggcgcccccgcattgcggccgccgggccccctccgcggggaattggccgagccgggcgaccgaagcccccaggaacccggcggccagggcgcgcggggcgggggaggggcggggagggccgggctgccgcgcccgtccggggcggggctgcctccctgcgcaccggccgcggtgactcagccccggcccgcccgggcccgcccgcgtcccttgtagttttgggaggtgatcagcgatgagcacggcatcgaccccacgggcacctaccacggggacagcgacctgcagctggaacgcatcaacgtgtactacaatgaggccaccggtgaggccccggccccttccccgaccgccctccggggaccccgcggcccctgccttggctgacgccctcccgtccccgcaggcggcaagtacgtgccccgcgccgtgctcgtggatctggagcccggcaccatggactccgtgcgctcggggcccttcgggcagatcttccggccggacaacttcgttttcggtgagccgtggctggggactgggcggcggctcaaaggtcaaggggctgctccaagggcaccgccgtgggaactgcgcagccggggcccctggacgccctcctcttctctgagccactcaatcccctctactaaatcggctttgggagcaaggtccagctgtctgccgaggcgaggagccgccacacacgtaatctccctgcagggagctgagctggggcagtggctgttcctctgtccttgggaattggcagtggcccccccggggaggggtttgttaagctgtcaggtttggcccctgacttaattcgtagcagggcaggctgccgtcttttggctttgaagggtccgtttgctctacctccagggtgaattctgtggtcagctcacaccatgtcactcggcttttttcgcatggcggtgaccagtagtgctgtctacctggctgacaaatgattagctgtgttctctcacaggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactct

SEQ ID NO: 135993 - DNA, 1870 bp, Homo sapiens
gggtaggattgtctgccatcctccctaccccttttggaaggggggtcactggacccacctaagtcccagacacaggccgagccccaaggttgggtacctggaacaggacaggcctgccttcaacaagcaagttccccaccaagcagatacccagggcccagggcagccccacacttctctgaagcctgggtgtccagcccatgctggtcctgggcacataagcccagctcagctgcagcctggctccccgcagccatgcaggacaactacgccctgacattcggcaacagcacccggagggcctactggaaggaatgggcaaagcgaaaccacacactatgaaaatgctttaatggtggtgtctgtacagcatggatgtggacagggaaaacagcaagtgcacacagtgggacaggccacaggacaggctgggagtgaataaagagttcacactgcttccctgctttccccagtgactgaaggctctaggccacctcctcctcagcctcctcctcgaactcgccctcctcctcggctgtggcatcctggtactgctggtactcggacaccaggtcattcatgttgctctcggcctcggtgaactccatctcgtccatgccctcgcccgtgtaccagtgcaggaaggccttgcgccggaacatggccgtgaactgctcggagatgcgcttgaacagctcctggatggccgtgctgttgccaatgaaggtggcggacatttttagcccccgaggtgggatgtcacagacagccgttttcacattgttggggatccactcaacaaaatagctgctgtttttgttttggacattaagcatttgctcatccacctccttcatggacatgcggcccctgaacacggcggcaaccgtcaggtagcggccatggcgggggtcgcaggcagccatcatgttcttggcatcaaacatctgctgggtgagctcgggcacggtcagcgcccggtactgctggctgccccggctggtcagtggggcaaagccgggcatgaagaagtgcagccggggaaacgggaccatgttcacagccagcttccgcaggtcagcattgagctggcctgggaagcgcaggcaggtggtgaccccactcatggtagcagacaccaggtggttcaggtcaccataggtgggcgtggtcagctttagggttctgaagcaaatgtcgtagagagcttcgttatcaatgcagtaggtctcgtctgtgttttctacgagctggtggactgagagggtggcgttgtagggctccaccactgtgtctgacactttgggcgaaggcaccacactaaacgtgttcatgatcctgtctgggtactcctcccggatcttgctgatgaggagggtacccatcccagacccagtccccccacccagggagtgggtcagctggaaaccctgcaggcagtcacagctctcagcctcctttctcacaacatccagcaccgagtccaccagctccgcgccttctgtgtagtgccccttggcccagttgttcccagcaccactctgacctgtgagagaacacagctaatcatttgtcagccaggtagacagcactactggtcaccgccatgcgaaaaaagccgagtgacatggtgtgagctgaccacagaattcaccctggaggtagagcaaacggacccttcaaagccaaaagacggcagcctgccctgctacgaattaagtcaggggccaaacctgacagcttaacaaacccctccccgggggggccactgccaattcccaaggacagaggaacagccactgccccagctcagctccctgcagggagattacgtgtgtggcggctcctcgcctcggcagacagctggacc

SEQ ID NO: 135994 - DNA, 1043 bp, Homo sapiens
ccctccgggtgctgttgccgaatgtcagggcgtagttgtcctgcatggctgcggggagccaggctgcagctgagctgggcttatgtgcccaggaccagcatgggctggacacccaggcttcagagaagtgtggggctgccctgggccctgggtatctgcttggtggggaacttgcttgttgaaggcaggcctgtcctgttccaggtacccaaccttggggctcggcctgtgtctgggacttaggtgggtccagtgaccccccttccaaaaggggtagggaggatggcagacaatcctaccccaaccaaggtgggaccctggtaatggtcagacaggtggtcctgaaccagcaatgaagggtgagcaggtagagccgtccctccccacattggccggggtgtgtccatgtgaccctgcccactctactcaccggggatgaaccccatgtagaaggggatcaggccttggctgctgtagatgtggttgctgggccagtgtgttccaggcagcttctcgcccaggtcacagtgggggtttctaaacaggaactggggagacaggaaggtgctaacaagctccctccccggcaggcaaacagatagtcaagttgtcccagtgggggcctggccggagggccggcactccgtgggaaagctgctaatgctcccagccttctgcatccccctacccccgactccaaaacttgagtgcagggatccaagcaagactcaggagagaggggttggggcggcacctccggggacaggagagagccaggcagagccccctcctcaggcttctcagggaacctggccttcaaggcaccctccagggaagctgccaggcaggagaggaagtgtgtgtgtgagctgggagcaggccctggatggcgctttcctacctggctcttgtcgaattcgtccatggcttgcatgacgccgtctcggtaattcaaccccattacccaggtgaaacggggaatgaagccagcatagcctgggggtaggcagatgtacgggctaccccaagcccccttagccttc

SEQ ID NO: 135995 - DNA, 1049 bp, Homo sapiens
ggaagttccggtggccgcctagctccgggagcttcctgtgctgcctgcccaagtgctgtccatggtgagctctgtgctgacttctcccacatgagccgcgtggagaccgaaccttagcactggagttagggtgtggggcccctcctgggaaagagctgttggtatttagcatgtctgtctgacatgctggggccggggaaccagtcataggtgccctgtggggtggagcttagctcgaggtggtctctgcggggctgaggcctcttggcttgtcttgaaggagacccagggacacaggtgccactcacaggcagcctgtggtgtcatgtaggttccggagaaaaaactgaagctggttatggctgacaaggagctgtatcgagcctgcgccgtggaggtgaagcggcagatctggcaagacaaccaggccctcttcggggacgaggtttccccactcctgaagcagtacatcctggagaaggagagcgctctcttcagtacagagctctctgtcctgcacaactttttcagtccttcccccaagaccaggcgccagggcgaggtgaggggacaggccgtgtgcggggtggggcacctcttggggatgccacggctagcgccttcagctgcctggggatcagcactctgctgccctgtgaatgatcgggtggttctgcttcttggctgggtggtgggggagggctggcttgtacacatgctggaaagaaagttggttgtttttctgtttgcattttacttttcgttaaagtgatatatggacaacatttaaaatctgcggaaagcccgctcatgtgaagttaatcccccctcccctactttttttctttttctttgagacggagtctcgctctgttgcccaggctggagtgcagtggtgtgatctcggctcactgcaagctcccgggttcactccattctcctgcctcagtctcccgagtagctgggactacaggcgcccgccaccatgcctggctaattttttttctttttctttttttttttttttgagacggagtttcgctattgtt

SEQ ID NO: 135996 - DNA, 1069 bp, Homo sapiens
tcacgtcagggtggggtggggcagggcccgggcccgcgcccgctcatggcctcccctcctcgtaggaggtagagctcatcaccaggttcctcccgatgctcatgtccttcctggtggatgactacactttcaatgtggatcagaaacttccggctgaggagaaagccccagtctcatatccaaacacacttcccgaaagcttcactaagtacgggctgtagggccatggtgcaggggtggccgtggcgcagggatggcactgttgcccagggggctgcctcagggctgggcaggggtcggtgtggggctgaggtggggctgaggtggggctgaggtggggctgatggcgccccgggcgcaggtttctgcaggagcagcgcatggcctgcgaggtggggctgtactacgtcctgcacatcaccaagcagaggaacaagaacgcgctcctccgcctgctgcccgggctgggtaagtcctgacgggcggtgcctggctgtgtcttccctgcggcagctgccgtatgcagtcctgcccagggtgcgggccccagggcccccaggagctgccttgtctccccagcccacctccaactttgctagctttgttttcaccttttttttttttttttttttgagatggagtcttgctctgtcgcccaggctggagtgcagtggtgcaacctcagctcactgcagcctctgcctcctaggttcaagtgatttctcgtgcctcaccctcctgagtagctgggattacaggcgcgtgccaccgtgccaggctaatttttgtatttttagtagagacggggtttctccatgttggttgggctggtctcgaactcctgacttcatgatccgcccgcctcggcctcccaaagtgttgggatgacaggtgtgagccaccactcccagcctcgttttcacttttacttttgtttgtagtttattttactaggaaagggagagggagttcaactttgtgctttcccacaaaaaggtgatgtaagagctgtctttatttcatcctaactggcgaggggcttgggacccctcaggtgctcagagaatgg

SEQ ID NO: 135997 - DNA, 1068 bp, Homo sapiens
ccctggctgccagcttctgctgacccctggacccagaagcatctgcttcccaacagggagggagaggcttcaggaacccctacttcacccagccaccgctcctttttgtctctcttagacgacatccctattcgtacctggttccccaaggaaaatcttttcagcttccagacagcaaccacaactatgcaagcgtgagtcttgtgcccacgacttggggtcagggttgggtggtctctttctgctgctcaggaaacagcactttttcccagtctctgggcctaccaggggggctgcttctgaacagacccacgtgcctatgctgtgccaggcctgccagggaggccagggctgactgctcttcccctcccatggctggtgcccagcccccccccccacacacacacagtcaggggacctggcccagggctgcagctgatgagctctcagtggggtgtggggtgtggcaggttctcctgctcctatccactctcctcagcctgtgtctgccctccctcaaaccccaaatagaagcctacttctgtttcatacgtgccataggtcatcacagtttcagggtccccgcagggacctgctcctctctgtcttgacatacatttggcttttctgttctgggattccttccagggaagttccctttgctgcattggtccccacaccaaagaagtgtcctgcccgggggagtccaccccacacccagcctcaggctgcctggtctcagcaaccagtccttgtggcatgggctgcagtgacatcagcttccgttgcccattcagggctggccagcagtgtagccagcatcctgctggtggctgggttacctgtgagggacctattgggtcagtgacaagaagggaactgtagggaccgggtgggggctgaggggaggcccggggttgagctcactgtgtcttctctctcacgccatcccttctggccctggcttcagcatctcgtaagtacctgtatgacttggtgcctaagggcacagctgttgtccctggggagaccctcccaccccaaataggtttgggcaggccagggacc

SEQ ID NO: 135998 - DNA, 1043 bp, Homo sapiens
cctccatgctccatccagggccctgcgcttgggccttcagccagtggcctcctcacagcagaactggacattctcctgggagacgtcttcatggctgccgcaggccgagagggccctgggcaaggcagcccctatccacagttgccaggtctggggtgctggagccctcagggtgcttggctgacaaggggaggagtgtctgcccgctccttgtccttgtggaagacccacgaagtgatgtgctggggcaaagctggagccagacagaaccaggggtggtgtgcagggctgccctgggaccaggtggctgcgtgtagggccccgggccaccttggaggcgggggtgggcatctgtggccggttctgcctctgagtgtggctatgctgggtacggtcccttccttgggaggggactgacgcagccctaccctcggtgccagacgaatctgactaccagacggagtacgaggaggagctgctggacgtccccagggatgcatacgcagacttccagagcacctcagcccagcagggctcagacttggtgaggagctgggcatggtcccacctggtgcccacagctgagccttggtgcctggccctgtgccggccactccctccctgtggtcccaccgggttaccagcgctgcagagcccctgccctgcctggtcctcacctggaacatgcggtctgcttgcaggaggacgagtcctcactgcggcatcgacaccccagtctggctttcccaaaactgtctgagggctcctctgaccaggacgggtagaggcctctgctaaagagcccggatgcagcgtcttccgtgggactgtccccaaggctgaggctcctgccaagtcctaggggcctctgtacctgccctgctggaagccctgacttccccggggccccaggctgtgttagggttctctgggcctcttctttgtaccagcagccctgcatacagggccctgtgagcccccctgcagtcctgtgaggcccctgaagctctgtgaggcccctgaagctctgtgaaccccctgca

SEQ ID NO: 135999 - DNA, 1035 bp, Homo sapiens
ggcaaaagtggtgatcgccattgacgtgggcagccgagatgagacggacctcaccaactatggggatgcgctgtctgggtggtggctgctgtggaaacgctggaaccccttggccacgaaagtcaaggtggggtgctaccgggcaggctgggctgtccctgctgctcctccctgcagctccacacctgtcctgcggcaggggagtgggggtcgctcctgggctctgaggccagcaggtctggggccacccctcaccacccctgcctgagcccaactcgggcgaaggaaggcacgaggccggacgggcctgaaggctgtggcagcccgcagggaggacccccggccgggtgctgctaccctctccccccagaacctacctaccccagaggatgggtccccagaacctgtcctgcgccacgggccaggctgggacggggtaggggccggggcaggagactcaggcggctgtgacggcagcaggtgttgaacatggcagagattcagacgcgcctggcctacgtgtgttgcgtgcggcagctggaggtggtgaagagcagtgactactgcgagtacctgcgcccccccatcgacagctacagcaccctggacttcggcaagttcaacgagatctgcgtgagtgccggccacccgcggcggcggaggcgggcggaggcactctggtggctgcccctcctcgcttcccccttttgagaacacaggaagtggggggctccccacacctcctgacggggccctgggggtgtgcacaggaagtgggctaccagcacgggcgcacggtgtttgacatctggggccgcagcggcgtgctggagaagatgctccgcgaccagcaggggccgagcaagaagcccgcgagtgcggtgagtacgggcgtccggaccacgcccagctccccggaccgcgcccagttcttcgggccacgcccacgcccagttcatcaggccacgcccagctcctcaggccacaggccctgcccccctggccaaagactccagggccaggacaaggattgct

SEQ ID NO: 136000 - DNA, 1045 bp, Homo sapiens
tcactgcaacctctgtctcctgggttcaggtgattctcctgcctcagcctcccgagtagctgggattacaggcgcgcaccaccacgcctggctaattttagtatttttagtagagatggaattttgccctgttggccaggctggtctcgaactcctggcctcaagtgatctgcccgccttggcctcccaaagtgctgagatgacaggcgtgagcccggaaagaggggttttaaactgcatctggagtccctctctgcgtcagcgtctctgcctgtggaggagttgggaactgaggatgagcacaaggcctctgcagggcgcagcctgggcctggtactcactccttgctctgtgtccctggctggtgtagaggctgtgcccaggtgggcgttctcaaggccttggcggagtgcggcatccctgtggacatggtgggaggcacgtccatcggggccttcgtgggtgccctgtactctgaggagcggaactacagccagatgcggatccgggccaagcagtgggccgaggtaagcaggcacccatcaccctcaccggagcacagcccccaggtccttgctggtgctgggggacgctggggccgttggcctctgcatgtggctctgcagggccctgccctcgaggaggctaccccctgaagcctcccagtgcagcttgtgaggcaaaggagcaccacagagaaggcacagatgcaggttggtggtgggaggcggtctgatctgtgcccaggtctgagttggtggagacggtggtgggaggtggtctgatctgtgcccgggtctgaggtgatggagacggtggtgggaggcggtctgatctgtgcacgggtctgagatggtggagacggtggtgggaggcggtctgatccgtgcccgggtctgagatggtggagacggtggtgggaggtggtctgatccgtgcccgggtctgagttggtggagacggtggtgggaggtggtctgatccgtgcccgggtctgaggtgatggagacggtggtgggaggtggtctgatccgtgcccgggtct

SEQ ID NO: 136001 - DNA, 1421 bp, Homo sapiens
cttcagggactttaaacccagatacctcctcccctgccttgtcgtcagacaccaccttctcctgaacttgaataaatacccttggaacagagatggagcctgggagccacgaggagggtgggacaggcatgtgcccctctgctgagccaggtgcgtaaggggcagggcggagcctcctaccgctgcccccaaaggaagggaggacatcgaggggtgcctgggcgggggtccaggccagggctgccttctggggtggggcctctccggcagcccctcccatctcccacggagtgccagcactgctaccccgggaaaagctcggaggtggccccagggcctcgaggatgcttctgctggccccagggcagggccctgtcagcctggggctgttctaggtgatgaggtgcccactgcatccttctgtctaagggactttccaccttgtcttgtgccacattttctcttgaaagctgcggaagttggcctacagcagttcaatggcttgcctgaggttgccaggctggggacaggacccaagtctctttctgtgggtctgggacagtgcagggacttggagcagttgagcccaggccacatcagcagcatttttaatgagaaagtagctttgatcaaggtaatacttagaagccatacggttctgtaaggcacgtaactgcagtcctttgccttccttccagcaccacctccagagttatcccagaaataaccatgtccagtgttttgagctgtctgcttgtctgtatttctaaatcatattcctattctactaagtttttggttttttttttagttttagattgttgacttcttaacccccttcaacacccgcaatcagagtctgctaactattgattaatcactcatctatgcatctgtctccctcctttccactcaatcccagtgtggtcccatcactagttagccagcactcactgtctgtgttgttatgacactgtgggtgtcactcagaactaagtcacatcctatcctatcctatgattgaagttccttccttggagttaataattgtcacatttgttcagttttctgggtatccttaatttacccgaagacactgaggcaggcattaacctcctctcggtatgttcggacataccactcatctctgtttacttttcaggagtcatcctcccgaaagccctctagcctcttcgtatctctactggttgttttctaacatgctgctgagatgttggcctggaattttctttcaccaccaccctggaaactgcctttgtttctctcctgtgttcaattccatttcctgtaatttcatgtcttctttattggtttattcctcattttggtggatatatgttctagaaatctccctaggagaagacgcatggggaagtaaacattttaagaccatgcatatc

SEQ ID NO: 136002 - DNA, 1039 bp, Homo sapiens
cgtggggtccctacgtccgcgtccagcagaggctgcccctccccatgcccgtcccatggggtccctgttgccagcactccctgtgtgttgcccttgacagctcctcctatctgaaccgggtggggcggagctgaccctgaactgtgacgcgtttggagggtacagcgcattgtcaagggcacaaggctgtcaaccccggctctccctcctcctggcggtgtgaccctgggaggcacttggccgggacgtgggacggtccccacctagccgagctctcgtgggaactgagtgagaccagggtttcgtgccctgctccatccccactgcccaaaacagtagcctgatatgcggagggctctctttagtcatggggcaagtggagctcggttagtaaaggcccagcacgcattagtctttagtatgtgcatttcagttggaaatcataattctgatgacattttagggcttgtcgtcttcagttgttgacattaagggaatatctttttgttttctacattatcttttgttttaatgaagagtattaaggttctgacaatttggggcagtatgttgacttgatcaagtgtttgagacagggcctagggtaaaagcaggctgagcttggttgccttaaacagaccagtccttttcttgaataactggatttctgggttgatgatcggcctctttccattgcctgaaatgtagcttaaactttgccttgagaggcccacacctgtcacacctttgagaggcccacacctgtcacacctttgagagtcccacacctgtcacacctttgaggggcccacacctgtcacacctttgaggagcccacacctgtcacacctttgaggagcccacacctgtcagtgggtgtggggtgttcctggggtggcactgaacttccttcttgtgtcccaggagagccaggccatccctctcgtgtctgtagccagtgtggctgccgggaaggccaagaagcaggtgttctatggcgaagaagagcggcttaaaaagccaccgcggctccaggagt

SEQ ID NO: 136003 - DNA, 1094 bp, Homo sapiens
taggagagttttctagagctcaccagaaccctggctcggatgcattcaggcagaaccaagcgctaggtccttgcatgaaacctcgcactggagcctgggtggtgtcctctgatcccatcctatgttcctctgctcggaaaggacgtaacaagctccagccagacatcggggtgtccagggtgctcactctgctccccggcagatgggcacaggtgcgctttgagctgtttggggcctggggtggaggcgtgggtgggacctcggcatctcgttgtgctccctgggacttgtgtatcttcacgtgacgcgtggcctgtgctggggaggctgccggcctggggagggagaagacacccacctcctttgagcaaggctgacctgccgttagaaggccggtgctcatcttcgagggagcccccagcgtggcttggggcagagtggggtcccagccaccagatccacctctgtgcacctctttggagcctctggttagtgtgtctctggagctgaggtgggcttctcagggactcctggatgtgtaaggggcacctgtgggcctgagaaaaactgggaaaggaccacaggagctttggtctacgtggacgtaaacccgttcagcacggggcatctgtatgcgacctaccttggatgattcgtttctctttaagcaaaaaatagcttcactggggtagaggctttctccattatttctttgttctttctgatcttgatcttgttgtgatattcaggttgggcctcacttatcacagtgcagccatgcctgttccaggagaggggagctgtgcgctgagacgggccgggttcctctcagctgctgcgatccgtctcatccgcgttggtgtcacagcccctctcccttaggggtgggaatggatcttccctgagtgtagtgggagtaaaaaatgggaggtgattggctgagcacggtggctcacgcctgtaatcccagcactttgggaggccgaggtgggcggatcacgaggtcaggagatcgagaccatcctggccaacatggtgaaacccatccctactaaaaatacaaaaattagctgggtgtggtggcgggtgcctgt

SEQ ID NO: 136004 - DNA, 1911 bp, Homo sapiens
gcccttccctggattttctggcacggatgggagtcctgctctctgcagtgaggcgggggtgggtgttgttttaggccttggctcttgtgtagaaactttcaggctgaaccagtggcttcccctgccctatccggttcctggctgcctgggaggaaggtgtgatgccagcaggaatggagagggctgcctgtctggctggtgtcgtcttctcgtcttctcgttttctctttcacttcttggaaccaccagcgtcctctgctgtcgttcactcaccatcctgccctcaccctctcttccctccctcccgcggacctggacttctgaagtcctgctgctccaggagactgcaggacacagagccttctcggccgctgcctccttgtttggcatgtgaactggtgttgaatgttctcagaatccagatggctcataggggttttgagcactgctcctgctggggctgaggcgacactgagaggggggccttggcctcccctttggccaggcctgctccctgagacctgcatcccaaggattgcatcaccagcatgtgggtgtgttagtgatgcctggggcagccgctggccctgccccactgtatcccagtgactgagggagccaggttgctctctgagtgcttcctagcagggggctcagaggaccccggcaccccgggcgagatcacttcttcccagaagtctccagggctgctgacttctcccctaactcccagctctcctcctgctgctctgaacaagttcgggctgggaagcctgtccatgcccacctgaccccatgctctctgctgcaggctgacttctgcctgggcaccgccctgcactcttggggactgtggttcacggaggaaggttcaccgtccaccatggtaatcacctcacgcttccctggagccagacctggatgggccgtggcctttttcacctctccctgtccccatcccctggctcattcctgcccagcctgtggttgggcagccaggggtgggggcaggcttagggctagggttaggtttgtggctttgctgatgggcgccgtgtttccactctcggccagctgacggggattgcagttggagccctcctggccctggccttggttggtgtcctcatccttttcatgttcagaaggcttagacaatttcgtgagtatcttggttccgactctggcccggggggttgggggaaagcgtgggtgtcttgggatgtgttttgagcccctgggaggggccctcaagcgcatggtggctttggctagaatctgatggcccgtctgggctcaggctgagcccgtcggttccaggaagccaagtctgttcagagccctttctgttctcctctcctgagcaaggcttcagtgggaagaggggagagccccctttgttggagatgagcctgtcactcaggccctcttccctcatgctgtctgagtatggccagttactggcagggacgagagtatgactgactgtgctgcacctgcatgtccaggaccaggcctgtgccacggctctacctcaggccatccctttactcccctgcaggacaagcacagcccactcctcagtaccggttccggaagagagacaaagtgatgttttacggccggaagatcatgaggaaggtagctgttgctcggggccccaggctgcacacggcttcctcgagcaggcccctgtgggagggaccccttctgctgtgggctcccccaggctgggcagtgcttggtgtgtgctgtcctctccccagcttcccagctctgccaccaggctcagggtttgggggaaattataaattgtgccgaatggtgtctgcttcctccagctgaatccagtgtgttttacccaagaataacccctcaccctctcaggcctctactccccctggcctggag

SEQ ID NO: 136005 - DNA, 1050 bp, Homo sapiens
aggccgggcagtggtgtggggggactcgagccctcgcggtgcccaaattaatcaataatcttggacccagcacgtccggcttgcgcactgagccctcctgcccggtcaccctcgcaggcgacctctcaccccacgcggaagtcgccccccagccgcaccctcacaatccggatccaccccctccccagctgcaccccgtccccagcggcacccccacagcccagatccatcccctctccagctgcacgcccttccccagcggtacccccacaccccagatccatcccctccccagctgcaccccctccccagcggcacccccacgccccagatccaccccctccccagctgcaccccctccccagcggcacccccacgccccagatccaccccctccccagctgcaccccctccccagcggcacccccacaccccagatccaccccctccccagctgcaccccctccctagcggtacccccactcgccggatccacgcgctccccagctgcaccctctccccagcagtacccccacaccccagatccaccccctccccagctgcacccactccccagcggtacccctacacgccggatccaccccctccccagctgcacccactccccagcggcacccccacaccccagatccaccccctccccagctgcacccactccccagcggtacccctacacgccggatccaccccctccccagctgcaccctcctccccagctgcatccccacaccccggatccacgccccgccagcgtcacctcccctccagccgtgcttctccagaaggcagcgctgcccccatccccgccgcgctgggcctggctcctcttgacctgcttggatacgccccatctggctgctgttctgggttccgggacagccacgtgagggctgtttacagagggaaggaggtggctcctagcagatgacagacacttctcaaaagacagcttttcttcctggagaacagactttttcagcaggattttcctttcagtgaaacataatttgacttgaaaggaacccaggg

SEQ ID NO: 136006 - DNA, 1027 bp, Homo sapiens
agactctgaaacagggcgtgccggaccctgcatgcttgggacgctccagcccactgtcactcactgacagtgccatggctgcctgtttgtggttccccgtgcgagccttggactttctcacctctgctgtacacatgctgcctgttcctcagacatccccttccttcccagctggctaaaactcctttgttctttggttttaagtgttaactgaggtctttccccctctctggcttttgccgtattcttcaccatcaagtgaggttctgtagccccgcttgatgcttctcttggaggcacacaggcgtgtgcactgcaagatgacggtctgtttcttctccaacatatgcccaggtcttgctggttcctttgcatgacacaacggctcctcaggaaacacttgctgacctgtgaggggctgttcttggagtctccctgtcaggtgtgacaggttggggagaggctctgggtgatgttgtgtttcctgggttctcccatctctcactccagaggagaggcaggaggcgacggtcctgacatctcacacattgcccgactcgctggtgtatggagccgactggtcctggctgctcttccgttctctgcagcgggccccctcgtggtcctttcctagcaacctaggaaccaagacggcagacctgaagggtgcaagcgagttgccaacaccctgtcatgaatgcagagaggataacgatggggagggccatgccagaccccagagtggaatgaagccactcacagagggcatgaggaagaatggcacctggctgcaggctacagcagccaccacacgtgactgtggcgtgaacccagaagaagcagactcagccttcagcctcctggccacctgctccttctatgaccatgcgctccacctctgggagtgggaggggaactgagcttgaaatcatgaagccccttcccacaaggaaaccaggagggagactgcgagtgagtgcccgggaccacctcatcagagatgcttactgcagccctgcaggtgcct

SEQ ID NO: 136007 - DNA, 1059 bp, Homo sapiens
ctcatcgggagcacatcctggccacgggaaggtgagtccccaggaggctctcgggcccttctcgtctctttcgctgtccccggggggctcctgggcccttcttccctctttcgctgcctttcctcctggcaccattgcagcatttcgtctgccagtgcttcgccggagtgtaggtatatgggtttggtaaaggggactttgtcctcgagggatgcatgggacaggtctctgggagacgttctgtgccccccaggggccttgtggaacaggtgagcctgggctttccttatatgcctcctgtggttggtcggtttcagctatgatgaacacatcctactgtgggacacacgaaacatgaagcagccgttggcagatacgcctgtgcagggtggggtatggagaatcaagtggcaccctttccaccaccacctgctcctggccgcctgcatgcacagtggctttaagatcctcaactgccaaaaggcaatgggtgagtggggacccgtggctgctgggcctcagggcagggcaccagttccctgccccctcgctctgctgggctcttccctcagctccctgctcccttgctctgctgggctcttccctcagcttttacacactcccagcgtcgcgccctagacttggtcgtgatccataactgtcccagctccagaatctctgctctctaaccacagttttccctggtttcccagctccgtcattccggtgcctcctgcatttcggcagacctctgaccccactgggacctctagtctggaggcttggccacccatcactcccataaccatccttgtctgtgctctcccatgctcttcctgcctgtggtcagctgggactctgtggtctgctgccccctgtgagctcacactccattcccttcatccctttctcacactctgggcagaacccagtgttgttttgttgggaacaagcacctctgattctggttgagccggagaacgtggctggaatcagctgtccacgttgtgttctagtaggtccctgggattcctggtgatctgtaacatttctctaggc

SEQ ID NO: 136008 - DNA, 1056 bp, Homo sapiens
cagtgagcatcctgtgtgaagatggcatttctcactgattattggaaaagcacgtgagtcctgtgtgaatttttccgagtttctcacagtgctctggagccatgcattaacaaagtgacttcatctgatagctgtcggggaggagaacggggatgtcccgtagtggggtgatgtaaacagcctgaaaccacgccctcactccgatgcagatgctgcaggcggggctgggccaaccgagggcctgtgtaggaaaaggccttgcttaaggcagcttagagcagttgccctgtcttagaaaggagggaaagagcagccacaggaaagctgtgggcccaagggaggagtgcatgaacccaggaaagggctttggtacagcagcctgctgggagcagggatggagttaagcactggccaggctgtttaggaaatgaaatttatatagatctgcataaagagcaaccacgttctcatggctgctcgcggcttctgaagtggaaaccagaggagtttccccattgtctctgtctcgggaggcgagtgttccagtggccctggaggcctggggtgggaaactgtgtgtgccactgtggtctggagcctgcacaggcatctcgacagcatctaggagcgcaaggatggcaagggggtgtgaaagggagggagaccatgccccaagatcaagcctgtgggaaagttgtcctgcaagtgtgaggagtgtgagctccagtgtccccaggtcttctcggggcccctagcaggggtttcagtgttaggtggaggtgtgactcagtgactgatgtacttcattcgcataggttgtaaatgagggaacgatgacttccctgcaggagaggaaaagtcttttgggggttctggggcggctacttccctttgatggagtttcttcttctccagtagaagagccacgtgctggagccattgtccagccttgccctggaggagcagtgtctggctttgtccctagattggtccactgggaaaactggaaggtaagggccaggcttggtcaggggtcctgagtctttctctgagaac

SEQ ID NO: 136009 - DNA, 1622 bp, Homo sapiens
cccgcagggagcagcgcgtctgacgcctgaagcccgccgcggtcagccggccgacagggggcgtgggagcctggcttcccaggggcgtccacggaggccaaggccctgccggatgtcccgccccggcaccccggaaggagtcgcgagagaggcggcccgcgctgacggtgtccctggggctctgcgctcgtccggccggccccggcctcgccgccccgcgcagtacccagcccggccccgccgacccgcctctactgccggctccgcgcccttccccgagggctggatgatgggctgtttcgccctgcaaacggtggacaccgagctgaccgcggactcggtggagtggtgcccgctgcaaggctgcaggcacctgctggcgtgcgggacctaccagctgcggcggccggaggaccggcctgccggcccccagaacaaggtgcgcgcgccgcggcttcgggaggggagggcggggccggccacgaggttgaggccgaaaggcgcaccgaatcgcccaggagatgaagaggggatattggccctttggccaggaggtaggctggaaacagtttagaatctttttaaaaaaattgttctcggccgggcgcagtggctcacgcctgtaatcccagcactttgggaggccgaggcggacggatcacgaggtcaggagatcgagaccatcctggctaacatggtgaaaccccgtctctactaaaaaaatacaaaacaattagccgggcgtggtggcggcgcctgtagtcccagccactcgggaggctgaggcaggagaatggcgtgaacccgggaggcagagcttgcagtgagccgagatcgcaccactgcattccagcctgggcgatacagcaagactacatctcaaaaaaaagaaattacttttttctgagacaaggtcttgcactgtcacccaggctggagtgcagcctcggactccagggctcagggcatcctcccgcctcaaccccctgagtagctggcaccacaggcacgagccaccgcccccggccaactttaaaatcttgagagcagaacgtcttctatatacaggtgtggcccaagggaatgggtggaatgtacagtaaagagaaagtgggaattatatcttaacttctggtgggtacatattaggatccaaattgggcactggaacaacaggcgtaagtcaggactgtcccaggcaaactgggttctgtggttaccctagccatagctggtccctgttggccggtttagaaggagccttctctactgggtccaggagtgttcacctactcattaatagacgtttctccagctcagaaaaccagaggttctccttccaggcagaattccactcctttagtcatggcaaacctttgagttccttggatcccttttcccatcctttgggttccttcgtgtcttgggataatcagagactacctctgcattttttgtagggtggaatggaagttaaggagcctcaggtccgtttaggccgtctcttcctgtacagtttcaatgacaacaactctattcaccctctggtcgaggtccaaagaaaagatacttctgcaatcctggacatgaaatggtataactgtgataatcccactgggtgt

SEQ ID NO: 136010 - DNA, 2416 bp, Homo sapiens
tcaagcaggaggagtttttagacggacgtagggcagctcccggtatggaaggggaagtggaccgacggggcagtaatgggcacctctgcaggtcaagggcaaggagaggggccgcctcgctttgcacaggggcctgacctgggccctgtctcctgcctactgtgtgcctgtcagtcccaggtgctggggagagggtgatagatgaggccatgcttacgggttagtgggaagatgagacacaatatttactgtcaggtggtgaaaagcacatgcagcagggatgggccaaaggagactcaaactcgggctgggtgtcctgggcaggatggcactctatggagtcattgcatcgtctgctgtgtgctggccccgtttggccagagtgcactcaagtgtctgcttctttctttaagggagcaaagcttgtattggcttgcaattcagcagctgcctacagaccctatagaagaacagtttcctgtcctaaatgtgacccggtattataatgccaacggggatgtagtggaagaggaggagaactcttgcacctactatgagtgccactaccctccctgcacagtgattgagaagcaggtgggtgtgctgcagtgcggtcgcgtccctggcacctctaccctgtagcccagccttggtttgggatcttgccctccaccgcggggtcccattccccagagaccgcttagcacctcttgggcttttccaccagagtggtctccctttgcccttgtgctggcctgaccagggcccaggccctccagccttggtacgtggtgttttgctgggtccgtcagattgtccgtaagacgcagcctttgccccacactgcgtcccaggcatgatggtgaagccacaggtgttctgtatttcagctccgggagttcaacatctgtgggcgctgccaggtggcccggtactgcggctcccagtgccagcagaaggactggcctgcccacaagaagcactgtcgggagaggaagcgtcccttccagcatgagcttgagccagagcgatgacgggcaggggagccacacatactcacagcccccgggctctaccctgggcacagcagagacagactggtggttgaacctggaggtgccaaaaaagccagctgcgggcccaggacagctgccgtgagactcccgatgtcacaggcagtctgtgtggttacagcgcccctcagtgttcatctccagcagagacaacggaggaggctcccaccaggacggttctcattatttatatgttaatatgtttgtaaactcatgtacagttttttttgggggggaggcaatgggaagggtagaaattacaaatagaatcatttgctgtaatccttaaatggcaaacggtcaggccacgtgactaaaaactgtcctgttgtcgaagcttctcccctgggccgccgggagccccgtggagcgcggcctgcacgggagttgtgtccacaaaggcaaagtaaaggggtggaatcatctggcctctcggacattctctgctccgcctccctcttgtgctgcttagggtgaggtcattttgagtggagccgagtccttgtgggtgaggcaggaggacccttgttcctggtgggcccttctgaggagcgggtgagctcagaccttcctgagtccagcagggagtatgagtgagactctgtccttgtcttgcggcaggagtggtggggttgctaagtcagctgcccgctgttttatggggagtaggatgctctcgcccctgacattggttagttcttgcctgatttatgcatgaagtggctgggagctcagcagtgagcttctgcccagaagaatccacagggcatgttcagcaggcctgctgcagatggtggagggggctggccagccagggtgaggtgagggtctcacttctccgtccgtctgcagggctgtggtttccaggatagccctccctctccttggggagccccaggtgtctggggctggtcagcatcttgtacccatagagctgccccagggaaacatgccaggctgtgtggctgggatcctgcctgtctccaggtgcgcccagccagaggccttgcttcttgggagctggaagcctggccagtccgactctgacctgtctggtctggtccggtccgaccctgtgttggtcccacaggttgctgctacactttcccttcttgaagctccactgccatgttccaggacaccctgtgtgttctcattgctgcccctggctgggctggcttttgtctgtaagcaaaacttccagtaccttttctggcagtaccctgggggctcctgaagaacaggactgctgaaaatgggtgatatcaacaaactccgcaggatttcctggagcttagagaactgcatgtgcccacatcaggccctgagaagcccccttagct

SEQ ID NO: 136011 - DNA, 1890 bp, Homo sapiens
ccagctgcctcccgttctctgctctcatggggtcttcctgcctcttcccagcttccattcctgccgctgagcttggcctccctcaccatcctttatctctgtgccccacacattcacagtagtgacctctccagggggttctctatctcactgcaccgtgggctttttttaagggtaggaaaatgtatttgtctatgtcccattgtattttgcagagttgtttgtgagtgtttcttgctcgaatagacagagtggtggtgggccacgctggcccctgggagccatgtgcctgtgggaagctctgcactccccagggtctcagggacagggctggcatttgtccctctggcttgcttgtttcacttggtttttctaagagggaattgaagtgttgctgagaattggaggttttttaacagctctttcccttgttccttctcaggcccgaatggaagtggatgcagatggaaatggtgctaagatatttgcctatgcctttgacaagaaccgaggaaggggctctgggagactccttcatgagctgctgtggtgggtgtttccaagctgtctctgccccccgccactgggctcctgggtgagctccgatggcacagggcgcctggagccccctgccccgctgaagccctgccttgccttccctgaatctcgcagttatttttgtgtccttcaccactaacccaaaggaacgaatgatttgtatgttgcacttcaaacaccaagtggactttctgctgggagcttgcccaggaccggcagcctctggagggacggtggttgctccccttgctgggttttgccgagcccccccggtgtgcatggtagggaccactcagatggggagctgtctcgaggccatctgcttaggtggttttgcgttccagctttggctgtctgtgctctgaagtccaggggccgggtcctccctgtgtccctgtcctgtttgggccacagatcaggtgcttgggtttctctcagcagcttccgcctgaggtaccctcatccaaaggaccaggggcccgatcagatcacatggctgacatttcttcctggaaggactttggtacctgaccagaaatgtctgtgagggtgggaggcagcgatgcagggttagatgcagggtttgctgtctgtttctagggagcggcaccgggggggcgtggccccgggcttccaggtggtgcacctcaacgctgtgaccgtggacaatcgcctggacaacctgcaactggtgccgtggggctggcggcccaaggctgaagagacctccagcaagcagaggtgggtcttctcagggcctggcgatgccagcagaggcgccttttgaggagggccaccgccaaagctcttgtttccaagagggtctcctgttcctcctctgagccctgatgcttctgtgtattttgggaatttcattgtttttccccaaagcgtggaatcctccttttcttcatgggagcgggaaggatcttgatggtgtgtgtttttgcattgctcctcttataattggctctgggaacctccctttagctggcatgacagtggggagaagggctgcctgctccagggcagggccagcgtcgggactcggtgtgagcagggcttctgccccacacccctgggaggcatcagccttctctcctcacctcaggattccttccttctctgctcacctcaggattccttccttctctcacctcaggattccttccttctctcacctcaggattccttccttctctcacctcgggattccttccttctctcacctcgggattccttccttctctcctcacctcgggattccttccttctctgctcacgtcaggattccttccttctctcctcacctcaggattccttccttctctg

SEQ ID NO: 136012 - DNA, 1223 bp, Homo sapiens
atctcctgacctcgtgatccgcccgcctcggcctcccaaagtgctgggattacaggcgtgagccaccgtgcctggccaggaaacattttttaaacctgcatgggggaggagggacagggcttgcagggcccctgcaaagaggtgcaacgttcaagtccagaaggcggaagaagtcacactctgactaggggactgccactgagccactcagtcctgcagccaagccctgcctggtggctttcctgttgcgaaaggctcggttcccttcagcgtgttctgccatcacaagcagtctgcaagctggaaagaagagggagcggggtcgtatgccgccagcagcagggagacccctcacaatggaccccatgtattgctctggcttctccgtgggcagaactgcatcctgtggtcctgcctgattcgatgatttgaaaaggcagaaacatggccgctgccattggcctggccagtgaaaacgggctccctgggaaattcacccagcctgacctgaagcagttgctgagaggcagaggagcagctccaggtgttttggcagggaagcagctggcagctgtgcgggagccccttgcctcccgtgttcttactgaggagtgtgtggggcagctcgggacaggtttcactttggacagtggttggaggctgcttactctggcagagtcatctcaaagagccttggtgtatgtgcaaaacggggccatctgcatgggcgttgggaagatcacagaacctggacccttaggatgacccaagggtcagttgcatactgtttgtttttgtggagtcaatgtcccatgacggttttcgcgatgctttgctagtaggagcagtggcgtgtgaggctcccggttaaataccatgagattctaagcggaattctgggtctcctggtatgcacaggtaaaattacagtagacctgtcccactctttgccagaacctcgtacttgtctgcagtttgactggaataaggggtgtttgtgttccacctccctccaacgtgtgttgagacatttatttatttatttatttatttacgttgctcttgttacccaggctggagtgcagtggtgcaatctcagctgctcaccgcaacctctgcctccctggttcaagtgattcttctgcctcagactcccgagtagctgggactacaggcacgcgccaccaggcctggctaattttgtatttttagtagagacgggg

SEQ ID NO: 136013 - DNA, 1080 bp, Homo sapiens
ttttttttgagatggagtttcactcttgttgctcaggctggagtgcagtggcgcgatctcggctcactgcaacctccgcctcccaggttcaagcgattctcctgcctcagcctccctggtagctgggattacaggcatgtgccaccatgcccagctaatttcgtatttctagtagagatggggtttctccatgtcggtcaggctggtctggaactcctgacctcaggtgatctgcctgccttggcctcccgaagtgctgggattacaggcatgagccaccgtgcccggccttttttgtatttttagtagagatggggtttcaccatgtcagccaggctggtcttgaactcctgacctcaagtgatccacccgccttggcctcccacagtgctgggattacaggtgtgagccactgcacccagctgggtcccagcatttgcgggattcaaggtggggatgtgcagtctgtcaggagtgttaaaagcacggcagcatttccagtccccaggcctcctctccttgcttcagccacgcccaccctcctctgtgcctgctcatgcccatgtgcttctgttgggctgtctgctggtccacaggaggattactggtgttccggattttcagcatgaacacagtatggggtctggcccgaggagggcctggctaacagagcatggattcaaaatcagagcagagctgggtaccgtggctcatgcctgtaatcccaacactttgggaggctgaggcaggtggattgcttgagcttaggagtttgagaccagcctggacagcatggcaaaaccctgtctctataagaaaaacaaaaaacaaaaaacaaaacccaggtgtggtggcacgtgcctgtagtcctagctacttgcggggctgagatgggtggatcgcttgaacacaggaggttaaggctgcagtgagccgagatcgtgccactgcacactagcctgggcggcgggagtgagaccgtgtctcaaaaacaacaacaacaacaacaacaacaaaaaaacaaaaaatggaccgaggttggggtggcaaggctgggctggaatggaggctgaggacagg

SEQ ID NO: 136014 - DNA, 1041 bp, Homo sapiens
ggatttgggtgggctctgacccctggcacagctgtttcacccttgccccattcccaaaccactctcctgttcaagccaagctcttatcctcagtccttcacccaagccacagccctgtgctgctgtggcgctggtgactgagacagggagacccagtgtgagctggtcagctgcagtgcccactcttatcctggccctgtggccacctcaggccacctcagggggggactgccccccacctccctcctgtctctgcagggagcctgcccgctggagagcacagcttccccttccagttcctgcttcctggtgagagcccagcctggacaggcctggtgatgaccaactggtcctgggaggtgggctctgcagggtggaaggcagccaggtaccagtgcctgctctctccccagccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgaggtgaggatggcacagtgacctccttggtgggtccccaccctcatggaggctggggaagagctgggcaggcactgcttcatcccagcgtcctgtccccagctgaggtgaggggggccagggtctggaggcagtggcctctttgccctgagctgactgctgatgtccaggggcagggcgtggcagggctgaggggcctgtcccaatgccacagggatccagcctgcgcacacctgctaagcccctccctggccctccccccaagcaacccaacgtggcctctgccaccaagaagttctcctacaagctggtgaagacgggcagcgtggtcctcacagccagcactgatctccgcggctatgtggtggggcaggcactgcagctgcatgccgacgttgagaaccagtcaggcaaggacaccagccctgtggtggccagtctgctgcaggtcagagcccccgccagttgcctggacc

SEQ ID NO: 136015 - DNA, 1110 bp, Homo sapiens
tgctggctgtcagaagcaggaaagcacgctcggtgggaagcttgcggactcaagtttatttccaaaccagcagctttaaagggctctcgatgtaaaaagttcacattcttttgttaatggtctcggccttccccgtgctcattctcaaggatagtttgtttccttgcttaggaaaggaagcagcgtagagattaaagtcttgcgagtggaccactggcgtccctctgaaggaaaagcaagcaggaggtggtgtgtccgtggagatgcagaaatagtgtggtcctagggctgagataagggaccggtttggagaaaactgtcagcgtagaagtatttctttgaaattaactgtctagtaacagttgagacttctaaagcttagaaagttaaggtgtagtaagaagccgtacagtatcctggtgcatagacttaacactgtattttaactcaggtaatgtatggcctttttgtttatttttttcctgcatttttggggggtgttgaaataagtaaactgggaaggtgcaggggaattcttaaattcaatgcaaggagtttttgctgagtatctgcagcattcaaggaattaatattagtcactgagaacaaaaagcgaaattagaaaatttcaagtcacttctaggcttgtaggggagaagacgtgtagtgatgaattctatcatttatgaagtacccactggatcccacacactgtgcaagacctttagatcaggcgcctccctcggttttcttcaccctgtgcagcaggtgctgttatttccttttttaaattattatttattattattattttttgagacaggatctccctttgtcactcaggctggaatgcagaggcatgatcactgctcactgcagcttcgaccacccaggctcaaaggagtctcccacctcgggtgctgccacacctggccaatttttttgtatttttttggtagagaccggggtttcaccatgttgcccaggctggtcttgaacttttggactccagcgatctgcctgcctccgcctccctaagtgctaggattacagacatgagccattgtgcccgtcctgttgtttcctgtttagctgaggaggaagggttag

SEQ ID NO: 136016 - DNA, 1033 bp, Homo sapiens
cagctccacctgggttagctcaacccttagagattatttgttctcatctctttggagttgaaaatgttgtacttttctaggagccatttccccaggccatgtggaggtcaggtatctgctggttctggcctcactctactcctcctcctcctccccgctctgtggagagggtggcttgaaggagacgggcagcaggtgtgtgactgcagtcctggggcacgggcagaggctggcatgtggggaaagcaggacccgggaggctgtagcttaagtagacatttgttttttatttgaagagaattttagagatggggtggtggtggattttagcattagagatttctggcttctgcttgaagcactgtgaataggggacaaaaaaataaccaagaggaaaagttcatgtaaagtagaagttttggtgtgttttcttgaaaggaaattgtctacagtgaaagcgttgtatttttagagaactcggggaggaaaacgctgttgtgctgcttatcacacgggtctggcctttttgacatctgaaatcttataggaatttgtctttttgagagtgtatgctgcttatttggtttcgtggaatccagaaaagagcctatccaaattatctttaccttcagggtaaattaccttttagaattgtggcagatggcacataggacctctcagagggactgcaccttgtacaagaagaaaagtgagagggtgttgcaaaggagagcttccacctcctttatagacttttgcagaacagctttcttcctttcgaccttggagaagaggcaggaccagtggggaggcagacaagtaggtgaaggaagacaaaaggaagaagggacgcactgatcgagaagacaaggagtgctgatggctttgggcgccagctgtctactccagagagtctaactgacctgggacttgcaggatcctgctagaagaaaaatccttgcttccttctcctcctgttttcttcctcttcctccattctccttcctctcccttctattcacccacccaccac

SEQ ID NO: 136017 - DNA, 1029 bp, Homo sapiens
ctcaggtgggtgaggcctgagaatcgcttgaactgtggaagcagaggttgcagtgagccgagatcgcgccactgtactccagcctgggcgagagagtgaactctgtctcaacaaaaaaattgtaagaggccttgtataatacatacctctatagatgcttaatctcaaagatttagtgatttaagttccttattgaattttcttgatttatctatttctataattttttgtaggaggttggacatttgaaatatatgaattattgtcagcagtagaatgcattttgaaataaattgtaacactcctgtaacagagcccaaagatttcagatatctaattatataaatgatacatgaatgcgttcttattgttaagaaactgtcttcaaaaatagaaatacaggagaagtttccttggactgtgttctgaatgccagttcttctgctggaggcgactgtaaccagctggcaggagtaaatctgactgtccagcagctcatggtgaatgttgtaactacgattttttgactttttccaaatgatgtccatttggaaaagcggcctcccactgaacccggctgacggctgttgtttctctctaacaggcagttccggcgaggggggagcctcagcaggattgctgtgtgaaaaccgagctgctgggagaaggtgagggcggtgtgcaccgagggacaggagcagcgcctccctccagactagaaaacctgctgctcttcctctcttattagtccccgtcttctgactttctttgcttcacctaggtttatggtatagtttctaatctatcccattcctaaatagcacagttgcacagacaaacacaaaagctctgccagagaaggaacacatttgtcaaagtatgaaaagcaaaaatcctgtatatccttgtcttaaagtacacccagaaaattaaaagtgagtggccacacaaatgtttatagcagcattgtcacgtcgccgaaaaccggagacactccggtgtcctcagttgataaggaactggataaac

SEQ ID NO: 136018 - DNA, 1026 bp, Homo sapiens
cccacccctcgcatgcaccatgattttcacacgcagggtgcgcccacccctcacgcactgtgatgattttcacacacagggcgcgcccgcccctcacgcaccgtgatgattttcacacacagggcgcgcctgcccctcacacgcaccgtgctgattttcacacacagggcgcgcccgcccctcacgcgcaccgtgctgattttcacacacagggcacgcgtgcttctcacacatgctgtgctggactgatcaccagatcttacgtggtgcatacacgatacaggttttcaaagtgttcatggtgcttttagtgtgctctctcagtttgatgtgaatttgggtgtaagttctaggtttgtgatcacattcccgtggaattttctctctctgacattgctggtgaacattctgacagcactttcttgtcatttgtttgtagatcgtttgctctttcccctcagccactgtttagggcttcacagccctgtcaattggaggatttgtgtcttcagctccagaaggatgctctgtatgagttttcttctgttttcttcccatggagctcctcttaaatggccggctcttctgtcctcctgggcagttctctgtctgtttccagcttccttactggttcctcagcccttccccttcttgctgttcatcccatatattgatatattttattctgacataaatttttttcatgcccagtatctctgattagttctctctctttttctttttctttttctttttttttttttgagacggagtcttgctctgtcacccaggttagagtgaaatggcgcgatctcagctcactataacccccgcctcccaggtttaagtgattctcatgcttcagcctcccaagtagctgggactacaggcgcctaccaccacacctggctaatttttgtatttttagtagagatgaggtttcaccatgttggccaggctgttcttgaactgacctcaggtgatccatgcgcctcggcctcccagagtgctgggattacaggtgtg

SEQ ID NO: 136019 - DNA, 1746 bp, Homo sapiens
ttgtgtcctaggaagactggcctggcctggcccctgtgctgggaagggaggctgggctcttcctgctccgcgctgcgtcctccctgctgcacatgctgttcacgttggtctgttttgcaaagtgagaggacttctcaagggtagtcattccatgtgcaaagccaaggggactgggaggaggagtcgcttcagagccctgctactgatgatttgtggctttcctgcctccaaggtggggtgataatgtttgctccgtgttttgttgtgaatggaacagatgaacagatgatccaggacgtgtttctgattctctgtgaattgatcgtgagggaaggatgcctgtcactgtgctgatgacctgcgggcagtgggcctgttgtgatggggtttgctggtgattttggtgatcaagttttgtaaactgtctcttacctttgaaaaacatttgaatggtgtttcttttcctttcttgtccccttttgacttttttttttttttttagcttgcttgccttttgttttagcagctgcagtatctcggaagaaaaaacgaagaatgggaacctatagcctggttcctaagaaaaagaccaaagtattaaaacagaggacggtgattgagatgtttaagagcataactcattccactgtgggttccaaggtaagagacgcatttgagtgagttgccacgtgtgcgtggaaatgcgtttctgtgttcagggcctcgttatcagtaatttgggtgacctcagtccccgggaaggtgccagtgccatgaagctcctctgccataggggcagagtgttcgtgtccaagatcattgtgggggactccaccccgtcctccctgccctcctcaccacagcccacctgtctgccgggctcttctccaggtggcaggggcacctcttcgtgtgtccccgcctccccacaggcccttgcacctcccagtcacccaagactcctcagtgaaagcaagtttgttcatgatgcgcactgatcctgccttggggtatacacctgcccgtgttctagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaaggtatgtgttgctgtcttgggtgacagcacaaggaaagagcatcacaaagttggccgtggttctgaaaattaacagtctggtcacttctagaccctgataaaatcccctgtttacaattggcttagatttttgtattttatttttcttgatttattagattattttcattcaagaagtatttatgtttctgtacatcattcattgaagtaaacctcttttttttttctgtgttttctttctttcttttttttgagacagggtcttgttttcacccacgctgcagtgcagtggcacgatcatagctcactgcactcaacctcctgggctcaatgatcctcccatcccagccccccgagcagctgggaccacaggctcacgccaccatgcctggctaatttttaaatttttttgtggagacggggactcgctttgctgcccaggctggtcttgagctcctttgctcaagtgatcctcccgcctcagtctcccagtgttgggaatacagccatgagccacggcgcccg

SEQ ID NO: 136020 - DNA, 1031 bp, Homo sapiens
ttttgaccttgtctgtagtgtcagaactcccaggtactaatcaatttctttatgatttctgagttctgtgttctaattatgataaaaacctttctcactgttgattttgaatgaattgatgtatgctatcttctaatacttcttttatttcattcttgtatataaatatttgattcatatagaattaaaatatcaggtagggctgctcagaatgggggaagtttatgacatattaattatatctcaataaagcttttaaaagaaaatgtgaggtaagggtcccagggcttcccttaaaatgcttaggtttcagctccacttactgactgacatttcttcccttctcatttacaacaccacgtttatcatgtaccatatgggatattaatttcagtctatttctcgattctctctttcgattgaggttctcatcttctagaggaactggacactgaataactctaggtatttgtcataaagtaaaacattaaatgactgtcaaggcacgaaaagaatcaagaaacaaaagcaaagccaagaagaaaatgtggtcagtgtaaaacagaacaagatggcaggaacagccttaactagatgggcactgacaatcaacagtgatagtttcgttacgtaagtggctccagagaatagagaaggataggaaaagtacgctagcccattctgagactaaaatataggctgaagtcacctaaatcctaaatacaaaagtcctaaatacattttttttttttgggactgagtctggcgctgtcacccagggtggagtgcaatggtgcgatctcggctcactgcaacctctgcctcccaggttcaagcaattctcctgcctcagcctcccgagtagctgggattataggcacccaccaccacacccagctaatttttgtatttttagtagagacaacgtttcaccatgttggccaggctggtcttgaactcctgacctcaagtgatcgacctgcctcggcctcccaaagtgttgggattacaggcgtgagccactgcgcccg

SEQ ID NO: 136021 - DNA, 1016 bp, Homo sapiens
ggcctgctcctgacctgctacccacccccaggacagatgtgggaagctcctggcctgctcctggcttctcttttcctgtttcacttgggtgtcagccttctcagttcacctgcatcagactctaagttccctatttactttattatttgtgtgtgtgtgtgtcttgctctgttgtgcaggctggagtgagtgcagtggcaaatcatagtttattgtagtcttcacctcctgggctcaagtgatcctcccacctcagcctccaaagtagctaggaccacaggcatgcgccaccatgtccagctaatttttttttttaattaatttttttgtagagatgaggttctctcagtcgacagcctctcactatgttgcccaggctaatcttgaacttctgggctcatgtgatcaacctgccttggcttcccaaagtgctgggattctaggtatgagccatggcgcccagcctcttcttaattctgatgtcagtggttaccccttctctttctaatctccttgggttttcagcttccacttgattccttacagctgtcttatgcacagtgatcaagcagcctcttataaagaagctcttgttccttccttaaaagtcgctttgccagagttttggaaggaagtggagttagctgtggtgttagtctgctgttaattggtggtttcattgccttgtcttgtttttaaaataagaaacctgtccagtgacatgaaaactcctgtcaaagccgactgaagtgtcggaatgcttatagaagggttagaacatttcgatggtcagtcgtgaagcaagggaggagaggctgctgctttcacctctgacacgaatgcggcagcattgactgttcctgctgattctgtaagagaagaaccggaaataaacattaatattttaaaagacaagagagaagagtttgctgagaatatactcatccatctgaaacatctagcaaaatcagctcaaaacctattacagctcctaagctgaccttacatgtgatcaa

SEQ ID NO: 136022 - DNA, 1558 bp, Homo sapiens
tcagaaatggagctttaaaaacttgacaggaaaaacaggggtctcgctgtgttgcccaggctggtcttgaacttctggcctcaagcagtccactcgcctaggcctcccagagcattgggattacaagcgtgagccatcgagcccgcagagtacacccttgatgtgaagtcgcatgggtgcctgtccaccgggaaatgcagagaatagtggaatagcgcagcaaaggcagccccatgccgccttagggagtgccgggcacagggtggacggagactcacgtatgtttcagtgtcttttgcactgaacgtctatttgcgtattgcctgtgcttatagaaaagataaatacagcagaaaaaataagatgtgtctgttctggtgtggaaagaattccagaacatatttttaattagaagaaaataatattcacagaactgttgagtgtcctgccatctgtgcagactagaaatgcactgtcgtctgtgggcccacgtctgcctggatgttcactggaaggaggcgtgggcaacttagctgtggtggctccgaggattggactgggatcatgggtgtgtgggggtaggtctcacactgtgtattgttttgtggcctctgaaaatctttttatgattgttctgtgtgttttgtgatgtgtttattgaattatcccattcataagatacagtgagtacctgaaccctcactgatacagcacccagcgggtgagctcttgcctcagtccgcaccagggcagccactctctggtcccgatgtggagacaggaccggggagcagagtggaagctcagagtgtgtctctggccctgcctggaccagcactcggtcaccccacacaccagccagggctggagcaggccggcggcgcccccgccccgcgagcgtctccggcgtgtgcggccagtgcccgtttcgaggtttgctttggatccgtcatctgccactaaaggatgtaattggtttctgttttctgtttgggttcccgcttcgactgtgtggctgatcagatggacggggagtccgaggaggagcaggagtccgtggacaccggggaggaggaggaaggcggtgacgagtctgacctggtaatgcccagcgcctcctcctgcgtctgtgctgatgtagaggagatgcaaagacaccagcgtccttcagttctttacccaacaacccttgttgcctgagcgctcacccatgtgcttggagctggtcatggtgatggccacagatgggtcctgtccctggcaaagcctcatgagaaagacaccgtgcagagttgcagcgcagggctgggcctggcacggggctgccccagctgcgtgctgggtggggtggagttgagtggcctgtggaggttctcagagggagagggtgtggtgggagccggcagcaaggacacctgtttgggattccgctgcatcggctgatgtgcgagaaggaagggctggatttgaaggtttccaggtagaacggcagagggagagggtgtggcgggagccggcagcaaggacagctgtttgggattccgctgcatcggctgac

SEQ ID NO: 136023 - DNA, 1824 bp, Homo sapiens
attgttttgagttgccaggctgtcgaatggccaggagtttgtttctgtccattgctgagaagtgtcccattgtgtggctgccccacagtcttatctgtccattcatccgtccatgggctttgggctctttccagccttggctgctagaaattaagtggccgtgaacatttgtgtgcaaatcttttttgaacaggtgcttccctagatcttggttaggtatctgggagtggaatggctgagtagagtggcgtgtgttcagctcttcaggaagctgccaagctgttttccaagcactcgtcctgttttaggtccagacaacacacaagcattccagttcccctctgtccacgccagcacttgttagggttagtctttttaattccagtggatctgtgggtgtgcagtggtgttttactgtagtttcaatgctgttacctaatgagtaatgagattgtacattttagccttcatttagtttttttgaaacgtgtctgttcacatcttttgctcacttttaaaatctggttgtttttcttctcattgggttaaaagagtttttaacatattctggagacaagtcttttatcaggtggatgttttgcatgtatttgtacctagtctctgacctgccttttcattttcctaatgctgtatttagaagagcaaacgtttttaaggttttcttgaagtccaagttacgagttattttacttggggggttcatgcttttgtgctctaagaaatctttgacagacccaggtcacagaggttttgtcccttgttttcttcttggcatctgcaggctccgcgcttgcctgtcggttcattttgcactgatgtttgagtgagctgtggcgcaggccccttcttggcagtgggtgtgcagctgccataggcactgctgcttgagttgatttttctccacctgttgacattcagtgtgtgggctgttcctggacattctggtctgtttcatttatttatttgtttatccttataccagtgtcaccgagtggcagcactttgttcttattcacagtgattttggctaatctagattccccaatgtagagtacctctgttaactggatgttggggaggcgtcatcccctgaaaagagagggttgcgggagacctggggcgtgaggcagtcaccatggaggctcctggcgtttgagggtggaggacgtgtgagccccccgggagctgcatgtggtgcttcagttacgtttctcttcacctcagtttattgattcagatcataacaccagatgtggcttttactgttggccaacaaaagcattttagagccaagactaaaagttgtttttggggtagagatttcatctttgtcatcttggctgtaatgtgcaaaatgtgtgcttttaaatattcacagaggagtttgaattttatttctttatgaattttttatttaaatcttcttttcgtttaaaactatacaaagtgtactcctgttcttcaagttgatgatggtgatttctcaaaggtggttgacttttcctgtctgtctaagatctaggtggagcatgtggcttgaatgaaaagactggttaccatacctctctgtgctagtgttcatttatttccagtcattgaaataagattggtgactagtccctagaagcttggctgtgaaatgtgaccatctgcccttggccggagttagatattacctggtacaggtacacactttcataggcctcctcagtgaatgcccttgtgattacaaacacccaattttatatatctttctccggccctcctgggaagtgtggacaggctggcctggccaccactcgt

SEQ ID NO: 136024 - DNA, 1107 bp, Homo sapiens
gcctccctggatttcagccaggacgcccgggaggtcattgctttctctctgacacagatttgcctgcaacatggcaccttgggccatctctttagctactttacatctgatctttcaaatctgcaagttagatttttctgttttatttaaaaataatctacaacatatgactaccatgtttttatctgtttctttgatcatttgatagcttttatgtagttggtgtagttacagagaaagatgtgctgacatgttggtgcctttgtttttgtctatacagcttctctcctcccccatgaatattatgtctaaaagggggaattagcaaaataatatgcgggagagaaaatgatagtgaaactggaatggtctaaaccatagtgggtttcaacttgtggttttgaatggattaattagaagtagtccatttcctggggccccagccttgctgccctgtgcgtctgggtgggtgcggccgcctgggtgcgtggtgtctgatgtgtgtgcctttcatacctaggttctgagtcgtataagtcatctgcaggaagcgctgagcagacggcaccaggagacagcacagggtacatggaagtttctctggactccctggatctccgagtcaaaggaattctgtcttcacaagcagaaggtgaatgtggtggtgtaacttagaccgggcaccatcttggtcctttgtcttctgggctccttcctctgtattagcatgatgccccttggtggacactagtagaagatcgggttaactgcatcacttccagctgaggtgtagacaggatggggtgcgtttgctgtgtcccggtgttcaagtgaagaaagagacattacggaaaccctctaagagtcaactggcgaagcccaagcatggcccagcgtggcggtcatctccctccgtgggtcaggcgtgctccgtggaggattgcccacggccagacgccctccctggtggcatctcaggacacacggggacgtactgttgaataaggtgtctctgattggctgaaatatgtccctggtcagtgttgagctgagagttctgacatacgttctgtaatggaatattcgtatttagtgtatttttgtacc

SEQ ID NO: 136025 - DNA, 1013 bp, Homo sapiens
ggtagacaggttggttgttcctacttttctgttattgcaaaagctgggtccttctagatacatgtttgtgcacttaattatatcttcaagtggagtcttaagaatatgtatttgtaattgattcatgtctccaagttgcttgctgtgaagtttggacagaactcacagtgatggtgtgtcatctctgcagaccccacagataccagctttgcagtgtgccagaccgaatacgaagaatgtcagaggcttatgttgaatttctttgtgtaatttcctttggggggcatttgtagttcttctttagtgaaatgccactcaattatttgcttatttttgggggggctacttcttgttttcttattggctatcagagaactttccgtagcaaacctgtaaggctttgtctggtgtgctgcagagtgcctggcatcctgggtgccctcattgcttccacctccacaggcgccttcaagtcctggtcctctcagaatcctccagtgaccatgttccccagtcaggccccagactctgtgtcctgctccttgccttgtgtgcaggttcctctggctgccccagaatccttggggctcccacagattcattgtaccgctgcccactgctggcctgtgatggcctggactgtcctgccaggtatacgttcatgtttcctggatacccagcccagaacccctctcaccccagaaccttccttgacttctgccagagttgagcagccggccctctggtaggcgcatgtgagtggatgtgggcacatgtggcccactggatctggtggatgtggtcgcgtctggccccctggatctggtgggtgtgggcacgcctggctccctggatctggtgagtgtggtcgcgtctgaccccctggatctggtgggtgtgggcacgcctggccccctggatctggtgggtgtgggcacgcctgccccctggatctggtgggtatggtcgcgcctggccccctggatctggtggatgtggtcgcgtctggcccc

SEQ ID NO: 136026 - DNA, 1049 bp, Homo sapiens
gcgtctggccccctggatctggtggatgtggtcgcgcctggccccctggatctggtgggtgtgggcacgcctgccccctggatctggtgggtatggtcgcgcctggccccctggatctggtggatgtggtcgcgtctggccccctggatctggtgggtgtgggcacgcctggccccctggatctggtgggtgtggtcgcgcctggcccactggacctgctcatgtgccgctgcctcctgcagtttgtgcagatgatgggcgtttccttctctgggctccctgtttgtcccccgtgctgaggcgtgtagcaggtgctcgataagtgcttgcaaagccaagctggccttgcagggctcggctcagtcagcccacacctgctgagcagctcttgtgtgcctgcactgcccagcgcctggtgggagggaatgccggcctctcgtgactctgacattgaccaccagtcttgtctgattgcagttgggccggtgcacaaacagcgtggtcaagtatgagctgatgcgcccctccaacaaggccccgctcctcgtgctgtgtgaagaccaccggggccgcatggtgaagcaccagtgctgtcctggctgtggctacttctgcacagcggtaagagcccagtccggcagcctctgagtcctccgcaggctttgctgtctgctcactggtgctggttcctgtcctgtgtccacctgctgtcgggtggtccagcagctggcccaggtctggtgtccgtctggaggtctccagtgttcacaagcccctcaccacccctgtcgagccccagtgccttagacaccttcacccccaacccccatttccctcctaccgcctggaaaccgcttttggagatgactaggacggtgtgacctgggcttccaggccagaggagggaagtgagggttgggggtgaaggtgtctaaggcactggggctcgagagcagtggtgaggggcttgtgacgcactggagactccaggtggaggctgtactgaggacgttcatcccccatgacaagggtgtactgaggacattcac

SEQ ID NO: 136027 - DNA, 1864 bp, Homo sapiens
ggtgtttgaagtcagccatgggtcactgtgcgcctccaggcctcagccttctgacctctgacccttggtctgtggaccctgcgttctctttggggaagcccagctccttccggtcaaagtctcctgagcctctcacttgcccctctgttttgtggttttttgttttgttttgttttgtttttgtaacagagttcacttttgttgcccaggctggagtgcagtggtgcaatctgggctcactgcaacctctgcctcccaggttcaagcaactctcctgcctcagcctcctgcgtagctgggattacaggcgccaggcaccacgcctggttaatttttgtatttttagtagagatggggtttcaccatgttggccaggctggtctcgaacgcctgacctcaggtgatccacctgccttggcctcccaaagtgctgggatgacaggcgtgagctgccgtgcccggcctctccacccccttagccgttatgagttagcctcattttccatatagaccattctagggctgtttaaacattccttatttaattgtgttacttttggtttttaattactaatagtaaaaacaatactattttcaacgttttttcataatgtttatgttataaattaaatactaggtctttgtcatctaagaagtttttcctcatggagaaaaggtttcaacagccaaacagctgattggcttttagcacacaaccaattttaaagtcgagggcttcttaagtttcagaccaagaaaaatttacctgccagttaattggtctttcaagtttctccgtttgtttggaaaaatggaaactgttccggaatgcatgctactggaaatcaggattttccacttattttggcgagtactaaatcagtgagaggatgctgtgtggcctggcagggtgaaccggcacctccctcctgcctcctctctgctgaggggcccctccctcccccttctttgtctgctttagaaggttgtcactgtcctcctcatttctaaaggtgttgtcacactcctgagctataaacatttactatcaaattaccttagaagtggaatgaaatctagcagaaatattctgcttagactaaaggtttgataataatagaataattatgtctttgaatacgtgtttagaaaactcagacattgttggtcactgaaacagtgcagctctctttttttgagtgtggaagcttgtaagtcacttctccccaggcggtggctaccgtcacagccctcccatacacctgaactgttgtttcactaggcgggcgctaatattgacacctgctcagaagaccagaggaccccgttgatggaagcagccgaaaacaaccatctggaagcagtgaagtacctcatcaaggctggggccctggtggatcccaaggtatgttcccctgtcagaatcaacgtcctagtgtgtgtgtagacgtttctcagaaagctgagcaagggacatccttactgacatctccaggacttggggccttcacacactgacccagttgtccagaaatagttccttcatctcactttggttacctggtttattattaaaaactactagtgagtgctcactctctacagagcctgacaacagacaggtgagcgaatgacgggtttgctgtgcagaaggtgttcgccttacagtacatcgtctcaccctgtcttcagcccagagcaattaggcaagaaaaagaaatcaaaggcgttcacattggaaaggaagaagtaaaactgcctctgttcacagatgacatgtttttatatgtagaaaatcctaaagaatatgcaaaaatattgtaagctaacaaaaccaattcagcaaaacaggataaaaaattaa

SEQ ID NO: 136028 - DNA, 1047 bp, Homo sapiens
gaaggaggagcagaacctgctacagcccagacttcctgccagccaaggctgctggtgcgctccgggtctggcctgggcttacgaagtttcagctcccgtgtgtgtgccattagactcgttgcacgcagctgtgttggtgcgtccccagtgagtggtgcccaactgggagcgggcaaggccgacagcacagggcatgtcgggcagggttgttgggcctgggccagtcctggttctgccttcatcctgcgcttgtggagctacctgggctgtgctctgaggaagaactgtggcctctgaaggttgcattcaggtcctgagtgagacgcctgcacgaggggcatggtacctgggaggtgcagagacctcggcgtgggagtcctcattgctctggtggttgccggtctctggagcgatgacagctttgtcctcttccctggcaggatgacggaggctggacacccatgatctgggccacagagtacaagcacgtggacctcgtgaagctgctgctgtccaagggctctgacatcaacatccgagacaacgtaagttcgtcacaccctccccgggagccgtgtcctggaggggtggggacctcctcccccagaaggttcttttctcaaaagcagaaccctggcacctggtggcggctttgacctcttcctgtggcagcatcggcccggcactgtgctgtggctgtcctgtgctggatgcagatgggggatgtgaggtcccagcagaggccaccctctagggatctgcgggttcagagggcgctgcactgccctggtctccctcctgctgcctcacggggctgtgcctgggcctgaggctactgaccctggtgcgggtgccacagcacctctggctctccctttgtttttgtttttgtttcttttatggatggagtctcgctctgtcgcccaggctagagtgcagtggcgtaatcttggctcactgcaacctctgcctcctgggttcaagtgattctcatgcctccgcctccccagtagctgggattacaggtgtgtgccaccgtgtctggct

SEQ ID NO: 136029 - DNA, 1035 bp, Homo sapiens
ttttaaaaatacatgaaagaaaagtgcctccaagtgttaatatgttgagtgtaggttgatataattctggatgaccttttccctatttttattctttactgtgattatgctacttttataattatgttatttttacaatgaaacaaacaaaacatgaaacgaagtgccttccagagttgagatgggcgctaggttcccatccggtgacctgtggcaccctttccacctggccctgctgcggacggccacgcatgctccagagcctctccccgggcacatgggctgcagctgctgtggcccagccccagcactgtgagccagcaggaagcctgcactgagctctggcttgtgtctgttcaggaggagaacatttgcctgcactgggcggcgttctccggctgcgtggacatagccgagatcctgctggctgccaagtgcgacctccacgccgtgaacatccacggagactcgccactgcacattgccgcccgggagaaccgctacgactgtgtcgtgtgagtgcagtgcttcccccagcgcgggctggcgctgacctgacctgggcgcccagagagaccgcttgacagtcttgtgttcacacttggggcgtgagtggacacaggccctctgttccttcgtgtggaagtccatccttggtgttccacacgcagagaagtgtctttcccagtccacgtttgagatcagctgtggtttatttctgggttagggaggattgtcatgaaaaaattcccaagttggagtctcagacctgatactcctcacatggctgaggggcagcatgggaacagccctgctcccagcagggacctgccagctcagagtccccgagaggctcagggtgccttctgggagcagtgccacccacagccagggctggagttgctgggggctgtggcactcgccactcagggcccttttaaaacttgagaccttcagctgggtggtggtggctcacgcctgtaatcccagcactttgggaggctgaggcaggcagatcacctgaggtcaggagtt

SEQ ID NO: 136030 - DNA, 1024 bp, Homo sapiens
ggctgctggggaaggacagggaactgtgggtgctccaggcaccagcctccagtgactccctggcccctacacatggggctgtgccctcccacatgtggatctcacggtggctcagccaggttggtcatctggttgtgtgaagcccagctccacgtacgatgactgcagtctggatgcagtgagcaggagtggaactgaggactgctcacgctgtgcgtggcccaagcttggcctctctccctccttgcttcccttcttatccttgagggtaaatttgaatgaaaaatccaagaaaaatcaaatgccgccctggattttacactcttcctgctaagaaaacagcctgctgactttgacagtgaatgtgggagaggaggaagggaatcatgttcctgggtgagctaaagcccgtctttgcagagtcattgctgagcagacttgttcaagttatctcacagtgaatagtgttccctttattgttagtgatgacggacattttataaatctcatctgtatcacattttcaagtcagctttaaatgttttgtggccttacattttcccttttagcctctttctttctcgggattcagatgtcaccttaaagaacaaggaaggagagacgcccctgcagtgtgcgagcctcaactctcaggtgtggagcgctctgcagatgagcaaggctctgcaggactcggcccccgacaggcccagccccgtggagaggatagtgagcaggtgagcccagccccaggacggctttgtggcaaatcagcggtcagcagggctttgggaacttgcggtgaaagctgctcctgaagccgaaacatccccaggctgcagtccaaattgtcagggccaggtgtttgccagccgccccactgcacgctgtgccaccccctgggcagagcacgtcagccaccaggtgacacctgtcctttccatggcagggacatcgctcgaggctacgagcgcatccccatcccctgtgtcaacgccgtggacagcgagccatgccccagcaa

SEQ ID NO: 136031 - DNA, 1033 bp, Homo sapiens
cagcctccgagtgcatgcagcctggtgccctcactgcttgcgccttctcgagcactttccttgtggctctgcttgtgggcagctccctcctcttcccaggccgggcactgcccaggcccccccccccccccgccccccgccccacaaggtgtgtcaggctctgtgttcttgcctttcccatcgagcatctggccacaaatgcagccgccgcccagcccttcacccaccccacgtcacccactgccgcgtcgctgccctgcctgccccctgtccctctgtcagggtcctcagccagagctccctcccacaggcactcgacatgtttctgcctgcacagccttctccctaagaggccacacactcacgtggtgcctttgagaagcacttaccagaatcagggttaacagaactggaagacgtagttgtgactgggaggggaaatggaaggcctgtgcctgcacgtctgaccccccggcgcctctcttctcagtactgcgtgtgcatcgacgactgctcctccagcaactgcatgtgcggccagctcagcatgcgctgctggtacgacaaggtgagggcggcctcgtgtgcgtgggctcaggtggtaagtgccgctggtccgggtctgcaaaaacagtgcaggcgtctgtgaccccagcgctgtcgtggcagcgtcgggaaggagttggaggtgagctgggtgtgacaggcaggggaggcacagcgggcaccagcacccgagtcagggtcgtgagccgaggacatggctgcggattccctggggctggggtctgcatcctttgtggctgcctggatggtggcgggggtgggcagcgtcagcctggcttggccccaggaggaggtgctgcttatgttgtgtgtatctggtaagctgtgccttgtgcttgctgagtgtgaggggtgtgaagagggagggtgctgccgggctgggtacagggagcatcagtgtgggcgctgggcttgaggagacacaggattggaagtttctgttgggtgctggtcctcggaggagccc

SEQ ID NO: 136032 - DNA, 1203 bp, Homo sapiens
tccgcgcgccagagacgctgggagtccgcactggcatcaccttctgagtttctgatgctgatttgtcgttgcgaagtttctcgtttcttcctctgacctccgaggtccccgctgcaccacggggttgctctgttctcctgtccggcccagactcttctgtgtggcgccgccgaagccaccgttagcgcgagctgctccgttcgccctgcccacggcctgcgtggctggggccgagtcccaggggccgcacggagggcacagtctcctgtcaggctcggagaggtcaggagaccgaccccaccactaactttggagaaaatgtgggtttgctttttaaaggaatcctatatctagtcctatatatcaaacctctaactgacgtttcttttcgaggaagtggcttggtgggtgcagcccccgccggttccgttgacgctggcaccttctgttgattttttaagccacatgctatgatgaataaactgatttattttctaccattactgaacattaggacaaacacaaaataaaaaacaaaacacagacaacggtgctgattctggtgtggtttctactcaccacgtgaaataaactatcaactgtataaagagaacaaagtgattttagaataaaatgcaggaaaaacttttttaaagatgttagtcttgtagcgtgaataaatttgccatcaccttttgtgtggtggcctggcaggtcatatacttttttttggcatatacctttttaaagactgtaattagtgcagtaacagtggggttttttttgtgcaactcttctaaaaacattcataatgcagtcatgtttatttttttctgttaaaatgtttttgacagttttaagagcagtcttttggctctgaccatttcttgttctgtttccaatgaaatcaataaaaaaaaagaagtactttaaatggggtttttattatgacaccatatttcagggtctctgcagaacttgcaggtccccctggacccggcccagctctctgtcccctgtccaaggaagtacagcttccttttcaccccagatctgtccccgaagaggggacgttccaggcagaggttaggggagcctgtgcatttgcgcacgtgtcgaatgagtctgtgtgtgtccacgaatgcatcgtgcacgtggtgcgaatgcgggcacactggtgtgtgtgtgtgtgtgtgtgtgttt

SEQ ID NO: 136033 - DNA, 1047 bp, Homo sapiens
gggcacagtgtagacggtagggaaggagagtgggagccggaagcagtgatccaggtgggagtggtgagggtttgtaccagggagtggcgctggagaacggggcaggtgggctctgacacccagaaaaggtagagcccacgggaagccccgtggtgcctccggagtctgtcacccatcggcgcaggtgcctttccccttccgtgccccagccagtctcacgtgcatccacgctcccagtcctgtccccacgtcactgcctctgccctcccgggcccctcaggaagcccctgtcaagcctctggccctgtggggctggttgcacctgggggtcagggacatgggcagggcccccagaaccccaaagccctgcgcgtccccacccctgttgtggctccagcctggtgctaccctccatggcccttggggacatcagagaaacacatcctggctcaggcaggtggctctccgggggagctttccaaccacggcttcttgttttagtctaaattaaactgggatttctttccaggacatgtaattagagcccagctttctccctggacccggcctcctgtgggttgaagagagggtgtgtgggtgtgtggccgctgcaccaggagggagtctggtcagcggagctcaggggccgaggcactgctgaccctgagcttcctgggcaaccactgtggcctcctgttcttttgggctttgtggacgcaggccgattcagatggtggcaggcacttctcagggagaagccaggcccagctcagggccccacagagggtccccatgggcaaggagggtccacccaggggagcagcagcccatgtgcaagtgtgcggctcagggatgacctgacgctgtgtctgaaaacaggtgacagcccagagacgctgccttcccgcaaggcgacctgacgctgtgtctgaacacaggtgacagcccagagacgctgccttcccgcaaggcgacctgacgctgtgtctgaacacaggtgacagcccagagacgctgccttcccacaaggcgacctgacactgtgtc

SEQ ID NO: 136034 - DNA, 1047 bp, Homo sapiens
tggcttgacacagacggtgccagaacatgcctcagaagggcaccctagcgtgtcgcatgcagtgctgtgcgtatcctgggcctcaggtgacagctgcttgaagggacactaaggtgggcctcaggtgacactgcttaaagggacatgtcttcctggttctctgctgggtcagcctcatcctcacatgaatttctgaacactggcagcctgcagagtcacactgacactcacacacacacacatactcacaaatacatataggcaagcacacacacaggcacacagactcacatacacacttatacacaagtacacacagacacacagtcacagaagcacacacagaatcatacacacagactcacacagacacacacacacagacccaccctcacaacactcacaatctcacacattcagttataatcatcccacactgtcaatcacatacacacataatctcacacattcacacacagtctcacacacacagtgtcacactcacacaccctctcacacacatgcctgtttgaagccagagcctgtgggcaagtaagctggtttgactgcccacaaaggcacagagagcttggccttgagaaggaggggctgcagcccacctggccctcccctgggaagttaattggagggaaatggctgtaaagggagctttggtttctttctgttggttttagaaaagcctttgaaagtcacttggaaatggctggagctgcatccaaaaggaaggtgggttggcgtgtggcttgatttgccctggaggtgtcctggtggcccagaggcgcctgggttgcagcctggggagccctggggctggaaccagagtggggtccaggtgcttgccgggaagtcaggtgggttcggcagcagggaccaggcggcatctccggaaagggcaccctcgcctcctttgttagcctacgctgccccatctcgagggccgggagacggtgcggtcagcctcccgccgcagggtgcgggggcaccctcgcctcctttgttagtctatgctgccccatcttgagggcc

SEQ ID NO: 136035 - DNA, 1054 bp, Homo sapiens
tccaggcattacagggtttgctgtctcacttcagtctcacttttctgcatgtgtggaattggttctcaacttctctttcaccctgaggtctcggctggtgcccgtctgacggacgcgtctgcggcctcctgtccagatgcacatggcagcctgcgcctacactggcgtggctctcagtgtcactggttctctcagaactctgtctctggttttctcacttctgtctgttctgttttttgcatgtgcagttttgtaaagcaagctcgaggtactgtatctcgcagctcatctgtctccagcgtgaactcaccgtgagtcgctctgctacgatattccatccatggcttcatgataactacatgcagacaccttccttccactcctaactctgctatctcaccgcaagtcatttgcttcatggggcagctccaggccgggcttctgtggcctgagcggggaatggtgggcttgctccctgatgtccccaagtcctgccacggggtcagaccctctgcgctcagcgcctcctcctttccctcctggtctctgtctttttgtctgctgcctgttgtgtccgctcactccggtgtctcgagtgtgtctgcttctcctgagtggactgggcgtcatgggttcaggtctccttgtggttcccatgaggtcagggccctgtgagcaggcacagcagagagtgctctttaggggctcactggggacgtttatgggtcctcctaggccccttacttgggagggactgtgtctgtgattctcaggaagtccttgttctagcaagagcagagagctgttgtccacttgggaagctcacagtagaccacccagggcccaaggcagagacacggaaactccagggtggccctccagggagtgactggctggcatcccctcgggcagcttctcatggggaagtgctcatggatggctggtccgcaggggcttcccctggagggcaaggccaggccctgcaggtgaggggtccctgaagtggtcaggtgcagttaggccacctgccctgatggaagtggccaggtgcagt

SEQ ID NO: 136036 - DNA, 1014 bp, Homo sapiens
aaggacagagacaggggccaggggaggtgcaggctgacttaagacaccatgcagagaggcccggcacgcagattcagagacctaggggatacctccagagaggaacttggtggtgctggccgagtgagggcagatgcagacagtctctggtgacgttagggctgacagtggcagataggcccggaaggaacaggccaggtggaaccagtggggctgcggggggcgggcaggtgccctagcgtaggctgctcagcatgttgctctgcctgggtggtcacgggggagcctgccagcctgacagcgccctcagcccagcagacagcctggcctttccctgctccaggtgtttcctgggcgagaaggagccacacctgaatgcaagggtgagggcagagctatatggtctggagcccaccccaccttcacacagaccctgtgcctctgcatgttccccatggtcctcactgcctgtctttttggaactgcaatgctggtccccaagattcacggcttcatcagagcgggccaccctgctgaccaagtggctcagagcccaggcccctctcgggcactggagtggactgggaggcttgaggcagtgaacagcctccgccctcacagggctcctgtgcctggtgcaagcccctggggctgccttctgttttacaccactcagcactgttggcagtagagcccttttgtcttggtcccagctggggttggtgggtcttctgtgggtcagttgtagggcacccctgggagcaggggcagcacagtttaaatgcatcagggatacaggtcagggcctggggcttcaactgaggctgggggtctgcagacggcccctacaggtagccctgcctgcccccaccccacccaagctcccaggtgagacacagacaccacacttccgctttcattcgtgcaaagtgctgcccctggacattgctcccactgcagcctggacttctacaaaggggcaggatttattgttcacctgcctggggtgggccg

SEQ ID NO: 136037 - DNA, 1046 bp, Homo sapiens
ccttctttctgtttgctttgggcttcttttgctcttcttttctagtttcttggggtaggagcttagattgttgatttgagtctttccttcttttctgctgcaaacatttagctctgtaagtttccctcttggcagctgcattccacaggttttcatattgtatattttttcagtcccgtttaaaaaatttcctttgagaagactcatggactgtttagaagtgtgttgtttagtttccaaacatttggagatttgcctatttctctgttattaacttctagtttgattactttatggtcagagaacatgttctgtattatttcagttcttttaagtttgttaaggttcgtggcccaggatgtgggatatcttgatgtatgttctgtgagcctttgaagggaacatgcattctgtgttgttgatgtgcattcctataagcattgtttagatcctgttggttgatgatgttattgagtatctttgtctacattcggattttctgtctagatatgtcaattgttgagaaaaggatattcagtctccagctgtaaatgtggatttatctttgctcctttcagtactgtaagtttttgcgtcatgtgtttgcagttctgtttttgggcacatacacatttaggatttctatgtctttttggtggactggccctttaattgttgtgtaacgtccttctctgtacctggtaatcttctttgctctgcagtctactttatcttatgtagatatgttcagtcctgccttcttttgattaatatgtgcatggtatatattttttcaaccttttgctttcaacctaactatatagttatatttgaagtaaatttcttgtagatagtattcatgttttcaatccactctgtcaattctgtcttttattttgcatatttagattgtttacacttagcataattattgatatattagggcttaagtctgttattttatttcttattttgtttttctctttctgtttttcatttctctggtttcctttttctcccttcctgtgggttacttgaatgtactt

SEQ ID NO: 136038 - DNA, 1048 bp, Homo sapiens
gcttcctggtgttttgactgctgaatggagcttcatcaggcctgttctggtcacccctgtgtcccccagtgtccagcacatgcctggcagggtaggtgctcagtaatgttgaacaagcgagtcgggcaaatgggactggagcaaaaggcgagcacgtggcagtgtgtggagtgtgtccccgtgcagcgtgttcacgtggagcgtgttcacatgcaccctgggagcctggacagggcacacaccccgcacaggccccagagaactttcctagggcaagagaggcctgctctccgtgagaatgttgacgctgaaattcttcctctctgagcaactccctccctgctgcccacagctgacctcttctgtgaaagggctgggtagttgatgctgttggctttggactgctgttggctgcatggacagttggtagtgaatggatgtagctgtactccagtgaagttttattcacacaaacaggtctccctatctggcctgtgagctttggtttgttgacccctgccatgaggttctgcagccttccccaccccccgtcccgggaggccctctcaggaatctcagccactgtccgtcacctggctgccaccaccaaccacagggaccattagcaaagcgaagctctggggccacagcttcctgaggcagcccagagccctttctgcgggacgggctgagcctgccctgtggcaaggggtggcgcgcccggctggggggccttgtggtgatccgtgccttccctcacaggctccgccgcttctgccactacatcgtgaccatgaggtacttcgaggtggtcattctcgtggtcatcgccttgagcagcatcgccctggctgctgaggacccagtgcgcacagactcgcccaggaacaacgtgagtggcccggatggccgggtccccgccaggctgtggcgggggagctgggtgccttcccaggggcccaaggggctggggtggggctgaggtcctgtcgtctcacagggcacccctccttcctctgtctgtgtgcctggcagtgcacgaccaaag

SEQ ID NO: 136039 - DNA, 1013 bp, Homo sapiens
gacacagcaccagtcttgtgtgtcaaggaagctggcggtggagcctctctgtggtcaggggcctgagggccttgcagggccctggaatgcctgggggccacctgggcctcagtggtcctcaggtttccatcccgtaggtgccctgcctggtcctctctcctggctcccttcacatcctttcctgcttccggcccctccctgtggctccacctcttgtcatggctccactcctcccctcatggccccaccccccaccatggctccacccctctcatcatggcaccacccttcccctcatggccccaccctcccaccatggctccacccctttcctcatggccccacccattcccttacggccatgccctcccaccttggcttcaccccctcatcgtggctccacccctccccgtgaccctacccttccccctcatggccccactctcccaccatgattccaccccctcatcatggctccacccctcctcctgcaggctgtgtttgactgtgtggtgaactccctgaagaatgtcctcaacatcttgattgtctacatgctcttcatgttcatatttgccgtcattgcggtgcagctcttcaaagggaagtttttctactgcacagatgaatccaaggagctggagagggactgcaggtaaactgaggcagggtgcaaggtgggacacacagccccatgatgcagacaacactgggagttcccttgggaccaggtggagctggtcacacggcgtgggagactccactgcagagcatcacggaccctgcctgagggccgaggaggggcttgcttgagaagggctagagtcaccacagaagacaggatgcatcccctccccagcaccacaccagggacccccagcacttcctcctcagcagagtcaggaaccaggcatgttctgagggacacagacatccagggagctcaaggtgcccactgggcaaggctttctctaagccctagagatcttggctgggctgtaaggtcagagggg

SEQ ID NO: 136040 - DNA, 1072 bp, Homo sapiens
ttgtaaattgaatgatacaatatgtggtcttttgtgagtagcttctttcgtgtgatgttttcaggtttgtccacgcagtggcttgtgtcagagccttgttccttgttacggctgaatatgtgttctgtgctgtgccacattttccttattctttcatttgctgatgaacattgggttgtttctaccttgtggctgttataaatgatgctgttgtatacatttatgtccacatttttgtgtgggtctgtttttgcttctcatgggtgtgtacctaaaagtggaattaatgagtgattgggtaactctgtgtttaactgtttgaggaaatgccagactgtttccaaagtggctaaagcattgtatattcccaccagcaatgcatgagggttctgaattccccatatccttgccaacacttgtggttttccatctttttagttttggtattttttaaactacagccatcatcatgggcatgaagtggtgtctcgtggtggtttttatttgcctttccctgatgatgagtggtgttgagcagcgtttcatgtgcttaatagccatttgtatatcttctttggaggagtgtctattcagatcctttacccattttttatttgggttttttttttttttttttttgagacggagtctcgctctgttgcccaggctggagtgcagtggcgcgatctcggctcactgcaggctccacctcccgggttcacgccattctcctgcctcagcctcccgagtagctgggactataggcgcccgccaccacgcccggctaattatttttgtatttttagtagagacgggggttcaccatgttagccaggatggtctccatctcctgacctcgtgatccgcccgcctcggcctcccaaagtgctgggattacaggcgtgagccaccgcgcccggccttttttatttattagaatagttatttacatattctaaatacaactcccttatcagacagaggattaggaaataagtatttttcccattctgtggatttgtctctttacgttctcggcgtcctctgagcacagaagtgtccgatttgatgc

SEQ ID NO: 136041 - DNA, 1027 bp, Homo sapiens
gcagcgtaggtcgcacctcagagctatccctgctggaaagggagctgcaacgtgtttgcctctgcaccctccgcacggcattaggctgagggctgcacctggggtgtcaattctcagatgcttccagctccctgagtgtgccacgagtgctgcacccaagctgttagggctgaagggacgtctgacaccatcagaggagaacctgctggagcaccaggctccttcctgttctgcccacacttcacattgggttcactgtgctcattctttaggatggtgctggtcatggtctctgggagacagagcggagctccgtctgctgtgctggtccaagcagagctggtgttcatcatcccgttccccccaccctttctagagcccctgagctgatgttcatcatcccgtccccaccaccctttctagagcccctgtcctgtggccagccttctgctgcactggttgctggcctggtgggatgacccagaccctcagccctgcgcatcccaagtccctacttgttgccgttctttttccaaccctggctgccgtggtaatccagtcgcagtgaagactgcgcacaggagcgtgttcataggagcatggagaaaggcccagtgaagcccctgattcccagaattatgcagtggcagctctgcccttcacagtaatgagggtcagatgatctggctggcatggaaactctttgtgatgcctgctggccttctggcacgagcagccccaagtgaccaggtggccaccatggctttggtgttgtgtggtagaagccttctccacctgtttgaaccagggcctctagatttgccagacctaaaattggggaagatgagcgcagagttcatactgggtttctggagcgatggtgagacaggccccttcttctttcaccatttcctccatccatacattttactgattgggcacccagtaccatcgattggccgttggttcatcttgaaatatggcaccccaaccccatgaagtgtatcaccaagccggcattttatct

SEQ ID NO: 136042 - DNA, 1076 bp, Homo sapiens
cggtcggttatcctgttagtctggcagccgcgctgaaggacaggcctgacccgcggcgggggttacatgctactggggaaaactgcctgagaatgtgagcaggagcgcatcggatccttgcgctgggcaaacttggcttgcataatttagattttctttattttagaaagaacacattgtcagctatttgggaaaaagcatttaaaaaaacataaagcagtgtcccagttataaatctttggcatctgaccacttttccaacagcagggacggaagagggacccgagtgttaatttgttatcgaaggtgccggtgtttcaaaggttcacggaaaactgatttctaaactctatttcagggattgaagagttctcttgctttaaaatttgcagagatctgatgctgtttaaataaatacatctttttttcctgctttggtctgtggatgtacaagagcacatacgttactgatctttgtggatgtgtcatagttcataaatttgcagccagattccagattttgggctgagtacaattactgacccatttgcatttcttactgtggaaaagtcagttaaaatggctaaaaagcccgttgtactattgcatatgttttaagaagacattttcccatgatctgtcagacctgttaccaacataatgcctgctttggagtcgctgatgatcccacttgaaaacacttcctgtgttacgtgtggcagaggcctcacaaacttagctcggggccgttcttgtgagtgtttcggacttgcatctgtggacaggttcagagctggagccggcacatgtgtagctacggagagggcgtctatactgggaatgcacactggcctctcccgggtgggagttctctggtgtggggcagtcgcccatctcacgtggggtccttgtacggctcgcacgccctctctggctcggtccacctggcgcggctcctgcagacccagcagggtccgtgccattgctcttctccattgcaggtgtttgggaatattgccctggatgatgacaccagcatcaaccgccacaacaacttccggacgtttttgcaagcc

SEQ ID NO: 136043 - DNA, 1053 bp, Homo sapiens
cactggcttcccctcagcaggcctttctggttcttcccctctctctgctcctcttttccaaaggctcttgatatctgccccagtctcagaacaggctgaagggaagccctgagggagatcatcctgggagccctgggccaggccggcctctgctgcctcgtctgtgctccctggcgacagcttgggagcctccggtgaggctccaggcagaggtctgggaggacagaggtgcctagcaggggctctcttgaagtgcgggcctccagctttccacctgcgcccttgttgattacagggattggtgggatcgagggcagtagggcaacagggggaactgaccagcagagtttgtagctactcagtggcccaaggaacccaactgaccagaactgccgatctgaacacacctttattttccaccatctctcatgggagctgccgttccctgggctcctggatccagccaagccaagtaacaggcagaacctggaggggccaagaggccatggcacaagcttcggggccttctgagatctcctggtggagatgtgccaggagaggcctcagcatcagctgctgttcctgggcgcggaacaggagctatgggccatcctggtttgagagtgaacttgggagcagaagggaggtgggtgaacatgttttcctgcctcctgagtctcccacagtttatcactcacgagcctaggacagaaggaaggagctcttttagggatttgccatttcagtccatgtgtgcaaatgcactgggctgctgtacagcccaccctgcctgcagatgcgcgctggggcgagctcagacccagacctgctttgctgagctgcctggagagacctcttagactcttgtttctttgcataacataagcaagcacccttaggctgacactgtccccagatgatgttgtttggctgggctttagctgctgcgttaattttatctcatcatttattactattctgcctcatgccgcggaagacttaaggcaaacctatgaagtcagccttagttttgaggcctttggtctcacagct

SEQ ID NO: 136044 - DNA, 1522 bp, Homo sapiens
gtgaccacatgtgcactctgtgcatgtgtacatgtgtgttgtgcacgcatgcacacagatgtctacatgtgtgttttgtgcacatgtgcatgcacaaggcgcgcacgtgtgtgcatgttgacgtttgtgtgtgcacatatgattgtatatatgtgtgcctgtgtgtatatgtgtgcaagtgaactgaatgtgcgtgcatgcctgtgtggttgtatgtggatgtgtgtatgaatgacatgtgcacctgtgtgtgcatatgcccatgtgtgcatgtgtgtgcctgtggatgtgcacatgcccgtgtgtgcctgtggtgtgcacgtgtctgtggtgtgcacgtgcctgtgtgtgcatgtgcctttgtgtgtgtgccaccgtggtgcgtatgtgcctgtgtgtgcctgtgggtgtgcacgtgcctgtggtgtactcgtgcctgtggtgtgcatgtgcctgtggtgtgcatgtgcctgtggtgcgcatgtgcctgtgtgggtgtgcatgtgtgtgcctgtgggtgtgcacatgtctgtggtgtacacgtgcctgtggtgcgcatgtgcctgtgtcggtggattctgaaggcacgaaactgttcaccctggtgctgcttttcccagccttcctattgttgttgcttcaaccctgtggtgtgaagcctggtgacttgagaggagaattgcagtcacacttcttgcagcaatctggctgctcatttctgtgtccacccatctgtctaataacatctcctgggcatctgccatgtgctggggcaggggcccaaaggtgaaacaggcacatgctgtcagaacactcagccaggcttggcagtgagaccacatggtgactgtagctcaaggccagggcatttctgaggaaggagaggccatgtctggcctgaagaatgagaggaggtgccatttgagctgaacttaaaggaataggaaggattgagcactagagaaataggatggattgagctggggatgggaggtggggcagagggaagagggaggccaggtggcttctgtcaggctggagaggagagtgcattgcagaggggctgcaaggaaggctgagaccgtttgagaaaggcattgaaattggttgaacaagtcgctttgattttgcgttgtagacagtgggctcagtccttgcatcgaggagtgatggtgtcaggcccacactttccacctgggcttgatgggcagggacagctggggagggtggggggtctcacgtgtgtccagccccccgtggtggtcccttggctgccacaaccttagcaaacatctttggtgaggccgaggtggggcttcctgtttcttcccttttacagaaggaaattcaacatgatttggagctgattggaccgagggggctacactgtaggagagaggagcattggtggtgatccaaggatgccagcctacgatgagaggaggtccttagctggaccagggcttccaggggaggacacagagtgttcagggagacagggtcagtcaggaggcaaatgggt

SEQ ID NO: 136045 - DNA, 1102 bp, Homo sapiens
tgccccaaggttaggttttggctgtacagcttcagggctccctgtttagttttctggtttgtttcagatcttctccacctttttagcctctagcctcacttggaagcaaatctgaccgtgaggaaagctgatgtctctgccgtggttctcagccactgcctcatctgccacctgaccccgcctgccagctcttctggcagggtggaccagctcttttctgattggcattcactgtgatttttaaaagagtaaaatcagaaattatcaacccaaagccgccccgatgcagcccttcctcacccctccatgttcattagctcagacgccacccccgcccactgccccgcgtggggctggagtgaggaggtgaggctcgggggtggggggccaggagggggtcaagccaagcagagaaatccctcattttatttattttgattttgggctttgaatccgacactttgattaactggctctgttttcttgtctgcttcctccctgcccctaccccgctcccctccccgctcccctcctgctgccgctcctcctgtggaccaccccactgtgccctggcctcgctgggacgggtttccagtgggcgcatcagttacaatgacatgtttgagatgctgaaacacatgtccccgcctctggggctggggaagaaatgccctgctcgagttgcttacaaggtagaccctgaccctgcaacccgccccccaggaggctgtgtgtgcttgctgaggggtgcttgctggctctcccagctcctctccctttcagggtgcccggctgtctgtctgccgctctgctgtgcgcccccggctgcctcactgtgtctttctcttcagccccatcccagcttccttcccagacagagggatgtggccaccatgatgtctcactggcctcttgtccccacaacctgagctgccccctttgagagccccctggaggctcaggaagacagaactagaccctcctccctgccttttctccctcccttcctttcctaggaatgaggggacagaccacttgtttgacagagattgtttttgttctgggctcagaacaaagccctaagcccctggtatggatggag

SEQ ID NO: 136046 - DNA, 1018 bp, Homo sapiens
ccagggactttctaggctccatggtggggaagaggcactgtggcactgagaaggaaaggggtgctggggagaggcatcttgctattattcctggggcctcagagggctgctggaggatggggatggcctcggggcccaggagtcatgggatgctgagttgccaagaagggggtaaatcgagggatgcctccaggcctccctcctgggtgggcaagcagatcacatggcccagccctaaaactgttccatctgcccagctgtccccagtcccacctcataccctccatgtgtaagcaccttcgttcccccagcacccacccacctactcaagagccctcctgaggcccccactgctctccggcaaacggcctgtggttcagccaacacgtgcctagagcttttctgatcctccctgaggaagactttcctgagtctgtctgaggaagcttcctgccagagctttcctctctggtgctgtggacagctgttgtccacactggctctgtgccctgactctaggtctttgtcacccgactcagtgcagcctgtgggagccaagtggctcctccaagccatcctcagcccctgccctgcccctgcattgtgcctgcctgggggttctgcatgcaaggctgtagctttgtccccaagaaggagagctctgtccacacttggcgccggggcaagcaggcagggccatgatggagcagcctttggagccccacccagctgtgctggctgactccaaggttctgggcatggagagaccaagggaggcctcagggtgggggcagaagggccagatgagctgaggagggtccaggagatgcccagagcactgcaccttggagggcccagggcagagacacctgtttgtttgccctggccttgcctcttggcttcttcctgagattcttggccctttggggcctggagtgggctgatggcacccctggggagggcagccctccagtgccctgggcggagctcttccttcttgtaaatcacctgcctgctc

SEQ ID NO: 136047 - DNA, 1015 bp, Homo sapiens
gggagacgtgagggagcgcaggaaggtgcccaactccatcttgtgggagacgtgagggagcgccgggaggtgcccaactcctccttgtgggagacgtgagggagcgcaggaaggtgcccaactcctccttgtgggagacgtgagggagcgcaggaaggtgcccaactccatcttgctttctggggaggagacacaggaagggccctgcattaagcaggtggggatggcctcagcccggtcttgagaggcctcaggaggagtcagggcagtcaggagggccaggtcagcatctggaggagccctaggtaggccaaactcctggtggccgagccccatgttctgcctgagagccctctgtcccagtgcatttccaggagtctttgtggggggcgagggaggggcggctgtttcctcaccttacttccataccttgtttccgtggatcctctgcccccttctccgaatctcaactcctgtgttcttttccagctgatgagatgacagtggggaaggtttatgcagctctgatgatattcgacttctacaagcagaacaaaaccaccagagaccagatgcagcaggctcctggaggcctctcccaggtagctggcggccctcagttttccaggaaaactgtgatgcctccgaggctctggcatccttcggggggttgacgacgggggagatgcacaccattcttggaaaaagtatctcagaaggaagatgaaagattcttgcagctacctctctggcccccagagtcagaaactacacacagcctttatgctttccatgagctggcggtactgggcagctcctgacatagaaagtcagcactcagggccagaagttgagggctgggctgggcagtgtcatggttgttatggggtggaagagaagaagatgtgaagaccatttgaggaggattgtttggagaggtgaaaggagaactgttttcccttcacacagagagcaaagaaattcagataggtacaggatcattgtctgttctgct

SEQ ID NO: 136048 - DNA, 1094 bp, Homo sapiens
tatcacttaactcttgccacaatatttccgggtaacaaatcacccagaagcaggtgacttacaagaaccatcactttttcccactgtggcccagaaaagtgtgctcccaaatctcaggacccagatcctgggggctgactcccgagccgctggcagccccccattcccacactgctttcagcatgctgttgaaaaccttccttgcatttaaagtcctgattctgactgtatgtgcaggtgggaggagatagtgaggtgtctggggtttatctaagccaggctttcagcaggaaattgagcttctgttatttctgtgatggtagtttctacctaaatcaattacaactccaagtcagagagcacccactcagactgggtctggtgagggtatttattgagccatttagtgagcgggttgagcacacctctggccttggacgtggtgttatttcagggttagcggtgcattaggagccagctccggttctcctaaccacccctcctctcagcaccagcctgccactgcggccgctctgtgcctggtgccagcaggggctgcagtgccccagacagcatggaaggagagctgcttgcaactctcagaagacaaaggatggggcttctcagaagccccagcaaccaccagtgtgtccttctgccatctctgcgtccactgctgtggtcagggtgtggtccatttagactatcaggctccagtctgagctcagagtgatcagtgccactcaacctgcatgactaagaacgtagtcttcagtgtttcactgaatgtgagaatgagcactcacccgaacacattccacgccagttgggagataagtgatgagaaataccagtgcggaagtatctccgggtggggctgttggggcaggcgtatggggagcatgtgtggggtggcctccgccagaaggctgcaccccagcagagagccgagggatggaagggctcattgtggcttggggggggggtcagagaagtaaggaggagccaccagcaagggacccctgagggaggaagcccctagaggaggaagcccaaagagtcccgggcgaggccccctaccccccgtcccagcc

SEQ ID NO: 136049 - DNA, 1100 bp, Homo sapiens
gagcggggccggtcccaggagcggaggcagccctcatcctcctcctcggagaagcagcgcttctactcctgcgaccgctttgggggccgtgagcccccgaagcccaagccctccctcagcagccacccaacgtcgccaacagctggccaggagccgggaccccacccacaggtaagaggaataggtggagaggtcagggcccagctgcctctcctcggcccagcacccctgtcccacaggctcctgcctctccccagggcctcgctgctgccctttgtcattcccagcaacccaagggccgggcgctcccctctgtgccctgtcccggagcccacgtctgcagcctaccccagctgtgttctcatcaagctcctgcctgggtcaccctgggacagtggttctgcgtcctatccactttcggacctgggcccccaaatacttacctctctctcggtcacttaactctccttccctgactgtggtcgttgggcttttgttctgtccttttccctggccccagcctgtcccttcccatcacctgctctccccaaccccattcctgggcctgaccctgaccatcgccctcccccgcacacaggtgcctgttgcctccctggtcaccgcagcccgttgtcccccattgcctccctctctcctcccatccccccaggcacctgtgtgtgatgtgctctgtctgttggttcggcttttttttttttttttttacctctgatttgttctggtccattttcatgtagggcagtggttccgtgaatgggagccccttgctgtcaacatctggtgctagcacccccggccgcggtgggcggaggcagctcccccagacgcccctgactccccgccccagcatcacctacaagacggccaactcctcacccatccacttcgccggggctcagaccagcctccctgccttctccccaggccggctcagccgtgggctttccgaacacaacgccctgctgcagagagaccccctcagccagcccctggcccctggctctcgaattggctctgacccttacctggggcagcgtctggacagtgaggcctctgtccacgccctgcctgaggacact

SEQ ID NO: 136050 - DNA, 1149 bp, Homo sapiens
atccacccgtgtacaccacaatgtccccttcgtctgcaccgtcctcctgtctacactggcaccactgccccatctataccaccacccgtctatacaatccacccatctgtctacaccatcgcctctcctctgtctacaccatccttctgtcaacaccggcaccactgccgtatctatatccacccatctacaccatcacctcccctgtgtctacaccatcctcccatccacaccagcaccaccaccccacctacaccatcccaccatctacgccattgccaaatctacacagacgacctcactcccatccacgccttcacacgcacacccgtccacaccaccatctcccccgtgtccgcacggcggccccgctccatcggcccgagaacagcgacggtggctttgtcccacgcgtcgggtctggcccggggtgcccgaggagctcagggaccgtgtagcccggggtgcggccccccagagggtgccgtggtctccatttggagggcctggctgcggcgctaggagttgggacgcagggatctctgcagcgccctgacctccacgccctcctaggaaagaccacgctgatcaaggcactgacgggcgatgccgccatccagccacgggaccagctgtttgccacgctggacgtcacggcccacgcgggcacgctgccctcacgcatgaccgtcctgtacgtggacaccatcggcttcctctcccagctgccgcacggcctcatcgagtccttctccgccaccctggaagacgtggcccactcggtgagcgtgggacggccggggatcgggtgctcggacacccattcggcacgggggctgggcactcagacacacacagccaggggtcgggccctcggacacccactcagcccaggggccgggccctcggacacccactcagcccaggggccaggccctcggacacccactgggcacggggaccaggcactcagacacacacaaagccaggggccgggccctcagacacccacccaactcggggccggaacaacaactgcctcctggggctcagacttagtgtcccccaagcctcccacgtccccgggcgagaggctgagcggttgccccagcctcaccgacactcagggccatgttcttgccgccgtga

SEQ ID NO: 136051 - DNA, 1398 bp, Homo sapiens
ttatttgtctatgcccatacattaacacctgtctacacccataatctaacatccatctgcacccatatactaacacctgtctacatccatctacacccatatattaatacctgtctacatccatctacacccatatcctaacatctctctatacctacatattaacatctgtctacacctgtattccaacacttatccatatccatattgtaatatctgtctgcaaccatatcctaacatctatctataactacatattaacatctttctatacctatatgctaacatatatctatatccatatttaataccatatggtaacactgtttacacccatgtatcagccccgatgtacacccatatcctaacatctgtctctaagcacatcgtaacatctgtatgtacgtgcattcgaacacctatctgtacccatatattaacatccgtctttacccatgtgctgatatctgtgtgctccatgtcccgacatctgtccccagctattactgtctgtctgtacacacattttggtatctagctgcatctgtaccccaacacctagctgacggcgtaccccctgccctgccttggcggggccctgagcatgtgctgtctgtccccgcaggttctggacgtggcatgacgagcgcttcctctacatgctcatggagtacgtgccgggcggcgagctcttcagctacctgcgcaaccgggggcgcttctccagcaccacggggctcttctactctgcagagatcatctgtgccatcgagtacctgcactccaaagagatcgtctacagggacttgaagccagagaacatcctgctggatagggatggccacattaagctcacggactttgggttcgccaagaagctggtagacaggtaagaggaacgtgaactccgatggaatctacactgcttggcaatgagaaaggtggtggtagttgtggcaggtcaggcagggaaagattgggaaccagagtttaactctcatgtgtaggagacacttgcaaccagggatgagagagccaggttgacccacagctcgttttaggtgggctgcgattgctggcaaagagccagtgggcaggaagtcagtctccttcactggcaccgtggaggaaatcagaacaccacatatccgctattgatccgaaatgatgaggaaatgagtcatatccaagtttgaattgccctgactataaaatagatctgcatcgaataggatacaatatctcttaaaattaaatgccaggtgctgtggctcacacctgtaatcccagcactttgggacgccgaggtgggagaatcatttgagcccaggagtttgagaccactgtggacaacctagtgagaccccgtctctacagaaatatatatatttaaaaaaa

SEQ ID NO: 136052 - DNA, 1030 bp, Homo sapiens
ctctgtttttggaatttcttgaggtagttgaattagaagcacttggtttttcaattatagtcttataagtcaggaaaacccctttcagtgcattgctttgtacattgataatacgaagcagcatcaccggcatctttgagaagcttctggaaggtgtgagggacttgtagaaggtatgcaacacctgtacaggggactcccagatttcttgggaattccattctgttctgcaccgtgggatagatgataaaatagcttgttttaaagccactaagtacagatgcccttggaggctgattttatgaattcaaatgaccaggggcatagaataatggttaagggtgtaggctttgggatcagacttcccaggttcaaactcttatcctgcctcatactagctggatgaactggctgaaatttcctactgtctctgagcctcagtttccttattgtgaaaaagaggataacagtactaatcccaacataggattacatgagcaatcctagttggataactgaatgcttagaaccattgtctggtcgtaggaaatgctcaacagaaaaaattttttaaaggtacgcaaaaaagccactttgtgccatgtttcttttcccttgatgtaaataatgaaaaattaaatccagatacacaagaaagcaggatagtcacttactaaatttttttccttatttttacaagatgttttcttgtgggattagagggtagacttttcaaagaggaggtggcactgcggttggagaaacatctggctgaaggagggacaaatagacattttatttgggtaattactcagaatatagaaggcagttttctgtgcttgagaaattccctgctatggtgagagaaccttcttaatttttgttttaaattttattatgcatgacaggctggattctctttaggggtcttctggatattgggtttgctcatataatttcacacgaactgagttattccacttatctgtgagcaaatctcatacatttgattttatgaatataatttggg

SEQ ID NO: 136053 - DNA, 1049 bp, Homo sapiens
ggtatcaagatcctcatgcctaagagccccattaagcaggacgcagtgaatggctttcagagtgagagctccaaaaaactggaccccacagagcagggtcaggaggaatggtagtacccaaagtggcagcggaaaagccagacaaagctttattgggccctggtactgagcaggccaggatggggagcaagcctggatacacctgctagtgcctcaggtgcatggccccgtaagtgcagccatggccacaggcctactcgttaacaggaaagctacatctacattcatggatgcattaacagccagtgggacaaccaacatacagacatctgttacagcagtaactgtcagcaaaaggaaatttattgacaacagaagagaacagccttttaacaaacgattgcatttcagtgtgaggcaaacagaaagtgcctaaggatacagagttattgtggccgggacaaaagatggcttcacccacatcttattcactagatcaacagggaataactcagtaaatacagctgtaatgaaaaaagtctaccagctctgacaaccactgctgattacagcaagcttgtactgctcagcgcctttaacagtgtcttctgttgtggacttgactttatttattttatgcagtgtttgacagatgacagaaaaagagaaagcattaaaatgggagaacctatcagaaacgtcgtgaataatctatggccatatcactctgaaagtgacagaaaaaaagaaagtgttaaataggcagaagctaacagaaacttcgtgaataatccctggccataccacccgaaataggcacgatttcttcggatatcagaagctaagcagtatctgccctgtatagtgcatggacacaaggaactttgtgaatactattactccgttcaaaaaacctgttactgaagtaaaagaagttatctgaaacatcatgaataatctatgaccatacgaccctgaatatgatacaaaaagagaaagcattaaaatggcagaagagaagctaccagaaacgtcgtacataatctacg

SEQ ID NO: 136054 - DNA, 1058 bp, Homo sapiens
aatgccgaccatgattaatgctcatcagaatctatgtagacctccatttgtcctttgataagctgaaatatttgtgtctactttttaaaaaacctgttgcttctctttatggtaatactcagaaggcactcactgtgaagagaggagaaacaggaagtagaattttttactatctagattgatgcacctatctcccctctccagagaccaatgcatttaggccccagtaagaaatttagttgtaatgaaccataaagcagatgcagagtatatttgggaatataccttatctgactccacagcccaacccctttaagaggaaagagatggcacaatatattttgctttaagccttagactggtcttgacttcatattggaaccactgaattgcttcagctgtgaactggaatcctctcctgtctttgttgttgagtgatgacactcttaattaatcatttgcttatttgccatccaaatcaccctatataatctttcagaagtgtatctcagagaatgaccctaagtcggctgacctctgaagcctgtaccagaattgactttatttcttaagcgcacacttcctgtgctttcaaggggcagctgtctaggtttagtttctgggagtttgaggcacagaggtatgtaggggaatgggaaggccaaatggtaaaagcccctgggacgtggaatctgtgagtacactaaccttgaaagagattatgaaaacaaactttagagcattgttgaagcaccatctacataatttatatcaatgaagacagtaacttattaggaagacaggattattaaaattaaccattttcatctttctacaaaaataaaaatcaaatcaattttagttcagataattgtatgtgaagctttataagtgaaaatttgaagttagcaaaattatataaccttagttaattatattagtgtactcaaactaaatatagaataagattagctcatggaaacattgcatttttatctcagtcagtactgctcatatccacccagtagttagtttctagttacgttttgtaatttttt

SEQ ID NO: 136055 - DNA, 1009 bp, Homo sapiens
ttggacaacaaatatatttttctgtatgggtttctggtggcccagatgttcattggagtggaaattctttctgtccacaccactgagttgggcagttactggtgtttggctttctctatctcttggagttgacttagatacattgtgtattcaggttgggcactcatcccctttgcaagctctattactttgttccatttggctttgccataaatgtttgcccttggcttgccaagacgtcagctttaagagatatgtcatttaacttagaactcttgagtctgacttaaaattaagtcagttttcttaaacattgttattgaggtataaatgacatgccacaaaagtcacctctttgaggtgtaccattcagggatttttggtaaatttactgggttgtgtagagatcaccatgatgcagttttagaacattttcaattcccaataagatcgctcctactcggttctcacccatttctgctcccacctccagccacgggccaccatgaatatccttcgtgtctctatagattccccttttgtggatattttagagttgtgcttccaagaatgagtatctctgtgcttggtcgaacttcccggatggtgagacctgatttagtgactttgccttccgccccttcatccccaggagaggaaggtggggaaaggggaaagacggcaagtatagtagtataacaggcatcgtgcctcagtttcctcatctgtaaaatcaggataaccatggactagtttcaggctctaaatgtgaaactctgtaggaagtaattagctgggaatctggcatagaggaggagctcattgtttgcgtgttaacagtgggaaatagttaaggaggtgggaaaagagctacctgtagaaaggtggcctaagtccctggagagctgagcacaggaccccagggcacacacccccttatgcttcccctgtctttcatcttgaaagcacctgcctgtgaacctcaggcttggagggaatctggatgttt

SEQ ID NO: 136056 - DNA, 1591 bp, Homo sapiens
ttctatctctatagccagcaccttaagaataaggtgtatgaaagccaaagggggtattgaaaccacctttgcaaaagttatatcagtgagagaatgatgacagtgaaagagatctgagctaatccaccccccatcttgcctttctcttaattattcatttcccttaattattgcatttcccttagttattccatctcccatgtggtgtggctggccttgtgtctgttaaactctttctctactaaaatgcccatggtctttatgcagccggcaggaagaacccctcaggcggttacagttttgctcccaggggacagttttggttgttataaatgaggaaggtgtgctcttggcatctagcaggtagaggccagggctggcctcctgaagtgcagaggaaggtcccctcctctttcaagagagttatccagccccaaaaggtcagcattgcagaaattaagaaaccctgacttagaagctttgcacctcgtggtagctgtaaatgaggtatttacatcctccatgaagacgtaaggaagttgaaggaataaaaatctcatggggctttgaaagcaatgcaagcatcttttagttttcatacattccatggaagtagggatttttttctaaagcaaaaagaccaacaagactttggagctcagtttagaagaaaaaagtgactttcaaaccctttagaagtattcatttacaaatgaacaatgaaatgactgtgtagatggagaaaccctgagcgccccttggctttgatctggtggtcacgttcatccgtgtctgttccctgaagaaccagtgcccacatttgcctgccttctttacctaactccccccaacaagagctgaccctcctcccatcttctcgcctggttggtctttttcctccctccccctgaagcctgcctgcctctgctttccaccctccgacaagccctgatctgtgctctgaacaaactcctatgcgggtctctttgaagtctttttgcctgcccctaagtgcatccctcccacccccacccaggtgatactgaatctatgtgaatttgtggagttctcccttccttcccctctggcagaatcaccaggattcagtctagagtacaacattatagatgttttctagcacttttcagctgtccatacgctaatatgtagtcttgggtctttatccgaatggagtcctattatatttgtttcacaccatctgctttccttatttttgtatctttactgaggtatattgaagtacagtaagctagacttgtatgaagtgtgcagttttaatctgttttttcttttttatttctttgtttgtttacatacattttttagagacaaggtctcactatgttgcccaggctggtctcaatctcctgggctcaagcaatcttcctgcctcagcctcctgagtagttgggactataggcgcatgccaccacacccggttaattttttattttttgtagagatgagggctccctatgttgcccaggctggtctcaaactcctgggctcaagtgatcctcctgccttggccttccaaagtgctaggattactacgggtgtgagccaccgt

SEQ ID NO: 136057 - DNA, 1054 bp, Homo sapiens
taatgttgcttatggtttgaagcatcaagctcgcatttttgtgtagtcgaacatgtcagtcttttctttgggcttctgggcatggcttccttccagcaaggggcagataccaagaataacttggagtaggtgaggcaggttttgatgttagcaaaactcaaaccatgacactcccccaaatgggagtctgccctcattgggcctaattgtgccctctgctgcagatgctgggatggccttctgatgggatggccgggctgtgttgtcagcacccgcccacatgagacgagtttgtagctgtgcctggtgccaagagctctgaggtgctactatgccccctggaacctttgggcaaagcatagctagtcatcaggcttgcctttcacaggcaaaccaaatccatcctttcttcatccccctgccctgccaaaatcaaccagtctcaaatcaattcacgaaagggggccaatttgcctttcgggtgtctgatctaacaagccttggagcagctaggaagctaccagaagatgtgtatgatcaatgtatttgttatttattttattttatttttttaagtttggggaaaggtaatacttttggtcaaccatctgaagggactccctcctctaggccagggcactccatagttaacctgaaaaactggttcagggcatgacaggaagggggtttgaacatgcttcattatgccctcctcccttttggaattcatgaacagccgacagcatttaacacagaccttaagtctgataagaaacagttacaatctattttctctgaagcctgctacctggaggcatcatctgcgtgataaaacctaggtctctacaaccccttatggtacctggacatttttttctattgataatagcttttttttttttattattgagacaagtgctgttgcccaggttggagtgtgatggcatgatcacagctcactgtagccttgacctcctgggctcaagcgatcctcccacctccgcctctctagcagctaggactacaggtgtgtgccaccacacctggttaattt

SEQ ID NO: 136058 - DNA, 1107 bp, Homo sapiens
ggtttctgcctctatggatttatctattctggacatttcatagatacagaatcatgtgatgtgtgaccttttgcgcctggattcttacttcatatttctgagtttcatccatgttgtagtatgtgttgttctagtttcttgtaaatgttctgtcaaaaccccaggtgattaaggaaggtggaacaatgttctgagataagtcagccagagacacaggctgctcctccctccaattacatttaaaatggaaaatcgttcacaaatggaacattgttcataaaattgtttatagttcagcttctattctagcatgaacggtaattttctctttcgcatttgctgtagttcctccaaatttctcccactttcctatacctaaaggtcaacgtagaaaacaattttcgtcagctagagctgggcctgcaggtctctcttgtgttgcatcttttgggtggagtcagaaggtcctttcttggtgtaagagttaggaagcttgcatttcccaaaggggttgtgtggtgttccttccagagctgaggttgtgggattccaagcagcaagacttaggctgttttctacggcgtccccaaagtcacaaccctgactgatgcaggaacagaatcataaggttgtttacttttctgaatttatcaaaccttttgtctgtgtttgaccaaaattacttttcccgggttgggttggagaatatggagggtgattttctgaaaccattcatgggacatgattttctggggcatctgtacctgcaatgaagggcttactgataagactgaaggccattgtactttactggttggtgttataattgatcatattcatttcttgtcctactgtgacaagtgactgcacatttactggcttaaacaaaaactattatcttacggttctgaaggccagaagtctgaaatgggtctcactgtgctaaaatcaaggtttagcagagccacaactttcctggaagctctaggggagaattggcttccttgccttttccagctcctggagactggccgcattcctgagcttgtggccccttcctccatctgcagaggagcagcgtagcacctctctgactgtccttccata

SEQ ID NO: 136059 - DNA, 1330 bp, Homo sapiens
ttacattgggcccatccggaagatccagaataatccccacatctcaagagacttaatttaatcacatttgtaaagtcccttttaccatataaggaaacatattctcaggtcccagggattcaggcatgagcatctttgggggccattattctgcctactacattgtcagtcttcaaggacagacttacttcctttgtttctgtctcttaatttgctcctctgaagcctgcaagattcataggcttatgtaacgtttgtgttttgtctctcgaataattgagaaatctggtactgttgagccatttggtttgtattgctcactcactgagtcgattgattggttggttgattgagtgattaatagagacagtctcattttgttgcccaggctggtctcaaactcctggtctcaagcgatcctccctccttggcctcccaaagtgctgggattgcaggtttgagccaccatgcttgccctcagtattgattccctctgaatgagccaggatttgctttccattttggagagcccctagattgctgaacagctcagagacacacttgtgtattgaggtcctctttcctgccactcttggttttggactttatcagggactctgccagagctacttttctggacttggagtctcagagtctgtgtcagctgtgggtaaggaatgagaccaccatgaagcaagcagaggtagcgggtggggcctggcttccaggactttgcagatgctgtgtgtggatttctggggcctgaatcaagagcccctgggtttgtggcttcacagaatggtggaggaagactggtggagttaagggacagaagactcaacaataattagcttgttaatcagcattttggctcaaaaatagtttgggagtatactggtcagctttctgccatgctaatgttgcataacaaacagcccccaaattcagaggcttaaatcgtttctttcttgctcactagtcatggttagctgtgtctctcctgggcttatatgggaataggaaggcctggtcaggttctgggctaggcttagggttgaaatgatgtgtctcctcatcaggggaccctggggcatgttgtttgtgcctctcccatcaggtataggaagccaagataaatcatgcaggcacatttaaagtctctgtttgtcactacccctaacatcccattgaccaaaacaagtcccatggtgaggtccagcctccacgggttggggagggctattctagtctgaaagccctgaaaagtcacatggcaaagggagcagccatagacttccactatgggaggatggaagagttagcattgcag

SEQ ID NO: 136060 - DNA, 1093 bp, Homo sapiens
catgtgcgtctgacataattaaaggccgacttagaccctatcagagaaaatcaagttcagacacttagtctaaatggaagtaaggaaaacgattacctttatctcattatcttagttctctttggaagatatataagcttgaaccatggtgacaggtgttgcctttaaacatggtgacaggtgttttcctttaaagtccttggcaaatcaactcatagacttcttcaacttcaaaaaaaaagtttttttaaaaaatattttaaaaatatttaacttgaggatcttcattgaaaattggtcatctttcgtgaatttgcttaagtaggctttgatctctttttaaaggattccttcctgcctgatacatttggtccttttagaattcgggctagaacaattctccatgaaggtggacgtgttaaaatctatttggttcattgttaggatcactcacattacaagagaaatttcggtcttgagtttttgtttttgcttatttgctttcttggaaatgtttccacatcaggtcttagaggagttgtaaaacaggaaggaggagttgacatgctgtttcataaccaatgcttgcttctcgccttggatactaacattttttccatccatttcccacataaaacatggagacaaacaccagagctgctcctgagaggtgctgagtcataggaattgaagggggctgttgggccctcgtgtgtgggatgggctcaagagctatcagtctacagagggaaaggttcatctctgtccctcattgcctgcagtttctctttggccctggctttttccgttcacagctgccctcgacgttcattttaatcaaatttcacctgcataaaagggctatgggcagagagtcttctctgtgatggagcgcagctatcctacaagtatgtagccctgatttagtagagaagaggcaggaattgtcgagggcggaggagcaggagaaatggtgcacaagggagaggggataatgacaggtcattcagggatgtctacggaatgtgaaaatgcagcaagatgggtttcggtttctttttttttaggtccgacagagattcctgggatagct

SEQ ID NO: 136061 - DNA, 1154 bp, Homo sapiens
cagtcagactgacgtgggtttcagtccctacccatcctagtggtgtgaccgagagcaagttgggcatagtgacatctgtcttgattgactttggagtttgacaggcagtacatgcaaagttctctattcccatgtcactcagagtgagtgtgcaaaacatactattgttggcatccatcgtcataagagtcactgtgaacatgggtgagcttagcaccttgtggcacggggctgtggtgagggactcagacagctttatgattgagtttgggcctcagcgagatggcaaagctatgcttctcttgctccttggaccatggtgacctgtgaggacccctgggggctgccttctccactgttgcagttcagggagctaaggccaaaggctactgcagtggtggactctggggtccccctggtgacaaggaagggactttgagctttggaatgccctgggctgagtcttgccacctgcaggtttgtgaacctcatcatgccttgtttttagcacaacaaaatgggataatagtgactttattattgatatactattatgctgttttcaggtatgtgacactgctgctattttactgtttcttccagatttccgtgagggtggaagaaaatcataccatatcagatgcctcgcagagcaccaggcccaccgtgaaaggtacagcaaattttacttccctcttcttgcctcgttggaaattctttcctgtgagatttcctcccctccgccctccgcgccttctgccatagcctatagcctcctctgggagttcttggataattttgttgccttatacctttgcaatttccagtatggtagccatgcgccacatgtggctgtggagtgcttgaaatgtggccagtctagattgagatgccttgtagaagtataaaatacacactggatttcaaagacttagttcaaaaagaaagaaagcaaggtatcttattgataatgtaatacagtttacatgttgaaatgatcacttggatacgtggagtaaaatagaatgtattattaaatgtaacttcacctgttttcttttgacatttttttgtggacccagaaaattgatagacaggtggatttccttcacacttacacacttgtcttgctcaagaccagccctgcttcctca

SEQ ID NO: 136062 - DNA, 1032 bp, Homo sapiens
atttttcattgcaaatgtacatttcagttacgttgtgggctttaaaaagcctttctaggctagttgggaatttgaccctattttttacagcatagtttctaggagaaaaacatttctgaggaagtaacaaaagaagacttgggctgtatcccatttttaatttagagagcactgtcatttgaaaatttcttctctcaacatgttttctttttgagacatgaagtaggcaggcaggatcttttttacagtggcgctggtgtctttgggaagcggcttccttggtttgcctttgctcattttctttcttgacttctccaggcattcagctgcaggcatgtacctctgctgctgggagagtggcaaggagagggggttggaggaacggggataaaaattagctagaattcaaaaacggcagtgacagcccagatgatttttcatgctaacctactttaaaagctgccagaataattgtggagtgggaaatctctcatttctcctgtcctactctgacaagatctaaaaataactttgaggagatgggcatgtggccctttgatctccttggcctggagtatttcttggtaggagcagagcttacaagaaggtgttcttcaatgagtgttctggcagtcggagttgtgggtggggctgattactgtaatcttccttcgtcattgaacgatttcatctgcccctggtttccattacttgctgctctaaatattcctctccccgcaccttccttttatgtagccacaaactggaatatgtgcatggaaaacccaaaggaggcaaatcccacttacactgcagaactttggtgctggatttagcggctatttaccaagcacctcctcttccagaataagtagcacagatctttgaccgccccccgccccccaccgagggactgtggtctagttggaagacacaaggcagaggtgtaaaaagggaactctggagataggaattggaaatggggctgagagctgaagagatggcctggggctagagaccagggagatggga

SEQ ID NO: 136063 - DNA, 1540 bp, Homo sapiens
ggatgatggttccttggaccagggtgtggtcaaggagctggagagatgggagtcagttacagacaagacagtgggatttattgggattcttgatttctctcagtggtgagaaatttcgtctttccacacaccttccatggaaacccggaacaccatgggtcccccgtaggcagtcttaagaggatagctgtttttgttctccttccaaattcccattagacttgaggtcagagtcacactttacttgttttgaatatttaaagtagtatacctaatagctcaatagactgtatgcttttatttttattttttgagcctgccttcctaggtatttggacaaatttctccataagagaagtgaacacgtaactctaacttgtaatagcaaataccgcgggaacactgggagccacatattaagatgttattagaccttccctggagtatccaaatggtctataattgcttaataaggagaagtttttgctgagatttacatgatagagatttgctttttaaaaagaaattatccagatttgaatggaaaaattgcatagtctcctgagtgttgttttgcctttgactttgtactgtttaagaactgattatgagcaggaggaaataactcacttcagctgtaatataaatgtgcattggtatttaagcatatgtgacacataaaacaataccaacttggccagaatttaaatgtttatgtaaattacatttttggacaggcactttcctctattttgcagagaaaataattttttcccaaagagattttgtgtttaaaaaaaaaacccctaatactactattaggagtgttagatgccttcgatgtggttttctttcctctttttgcctgaaaggcttgagtgctgaagcatctagcgctattcttgtgtccgggaacgttcctgcctcatttttgtttctagtcttgtttctttctgtgtcagaaataagactaatgcgtgcagctgcacctatagttcaagatgaaggggtctgtgtgagagagagaacgtctgtgcatgtgtgtatgtgtgtgagtgtgtgtgtgagagagaggagagacgggcgggggaggggagagagagagaaaagagagagagagaaaaaaaaacacagcctctttgtaatacctggttgactcagtgaagtctggctctctgagctttactgaattcctccttacttattttggggccggaggtggagatgagttcaaaagtagataaaatttgcctgttacctaaatgagcagaatagattgcgcataatcttttctagatgaagcctgtgtttttggcattctgctctcaagtcctctgagctgatctgagagtgaactggagtgttaagttgagagagatgttgatgactctggtgtggtcttttcctttcggagaagtggaggtgaaacgacttgcccggggtccctgggaagcagagcttgtgccaagatgtaatttttcggttctaagccctgtggtttttcttctgcagcaaggtgggtaccctttttctgtaaggg

SEQ ID NO: 136064 - DNA, 2201 bp, Homo sapiens
ggcatattgaaaaatgtgctcttacagataggtttcctctctctactgccccccgccccccaattttttttattgtggtaaaatacataaaacagaatttaccatcataaccatttctaagtacactgttcaacagcattaaatattcattacattgtgcaatcctcaccacgatccatctgcagaactttttcatcataccaaacagaaaactgccccattaaacacaaactccctattcttccctccccacagccccagcaaccaacgttctactttctctctctatgattttgacactctagggaccttttatatgtgggatcatatggtatttgtccttttgcgtctggcttagcacaagtttcatccatgtcatagcatgcgtcagaatttccttcctttttaaggctgtataatattccagtgtatggatggactacactctgtttatccactcatctgtcagaggacacatgggtggctttcaccttttggctgttgtggataatgctgctatgagcattggcatatgtttacttctcattgatttaagtttacatagtcatgtgtggctagtggctgctgtattagacaggacaaccctaggcctgatagccctgaggacctagtttgggtgggaagacaggggtgacctgcagcgagttgtcggctgggggccttggtgagagccagatctgggttgtgaggccactcgaggcagggggaatggtgtggcgggaagtgaggcccaaaatgagaatttcagagttgaaagctttggaagtaacatgatgctctatgactgtgaccagactcaactgcaccaatgtgcatctgagatcaggtcattggcgttgaaatcgtgaaatgctcactgcttgggacgtttgcactgtgcttgatgtctggaggttccgttaatgttaaaatagcaattatgggactggagattaggtttaatgtctgggttttttccactgtcttcaaaagcccgggtcttagtagtaaccatgctgctccccattttagtaatttcagcctggtttatgttgctcaatagcagaaaagcggttcagatttcctttggatatcatggaccatatgtttgcccaggtatcctttcttattgggaactatcaaatagttaacacagatttctccaagggcaccgactgggaaattagtttaccaaagataaatttggtaaaaggaaagtttttatgtgcgctatccttaaactaagacacatctgtcgaaatattaggacgtgcccagtctcccatcctctgctgaaactttagactgtacgtccttcagatatcttctctttggtgctttgtttgggaacagattagcctcatacttcctcgcttgtaaaactgctatcccatctcttgctcaatgcttttcttgtaccgaagggtgagggggaggttccagctctgttttctgtatcagtttcctgggtgatgtttgtttgagggtgccttgtgtccagagccccagaaggtgtttccgttctctgatgagcctgaagtctgcatgcttcgcctttggtagggaaaggcagctggggaaaggttgcatggcccagtgccagggtgccagagtgcgtgtgcacctgctggggagaagcccgctggggcccctcctctcagcacaagatgaggcctcagggcagtgcagcagatggagggcttagctgtccttgccagcaaaagctgctgggaacgtggcactcagataacaggacggttgagaagcggtgagttagggttactctgatggggagatactgagaggaggggatgacaatcttgatttctgttccctttgtgaatcttttggtggccaaaatgaggaaaaggatacattgtgtttgaggacaacaaggaacatctaggcacattgcatacttgattaaatgcacaaagagcttcttgtgacctttatcacaagagtgtggttctatgaaggtcgtaggtacaatagaaattgtgttggtctgagagttactcagattagggtgcattgtgtcaccaccattttgcatagctgtggcaccttgtcaagttaaccttttcctgcttgcttttcctaatcagaagaatgaagttgaccgtatgtactctataaggtggttgtgtgaggtcaatgagattacataggcaaaatcttggtgcaggggcacttggtaa

SEQ ID NO: 136065 - DNA, 1699 bp, Homo sapiens
gttgtggccagagccatacaagtgttctgatgcccctcaactgtgttgaaatttgtttgaggccaaccaagtcagctggcgagggggaaggcaagccagagagaaattgtgaaccagaaaggccccacctctggcagtggctcttccattggagatgaagtcttcttgccctgtttttctctttaaaaaagtgagccatttcacaagggaagttaaattaaaaactgtgcttgttagcgcggagctgggacaaccgagggaagtgatgccaaaggcaattgttggtctttccttcaaatatgtgctgacttaggaagagcaaaatgttttatattaacaattaacaaaagactaagtctttcatcacaaacaagtctaaattcagtggttaggtcagtattatattttcctatagttttaaataagatgcttatgtattcactagtgctttggatgttctttggaaaaatctccaatttagtgacaagccccaggaaatattactcttagttggtccagcatcctatattgtttgtgaaatccctcttttattgtcttttaaaggttgtaaaatgctttttctgtcaataatcagagaaggatgccgcattcatattaccccagtttccaactcaacctctcctttccaattgaaaacaaaagtcagaattcactttttgttgtggggcattaagtagtaagcaaagagatttcactcgccagggaaaagaaggagcctgcaaatcagacaatatcaaaacataaccaaaccatataaaaacacaaaaatgttgcttggcagaatttaactataattaattgtactaatttaatattgtagacacaaatgatcataaagccatatggtacaatccttttgttcatgaatttcttattcatcaaatgttaggtacgtgatgtgggaaagccagtatgttgggcttcgtgctaccagggctagagttgaccagttcagctttgtttctccagtgaccaaaaaaaaaaaaaggtatctgccttgcacatgaaaacactggatggttagattggatttagccaacaacaaactgcaaaaatcggttctggctaactgaagctcacagggtttattagagttgttggagcccatgggaactgatggagggcaaggaggcttgtcgtgcaggagcagcaggaaccaaggaagctttgcagagatgagaaacaaaaaacagggaacacagcaacatttgctgtgtcaggaacgactgccactggtggcctggacaccatcacagccgcagaagatacttaagacacatttctgttctagtgttggtagttcaagattcaaagtatgtgtgaaagtgagtgtgtgtgcataggcagagtagctaattggttgagttggggtccatgtgcccacctccaggttggaccaggggacaagccatgcagcgttttggtcacccctcacttggcagtattcccaccaggaatgaccctcgctaggatttgaggggcctggagtcactacttactaattttcttaaagttgacaacgatcacaaacttcatggtctgggaaaatgtgaattaattgcctgatccaccttcatatcttttttcttttcttttttctttttttttttttttaacaaaaatctgtatattcatagattgtctcttcctctgctagtggttttgcagtagcattttc

SEQ ID NO: 136066 - DNA, 1398 bp, Homo sapiens
cccagcattttcttttagaatgggggcatcagagttgaaggaggtaactgtgggtagtgtgtcttgtctttggaaattttcatcatgacctgagcttgtgaacactctgccttggccccgcctcgcactttggaagagactggagcaggagcgggcagcgttgccttcgcagcatggtaacttctctcagcgctgtttgtaaagcagaatgggagaggaaactccccagagggaaactgggaccctgttaggtagggctagcaagaggtggttaaaacgtaagcatccgctgcaccagactgtattctccacgactgtatattttttgttgttcataagagccccgaattgcaatgagtacgattttccctggacgctgcagtgtatggagaagctgtcacttgtcacatgacagctcagtcattcgatccctgggtgctgcagagagggaagaattggcctcgcagtggggagtgagtgccagcccgtggcctgtcccctgccacgtgtcaccatactgaacgtttgtgtgtgctctgtgtgttttcaaaacaccttcatgtcacctgccccggactcctccctgtgagcaaggcagggtgggcgttaccatccctctggaccaacaaggacagaacagcttgagacgcacagggtggcttccccatggctgcggaggcatagaaagtgagggcacgggacgtgaatccgtgtgctgggattctggccgcctgtgcctgccgatcaccctcagtgcctccctggatttgattttgtggctcttctgggtgtgcgtgtgagtgtgttgtgggtaagtctgttgtctaggggaaggaacgggaaatcatccggccaggaatctctgtggggtggtcggcttgagttggccatatccaagctctgcgtgtgtctcacttttcagagtagcaggaaggccgggtgactttgaaatcagatgggtattttcctgattcgaagagacttggcttcttcccccgcccctccttctccctcctcccccctcctccctcttgctggctcacaaactcaatggggcatcccagcccacccatgggaggccaggagaaagaggaggcagagctgtcagagtgtggcccttcgtcttgggggtgtgcaagtgaccgctcctgccccttgatggctctcctgtttcgggtataagggatgttgtccaaaccatgtgtgggactctctgttgacagttgtttttaaattgcctgtttaattgagcttctctaaagtcttctttgtgccaagtatcgggacaggtgatagaaatagaaaattcgacacaaatcgaaaattccagtatcaaaaatgacagcgatgtacccttgccccttaacgcagccaagaaacaggggtgaagggctactc

SEQ ID NO: 136067 - DNA, 1059 bp, Homo sapiens
tctcgctgtacagaattctgcgatgccttcacttgatggctgtttcttcggggataggagggctgggggtcaggatctgatctcacacgaatggttcagagtctggacttagtagctcagagcagttcactgatttgggatctctggaagaaaagggtactgagtcactggcaccttctgctcagctcctgacagcagtgtaaaggatgctttcgtgacacccagccttcagcccaggaggatggtggcagatcagacagctctggaaatgcagggcacaatgcgcagagggttgcaccacaacagcagtcactcggtgcccgcctggagcactgctctcatttccagagtccctgtatttctgatcttggctgctttaaaaaggaggtgtgggcctgggatcccagaagtattcctctgtgattctgtaccacagctttaccttaattgggggtgtagggggtggggagaaagaggaagacagatgaaagcagggaaatccttcttggagtcatagttaaaaggataaaataagagctttagtgtagcctccgtttccagcaatccattttattctttgtccacaaactgaatgaaaataagcagtcattcaaaaatgatatttacgtaacctacaaaaatctcaatcaaccaaggaaaaggtggaatggggcttaatacaatacagggctgtctccggagttccctcccttgatttcaggcttttggtgtaaagctcccgaaagaaagcaactttgatttttattagactcttcaaaatcatctcggtagaatattgaccttttttgtgtgtggaaaaatgacttctacgaattctcttgtaggagtgtacattttggtcattttttggaatgtaggaaaaaaaatgtggggtaccctttattgcattttcaagaccttccaaagaagataattctgattgtaactcattataatctgggaaagtagattgttctggtttcaaggactgcgtgtgctttaaataatcacaggctgctctcagacttgggaacttttggtagaatacagcagtgattc

SEQ ID NO: 136068 - DNA, 1651 bp, Homo sapiens
agaccagcctgggcaacatggcaagaccctgtctctctctaaaaaaaaaaaagccaggcatggtggtccacacctgtagtcccagctacttggaggctgaggtgggaggatcacttgagtccaggaggtcaagactgcagtgagccatgcgagtgctccagcctggatgacagaacaaaatcttgtctctataaaaagaaactggaaaaaaaaaaaagtagttctagaggtcataagttccaaatgggtcttattctgctaaaatcgaggcatctacagggtggtggtatttgctgaaggctcgagggttaagtttctggttttttgttttgttttgtgttttttgtttttgtttttgttttttttttgctttctcagtttctagaggctgcccatattccttagctcatggccccttcctccatctttaaagccagcactgcttgttcgagtctttttcacattgcatttcccctttcacattgaaagcactcttctgatgaaccacttctgttaaaaccactcttatgatccaagataatttacttttttaaaagatgaactgattagcagcctgaattccacctgtagccttcattcctccctgccatgcaacttaagttgttcatggtttctgggaatcaggatgtggacaccttgggtggggatggaccttaactctggctgccaccaatggcgcctggtcaaagtatcctgtaggatttattcttggaaacggcgttaaccccaacgccctactttgctggctgtgtaagaaacacgaggtcagtcaggcagtaagaggagcatggacttgttttctgaaacagcgacacaatccattacatattttcgaatgacgagatgagatcagacttctgctttaggaagagtcacagggttttgtggatttgcaggggaaacaggcggtcagagggagttctgtgtcaccgtccagaggctggggtgccaaggagggcagtggcagtgggcttgaagagatgcaatggggctgctttggggctgaggcgactggactggcgtctgattgatggaataccaggagagggatgggagagggaaagagatgagtccaggatgacagttggaaagtcctggacttcggagtaaagggtagcgattgaggagttaaagggtagaatcaggctggggagagcaaatttacttttgaaatagtgacctttggatgctggacagggagatatgaagcaggcagaggaaatatgggcatgaaatagagcttcagcattttctacaaagaagccaccacattcggtgacatgacaagggagtgatgccagagggaagagaggtacaagggcagaatgctggggaaatgcctgtgtttaatgggcgtggagaacccgcttaataaataatgagaatatattgctggactgaaacaaaagtcctcattagctcattaaatgtttcctggaattcccagtcaaatctgtgaaacaattttaatgctagatgttttgtaagtatttctccggaaatctggaaatttgtccacagacccccagacattgtttataaactgaagtcagttgactcaagtattttgcaaatgtctatggaccctagtgtgattaatagaaacacaaattattttaaaggtgtcact

SEQ ID NO: 136069 - DNA, 1964 bp, Homo sapiens
agttatctcataatgagggttattttaagaagtgtctcaaggaaatgtgtcgtgtgtttactgaggatagcgttgtatgtagtccacaatttcctctttctgggagaaattttgcacatgtatcagaagtctaggagctgtgtttctgatatttgcatcttctttattgtttagatactgtgaatccagcatctaactatagttccttctttgaggtctaggaaacttggaattggattgacaattcccttccaagtgatttcaggttgtatccgactgcgaactttggataccgccttcctgtctcagcttcgtctcctttgtcctaccatgatcttctcttggccccagtttacccagtgaattactttatttttgctattttgtatgtgtttttggaagccacccccagttttttctcttcttttcctgggtggggagttagaagtgttgcagtggatgatggtgctgtggctttttggaggttggtttgcagtagcttttgagttctggtgtgttagtgtcatcttattctaatctagctgcttcctgttgaagtacatcaagacgaagtatatttctaaatttattacgatgaatactctatcaaaagcagctggtgcttaggccctaggtagagctttaagataaagttctttaatatcaatttagaaaaagaaagattcataatgattaatggagctcctgcatcactgaattttactggaataaaaaaaattagtgggcttaaagttacattgaatgtagtggaaattctttttcttatctccattactgttggggaacaatttcatctaaaccccattgaaaactgggccttatagccttcagtatacttcataacatttgttggaaagcaggaaatgaaaacgaagtatttgaagtaaaagttcttaaatgtgtcccaagaaatgaggattactgcagaaagaatggatcagttatttctcgaattataagaaggaaatatctgcagccttttttgtcatcagtgcagcagccccggtttttctgttaatcatagctggtaataatgccctccggtttatagttttgatgagccgggagctaggctgcgtgttttacatataatatctctgttccatcagctgcataacctagatatccttcaccccatttttatgagactcatgggttcttgtctgggaccatgcacctagtaactgacaagattgcaaactagttatgtcacctgtggagttccacgacaaaggcaattctaggcgatgtttatgtagtgttccttgcatgccagggggattctgtgctctttccatgtgtgaatgatagcatccacctgctaactttgttgggagggttcagttatcctctctgtacaggtgagaacaggaggtactgaggacatctggcccaaggatactaccgctggcacggggtggatggtgattcgccctcagtccctctggcgcagcatctgtgctgtttgctgccaggccagctgcatcccagatagagtgacaggatctgttcgcgtcacatccagaaaaggctctgaggccaagctccctgcgttgcttctcactttcactctggaatcagaggtgcgtgcctggaggacttagctctgcatggacagctggtaaggtgtcacagagggtgaggtgggccattgtagcagagagttgttaagagttggttacgtgggttttctcacagggtacaaggctgaggaatgggaaaccagttaggagaccttgctaatagcgtggaccaaagatggggagtaggtccagacagattccgcagtgttcatgcagtgttcatgaagcaggtgtagacagattgcggggccattcatgaaggtgatttgccggggctttttacggatggaaaaccccttttctgtgttcatcccacctcctgttgtcgacagatgacacctgcacaatcaggtcctccca

SEQ ID NO: 136070 - DNA, 1536 bp, Homo sapiens
gattctgaaattgtggtgtctgtaacttaaacatcatctacaaaatcactgctctatctttggatgtgagtttgttctagcatgttatcacagtaccgaattccaaagaaactgctgtttacttaccaagggtaggctttcaactcagatgagtttatgactttatttacatggaatagtcaaaatggacttctgacatttgctgcaaagtaggacaacttaattgatattgatggatctactcatttattcagcagataacaaagcccttccgattgcaggtgttgtggagagagcaggatattcatttgctagggttgccataacaaagtttgatttgatttttggttggggatggaaactgtgtaggaggcaagcgtggagcttgatgtgagctccttgaaataatgaaaaaccagttacaaaatctgtattacctgtagcagtacacattctcccaaagcattctgttggcattttaaagtcctttaaaacacacagctgctttctgttgcttcaaactaaataaggcattatcttcacttttccttttgttaacctaaagaaaaaccttcatttgtaaagcaaatcatcacagcaggaggattttctggtttatgcactagggtgcatttaatctttattttacactgctgattaactttatgattcaaattttaacttatagtttctttttaaattaattacattattgggtgctttcatgtttttgctaaaagccttcctattagaagcactacaattgacagtgatggactgacctttaatatttttttgttatgtgaccagtgtttggtttataaaaatttttctctaaaacaccaacttttggctgcaaataccaccttttcacttgggttcttttcatagtgtttatttacatgggatattgtcactttgcacgctgtagctatttgtctttgtcagcaaatgtaggtaaaatattaatcttgtatgaaattcagataagcagggaacagatggatttatggtgcttgaaacctctgaactctgcagctgtggcaagttgttgaactgtaaataaattctggacggtggctagcaggggctggcgtgacctcatttgccccacaatacctcaccgtgccagggatgcatttcctgccctgtgccacctgtggtttggtcctagtgctttggggccgcagagtggagctgggctccctttgaggaagtcatcagtgctgagagccctcctcacgggtgagagtccagtgggatgtgtctgagcagcctacgctgggcatgggccggggcacgctgtgtcccaagcatgctttaggggtcccagtggcaaaagcacatttgtggttgtttaatctctggaggtggaggatagccccagctcctgggtcagtcagctggcggaacagggtaggccaggggagacagcactccaccctgctgggcatcttattaaatgcagcccagtatattcaatgccggcatcactacttcatgggaaaggatgcagcgcttacagcaggtagtggg

SEQ ID NO: 136071 - DNA, 1035 bp, Homo sapiens
gtttggtggagttaaaaacagattatctgtgtactatattaagttgggtgaggaatgatgaagtgtaaattatacttacataaatattataatgctgtgcagaaactcttaagctatcattcttttagaaaatgaattttatgagcttgggacctttttgttaaccaatctgagaaaagtctgttgtcagtgtggacatattttacctttaaatggaggaggggagagaatctttcaaaaacattaatatcagtgagattaatactaatctgtcaagatgacccagtgaacagttggctatcaaagtattataagaaggtttttaaaaggaaagtgtctattttgtaaagatcttgagtaaattatgcttttaagtatgttttgatattcccccccctcctcccaaagtgtagcatgcctgagcgctgtcatgtttaggaggtgatgggttggggttagagggtgattgactgttagcgaagtgggttgggatgaacaagtgcacttgagtacgcgctgcacagtgtaggcatcaggccacgtcagtgtgtctctgcatttgggcagatgccaggcctattgcaggcagcataacatctaggaacgggtttatggatgaacctgggtaactctgggagcacaaacccagaccacacccatcgggagagattgacctgagtgatgcgctaacgcatatcattgagatggggccagatatcttgcttagatgaataattggagttcatgtcaaccatctgtcctttcccataatttaaagccaacttctatattttccaggttcatactttttttttcattaattgcatgtaaagttgcggtgaacaccttctttcttgacttcctgtttaaaaaaattacagttcttaaaattataagcttattcaggatggagtggtcagtttgtagaaaaactagctctttagatcttttaaaagcactacattaaaaaaaaaaaaaaaaaaaaacatcggacgtggtgggtcacacctgtaatcccagcactttgggagtcca

SEQ ID NO: 136072 - DNA, 1051 bp, Homo sapiens
cttagaagaaaagtcagtaggtaaacagctatcgtgtaatctgatgaatacccaccggaggaagtattagtaattattctttgcttgccagggttttcataattcttttccaattataaaaattaatatgctgtaagcagtttttaaaaataaaagtaagcatgaaaagaaaaacatctataaacccacccctagaagttttgccccagcattttggtggtgtgttttcttccaggtgtgtgtgtgtgtgtgtgtgtgtgtgtgtgtgtgtgttgccccagcattttggtgtgttttcttccaggtaggggtgtgtgtgtgtgtgtgtgtgtcctgctgtattctgagctttgtagtatgccccttccacttgaccttctccaggaagcatttgatcatccagcaacatcgattgaaaatgtttgtatgcatctctttcatgaagtacatgttccatcatttatatcacatgtgttgctggagatttcaattgcttccattttcctttaggataaattgctggaaatagaactggagggctcttgagaccgattaccatattgctttcctgagaggctgtgcgggttgcgtggcagtgaggagggacgggggtaagtggaggggctggggcacaggcctctccaacacttcatgtgaacatggtcagctgagccaggaatgcgtgacatctttatttttccccttgcatttctttaattcctaacgaggtggaatatttgatcacatttgtcagctatttgcatttctttttccatgtattagacctaagcctctttgaaaggtgttatctcaggttctttccaatattgcactttctgagtttctcttgaatcccagttattttaaggattgcagtgttggagtttcagctgaaggggccatgtctgatgtttgctggtccattagcctcctggcctgagccaaaccatgcatcttcatgtcagagctgcatatgaaacaagagctaagtccagaaagcaagaagaagctagcagattgattttcctaggtggggcctaccagggcactt

SEQ ID NO: 136073 - DNA, 1002 bp, Homo sapiens
ttcgatttgccatcattgattagacgcatgcagtcacccagtgctgtttgcccaagcatctgtaggcggggattccccagtgctgattccccaatgcttgtaaggggcaggacttaattaaatcttaaagtgacagctgaaaatgtaagggtcaggaagtcatgtctaaaaggggatttagtataacaataataacagcagtgactaagactaatcctggctcaggcattttgtttggggtcacctggtcttaattagcagcactctgggatttgagtggcgctgtgctgttgcccacaaagcccatcagtggcaccattgcctgtgtctttcggggcagtctgttagggagggggtggcacaggtgttggcacggccatccccattttatatgtgagggaacctcagccaggcaggatccttgcctggatgctctgtggggagccctgtgagtttgtaaccctccgtgcagcctgccaggtcagcggccccaaaatggagagatacagagggcaccaaattgtaaggcagagcgttggctagtgacacaagctgcctttcgatcgcctgggcgttctgaagcccgcaaacattcgcctggaccttggtcaggtgtctcacagaacctacagtaattcactgttaagaataacttcaaacacagaaaatcgctttttgtttcctagagaaggctagtcttcagcgagaacaacttgtgatttttaatctgtttcacactggtcggggaggggggaagaaaagatgttatgggcatataattaaaaatttgtcggcagatacaattacaggaagaatcatgtggcctaaaaaactgaaagcctccatatgcctcttcatcttgccagctacagtccacaaattgtagagcctgcgggcactgtggaagccagctagatttgctctatccagtagcagcagattgagagccatacatggaatttatacttttctagcagccacaggaaaagagtacaaagaagc

SEQ ID NO: 136074 - DNA, 1004 bp, Homo sapiens
tctgaaattatgaaaatcaagtcatgggagatggataccctattccctacgatccacttatttcacattgcatgcctgtatcaaaacatctcatgtactccataaatatatacacttactatgtaaccgcaaaaattttaagaatatacaaaaaattttaaaaactgaattaaagagcattgtagataattgtatttttcaaaaaataagtaaaatatctggtatataacagttaaaaaaaaaactgtattatcaactctgtgaccttagaactacctttttacattttcaaagattaactctccttaaaaaaataaatgtacaaattattaccaaaaaaaaaaaagaaaatcaagtcataatgtgaaaaataatttttaagctgaaagttacactgtttctaggagttttaaactaggatagtttgtggttattaatctgtttggaagtagtccagaaaaaaatgctatgggtcaataacttgaaaatgtgcatgtggactacttaaagaggaatcgtgtggcctaaaaagtccctgttatccctccaccctgcagactccaataggagaatttccgctgctgcagactctccttggtggccaagctgcccagcactctcccgtcccaccaatggtgtgactcctatcactgagaaacagaccccttaccatttcatttccttttaattaatttaaatttaaaaatcaacacttccttggttactggaatgttgggaaccatgtgggtgtgtgcatctatattttccagggtctattttgttacctataataccagtcatgtatttccaatgaaaatttaacttgtgaattgagatatagtacaaatgtaaaatacatacactgtgatgatttaggaaatttagtaggaaaaaggaacgtaaaagatctcagtaattttttaaatagaatacaagttgaaatgatactattttggatacactgagtaaatcaaaatctatcatgaaaattaatttaaggctgg

SEQ ID NO: 136075 - DNA, 1074 bp, Homo sapiens
ctacaaaggacgcctctgtcctacctttcatgcccagctttgagtatatcctgtctcttgctcattaccgatgctgagttttagccctgtaaccagagtcctctttctttttccacagatgggactatgaactgtgttttaatgattagagggagtagtgaagattttcactgtgaacattttcaccccctttcccatccttggccagagatgatctcacatggtcttggcaggtatctttttacaggagtgcatgttgtttatcttgggagctttttgcacagggaaggcctttgtcttccagctctgtgaatccttcttcactgcgtagcaccttgcagaacatttgcacatattaggctcttggtgaacacttagaatcctcagtcatttgcattcacgtcatgtttccataacacattgaatgaaccagcaagtatttattgaacatttactatgtgaaacacagggaagacagccatgaacagaccagacacaaatcttacgtgctactggataaaaatgtaccccacggatgacactttgggtattatgatgccaacaatgagaacatattaaatcactttggtatttgcattagattgtgtcctgtaagtttcagattggtgtatttgccaaagaacaattgtgtgtaccccccacccaccagaaaagaatacagtaaaagtgctaaactattgaatatttttaaatggtattatatttgaaacgtgtgtttgtaattttgagccatgtaattagaaatctagggtttatttaaattcttgtttgttttagagaaatatgtaaagccacatttccctttatataaagtacttggttgaaaaaacaatttttttctaaagaaaaaaaacactctttagtgtacttttgccaattaaaagacagtacagagaaattgattcctcctggagtttgtgtagaaattagaaaacataatgcttttccctaggcatgaactcgcttaaaactactgagaagcttatactcacgcaggttgaatggagtgaatagtggtttagagaattgagctgattaataagaagtccctga

SEQ ID NO: 136076 - DNA, 1049 bp, Homo sapiens
tgactaaaagaaaaagaaattttgggggaggagcaggctggtggatgtgcagtttctaaattatcttgtattttatttgattacagtgtttgaattcagtgttttgaagagatgtatgtagcactgcaagctctattctaacctactttctttggagaagcaggtacatgctgtgttgtgtcagcttagagagccccttcaaaacctctccatgttcaatgtggagggactgtcactatacatgcatggcacaccacaccaagaacagagggctaccagaaaattagaatcccttttatatttgtcacatatcagcatttatttagctgtaaaaataaacagcatatggcatttgttaaaatcgtttgtatttcacacaaatatttggcaatatgtaaactttcttgccagggctgtttattgtggttctatttgcatactaataatggggaaatcagtaatgaccaggtgttggaaggtctgatttctcatttaaatgtattgtttctagcaataaactaattatttttgacatgtttcataaccagaagaatgttattaaccaaagtcataattcctatttttgtgttgatcacacacagatgataagttaattatacttattgaatttaacaacatatataagagataatctcaaatttcaagactctcatttgtgggttaccatctgttttggaccaaagaataggaatttgattgcaagctttcttctgaacagcttgtaataagagctgtttgtatattaattacttattgaattattgtggattttaatgttttaatttacaagcaatttggaacttattgtggtgacagctgctcatattttgatactttatggtatttagcaatttcatcataaggctattttttcccctggtaatttataacccaatcctgaaaacagtaatttggtctctccagctcactataaggagtattgtcctgtttcatccccactgcagatttttttcatagttaaaagtatattttataagcaaaatcaagattcctttgtgcctgcttcc

SEQ ID NO: 136077 - DNA, 1032 bp, Homo sapiens
ggaaagctagcccaagcgatggggaatgtttagctaaagcgtgttgtcttctcccgagggtgtgcacaggttcatgtatcagctgaataaggccctgttccaaaaactgatatttcaagggaaccttaatttatctttaaatttaatgtaatttaaaattaatttaaatctttaaattatctttaaataatagcagtagcaatagctgagctaacattaattttatctattttgagactcttttatttcagaacttctacatgcataatgcctgaccggccacttttaatttctcctttctttcactttgcaaacaaaaccttacaatctgtgctatggactaagacagaaattaagaaccaataaaatgtgttaagttttaattaggaagaagaaaaaacctaaaggaacgggatggttgagaggtaaacacaccccaatgatttttaagtcttttgtttcaaacctttccctttctccctaggctggtccctgcagacggcttcccatttttatgaccggatgctgggaagcctgctggtccacaggtccatacatgaagtcaccataaggtaagcagcccagcatgccattggatccttgcccttgtacctgaaatccgtttgaggagcagaactgcattttcccaaaatggaaccccttctgttttaaatgatgttgtcaggggaagtgcccggtctttctccttactgaaggttgaaggtagtagacagacaatcattaaatcattgcgagctgcatagtcaattccaaatgagaaatttgcctttttactgacttctgagaattttgggttgtgtttttgttttgttttgttttgtttttgtttgtttgttttgagacagagtctttgctctgtcacccaggctggagtgcagtggtgcaatctcggctcactgcaacccccgcctcccaggttcaagcgattctcctgcctcagcctctcaagtagctgggattacaggcacctgccaccacacctggctaatttttaaaatagtttcagtagag

SEQ ID NO: 136078 - DNA, 1069 bp, Homo sapiens
aattaatttcaaaattccttatctaccgtctttcacaaatgtatgtatagcctagagaattttggtaataattttgtgatacatttatattgggatttgtagctgccagcctttttttttttttttttttttttttttttttttttgagaaagggtctcacttccgttgcccaggctggagtgcagtggtgatcgcggctcactgcagcctcgacttcccaggctcagatgattctcccacctcagtctcctgagtagctgggactacaggcgtgcaccaccacactcagctagttttttcgtttgtttgttttgttttgtttttgtagagacagagttttgctgtgttgcccaggcaggtctcaaactcctgggctcaagcgatccgcctgcctcggcctcccaaattgctgggatgataggtgtgtgccactgtgcccggcccaagccattttttcagtccattctttttgctcctcctagtaacccttcgtagcaaccagccttccattgttcagtcaccagaagttaatgatagaaaaccagagatttctagctgtgcaagatgtagagagaaacctaaactctatacatttgctattggcactgtgttgccatagtcactgcagcactcagcatcaccaaaagcctgcccagtgctgcaacattctttagatagatttttgttgttttattttgtctccttaaataatatttaatttttcattaggtcatgctatgatttcatagcttattttgtctctaatattttcttctgcatgctgtcttttgagagacctctccagagttcaagcacaaatcctaggacagacttgtattttgactgtcaaattttcattgcagtatgtgcaaaagtacagaaatgtcatcaaattaagcaaagaagataagaatttttgaatggcagtgttctggcaactataaaataaagtctattaagagtgcaaagtgagaggtggaatgtcgccagggcagctgcattcattatctcttgctggataacagacgaccacacgtttagcagcttgaaacaacacacattcattct

SEQ ID NO: 136079 - DNA, 1048 bp, Homo sapiens
cgcgggtgtactcggtcacctctccatgtgtccagaaaagtgctcagtgttgaatccctccacgtctgcctgagtgcactttgggattccattcctgccgcttatggggcgcgctgcggatccctgcatgcacagagctttattgaacgcaaagtcagttgtttgttgtcgtgctctgttgcccctgcttctggcttcattcatgtggtttttgctcaattcttccccggccttaggaaataggccaactcttgtttttttggaaaacatttcacctgggcatatttttctatctataattacggaatttttatgtaatcacataattataaaatataacacaatcagatattaattaccttcatgtgtataatagcatggatattattttctttagtcatctcaaaaaaaaaaaagagaaaaatacaagcagtgtttcaaaactctcttctctttttgaacagagggtggttcccacttcatcaacacctcatcgccgcgaggtgaggctaagatgagcataaccagtgacgaggtgaactttctggtgtatcggtatctccaggagtcaggtaagaggcttggttttctgtcggtaggaaattcatctacagcatcttacaagcagaaggatcaacgcttaattcaaaaccaggctgtagaagaagaagaagaagagctaagaaggttcttagtgctgatggggagaagagaaggttctggagctgtgccatccccgggtggaaagagggaatgtgttctttcttcccttgacacttctgtgcagatgaatcaggcaggaatcaagagcggttgtggtgaatgtggaaaggacggaagcagtgcggggctcttggcctccacctcggcgagggcatgcatgagctggtgtgtgtgtttgaacctcttcgattttgctccagagatttattcagctccccagcctcccctactccccgccccctaaatgggctgctaggcaattttctaaaacttaggaatcgtcgtagcatcttccaacatttttgattaccactgagacattact

SEQ ID NO: 136080 - DNA, 1014 bp, Homo sapiens
tcatagttgccttccctcggcactccagattccagcactctaggggctaatgaaagactgtcccatttgtcacaatggtttctaatcattaaaaagtgagacgccaggggcggtagcacacatctgtaatcgcagcactttgggaagccaaggcaggagggttgcctgaggccagaagttctagaccagcctggccaatataatgagaccctatctctacataaaataaaaaaaattagccaggtgcagtggcacatgctcgtaaccccagctactcggaggctaaggcaggaagatcagtttggtccaggagtttgaggctgcagtgagccatgactgtgcccctgcactccagcctggatgacagagcgagaccccgtctctaaggaaaaaagagagacagtgtgcccgcggagtttaaatgaggacatgttgttactactttggacagttaccgcgttttgtcatgggcttgttcatttgggtgtgaacatatgaaggaggaagggggtgtgggagcgtcttgacccatcggtcaccattgtccactccatggccagaatcaagggccaagagtgcctgaggaggtgatgcagctagttctttacataggttgtattgttttctttattttgaatattgtcttgtaatcagaaatcatctggagtgatgtttcatttagttattcttcagctgaaacctgagcctttcagttcttcctcacttctgaagtaattcaggttcagagcatataaacatgtgtttgcacatccagatacaaccccaaggcttactgaggttcacctgattcgaatatctggcgtgtttcacaaggaaagaacctcctgctgtatttttaaacgtgtgtggaaagttttccatggtaaacggaaatcagagaatcaaagaatggtcaaaaaaacatgaatcaaaacaaaatgatgtcaattgtgtcatggctatggttagtctaaccctgaacccaaggagtcatttcaagtagcagcaagtgcc

SEQ ID NO: 136081 - DNA, 1723 bp, Homo sapiens
caagcagtcctccctcctcagcctcctgaggcactgggattttaggtgtgagccactgcacttagcaaactgtttttattcctcaatgaaatttagagactgtcaaaatgtaaagaaacctaaaatatttactaaattgcactaaagccacgatttcgttagaatcatcagaggtaggccgggcgtggtggctcacgcctgtaattccagcattttgggaggctggggcaggtggatcacttgaggccaggagtttgagaccgaccctggcaacatggtgaaaccccgcctctactaaaaatacaaaaattagcctggtgtggtggcacatgcctgtaatcccagctgcttgagaggctgaggcatgagaattgcttgaacctgggagacggaggttgcagtgagccgaggtcgtgccactgcactccagcctgggcgacagagcaagattccgtctcaaaaaaaaaaaaaaaaaaagaaaaggaatcatcagaggtagtatttagtacataaaaaaaatgtttctggaaacaaaagagccctttaagtgtgtttctcttgtattggtaagccacttgtctctttgtgtttgctgtgacagataatcacgcgaagccaatggaaatagatggagaggttgagattccatccagcaaagccacagtccttcggggccatgagtctgaggtgttcatttgtgcctggaatcctgtcagtgatttgctagcctccgggtaaggatgtcagggtggggggcgctccagagttggggagatgggagatgcaagctgctcgcccttctctggagttctgcctaaaggaacacacactccccttcttaccccggtgtgtgggcagaccaaggaatgggtggctctatgagccacttctctacatgtctcatattgtggagaagccatagttccaagtcgttttctccatgtggtggtgaggaacacagcagcacttaaattaccaaatgcaaagatggcaaagagggaaacagggatccagagggatgaaaaagacagaagagcatgtgctgaagatgccctctggccagagagcaagctgtggagagcttcttatcccatttgaaccaaacaccagaggctcctgtgtttttattctgtagatctggagactcaactgcaaggatatggaacctgaatgagaatagcaacgggggctccacccagctcgtgttgaggcactgtatacgagaggggggccatgacgtcccgagtaacaaagacgtcacctcactggactggaatgtaagcatcttccaccccctgggcactttgaaattggtaaaatcggccagccaccaggcaggggctgcagcaatggagcccatgcagacataggaggcaggtggtcctgtgtgctcagcccccactctgatgggctgccagagaggtgttcttggcttctttttttattttgagacggagtcttgctctgttgcccaggctggaatgcagtggtgtgatctcagctcactgcaacttctgcctcctgggttcaagcgattctctttcctcagcttcccgaatagctgggattacaggctcatgccaccacacctggctaatttttgtatttttagtagagatggggtttcaccatgtcggccaggctgctctcgcactcctgacccaatgtgatccgcctgcctcagcctcccaaagtgctgggattataggcgtgagccactgcc

SEQ ID NO: 136082 - DNA, 1062 bp, Homo sapiens
tcattaaagaacacgcagtggcaaatggttccagtgtacctggatcctcggagaggctctccgagctgcttcggtgctgccgctcctaagttgtttttgtggggttttgtctctttctggccctcagaccaatggaacactcttggctacgggttcatatgacggttttgcaagaatatggacggaagatggtgagttctgtgtccctcgtgctggggtcgggtaagaggagctgccgaacttaacccttgagtgaacagaccatgacattgaggtcaacatgtttgtttttactaacaggtaacctggccagcaccttaggccaacataaaggccccatctttgccttgaaatggaaccgaaaggggaattacattttgagtgctggtgtagacaaagtgagtattagctgaaaatacatccctttgatctataggtggttatatatttttaatctcaaaataacatcgtggtttcttggaactcgtaggctttgtgcttccccttaagaaatgaaaatgatttgtttaggctttgtttttgtggttttgatctttctgttcatttgtgacacatcatctcttaatatattctgctgttctgcagaccctcgtgcaaagcttccctttatttgaggtacatggttcagtggtagagagaggacaatctccacattgcatttgtcagttgctggaaggagccacgtggtatggggcgtgccctgcctgaacttgcacccactgaggggtgagtggcacaggctgtgtgtgttcttcaggcttcggctttcctcatttgataaactgctgcttcccaccgtagaccgcagatttctctgagtaggagtcaagcaacctggctacaagggcacgctcttccgatggcccacagagccaggttagaattgacttgctctgcacctgggcagggctgcagggagacacggtagtgttaactccaggtgcatgtaaaagccatcaatggggtgggaacccaagggcaaagagtaaggggacgcagactccatcctgggcccgagtctgatccagccagcaacctcgg

SEQ ID NO: 136083 - DNA, 1069 bp, Homo sapiens
gtcatccctgccaacgtggcaggagagggtctttaaggtcttagaaagagactgtgttcacgcttgagacgtttttatcatgttactaaatggggcttcttggctgggtgcaatggctcacgcctataaccctaacactttgggaggccgaggcgggtagatagtttgaagtcaggagttcaaggccatcctgggcaatatagcaagaactcgtctctgcaaaaaaaaaaaaaaatttaaattagctaggcgtgatggcatgcgctattcagaaggctgaggtgggtggatcccttgagcccaggaattctaggctgcgttgagccatgatcgcaccactacactccagcctgggtgacagagcaggccctgtctctagaataaataaataagtaaactaaagaggcttcttgattgtgctgttcattgttgtaaatccatggagctgtgcaacagtgagtaactccagatgtcctccctccctactgcagcccctgcccttgatgtggactggcagaacaacacgacctttgcctcctgtagcacagacatgtgtatccatgtgtgcaggctcggctgtgaccgcccagtcaaaaccttccagggacacacagtaagtgagagctcttgtcactggtctcgagtttgtgagaatgtgatgtgggagccgattcttgtgtgcctagaattaaaagctactgcagcagcagaccagctctaatgtgccccttggctatttgagctgtcatggttaccccatggtaaccatggtggttggattgactcagtttggggttggcagtgagaacagttcactcagaaatgacctagatggtggatttggcaacaaagcctttaaggtagccatgagaaacatgtagaggacatcaaggaaaggatgctcacaataaatgaatagacggggcacatctgcagtgaatagaaaaaaaaatcattaaaaaacaaatggagactaagtgtggtggcttatgcctataatcccagcactttgggagtctgaggccagaggattgcttgaggccaggagtttgaggccagcctgagcaac

SEQ ID NO: 136084 - DNA, 1043 bp, Homo sapiens
ctgccttagacccccacagcagctctcggtccaaaacagaatcctccccagtctccaggcccattcacgtatcctctgcacgccctggggaggattcacggcaccccctgagctcctactgcccacatgaatgccacagccctggcagtagctgctggcctgcgtgtctgcctctcccagaaaacgcagagtgcatcaatgctgggaccatggcatcttgcctttctctcaccagcacccaggatatctctgtggtggggcagggtgggggtcccttgttaaagcaggagaggatggtcacagtccctggagatttgccattgtgccactaacttaactgatgtaaattcccttgtcctgattcccctaatgcccacctctccccacccctggcccaggggtccctgtcccaaaggaaggcgcttttagagcacaggcacctatcgtcctgttaacatctgtttggctccaaactgactctcttctcccggtctaaacttatttctcctctaaccctggactatccacaagtttttaatagagctgtacacactatctgcagttcccaggtgtcctgcccaggaccttgccaccagcacaggccttggccctttaagtgggtcttaatgtggctgatggccctgaacaaagctccagctcagtggggttgagtggagacccatgagccggctctggaggcggcccaggaaccggggcttgcattgcagagctagggatccgctcccaggaagttatttgttcctttgcatgggcttggctagggacagccagtggtgaccagctctacattcctgggcccatgagttttcctctgaacagctgcagtcagagccacccttgctggccttgcatacacattcacactcatagacacccatgcgtgtgcacactcacaaccctcagccccctctccagtcggccccctccaccctcccgggctctcgcagcagcctgcccctgggccgcgaaacttcttcctcctccctttcctgggccacgtgtgcctcatggaacacagatgt

SEQ ID NO: 136085 - DNA, 1078 bp, Homo sapiens
gggcatggtggtgcctgcctgtagtcccagctacttgggagggtgaggcaagaggattgcttgagtttaagaggtacatgctgcaaggacctgtgatcctgccactgcactccagcccgggagacagagtgagaccctgtctgaaaaagaaaagtgcataggaaagtgattttcaaaggccaatttaaaaagtaactggttttactggttttatttgctgcgttttatggtatgtgatttcttcacttgccttccttcctagcagggaaggtttttttcttaatgaagtatggatgagagtggctggtgttgtgtggtatagggctgtggttttatataaatgaaaaaggcaaagtgagaaaaagaggaaactagatggctggttgggctgtgccctttgatgtcaggctgaagccgaagaccttctgcagcgccggtggcgcgctgctgccccctgctggaaggtgacctcatctactcacaggccctgatgtctttttcacactcttctgctctctttcagaacgaggtcaacgccatcaaatgggatccgtctggaatgttgctggcatcctgctcggatgacatgacattgaaggtagagtcggcatggcaaggggtgggctgtttaatcctagacaaccccgggcacttgatgccagtctcacggtcactcttacatgaggattatttattactgaccaccctcccttcctctgtcatccggtgagctacgatttctcagtcatagtcccactgagaatcgcagcctccctgcagcctttctcaccactgtgcaccctccaccctgccctgggccccgtgtgcacccccgggaggaatgattccacatcgttcccggatgcaggaatggcttttgctcatgttgtgtctggtgtgttctgtagatctggagcatgaaacaggaggtgtgcatccatgatcttcaggctcacaataaagagatctacaccatcaagtggagccccactgggcccgccaccagcaacccaaactccaacatcatgttggcaaggtaagggcaggcaacacagctggcacagctcggtgttacaca

SEQ ID NO: 136086 - DNA, 1015 bp, Homo sapiens
tctgtattaatttagttggtaataatagatgtcatgttttaaattgtaggggcattttaggaaacttgataaatattctacaaaaatatttaccatttacgtctataggaaacatagaaacagggctgggcgcagtggcttacacctgtaatcccaacagtttggtagggtgaggcaggaggatctcttgagcccagaggttcaagaccagcctgggcaacacagtgaaaccccgtctctacaaaaaataaaaaaataaaaattagccgggtgtggacctatggttgcagcttctctgctgaggctgaggcgggaggatcacttgagcccaggagttcgaggctgcagtgagtcatgatcacgccactgcactccagcctgggcaacacagtaagaccccatctcaaaaaaaaaaaaaaaggtgcagaaacaaatgtagatatcaaattgtttccctaataagaccattaaagctttttttctgtttaatgactatggctttgtttttaatacttgtaagtagttacagtttagaagacaaaaagctttttagttattatcttttgaaacgtaaaagctgggaaaaacaactcctggagatctgatacacattatggagaactgtttgaaaccaccgtgtgtatgtgattttgctttctctcccaccttgctagtgcttcgtttgattctacggtgcgactgtgggacatagaacgaggcgtctgcacccacacgctcacgaagcatcaggagcctgtctatagcgtagctttcagccctgatgggaagtacttggccagtggatccttcgacaagtgcgtccatatctggaatactcaggtaagctcccgacccctacaccaaatccttttagtaagggatgcccaaatagccacgactccagtgcccttggctcagagcagtgccccggagggagttgagcaagctcaggctccccgggcagacccagtggatgctgtccacgtgcaccccacgtgggctgtcagctcttccc

SEQ ID NO: 136087 - DNA, 1048 bp, Homo sapiens
tcatgcccagcttatttttgtatttttagtagagacagggtttcacatgttggccaggatggtcttgaactcctgacctcaggtgatccgcccacttttgcctcccaaagtgctgggattacaggtgtgagccaccgtgcctagcctcaatttttcaaatcaaagtaggttctgtttgaggacataaggtatgtcaatattgggttgtccttttagcagggattgaaaggacataggatttaaataaaggtggctgctgtgggtatcttgggccacacctgaggatagaagaattccagctgtaaagtgtagaaatggatgggaagtagcactgcatagcataaaggattgtatagggccatcagcacgtgattctagtctaagggaagagagaggtgataatatgctaggagctgttgaaaataaggaaggggtccctttcgcctcaggaggggaggaatcacacagccttccccctgccccctttcatctgcactgccttcttggttccttttggcttggttgacattcaggtggatttataccctcaagttcattccccctgtggactcaatggtgatgagccctgttcactggcaaggggtccactgagatcacaggcttcccagggacctcatgtgaaccacatcctctcagggaaggaagggaaatggtggaccctgcgtagagccaacccgacgccaagcccagccccacagccctagatagctctccgggaagcacgcatctcagcactagtgtccaagagtctccgttcctgaaatcctcgctagaaatagtaatgggtggatttgtaaaaagaacacatcaattatcaaaacaatgacatgatcagttaggtacagcctgttgtcaggaactcactgaactgtttcaacccttttttataaatcaaagaaatccttaggacttttcttttttttttttttttttggatcggagtttcactctcgtcacccaggctggagtacagtgatgccatctcggcccactgcgacctctgcctcccgggtttgagcgattctcc

SEQ ID NO: 136088 - DNA, 1819 bp, Homo sapiens
accacaaaatattatcgaaaaaagaaaagaattctaatgaccagccgtgaatgtgtagggttgcagctctattctccaaaactgtaggaacttgacttgcgttagagtgtactctgaaaccaactcgtctctggccgcaggagtctatatgttttcgtaatcttcatcaagaagtttttaaaaggcaagcaaaaacagaagcaaatcatatcaaacggggatagaatggtttccactgaggacattcagcctgggaaggaggaagtcaccagctcgaggcgtgtggattggtttccacccggaacaggctctgtgatggctgaatggaaagaaacgtaaaaagctgtgccaaaaaaaaagcaaaatgctgtgataaaccaaacagggaagggggaaaaaccctcctccttgggattttttttttttgttttccctaacaatttggacactacaattgctctcacaaaggaggttcaaagaccagtttgtaccgatgaaacgcgcaactttgtaatcccaacactttctattttctagaatcttctttgttcattgggtggtttttcagtcggctggaattctatcttctgggggccttccgtctgagatggaagctgtcttgggcttgttgtctcttccttctgttgctccctgcccctccccctgcctttccactctgtctggtgagctctgctttttcagtgcaccatcaagagatgcagccccgtggacatgaagacacaatctcccacggacagctttcccccttccgccctctcccaccctctcctccccttgcgctcgcgctcgcgctcgctttctcactggcgtgctctctttctctctctctctccctctgtacctttctcatagttgcttcagatcttaggtctcaagggcactttggcgcgtagtaagtgctttatgtaagaaggcagggcaggggggctttttacaggagaaaaaaaaatgacttataagagaaagagcctggagtatttttggaaaaaaaaataatatttttatgttaaaacaattttaaaatcttaaaatggccatcagacatagagagctttgtgtgattcatgttttaaaaagaaccgaagaagccacaggcagggcctgagggagcccctggctttcccctcagcctcaggaaaggtggtcaggaaaactctggctggacaagggtcagtcttcggggtcagcagcgagattgctctgcagccagtgagggaggtccccgccatgccggctggaagaagaacctcgcatcttttggtgtgtatgcaccttggcagccagcaggaaagcagcgaagagccgcgcgccctctggcctcaagggagcattggcagaaccataaggtactgcagaagccgtcgaaaccgactgctcggctggattaggcgtgttggctacatctttcccacaaccgtataacgaccgatggtcatttctccaagagcaggcttggcgagtccttgcagagctgacatagaggcgcccgcatgtcacttagtctaacgctgacagaaatgaatgcagaaggaagattttcagtcctgaacgtgaattatagaggtagaacgtcgctaataatttctgccatctttataatttctttgtctcacagaagactaggagaaagatcttttttaaataatctttttgctgtttttaaaaaattaaacaaggctttgtgttcctagaagagcttcatttcagtgaatctggtgacctccatctgcttgctgtcataacccgacacggacttatttttgtcattagcaagggggaaaaggccaaaggacaaggg

SEQ ID NO: 136089 - DNA, 1287 bp, Homo sapiens
gtgggatggcgatggtgggatgtgtcgcaagcaattcactagacaatcttcacatgaatgtcggtagccagggtctctcccgagggatggctttagtcttgatgaatgtgaaccatgtcggaattgttaggtagaaacctgggctgggaggcctcggaccccaggctccatccctggcttccccagcctgcggccgcaagcaaaaccaagcgcgagatgcagctagcacccttcatatccatccccgttctcagcgggacaacaccatggacagccgttttcagagcctccagcatttgcacaccactactcaccctctctgctgctggcatgttggtagagtcatccctgtaatcaagaaatggcctgtggaatgttattgttcaacgttgtttacagctcttaaaacatggtgaggaatgcctaagtcttagtgaccaaacgtgaccttgaaagcagacatagcatgacagaccttcctagagtgtttggtcgggttcacagtgaccgagagtcaggtccagcacacacctgggaaagggatgctgccccaagggggaccaaaagggccggacgttacagggtgaaaccctctgacccctcgcgacaccgtaggacttgacttttgtttagtctttctaagaaatagatcatggagccaagtgaagtgcactttgtcaaatgtaagggtctgctttgttcttgttgcttttctgttttttaaccttttgttccgccatttaaaaaaagaaaaaaaaaaagcttatgtttcttgtcaaatgcagaaatgttccttccgccactcactgaagttttgcattctggcttgtgcagtttttattgtctgtgtcagacgtacagccagacatgttctctattggcatttttccgattctgttcagatgacagcgaccgccttttcattccccccgccacctgtactcaccctcacgctctttgaagaaaaaaaaaaaaatcaccttgtgtgttgtagctcatttgtttcaagagagaatcaacagatcatattcagtgtcttgaataaattgctctattttgatattagagaacttggtgggtgtgctttcttcctctcgctctggaactcttgggcccacgttgactgaatgactgaagacagagctctgtattttctccagaaggaagtaccttgagcctctgtttaggattgctgtgtgagatagggagctgggagcagaacgcagtgacatggcagtcacagcagccgcctgctgttctgaaaggtggttctgtccagggatcatg

SEQ ID NO: 136090 - DNA, 1107 bp, Homo sapiens
tacttccttctggagaaaatacagagctctgtcttcagtcattcagtcaacgtgggcccaagagttccagagcgagaggaagaaagcacacccaccaagttctctaatatcaaaatagagcaatttattcaagacactgaatatgatctgttgattctctcttgaaacaaatgagctacaacacacaaggtgatttttttttttttcttcaaagagcgtgagggtgagtacaggtggcggggggaatgaaaaggcggtcgctgtcatctgaacagaatcggaaaaatgccaatagagaacatgtctggctgtacgtctgacacagacaataaaaactgcacaagccagaatgcaaaacttcagtgagtggcggaaggaacatttctgcatttgacaagaaacataagctttttttttttctttttttaaatggcggaacaaaaggttaaaaaacagaaaagcaacaagaacaaagcagacccttacatttgacaaagtgcacttcacttggctccatgatctatttcttagaaagactaaacaaaagtcaagtcctacggtgtcgcgaggggtcagagggtttcaccctgtaacgtccggcccttttggtcccccttggggcagcatccctttcccaggtgtgtgctggacctgactctcggtcactgtgaacccgaccaaacactctaggaaggtctgtcatgctatgtctgctttcaaggtcacgtttggtcactaagacttaggcattcctcaccatgttttaagagctgtaaacaacgttgaacaataacattccacaggccatttcttgattacagggatgactctaccaacatgccagcagcagagagggtgagtagtggtgtgcaaatgctggaggctctgaaaacggctgtccatggtgttgtcccgctgagaacggggatggatatgaagggtgctagctgcatctcgcgcttggttttgcttgcggccgcaggctggggaagccagggatggagcctggggtccgaggcctcccagcccaggtttctacctaacaattccgacatggttcacattcatcaagactaaagccatccctcgggagagaccctggctacc

SEQ ID NO: 136091 - DNA, 1067 bp, Homo sapiens
atcttcctaaaccaacagttgtgtcacctgcagcatctgtgccgcagtcacctatcaatcaactggcctagatgattctgtagggcttgtgtcatccgttgtaatgatttaataaaatgtagatggaaagttgatgtagatttccacccctcccacctttttttttttttttttttttttttgcagatgagatgaatgctaggactttgaccaaagttggtccatgaaaaactccatgcactgaatactgagcattttctgaagctgatgacaaacctgctaggacacagacacagtcagtcttttgtcttttcctctccaggttctgatgccagcacaattgaaattcacactgcaagtgaatcctgcaacaaaaatgagggtgaccctgctctcccaacccatggagacctatgaaggggatgtgctgggggtccagaccccatattcctcagactcaacaattcttgttctttagaactgtgttctcaccttcccaacactgcactgccgaagtgtagcggcccccaaaccttgctctcatcaccagctagagcttcttcccgaagggcctttaggataggagaaagggttcatgcacacacgtgtgagaatggaagagccccctccagaccactctacagctgctctagccttagttgccactaggaagttttctgaggctggctgtaaagtaagtgtaaggtccacatccttggggaagtagttaaataaaatagttatgactgagctctcagcctgacttggattctgtcttaacacttctagcaaaagaaaataaatacatgtacagttatgcattgcttaatgatggggatgagttctgagaaatatatcgctaggtggtatcactgttgtgtgaataccatagagcacagttacacaaacctagatggtacaggctacagcacacttatgctatacggtagagcctatggctcctatgctacaaacctgaacatcatgtgactgtaccaaatactgtagacaactgtaccacagtggtagttttgtatctaaacatacctaaacatagaaaaggtgca

SEQ ID NO: 136092 - DNA, 1009 bp, Homo sapiens
atgtcttaatgagtgctccaaggtactagtgctgcatcccgttgctgtcaaggcacctatgtgactgtactgacccattccccatgtttattgggcaccctctacatgccaggtgttgtctggggcattaggtacactatggtgaccaagacacattccctgtccactgagactccactctagtggcagagacagaaagaaaaacacaaataatgacatcatattccagccaggtagtgggacgtgccatgaagaaaaatcagggaggaggtaggagcatggttttagagagggtgtcctgagagtcttcctgagcatgacgtaatattagaattgagaccttaatgaactgtaggagccatgagaaaatcagaagagctttacaggcagaaaaagagaggcaccaatgccctgtggcaggaccaagcctggagtgagagggagagaggcagtgtgcttaagggtgtgagggagctgagaggaacacagagtaagctgcagttgtcagcaaggcccatgggtggagggctttggaggctttttggagtgcagtcacttgccccatctgttgttaggaaggccactctctgttgtgtcttccacctgtgtattccccatgtgaaagcccataacctgtgttgcggctggagcaagtactctaggatatttggggattggaagaataattctgacattggttccaaagggtctcacagattctgaaggaagacatgttgctggaattgatgcaggattttattcttggtcactttgcaagctggggacctctggctggtgatgccccgcccaggcctcgctcggccatgctacctgttgcaggagatggcctgcccacccagcttgcatgggccaagtctggcttgcacaccagttctcaagttcttgtcccatgcccaagaagaatgaggatgcactgactatagaagagtgagcaaggcagggagttttgagtgatgaaactgctttcagcagaaaggggacacagggg

SEQ ID NO: 136093 - DNA, 1034 bp, Homo sapiens
tcctgtcttccctcctctctcttgtcctctgtcccctttcttcccttctctactccagctcctccccgtcccctcctctccccactcccctctgctttcaggcacccttgaaggtacagcacctactgtggccaatcttcatcttgccccaaaccaacccaccaaccagtcaaccagccaccagccaacccatggtcccttccaagcgagtccagccctgtgggcatcctggggggagtgtgtcactctgtgacagcccagggctctgacttctgctacgctgcactgactgccatgtgtctttctgtcctctctccagggaatcctgaatccagcccagggatttctcttgtctttggccttctacggctggacaggatgcagcctgggttttcagtctcccaggaaggagatccagtgggaatcactgaccacctcggctgctgagggggctcacccatccccactgatgccccatgaaaaccctgcttccgggaaggtgtctcaagtgggtgggcagacttctgacgaagccctgagcatgctgtctgaaggtaatgccctgtctgccacagcaggtagacttcggggtcccagggctccccttggaaagccttagaggattctttgtcccgggggctgtcctgtgcatggcggggtgttcagcagcacctctcatgtgaactcactagcttccagttgcacctccccaattgtgacaaccaaaactctttctagacattgacaaatgtctcctggggagccacagtggcccccagttcacaaccagtgtctcagaataattaggcttggatctaaaaatgtgatttttttccagatgttgtctgagctaaatgcacacaaacacaaaaccaaagacaaacaccacacaatcccgtgatggggtgtaccaaaataatgttgaaatttggagtaagaaaaataatatgcagaaagatgtttggaaatggcttaaggagttccgttttcttttccattcctactattcaaatacactgaagggaggccaaggc

SEQ ID NO: 136094 - DNA, 1054 bp, Homo sapiens
cgggctcaagcgattctcccacctcagcctcctgagtagctgggaccacaggcgcgtgccaccacctccagctaattattgtatttttgtagagatggggttttgccaggctggtgtcatctcctgggctcaagtgatccgccggccttggcctcccaaagtgctgggattacaggcgtgagcaccgcgctcagaccctagtgtacttttaaacaacggatattgcattacctaacaaagaaccataatatgtaccatgagtgtgcatactgttttgaggatattagacatttgggtctaatagcaagagaaactcacaaagaataaatgttaaaggcaaattattgagaattaatttgtgaaaattttaaatgttgtgtttaaaaaagaatgaaggaactatatattcaaacttctaaattgtgctttttgaaaaattcttttttatgtgaggaataactaatatggccactgaaaatgcagccgagaaatccagattgctagtcacatattgcaagtaaaccaacagacaaacaaaatagggatgagactgtggccaactatggtttgcgttaaagtgcctgcgtttgttttgctaccataagttattttctgagtttcaggccaggcgcggtggctcacgcctgtcatcccactttgggagaccaaggcggacagatcacttgaggtcaggagtttgagaccagcctggccaacatggtgataccccgtctctactaaaaatacaaaaattagctgggcgtggttgtgggtgcctgtaatcccagccactcgggaggctgaggcaggagaattacttaaacctgggaggcggaatttgcagtgagcagggtttttaccactgtactgcagcctgggtgacagagccagactccgtctcaaaaaaaaagataaataaaaaataaaaataaaaaaaagttattttatgagtttcaatcttctttttctctctctgcacacacaaatatgtatgttttttcttcctttcttccttttccctccttgtctttttccctccctctctccctccctc

SEQ ID NO: 136095 - DNA, 1075 bp, Homo sapiens
cacaggtgcgcaaactgcagccctcagaccaaatcctgcccgttttctagggtccacgagctaagaatggttttacatcctactttttaaaaaattaatgattttgttttttgagacagggtctcaccctcttgcccaggttgagtgcagtgtcacaatcacagctcactgcagcctcgacctcctgggttcaagcgatcctcccacctcagctacccgagtagctgggactacagccacacgccaccatgctagggtaaatatatgtggggtctcactatgttgcccaggctggtctccaactcctgggcttaattaaaagatcaccacccttggcatcgtaaagtgttaggattacaggcgtgagccacctcacccagccctaaaatgtttttaaaaatcaaaattaaaaaatatttcctggcatgtgactattactgaaatttaaatgttaatgtctacaaataaagtttgatgggaacgcagctatgttgttcatgtgcatttgtgaattattcatggctgcctttaccctacaagggcagggtgaatattggactgagaaagtatggctcccaaagccaaaaatattaagaatgagtttgccaacatctgctttaaactattatgtgacactttatacagacctctcagctagatttggccattctgtttagctttttggaacatttccaccatgcgtaaatgcagtctataatagaaacacttacagtgaatccctgtacgtgggattcgtgaggtacgggtacccggctcatctgctcccctcttcaccctcctcactggattaatgtgaagccaatctcaggctccatcatcctgcccattcagatctcagagagagccctaaaacataataattctaaacatttgcaaccccaatatcattatcactttatttttgagacagggtctcactctgttgcccaggttggagtgtgctggcatgatcatagctcactgcagcctcgaacttctaggctcaagggatcctcctacctcagcctcctgagcagctggaactacaggcatgcatcaccacactggctaattt

SEQ ID NO: 136096 - DNA, 1010 bp, Homo sapiens
aagggcgcgcgcggcccgcgggttggaatctgatcagcgcctgggtgagggcgcgtggcccgcaggttgagacccgactggtgcccggataagggcgcacggcctgtggatttggacctgttccgtgatggagtgaggacgagaggcccgcgggttggaacctgcccggtgcagggctgagggcgcgtagctggctggttgggacctgctcggtccccggctgagggcttgaggcccgcgggttgggacctgctcagtgctggggtgagggcgtgaggccctggggttgggacctgctcaatccccgggtgagagtgcgtggcccgcaggttgagaccggatcgatgcccgggtgagggcgcatggcccgcaggttggaactcgatccactcgggttggaacttgatcggtgcccgggtgatggcgcacggctagcgggttgggctggccgtcttaacacttgaaccacagagaaaagagaaagcggaggctgttccctagggaccggatgggacaactaggtaatttttttttttttttttgagacggagtcttgctctgtcgcccagactgaagtgcagtggcgcaatctcggctcactgcaacctccacctcccgggttcaagggattctcttgcctcagcctcccgagtagctgggggaggcgcgcgccaccatgcccgactaatttttgtatttttagtagagacggagtttcaccatgttggccaggctgctctcgaactcctgacctcaggtaatccacccgcctcggcctcccaaagtgctgggattacaggcgtaagccaccgcgcccggccgactaggtagttttgcaaacacatggtcggtaaaattcccatccaagggacgttgggttttaaaaaatccgtttattgtgtttgttatatggaaacttcagatggcgcagttaagcaaaacccagaccagaaaagatttcctcatttttgcccaactgcaccagggagagactaacaattaacttctct

SEQ ID NO: 136097 - DNA, 1743 bp, Homo sapiens
tgccattgttataaatttgaccaatgtgtaatcttttatcacactggcttctttggaaacatggtggacagtcataaagtgtgtatactctgcccagccagaacactcctcttttttttttcttttatttcttttcttttctttctttctttcttcttttttttttttgagacagggtcttgttctgtcagcctcctgagtagctgggaccacagatgtgcgccaccatgcctggttaattttttaaaattttttgtagaaacggggagtttcaccattttgcccaggctggtctcgaactcctctgcctcccaaagtcctggcattacaggcatgagccactgcgcttggctcagaatgtggattaatccaagctttgaatcttcctctcccaaaagctactgaaaagtcactggggctcattaaaaaatagctcttctaatcgtttttttttttccacttgtaattaaatagttacatattagagccctggaatactgtacaactcacttgctatttagcagactctgatttggggatagcttgcattaaggtaagagcgcaccttctctttatgataatgagggtatcatttgaaagcctcatgggagtgcgtgtagtagaactgggaggggtgtcaagaacaaggctggttcggtcctggtcttcagatggaattttatcagcccattttatagatgaaacagctgtggcccaggcagggcaaatggtgtatcctgaggtcacaaactgttgagtcctgggaaaggccctaagaatcagactctggccccagtgttcaagcctgctgctccccttcagtcagtgccatctgcttgggtctgggatctcctgcaatgccatattgaataccttcgtcacatcggttaggtgagggtttgccagccttggcattggggactttgtgagctgaatctctttgctgtggggctgccctgtgctttggaggatgctcagcagcctccccagcctctacctgcttgatgctactgtcacctctctccaggtgtgatgacaaaaatgtctccagacattgccaaatgtcctctgggggcaaaattagcctggttttgaatctcttttgttagattaaccatatatcacctttgctcttaaaggattcttgctcttaaaacttctgtttctttttgaatagactggcctttagggtggtgtgtttagaggcctctggcattgccagtgtttgcatggagagctgttttcctcccacgcgttggccctgagaataggctttatttacatagtcaaactcaaacaaatacttgcttcatctgcattttttgtagctggagaaaggaaattgaagcaggaactcccaagtgctgtgttttatgggcatccacagtggctgttcagaatcaggactgactactctctgggtctagtttgaagctaaagggataccaacttcagaggagtagcattcttggaatttggggtgcatgcatgaagcccagcagaacctccgctgacagatggcgacaggattcatcactcctcagtacgtttctgctgatttctgccttgaaattttgctacagttggtggaaaaaatgcactcaaacccatatttccatgctgttgttagagagggggcaggaataacatccatgctgtaggaatctatgtaacggaagtagagatggtggatatatgtgatcctggtgggttttttgcatgtttctgttcccatccattcaa

SEQ ID NO: 136098 - DNA, 1029 bp, Homo sapiens
agatcagagtgaccaccctggtcgggatcagttcttgtctcatatgccattatattggctcccaagagccaaccaagctctttgtgaaatatcagtaaaggttttgaaaaagagggacctgatgaattcagcagtgggtcaggagcgggtgactctcaactttgtggctgctggtggatttttgtgcccagatgcagtgtgcggtcaacatctgcacgagggagtgctgctgcttctccaggtgtctgagaaccagtgggtgagggcttggatctcccttgcctctgccatctctaagtgatgtccgagttgtaaagctttactcactttttgatgccagctaccatgttttcttcagctattaggataagtgtcattataaagatccatctgtatttaagaattaatagtaaggttaaaaaccaagaggtgagctttctttcctgtgctgaaagaccctttcagttggtaggcccgccttgccaactggctttcaagtctatctttattaccttttcccagcctgtgaattaatgtgaccctgctgaattctcatccttgttctccggcgatgttttgggcaagagtgtggagtcaggcagtgagcctcaagtcctattccagggtctgggagctggaggctttgagggtcagctctgggaggattcttcctctcttagacattaactcagcttgactcacgcctatgaatccagagccttctgcgattatgagaagctgtaaacataagctatgcatctcacttctgtaccaggatgcgttcggtcttcatggctcagttatgagtatttcttaacatgtcgtaacatttatcttttgaaaaaaaaaaagaaaagaaaactagtttgcccaagagctaaaggtagaatagtatgataatgaaaggctcagaacaagtagcagttttcaccttgtcctaatgagctgggggtttcttaatctacctttgtaattcatggtcaaaaaaactggcttgccacttgggaagggctggtttttctctttgga

SEQ ID NO: 136099 - DNA, 1051 bp, Homo sapiens
tggctgctttcttccctgttagaggttgtcttcaaatgtctagtgctccttggccgtctgctggtattgaaggttgcgttccccaaaatgctgtttggacactccgtgcatgggggtgagtgatcaggtgaagctgtttccctgggtattcctctaaggctgtatctttctctttttttttttctggaggggcagggaggcggccatgtttttgtcagatactttttttctacttaataaacttctggtgtagtacaggttgaaaagtaatgggaagtctgccagttgaggggatctctcctttgctcagctgggcgagggtgatcatctctgccccccaactttggctgtagtggttccagtttggagggaaggttaccactaggcagaggaggcagtgcttgcttgcttgcatccggagctggatcttgctctcagttcctaaccgtttctaatcagtaatcctctgtctgtccaactagaatcattcctattttattgtggtatcatggggattaaatgaggcaacacataaagctatctctagtaaattcaaattccccctcacttctcttcctcactttccctactcaatcctgattcattaagaatttggaactttgggaggccgaggtgggaggattgcttgagcccaggaagtcaagacaagcatgggcaacaaaatgagaccccatctctacaacaaatagaaaaattagccaggcaaggtggtatgtacctccagtcccagctacttgggaggctgaggtgggaggatcgctttgagccaaggaggttgagggtgcagtgagccaagatcacaccactgcactccagcctgggcgacagagtgagactctgtctcaaaaacaaaaaataaataaaaaataaaaataaaataaaaaatacatctaatgcccagcatcagtacatttcctatgttatttgtagcccaccagaagtgattctttcctctcctctaccaaaaaacttttttccagaataatagtgtttcttatttttataatattaataaagggagtagctcttt

SEQ ID NO: 136100 - DNA, 1457 bp, Homo sapiens
gaaagtgctgagattactgatgtgagccactgttcctgggccagagtagggtgttaaaaaagtagttttgggaagtggcaatagtgggaaagatgaagattcagtatccctgtgacaagactctatttcttcactctttcaatctttggagtagaaaatctgttagggtttagagtgggacccacaagtgtggcagaaatgctgcctgcccgagtccttgttgcctcctcctctcagacactgttgggccacatttcccagcctccctagcagttagctgtggcctcctgacgcttctaccctggggagtgcagctgcagccatgcctgccattttacttttccccttctggctgcctggaatgaagatggccgcagggcagagttcatcagcgtggatccctgaatgactgcagaggtggctgcccatgctatggtcaccatccatggtgagcaagaagtaagcctctgctgtgtttgggccattcattgtatgttttttggattacttgctgtaacagactattctcacaaatgaaatgctgggagaaatcagaagttttccttctagcaaatatacccagctttaagaggcggaatatacggtgcttcttttacacccatgctggaaggagtgaggaaagcatcactgtgggtgtccaattagcatgaagcctattccctgcacacttattatataaaatgagacctccacgcccattggcgtctttccacctccttacccttttctctcagctggtaatttattcacccccaccccccacttgctcttccttctcctccccggggatgatttcctgggagccctggagcattggggcaggaggccgggagaatgcccagtctagataattagtcctaggtggggctggccggaggcacagtgggtggggtgggtggccagctgctgttaggatgatttcagggattggaccttcctcctggtggtggtgtcctttctttaactgccttggttaaaatgcaaatgttgcctgggagggctacacattgtcatcattaacagaactgccttcatcagattaattaattatagttctgtatggcagacttttttccccctggtagtagcacccagacacatgaattagaccagcaaagagaggagagataaagttgaaagccagatgaaagccaagtaaaactggcctcgggaggaaggtggagctggcggagtgggagtgctgaggaaagaccttgtctgttcaggtactggccgcctacaaagaggagttaggacagcctgtggaggaagctggtagggagagcaggggcccaagtccagctgaaaaccctccctggacttgcaaaagaggtgaaagagattctttacctatggcttgcagattctgaagctgacgaaattccacatctattggtgttaattgtgcatctgtttgcaaatttgtaaacatggtg

SEQ ID NO: 136101 - DNA, 2170 bp, Homo sapiens
gtgtccaccaccagtttttcaaaaagaaacatgctataaataagcaaactacatctgctcactgatgtgtgtatggactccctggatgtctcattgagcttaattacagaccactcacagtaatggatttttagtgtatagtgtagcttgatgttaagccattttagcttttgcgcatacatgttgtgctggctggtaacggagaagaatttgcagcattacaatgttaagctaggttgtatccatcccattaaatggcatcaatatcaatgtcatcatccttgttgttggactttacagtttcaactttaggtacactggcagtcttctaatacaccacctcaatgttctcatcttcatcttcttcaccaccagaagattcttcctctgcctccattttataaatggttctactttgacacgaatctctttggcaggttcttttgagacatgtttcttaaaggcctttttccgaccagctgatgacgacctcttcttctaaaaaatctacatcatacatctccttcaagatatttggaatcttagagataagctgagcttggtgcattgctaccccacacgtaaagccatgaagaaggtaccattgagcttttttgttgttgtgacaaaatcataagaaatggtgcctgtatttcttatgtgttctctaatctcctctttaaaaagaacttcagtcagaacaagagggcccatggctttaacatccagtccttctgcttcagtaacaatttctttgtcacataaatcaatgataccctcttctttctttttcttcacaaaatcaaacaggatgttggcccgctcctcaactgttttttccaaatcatcatggagtatcagaacttttgcatgatcactgatttcatccattctgcacctttgagcttcctcagttgtatcttccccccagtcatcctcctcttcttccactgtatgtggaggagggctaatttctttggtggtggtgtctcactgctggatacggagccattttccttgtctttgccctttatatttttcttttccttttctttctttcctgtaccactgtcactattctcaggtgggtttttgagaatgaatgtgcagagtttatgatgtgtgtcaagcatgcctcgatagccacaggctttataagaattacctattgtttgctgctttggcttgacatgcatatctgtttcaggattctcacattcaggacagagaacaaattttttaatgagtccatccaatatgtcttgcagcttattggcctcctgagatccattcacaatgtaacaatgtatcccaccaaaatacttggtgggataccttggaggccaattaagcgcctttgcagtgtcagtcatgttgactataactgtcttgattccatttcctttgccctcaaccttggcaatcagacagggcatcttgtaatagaactggtctgatatgctggggttgacgttgacagacattttggcttattggtggctttatcaataagatgaagagatctttgattgcagcttttttatatcttctgtctggagaagaagggatgacataaacaactgcaaaagttctcggtctctaatgtgaaaacattttcaccactgaggctgtaagcgtcttgcttgtatgctatgtttccccaatacaggtactaatggctgcgcaaaagctcttctggtgaaggcctccctgctctcccacgcttgaaaagcgctgtccttcatgcttccctgtcaccttgctcctagcaggcatcacgtcgagtccaccctgccagtttatctttttttttttttttttttcttgagagggagtctcgctctgttgcccaggctggattgcagtggcgtgatcttggctcactgcaacttccgccacctgggttcaagcgattctcctgcctcagcctcctgagtagctgggactacaggcacctgccaccacacccagctaatttttttaatttttatttttagtagagatggggtttcactatgttgtccaggctggtcttgaactcctgacctcaagtgatctgcctgcctaggcctcccaaagtgttgggattacaggcatgagccaccgtgcctggctccctccacctttaaaattttttttttttttcagattatgtttttcgagcctcaag

SEQ ID NO: 136102 - DNA, 1050 bp, Homo sapiens
attttggtgggatacattgttacattgtgaatggatctcaggaggccaataagctgcaagacatattggatggactcattaaaaaatttgttctctgtcctgaatgtgagaatcctgaaacagatatgcatgtcaagccaaagcagcaaacaataggtaattcttataaagcctgtggctatcgaggcatgcttgacacacatcataaactctgcacattcattctcaaaaacccacctgagaatagtgacagtggtacaggaaagaaagaaaaggaaaagaaaaatataaagggcaaagacaaggaaaatggctccgtatccagcagtgagacaccaccaccaaagaaattagccctcctccacatacagtggaagaagaggaggatgactggggggaagatacaactgaggaagctcaaaggtgcagaatggatgaaatcagtgatcatgcaaaagttctgatactccatgatgatttggaaaaaacagttgaggagcgggccaacatcctgtttgattttgtgaagaaaaagaaagaagagggtatcattgatttatgtgacaaagaaattgttactgaagcagaaggactggatgttaaagccatgggccctcttgttctgactgaagttctttttaaagaggagattagagaacacataagaaatacaggcaccatttcttatgattttgtcacaacaacaaaaaagctcaatggtaccttcttcatggctttacgtgtggggtagcaatgcaccaagctcagcttatctctaagattccaaatatcttgaaggagatgtatgatgtagattttttagaagaagaggtcgtcatcagctggtcggaaaaaggcctttaagaaacatgtctcaaaagaacctgccaaagagattcgtgtcaaagtagaaccatttataaaatggaggcagaggaagaatcttctggtggtgaagaagatgaagatgagaacattgaggtggtgtattagaagactgccagtgtacctaaagttgaaactgtaaagtccaacaacaaggatgatgac

SEQ ID NO: 136103 - DNA, 1031 bp, Homo sapiens
gtctgtgtgccctcgcttctctccctctctagctgtccttcagcctcagcctcagtctaccccccagcttctctctctctctcttttctccctctctaccccctccttctcccttctctctctccctttccctcccactgtttttcttttacagctttatcgagatatgtgattttctttctttttttttgttaagagacagggtctcactatattgaccacaccggtcttgaactcctggcctgaagcaatcctcccatctcaacctcccaaactgctgggattacaggcgtgagccactgttgccggccaatttctacactataaaattcacccattttaagtatacaattcagtgatttatagtgagttcaaaggtgtgcatccttcatcatgattcaattttagatcctttccatcacccccaaaagattctttttattcctttaagccatcccttctggttcccaccacagccccaggcaaccatgaatctcctttctgtctctggacttgcctcatttggacactccctgtacatggaatcctgcagtatgtggtgttctgtgactggctttttgactccgcatcatattttcgggattgatccacattgcaggtggtatcggtactccattcccttccggtgccaagtgctggtccttggtgcagactgaccgcatggtgctgaccagtgtgtcagctgatgcacggtctcattgctttcccgtgccaccctgacaagagtggttcccacttttgtgggcacacgggagggggtctcggctctggaagtgaccagctttgtggtttgtggggaggctggtcgcataagtccttagaacatcaactgtcacttgggagccgggattgttagcataggattgttcaaaaaatctaataagccaaatattttaaaaacgtgtttcatgttgcctctctctgacctcaggaagtaagtcactgtcaattattgtcgtgtgagcaaaaatctccagcttccttcaactgacagttcaagggatagaggc

SEQ ID NO: 136104 - DNA, 1069 bp, Homo sapiens
gctgctcatttccccatgagcagtcactacccccgacactgggtagtggctgctccttcagaaggaaggaccctgtcccttcaccacaatgcccagtgctcgaggctgtagaccccatcctgagggtgtgtgttctatacatgcagcccctccacttgcagcggcccctcccagcctctgcgagcgctggcgtgtgcactccagggctttatgttttccccgtgttgccttcttaggctctgctgcctaggctgtgacaaaggcatccctgaagagagttgttcaaaaaagaaagatagcccttgtgacgggtgagatcatccatatgttacccaataaaaagtcaaaggcttgaggggccctttgagttcactccagagaaaggtgcagcagcctcggctcagtgccccctaggcctccctgacgttgcacggcggcagcattagattatctcactgaacaaggcccgtccctttgaaatagcagtaggatgggaatgtccattaaagtaaacagctgtgcgttctgagaagcggggacactttgttctaatggccagcagttccttttcctgtttcttggttgcctatcagttctttcagatcgccttttcactttgaaaatgcaaaattaagtaatcccagttatctctgtttaagcgggtgcttcagtgatgtgatgacttgctttcaaaagctcagtgaggccgcgcacggtggctcatgcctgtaatcccagcactttgggaggccaaggcaggtggatcacctgaggtcaagagttcgagaccagcttggccaacatggtgaaaccccgtgtctactaaaaatacaaaaacaattagccgggtgtggtggtgggcacctgtagtcccagctacttgggaggctgaggcagaaaaatcgcttgaacccaggaggcggaggttgcagtgagctgagaccgcgccactgcactccagcctgggtgacaagagcaatactctgtctcaaaaacagataaaaaagctgagtgagaaggggtgaggatctgggcaggtctgcgttctgtgttggctggaagcctgctg

SEQ ID NO: 136105 - DNA, 1138 bp, Homo sapiens
cagggagaattgcttgaacctgggaggtggaggttgcagtgagctgagattgcgccactgtactccagcctgagcaacagagcgagactccattgatggacttgaaagaccaggaatatggtacaggttttgttttttcctcctgtagtgctaagatgaaagcagggctttagacaacgtcgcttatgttcgatgattctttttctctctgttcatcctctccagaaacattgcctattgcattgcgaccagcttttgtataggaagggaagaaacagatatcatttgggttttgtcatcagtgagatgctagtcttgttgtgggatgagaagcataagctggtaactgtcagcagggttaggagcagatagtggccatgtgctccaggcactagggaggctgggagatgtacagagtcccttggtggagacggtggggttcaagatggcgtcctgagggctgaatgtgggcgagctgggcagagtgtgtgcacagcagcgatgggggtgcatggtgtttccagaggggacccagtaaacaaagctctgcaggcaagaaagaccactttctctagggaggaaggacaaagggcctgttgttgcgggtgtgtgatgtttgggcagggtggggatggtgtccagaacagcaaggcttgttttacatggtggtgagtaggacttgattaaatgcagtgcctccctccctccccctcacctgatcaaactgctcttttgcgttgctgctagaggcgagagagaagatgatttgcgtgaggaagacggctgcctgtttcctgccgtggtaaatggattttacagggcaggaggttaaagcgtgactttagaggtgccttggttttgttttactgttccacatgagccatgggtgaccatttctaatacgttatcctttctctggaatattggtggttctcccctgggggcagttttgtcctccaggagacatgtggtaacatctggaagcatttgaattggtcacaactcggggcaggagggtgctactggcttctagtgggtagaggccagggatgctgctgagtcccctgcaatacccagggcagccctcacggcaaagaatgatccggccccaaatgtcaatagtgctgaggtggaggag

SEQ ID NO: 136106 - DNA, 1036 bp, Homo sapiens
ctcaaaactcctagtctcaagtgatcctcctccattggcctcccaaagcactgggattacagatgtgagccaccatgcccggcatatataatgtgttttttaataccacttaagctctgatttcctcgtgttatgatgaaaacggatactttgtcactgtccctgagagtggagcagcatagcctaggttccactggcagtttggacatgaagaaattataacaacagcagaataagttgtaactgtacttgtagcatactttagagtttgcaacatattttcataattgtttcactgttatcctcctggtcgtcctaggatgtaagacaaccagctcttaccaccatttttggggtgataaaaccaagagtaggaagcatttctccaaattgtgtacgtaagtggcagaggcaggtcttcagtaccagatcattcctcatcttttgaaacgctccgtgcccccaccctctgatgtgattattccctcctgtctgccaccaggggatcctgtgcatgtctgtcactgcacttgcctcatgggatttgtatcagccaggatctagttaggagacggaagccacacagtagttggaacaggagtgcttcataggaagcgggatttcgtggactgaccaaatcccaccatgcccccgtgcttacggcttttctgtttacagaagcaaggttgaacagttgcacagagatcgtgtacatgcaaagctcaaaatatttacattacggctctttgtgaaaaagtttgctcacccctaatgtaaagaactattaacttgtggcagtttattatctattatcgacgaattattaactagtagctactataggtaaggagaactctaaagaatacgagaatagcagatagagggagtggccactccctccagggctggggcacagagtacctgaggaaggaataaatttggaactattctccccaccccctccaaagctgagattcgaatctcgatggaagatggctcactaggtagtggagaaagtcgctgagggccaccgctg

SEQ ID NO: 136107 - DNA, 1116 bp, Homo sapiens
aggaattgtctctaaaagtcgctgggaagctgcccgccagagcaccagtggaacttgctaggaggccgcccttggagcttagtgccactgtgtgtgccacatgactgccaggtcccactggagcaggcagggaggaaagcacgctggaatgatgaaggcaagccctttccaccgcccgcgtgcctccaccgccctctgctgatggtgctcaccaggtgccagcactggagaaacgcccacagggtcctgctccaggatcaccatgtgggcagtgaaggtgcatttgggatgcagaggcaatgcattgctaactggcaatgttgcaacaggttgtcttcagagctgcactgtaaattcctctgacacacgatggtgttccagaaatcctccctgaacgttgctccccattaaccatctcttaggtggatctcggcctgtgctctgtgaaattcagggctgacatggtggtcaggatttggccaagtcctgaggccccaggatctttgctacatgtggagaggaggcacacacctttgggctctatgctgacctccctccaagaagactgtcaccccttgccacagaatgcacactcttcttccggtcccgtccagttggcctgcattctgacgctgcagctctcacctgcccagggcacattccacccctgcccgtttctcccagtcactcctgggacagtcagcttgccttccgttgctctgtagaaatgctgtctgccaactcagtctccaccacctccagatcttcacctcatctccctccacatttttgggagccacatgcccccttttcacctagccgatcacccagccgtaggttttctgtcatgacactcccttggcctgtgtgtccattagcatggctttgtcacctggtgcagccacgtcctcgtcctctcctcatgcctcatcctcgcgcctctccttgccatggtgcctcgtgtggtgcagccctcattttagggagagatgaaacaagggctagacctttgtggactgaatacctccttgagcatctagttccaaaacacacgaggagggttttggtttattttgttagtgttatttattatttttttttggggggggtgtatat

SEQ ID NO: 136108 - DNA, 1522 bp, Homo sapiens
ttagggctatgacaaaaaacagatacgtgttagcaaggatatggagaaattggaaccttcatacaccgatggtgggaatgtaaaacggtacagctgctgtagaaaacagcctggaagctcctcaggttgttaaatgtagttatcatagggcgcagcagttccactttataatagccaaaagtagacactgatgaatagataaaatgcggtctgtccatacaagtgaatgttactcaaccataaaaagaaatgaagtactgctacatgctacaacgtagataaacttagaaagcatcgtgctaagtgagagaagccagacccaagaggccacatattgtattactccatttatgtgaactgtctaggacaggcaaattcatggacacagaaagtacatttgtggttgccagaggctggagggattggaaaccgagtagtaatgagcacaaggtttctttcggggttaggggaaatgccctaatattgatggtggtgatggttgtacaactctgaaaatactaaaagccatgctttatttgagtgaatatatggtatttgaattacatttctataaagctattacaaaaacagtctagttccaggattaatgtatgagaaataattaataagtaatttaaaatggtcaaaaattattgtctggttaaaggagatctagaaaatgaatcagtatcttcaggtcccctgttttccattgtgtgtgttctcaagctttcccattccctggataaacaggagtcgtgtccagggaaggcaggccagggtgaggggtgtagtgcatccctgatcccctgagtggtaataaggtcagcccccagggcccattcccgccaagtgtgaggtatgtctgctgcgttccgaggacctgctctgcctcaggaattgctgctcgtggaaggctcatggaacatgcttctctgttacagattgaagagggcagtaaagccgcggcggtcgacaagttactggctggagatgagatcgtcggcatcaatgacattggtctctcagggtttagacaggaagcgatttgcctggtgaaggggtcccataagaccctgaagctggtcgtcaaaaggtaagatctgagcttcctcccacatttaccacgacacacaggaatgagtggaacatcaaagtgggaagccagttgtcctgcccacatcactacagagatctcgattgggacatgcacttagagttatatgtctcggccaagcatgggcccggcatcaagagtctgaacggttcctaattttattacgacgatttttataaattttaatgtattaagtggatttgaatactcgtatctttcctttgtttatatgtagattattttcttggcaggcagaaaacggtgcttatgctcccagtgaggtgacatgttgttgcctgtcttgtacacaaggtggcaggccactgcgctttctgttttcatgctagaaagagagtgactgtcacgaagatgccagccaccaagggtttagagcactgtgctgag

SEQ ID NO: 136109 - DNA, 1015 bp, Homo sapiens
tcccgctgccaaggctgactgcaactcccttttcttctgtctcctgtactgtctcgttctgggctcccagagaccccaaaaacactgggctgtgcttgtggtcttactgtgtgtctcttctttgatggagacaccagcttagtcagcatagctggccaactttgtatcaccagggcatagctatgcgtagaaattcctagcatgggagttcctgagtcggaaggtgtgtccgttgtgaatgttcagagacatttctgagtttctcagaccctttcacatcatctctagcataggatatttgtagtttgtttgtttgtattctctgaatgtgataggtgaaatatggttttctatttacatttgcatttccgtagttatgggagtgaagtcaggtatcattccatatgtttagaagcaaggtagatgtgattctttttttgagctagaagtacatatttagtgataaagatagacagtctaaaatctgttcaaaggaaagccatgccacaggagaactggttggtgggaggagagagcgaagcctcagggcatctgctggctggtttcactgagtaggtacttaaaagactcttgggaaaagggattaaacttttgccctgaaggatctccaggagccactgtgtagaatccccattttgtgttctgcagacccactttcctttaaatgagagatgtggacaaaatgataatgtggtttaaatagaattttatttaagtagtatgtgtaacgagatataaagcagcggagtttatttacaaatttttatttcccaacacactttcaataaccgtgttaggaaaaaacccacaagctgtttttcctctgctctcacacaacactcaacacagaagacttctgtgaccaaatgtgcatagaacttctaatactccaactacctttatgtggttttccttactacaaaagcaccaatgggtgctttcaaaattgttcttcttaaagccagaacacgtattcttctctatctaaatttaa

SEQ ID NO: 136110 - DNA, 1074 bp, Homo sapiens
gctcactgcagcctcgaactcttgggctcaagcgatcttcccaaagtgctggaattacaggcgtgagccgtcgcacctggcctctccatggttttttaaacatgatttgaatagtggttcacggataaactcccctccctgtagtgacagctgctacacgtcttattttgtaggctcattttatctttgtatgtgtggggaccaggggaccaggcagccaggataggattgcgatgggccactttcacaaagcggtggcatcttgtttcacaggcatgggcaacgtggaccttgtggtcgttgagaagctggtgctgggaaagcgatgcgggaggagacaggcggatcactatctccgcagacaaatgagggccagcgcttcctctcgcccagggcagtgggagctggagacaaagaacttgtaacaatcagccctaccaagtgcatgtatgttcttccttgtgaggtccaggtggcatccacggcccgagatgtcaggggaggggtgctgcccaggagtcagatctgtcggttaggtcaggaggagaggctgaggctggcagttttgcttttctctttcttcccaggcggtttgttgttctgtctctacttggcaggggagtgctccttgcaggaaagttcagggcagacatgtagccttttattatgtgtatgtgtgtgtccagtttttttccactgcactgttttcctaggtgcccaggcccacccctggagagtcctgggcaggtcttgaatggatctgggctctggaatcttcacacagagccacaggctatttcgctgggcattagcagcggatctaccgcttgctggccttaagcacaagttcttgggaaggttaaggccagaaaccgggtgaccctttggcattttcctcattaacttagcccagttgggttagtgcaaaagggaggtctgcctgatgccctcaagctgctccggaggagaggaagcagggttgggagggtggggaaggaccgagaaggggacggcagctcctagcttagctgggctcatcctatccactcggtgccagggaccgtggctgttgcc

SEQ ID NO: 136111 - DNA, 1025 bp, Homo sapiens
aattattttctaaagctttgcaattacccttttggctttttccccaaatatgcattataatattagttttgtttacagcaaatccacctgccaccttgtcacagaccccactctgggcagtttctcttgaaccggtcatgtgttgcgagtcattttgtgggggccaaatcgtggatagggttgattcatgtcacttcctgcctctttgctggcagccctaaaccctcttgtgaatctaattacatccactaagcttgcattcaggagcagcttagcagcagagggaagggttttctgcatcaggctgcaagggtttgcgagaccatgtggtgtggtcctgcatttgaagagaagaggctgcatgtcgagggagagcactcatgtttgctaggagctggtttcttacaacatgcgtcccgtcttgggcattgctaaggtgccctgactgctgctccaagcccacattgtgctgtgcccccctctgctgctggctccttggagctgtcctggagcaggtggccctgcagccctaaggttgattagcacagatgttccgggagctgctactcgcaacggtggcagcagtaaggggccgcctaagacgtcagcaggtttacacccccaccccactcccccagcaccccaccccctccagaactactcctgaggcagaaatggtgcatggtcagatggagggcatgctccttagtggggacactggaggacgtcaggtgaaacccatgccttcgaggctgtctgatgtctttgtctgtgattcaggagtgggtatttctattctgtgagcatttggggtctaatggctgtttgctactgtgcttattttcttgttaaaacaaaggagaccctgactggtttaggctattttccattattgtttttatttcatttatttattttattatgagtgaaggaaagaaaggagagagggagggagggaggatgggaaggaaggaaggatgaaatcttgctctgttgcccaggctggagtgcggtggctactgaca

SEQ ID NO: 136112 - DNA, 1369 bp, Homo sapiens
cacagaaacatgtctgtcctgcacatgagacccacggttctagggactaggtggtttaaagtgtttaaagagtgcgtggcttgtgcaggaggaaacaccacagccttcagtctactcaagtccttctgggagcccttgaaactcagccagagggaccgggagtgtaggcgggctctaggtggcgccagagcactctgtccccaactccacgggtctgtgattgagcgaccagcatgtaggggctgaaggtcctccccaccatctccttatcaacaccaatccagccatttcagaggtgccaacaaacagaaaccactctgaccccggcttgatccccaaatacattcattatgcaccaggaaattcagaagacttgagaaaaaaagcatatatattagtaaattttcactgtccacagtaaccaagatatcttcagttaaagcagaaagagtgcaactcttttcactgtgtgtcttcatttgcttatttaaaaaattatccctaggccaggtacaggggctcacgcctgtaatcccagcactttgaaagaccgaggcaggcagatttcttgagcccaggagtgtgagaccagcctgggcaacataacgataccccatctctcattatacaaaaagttagcttggcgtggtggtgtgtgtctgtggtcccagctactcaagaggctgaggcgggaggatcacttgagcccaggaggtcgaggctgcagtgagccatgattgcgtcactgtactccagcctgggtggcagagggagagcctgtcaaaaaaaaaaaaaaaaaagccacaattcgtataagaactgctgaccgtgtcatatgtaagaacacatatatctgtatattatctttttaaaaagcagcttctgggtttgttttcattttttcattgcctcatacagcattgctcattctcttcagacagtttggaaagagtgtgtgcttgtgcaggaataaaccaggtgagatgcattttctgaaggcatggaagtctcacttccaggcaggttccctgcctgcctccgacaactcccacccaagatgccttctgcacatgcattcccgtccatggggagccctcttccatgccatcagcctctctggctgtgacgcccctgttcggactgtcctatcttcctctttccctggcctgcattttgacctcaaccctgtatctttttgtccccgccgatggacacatccacagggatgtcccatagctatgggagatgcacaatatacactttgggtttttgttgttgttgataattatggtaaaatacacataaaatttaccatcctaaccattgtaatgttcagtagcattaagtgtattcacatcatacaaccaat

SEQ ID NO: 136113 - DNA, 1135 bp, Homo sapiens
tattcccgaagcagggctgaactagcgtcgtcttgagtgtcagacgttttcttttcctagccttctctttttctcccctttcctccagtttcagtcagtctagtttattttcttcattaattaactataaaggaagatgaaagaagttgtggatgtcatagcacagagaaagccagctgaaaatgaaattcacatggccagaaccttccttacgaggattttgagaaattccatgaggtacagtctgggttttacaattgctttccttccatggggtgctgaatttgtcttttatactttctctttggttcctgggaaactgtcataaagtcagcatgttccacattttgccacccgtatacttttcctcgttaaaatgatctgagtcatcgaaaggtttgtgttatacatgcttttcagttttattttgtaaaatgttctttattgcataatgttctttaatgtttttgcctgctgggaaaaacatctgatctccacaaagtatttaaagaggcccgcttgagctcgttctccattcttgattgggttatcagctgtcagttctgtcccaaattagagaaatgtaaagctggcttcctaccatgaggctggagaagtgagctcgggaggaggatctcacgcccagcagtgttcccctggaggccctattgcattaccgacatccattgggatttctaaccagacacacctcatcacatctgggcagatgtggccaagacactaagaagccacacatgggatggtggggactgtggcgggggagcccaggaaagctcgtccatattcaggagccctggctgaagggactttagccttttggtgtgggttgtcatgactccctggggggatctttggttgactaagaggctcaggggaagatgcggctactagtcttagttaaccagaaggtggctgtctttactttgttacctaggtaaatagacacagataagctgtctgaactgtgtgtgacccagccgcctgagggacccatataccttttctccagcaaaagataggagatgctgtttgtgttcatactggggcagggagagggcaacatttgcttacttatttatttagaataaatgttctttatttatttttacatttg

SEQ ID NO: 136114 - DNA, 1343 bp, Homo sapiens
tcctcaagccccctgcactgtttggcacgagcgtgtgccctgtgtgcggtccccaagccccctgcactgtttggcacgagagtgagcgctgtgtgcagtccctgaccccccgcctcccctgcgttcttttctaggaggagcgagctgggctggaggcctcactcctggcatgccaccaagttctctgacagccaccccgagctagcggcctccccattcacctccaccagcggctgtccttcctggtccggccgacaccacgcgaggtaggcacccattcccgtccaggatgccaggtttgttcagccttctgcagggagcgcactcctgactgcagaatgattttgatgtttctgatgagactgggccaccgacacataatcacagttggagggctctgaatttttgactgaaccggcaagcgtgtgacacaaaatgaaatggcaagacaaggcatgagcaagaaggggagcataggacttgggtttcagccaagcttctttgggattggccaggtgggatgccaggcagtagggttctgagccggtggggtggcatccacggcacccctctcctttccagggttttacacatggactggaaggcaggagatatatatggggtggcaggtatatcttgtaaaagctcccaagaggttctttaagctttggtagcctctcctcaaccctcttggagttagtggcagtatcctcactagtctcctgttaagaggatggcggtaacagcagatagtctgcttttggtgtgcgtgtgtggatgtctccctgcttgcgtgagtgtgtgtgtgtatctgtgtatgtttacgggtgtgagtgtgtgggggggtgtgagtgtgcatgtgtatttctacacgtttgtgtgtgtgtgtctttgtatgtgtatgagtgttcatgtgtctgttcgtgtgtgcctgtatgtgtgcctgtgcatctctttgcttgtatgtgcatgtgtgtgcacatgtatatgtgtatgtgagtgtgtgagtatcagtgagcatgtttggtgtgtgtgtgtgtgtgtgtgtgtgcgcgtgcgtgcacacgcaggtatgtgtctgtgtttggagctaatgtaaccactcagtttttggctgttaataaatgctggtcttggctgggcgcaatggttcatgtctgtaatcccaacactttgggaagctaaggtgggaagattgtttgagttcaagaccacccgggacaacacagcaagaccccatctctattaaaaataaaagaaaattagctgggcattgtgtgcacacctgtagtcccagctactcaggagactgaggcagtaggatcactgaagcccaggagttc

SEQ ID NO: 136115 - DNA, 1048 bp, Homo sapiens
ggccgaggcaggcagatcacttgaggtcaggaattcgagaccagcctggccaacatggtgaaaccccgtctctactaaaaatacaacaaaattagccgggcacagtggcaggcacctataatcccagctactcgggaggctgaggcaggagaatcgcttgaacccaggaggcgaaggttgcagtgagctgagatcacgcgtctgcactccagcctaggcgacagagtgagactgtctcaaaaaaaaaaaaaaaaccaaaatcaacaacaacaacaacctgagttgtggtgtggccacccctgcgcttaactgttgattgaccatagacgtgtaaatgcagacgttgcctgccaacgatccgggcatcaggctgagaatgtgcgctagggttgcaaggcatctgtttggtaaaagccatgtaacagggaggacacagtcttttcagcctgtgcccagtttctccgtgtctctactaaaatccagatgtgctgagctgcaacctcagcctcagcaacatcaccgtgggaaattactgtttggcattttggtatttccacagagggtcagctgcgtccaccgccttgccctttgccattgctgttgctaaagcacaccatgccttgtccttcttctcattcttgcagttcttcctcccacgacctgtccagttcctgggagcagacgaacctacagcgcaccttagatcacttcagctccttggggagcgttgacagcctggaccacccctccagtcgcctctcggtggccaagtccaacagcagcatcgaccacctgggcagccacagcaagcgcgactcggcctacggctccttctccaccagctctagcactcctgaccacaccttgtccaaagccgacacgtcctccgcagagaacatcctctacactgtgggcctctgggaggctcccaggcagggtggccggcaggcccaggccgcaggcgaccctcagggctcggaggagaagctcagttgtttcccgcccagggtccccggtgacagcggcaaaggccccaggccagagtaca

SEQ ID NO: 136116 - DNA, 1523 bp, Homo sapiens
gaggcggctgcggcacagcactttacggccctggcccaggctcagcctcgtggtgaccggagaccagagctcaccgatcggccttggaggtcagcacacccggggagcctcgggaagggatcgggaggcccgggctgcccacaggaggcccacgcagacggcagctggccgccctccaaggatggagcttccagtaggctgcaggcctctctgtccagctcagatgtgcgcttccctcagtctcctcatagcggccgacaccctcccctatacagcgaccacagccccctctgtgctgacagccttgggcaggagccaggggctgccagcttccagaacgacagccctcctcaggtgagggggctcagcagctgtgaccagaagctggggagcggctggcagggtccccggccctgtgtgcagggagacctgcaagcagcacagctctgggcgggatgctggccttctgacacagcccttggagccctcgagagtcttcccccacccacggtgggccagagcccacgccatcacctacctcagcctgagggtcctccggatgcccgcgagacaggacggtgttacccgctggacaaaggggccgagggctgctccgcgggagcccaggagcctcccagggccagccgtgcagaaaaagccagccagaggctggcagccagcatcacgtgggcagatggggagagcagcaggatctgcccgcaggagacgcccctgttgcactccctgacccaggaggggaagcgccggcctgagagcagtccagaggacagcgccaccagaccgccaccgttcgacgcccacgtgggcaagcccacccgaagaagcgaccgctttgccaccaccctgcggaatgagatccagatgcatagagccaagctgcagaagagccggagcacagtggctctgactgcagcaggggaggcggaggatggcaccggccgctggagggccgggttgggaggtggcacccaggaaggacccctcgctggcacctataaagaccacctgaaagaggcccaagcccgggtcctgagggccacgtccttcaagcgccgcgacttggaccccaacccaggagacctatacccggagtcactggaacaccggatgggggatccagacactgtcccccacttctgggaggcaggcctggcccagccaccctcatctacaagtggcgggccccacccgccccgcatcggaggccggagacggttcacagctgagcagaaattgaagtcctactcggaacctgagaagatgaacgaggtgggcctcacgaggggctacagtcctcaccagcaccccaggacatctgaggatactgtgggcacgtttgctgacaggtggaagttttttgaggaaacgagcaaacctgttccccagaggcctgcccagaagcaagctcttcacggaatcccgagagacaagccagagaggccgcggacagcgggccgcacatgtgagggcacggagccctggtcgcgcaccacctcccttgg

SEQ ID NO: 136117 - DNA, 1048 bp, Homo sapiens
gaagtggacgtggggtcttatttcagtcatctcaatgaaatgctttgtagaactgccctggcaaggcaaacccacaaatgagggctttcataatcacagatgtcctgaggaaggcagcttgaggacttggtgtctcattatgttgccctttgcaggaagcttctgtcgaactgcgaaggcaggcaggggaccccggcgagcccagagaagagcttccctccgcagtccgggccgaggagggacagtccacgccgaggtgggtgaaatttggattcagagttactgaagaggcgtctgagggtgggcttctgtacgatgggtgggtgcttggttaacatggctagatgtctggcttttgccaaacccaaagcggctgaaatccggcgtgatttctagcatccctgacgtactggaggtctgggcagagcctgtgcaccctgcagccctgcctggagacacatcccagggcggggaggccttcttacacggcggtgacattttttggttcttaaaatggctactgtgttttccgcacggtgagactgcttatggagacataatgagaagtccagttgaacatactggagctgcacgctttgcacagagcgccttatggaagggcagctttagctatctagcacacagctgtgtgcctagccgcggcctggaaatcagagttgcctctaaggattgttagtaagaaaggaacagggcaggccttcctaaattggacctagttaatgagttaattttgagctttaaaatagaaatcgagttagtcacctcccaaagagaggcttcaagcatctgcaggaactgtggcagcagcaggagattagagcgttttgtgccataattccagaatgtgcgccgtagccgcttagttgagacaaggacagggttagattaaatacatagtataatctgtgctgggtgtggtggttcacacctgtattcccagcactttgggaggctgaggcaggtgaatcgcttgagcccaggagttcaagaccagcctgggcaacatggtgagatcccatctctacta

SEQ ID NO: 136118 - DNA, 1028 bp, Homo sapiens
caaacacacacacacacacacacacacacacacacacacacacacacataaaggaagactgccccccaagccttttggggttttaaattacaagacacacacacacacacacacacacacacacacacacacacacacacacacacataaaggaagactgccccccaagccttttggggttttaaattacaagacttttggggtttaagcactgaagtgttgggaatgttccccactgaggcaaggagttgctgatgaagtgatgggaaatgcaagcggagccttgagccgtggaggtgaaggttgacggagcctgcgtgagcttgcccatcaacaagacagcaggcacagacaggccagctgttgtgagcttggctttaggactccattcagtaggcaggaggagagctgcagcagaggcgggctgtgggtccctgaagcacatcgctgccttcacagctgggcgaactcccatccagcacggtaagcagagccgggtaagggacctctgcgtttgctctcggggcacttcatcccagatgggaccggtttcaggacgcctgcgccgtttgttaggggtttgtagttcccagtggctcttttgttctgctatcttgaagggcaggttgcttgtcagctcacaatgctgtgggtaaggtctggtgaggtcggcgaatgtgttctcattgtttattcttctgcctgaagatgagaaataatgcaaatcagggtgcagattccggctcgagctccacaggcgtgcacgtatgtgtaagggcatgctcgccggtgctgcatgtcctcgtggatgcatgcaatttttacagctttgggattcacggttagctgaaagcacattggaactggaaggcggtgctcttaacaccgtgttctaggctggaagccgtagagccatcatctgctctgatgggactgcagcccttggtatgtgggacccttgctccatgtgagttctgcagatgggttccccgagggagctggctggaggacgccagcatcgcatgaag

SEQ ID NO: 136119 - DNA, 1028 bp, Homo sapiens
atctgtagtgaaatacttgtgctcttccatgttgatttccttcggataaaattctgggcatggagttgctaggcaggcgctagaaaatatcaccacgttgccctccaaaaagtgtatgcttactatttacactctaggggcaccgatcgcccaggacagtcctacttctcccaaaactttgtcaatattagacatttttaaaattctgtggtttgataggcaaaaaagttatttcatttttaacttgcatttcttcagggactagcaaagtcagacttttttggtgcactgactagccatttgtgttttttcttttgtacattactcttcagcgcgtgttcattttcctactgaagatgagccctttcttgattattgtcatttaggttgcagataacatccctaccgtgtgctgtgtgccttccagatgttagtgggtggttacagttcaacttttttgacatacaagtgtgttgaattttagcgttgtcgcccttgcacctggagcctctgtgtggccagttctgccttttggtggctactggcttctgttagttgtacattgccattactggtctcttgttaccatgtgtgccgcagaaggtgtagccaccaggagctctgtcagcatgaattccctaggaggtgtagacatccatctcggaaggctggtagaaaaattgtctctgtggaaaaattaagaagtgcccagctttccgacaaccctaactcatcgtagttcccatcttttgctctggttgacaggaaactcgtggtcctattggaagcacaaccataggacctctgtacattctcgtgtccggtctgctctttgcataagggtgcttgcccctgcttgtgcccttctgctttttgtttacatttgctctcactgtgatgtttttatgttcattttgatactcaagttgtgtgtttgttctcctgcgtgagacacttctaaacatttcatcatttagggtatacatagatcaaagtaagtggggaccacataaacatatgtagaaaca

SEQ ID NO: 136120 - DNA, 2247 bp, Homo sapiens
gggctggctcaacatccacattgcctggagggctttccctgaaacacaggcttgcaggcatgccagcccttgctatttcccacctctgcccaggcctggccctcatcaaggcgggagagcccagctcccagggctcacgctctggaaccaagaatgtggctctccaggcacagagacaatagaggcctggaacagatcctcaaaatgtgtgtgctgaagacatactcagggtccgatacttgagggccatctcacattatcatctccaaatctaggcaggttctgttattgggcattaacccctcgagaaatcagtgcctgtaactatgatttggatcatctgtgctttggatttctcttttaatcttctctgtctcctcccattcttaaccacaagtgatttatcagcctctctaattcaacttcattactctttgccatccaagtccctgcaagcacaaataaaacccaaaggaagcagcagacctttttatccatctgtgaagacactcaagaaacactaaattcatctgactttctagagtaattgctttccccacatggcactagaatcctggcatacagggagcagcttcagcagagacacggcagtagagaaatgactgactgaaggatggttcagggctgttgtcctccctgaaggtggttccaacaggacacaaaagttgcagcagagcctgtgagaacagctgtgtcctttgtcgtcactagctggtctgtctgttcattgggcaatttcagtttttatgactgaaagctgggcatgcaaaggacaaccaaacagcctctagcctgctgatgctcacagtctggaaagtcctatggtaaatcaatatttcttttttgcttttcagagacagtctcactctgttacccaggcaagagtgcagtggcatgatcatcgctcactgcagcctccaactcctgggctcaagcaatcctcccgcttcagcctcctgagtagctgggactaaaggtgcccaccaccatgcctggctggtttttcaattttttgtagagacagggtcttgctatgttgcccaggctggtctctaactccttgcctcgggcagtcctcctgccttggcctccctaagtgttgggattgcaggcacggggcaccacatccaggcttttttcatttgtttttagagacagggtctccctctgtcacccaggctggagtgcagtggtgtgatcatggctcactgcaaccttgaactcccagggtcaagcaattctctcacctcagcctcctgagtagttgggactgcaggcatgcatcaccatacctggctaatttttaattttttttttatttttattttttgtagagactgggtcttgctatgttgttcagagtggtcttgaattcctcccacctcggcctcccacagcactgggattataggtgtgagccactgtgctcagcctggtaaattggtatgtctaaggagagtgtttggtgccattgttcccaggtgttcacactgtttaaaatgtttctaatacatctcagcattgataggttggttgcttggttggtttcttgcctcttttgggctccatcgccttccccactgtctcctttttccacctcatctggcctttgtggagtgctgtgttggcaaaagagctttccacctgtgcctccccaagggtgtgtgtctgtaagagctgcccagggcctgggaaggacagtggagacaccaggtactcgttcgggagacttgtgctcaaaatgacatgggtgtgccggctcttagctgcctgacccgcattctgaggcctggtggcgccgtgcttcttcagcgtgtgaacacctgcctggcagcgtctgatacacctcaccaggctgaagggcagaccagctacctgtgattcctgataaaaattctgtgctttacagaatcccttctatttatgcccacaaccaatggaggagtgctttctagatgataacctcaaactgtcagtgttgagcttgagttgatgtttgagttactgagcgttccacgttccatgctcatggaaacctggctctgtttggaagcagcaatgctgggccctaccccagttgtcccatgagataattgtgctctgtgcacacagttccggtcccagaccctggctttgtagcatacattttcaaggaggactcttgggccaccacagatactgccctatccattgctatttttgatggtatgcttgtgtataatacgt

SEQ ID NO: 136121 - DNA, 1425 bp, Homo sapiens
aaacaaatgcaatttgtgtgtgtatgtgtgtctgtgtgtgatgtgtgcgcctgtgtcttgaatgcttcatgttcccttgtgggacatgccagtcgacagcctcatgttgtctgaggtgcgtcacgactccccaccttgcatgaggagttgcggtggcgacaggtgtgggaaagtgcatatggatttaactcctgaaagtggcttaaggggattgtgaagatccaggtccagtcccttgtggtgggaaggtattattggaatcgttgattaatttgtacttgttcttcctctagacaagcagatgcccagtgtcgggaaggcagcccaggatcacagcagcacccaccgagtcagaaggcaccgaacccacccacattctctgaactatctcactgccggggagccccagagctgccccgggagggccggggccgagcgggaaccctacctcgagattatagatactcggaggagagcaccccagcagacttgggaccccgagcccagagccctggctcacccctgcatgctcgaggacaagactcgtggccagtgagctcagccctgctctccaagaggccagccccacagaggccaccgccacccaagcgcgagcccaggagatacagggccacagacggcgcacctgctgacgcccccgtgggcgtcctcggcaggcccttcccaacgccatcccctgcgtccctggatgtgtatgtggcccgcctgtccctctcccacagcccctctgtgttcagcagtgcccagccccaggacaccccgaaggccactgtctgtgagcgtggaagccagcatgtgagcggggacgcatcacgtcctctgccagaagcactgctccctcccaagcagcagcacctgcgcctgcagacggccaccatggagacctcgcgctccccctcgccccagttcgccccccagaaactgacggacaaacctcccctgctcatccaggatgaggattcaaccaggtactgtcctgcgacggtgttccctccccatgaggctcctaatgtgggacgcgggttctcagtgggtctttctggggagtcacctgggcaccttgctttagctcaaggcgttggacttaaagtcagtactggggaataactgtgtggacagaaagtgaagcttcagtggtggttggatttttatctcactggggggctgctgtttcctgcagggaacaggggtagatgtgaataggtgatacatcttccccttcctccaagccagatgcatttatatctgcattacccacaggcatctgcagggtagaggtctgtttttttttgtcgttgttgttgttttaatgcagtcaatatttgtgattggaatcgagtttaacctaagcatgcgacctttaggtgaaattggtatttttcatggtgtccagtattttcttac

SEQ ID NO: 136122 - DNA, 1031 bp, Homo sapiens
gtgcagtggtgtgatctcaggtcactgatctcagctcactgcaacttctgcttcccaggttcaagcgattctcatgcttcagcttcccgagtaggtgggattacaggtgcgcaccaccacacccggctaatttttgtatttttagtagagacagggtttctccatgttagccaggtgggtctcgaactcctgaccacaagtgatccacccgcctcggccttccaaagtgctgggattacaggcatgacccaccacatctggctgacacttttttaaaaaaaaagcaaaactgtgccctttggaagtaatacagaaccgatgactcgctgcttactgcgagatcgtatctcactggtgtgcaaatctgtgcaacgctagcttgaagcacagcgggcggggggtacaaggacagtgttgggtgggctgtcctgcatatggcacaggaggttctcccaagtggggtggtggggggctttggcctgactccaagcacggccactccggagaggagccctccccaggccctgagaactacgcaggaacccgcgggcctgcaccaacctaaggacggatgggaatcctggaaaatgcccatccactgcaggcttcccctacaaaagaacatttaacccaacagggcttgttgaagtttgcattatcatctgcggaatgacaaatggtattaaatagtcctcacagccctccacgaacccctggaggacaccttgggatgcctcaggggtggcattggcggtttgagcatagaaaggatgctgtggttggaaggcggaggtaggagtcagagggagcttcttgaggcctctgcctcatccaggatgtgggatcatggaggctccttcgagttgggtggctggctagtgcctttgagtcaggttcccatccagaggggagggcaggggacacgtcaatcagggtctgtggctggagcatgctttgcgatttcagcagactgttcatcttccagaattgagcgggtgatggacaacaacaccacggtgaagatggtgccc

SEQ ID NO: 136123 - DNA, 1016 bp, Homo sapiens
agaagcccagcaacggaggaagctgctccccaaaatcccctctcctagaagcacagaggagaggtgagtaggcgtggcctcccagcttgggcgtgactctgcctggcatctcttaggcttgtaaagggaagggggtctgcctctctgttttcatgcgtgcttttggggaagacgggttttcataagggctcctcgatgcttagcactttttggcttttttgtgagcctccggaaagagaaatggagggttaacggctttgggcctgacatgaaaatacacactgcagaccaccaagctgccttggcctgaggccagcaggatttctgatgatgcccacaggtctcctttctcgtaagacagctgttctcagtgggggccgctgtctaccctgggggacagttggcaatgtcactgtggggaggggtgttccaagcatctggtgggtggagcccaggaacactgctcaacatctacagtgcacaggagggccccccccacagagagtcatccagcccccacgtgtccctagtgccaacatgagaatgaaggcttagattgaatatatatgtgtttctttatgaaatgtttttttaaaactttatttgaaatttttttacatctgcatttaaaaaatttattataatttggccaggcacagtggtgcacacctgtaatcccagcactttggctgaccgaggtaggcagatcatttaagcccatgaattcaataccagcctggacaacatggcaaaacccagtctctacaaaaagtacaaaaaattagccaggcgtggtggtagacacctgtagtcccagctactcgagaggctgaggtgggaggatcacttgagcccaggagttggaggctgcagtgagctatgatggtgccactgcactccagtgtgggtgacagagtaagaccccatctcttgaaatagaaatgaaaaaaaattacgacaatttacacctgcctgaacaaatgtattttaattggttttgtaagtagcactttcag

SEQ ID NO: 136124 - DNA, 1048 bp, Homo sapiens
atccaccttggtgaagagcagctgaagtgcttattggacagccttcagcccgaaaggggcaaataagagaccagtccccggtggaggaggggcacggggcctccgagctccagctccgttcccaaggatactcgtgaagaccccatctgtgttcatggcctggaaagagacttctcccatagcaaagaggctgttataaaagcaataacttttgtgtttgtgtgggatgatttatttaattttttagtttcccctttgattgctgagagccattttcctttacacataactacacctgacaccaggctctgctggatgtgagtttccactgcatgggctgtgggctgggcctgtggtgcctgccgagtggtcactgtcagtgggaaacccgttgttcctcccgtcttcagatgctgagccaactgcttggacagcagccagcgcgtcatgacgtgcatgagagggggaccctggtgctcatcttctcttgtcattcatccaggcatgggctgccaggttttgtccctgctcgttcaacagtgtgagcatttgtctctgttatctaatgatgttctctgacccagcagaaatcatcatcatgatgatgataatttattaactttttggaagggtgaatagtttcctaatggttaaaaaccaactgtgaaaggaaccacctgtgtggttgggttcactcattctcagattaaattgccacttaaagaaataacgtgcatgctttaaaaaacacagtcacgcaccaagcaggcaaatagctttagtccttctcacctcacatcacagttgttctgcaaagtaaaattttttggttaagagcgtgtccagtagtaatgtgcttgttagctgtttctcaagaccaacagaagattttttcagttactttccccccatgtattttgtatgcatatgattgtccgtgataattggctacttttccattgtttcctccttaaatcgtttagcatggcatgagggccacattccatggacgggaagaccccttcctcttcagaggtcccgtggacta

SEQ ID NO: 136125 - DNA, 1111 bp, Homo sapiens
atttcattttgtcagcagcagtgaccacagccttaccaaagcagacgcgtgcgcgtgcacagatgcacacacacagatgtcttaaaagactagaatccacacttcctgagccagaggggccgtgttgacggtaatgcattctctatagagccaagtccaaactggcaagctcaatgatgcaggcaataaaccgcctttttggcagcctaccaatgccaaaaggataaatgtctttccaaaagtgtgtattcctgttaaattaagctcttgctaacttgaaaaatccctgttctgccagcgaagcttcctcctcctctccagctggtagtcacttgcgtgaatgctggtcagtctgaaaaggtgaagctggctgtgcacttacccccatctttctccctcggggagacgacccaaggaatttcagagtattttgtttggcagagcttttacctgttattctttgccctcaaatacagtattgtggtcattttgatgatatgtgtgtaaaatgtgaataatccaattggtgtctgtactcagccttttgatgtctttttaggactttctcttctacacagcaatacgtcgtgctcgagtatccttgtagcaaagcacatagagccagctgtcctgtcagttcccctgtttgcctctgaaacgtctggttagtggggacccaaagattctagtgagtcaacatccataactctgtatctagttgtattattcatagaaaatcaatctggtgctaatggttggccctggtgttgttgggtggcagctgctccttcgccctcttgtagtgtggctgtggagggctctgcctatggggggtggcctgtggcttgtatccttcagtccaccacagcaaatgtgtgtagatttcatgctcgacacttaccactcacctatcaacagatcatcctgcttgactgtaacaaaataaatagtgtctcttcaagtgaatggagatgtctttgatttacctactttacagcttttgtaaaaaaagaatgtcctcaccatacgtcagattcttaagccatctgagtaaaccgtgggattgattatatgtgtgtaatttatttacactagtcggtttgtggtgagg

SEQ ID NO: 136126 - DNA, 1015 bp, Homo sapiens
tctgcttggaacaggtgtgaggggaatttacagcctgtctgtcattttccccaaatcatgcttccgtgagctgcccggcttgcactttggaatcttactcctcccctctgttgcaggtggagttaccaggatgacggtgtcattggtggtcatcatgtttgaattaaccgggggtctggagtacatcgtgcccctgatggcggcggctgtgaccagcaagtgggtagctgatgcatttgggaaagaaggcatctacgaggcccacatccacttaaatgggtaccctttccttgacgtgaaggacgagtttactcaccgcacactggccaccgacgtcatgcggccccggcggggagagccgccactgtcggtgctcacccaggacagcatgactgtcgaggacgtggagacgctcatcaaggagaccgactacaacggcttccccgtggtggtctccagagactccgagcgcctcattggatttgcccagaggagggaactgattctcgcaataagtgagtaaagagagggaagctcacattttaccaagagccgaatggcatcctttgtacccctaacattatccaagatttttgaggtgatgtgcattaagccaggggctctcaagctttcacatgtctctgggtcacccaggggtctggctcaaaagcagattctgattgagcaggtcttgggtgggatccgatactacatccctcacaagttccccattaacgccgatattgctggtccccacgtcacactgtaaggaaaaaggctttaaacccaagtcttgggtagacattcttggttgcaaagtgactgcatgtttgcaagcagccccctggccctgctccgctgctgcctttcagcaattgttggctaaagctgagaaggaagagaggcgacagcctggagtggcccgggctgagctgtctcagagactttcaggtgtaccaaccatccggctgagatcacgagttctctgccccagacaccccttgccaccacacaa

SEQ ID NO: 136127 - DNA, 1023 bp, Homo sapiens
tgggctggccgtattggtttcttgttcctcccaggattcataatgccatttgggccagttataagttagttcgtaaaaagaaaaacaatgtattaaggtcatcgggcagctaagtaagtttcttgtcacctcaaactccagcccatgatgaggtgaaggagcgtaaggaaagccagagtggagggccctgggctgtttggggtgcccggagtctgcggtgaagcagtgaatgtccccaaaggggccatctgggtcaggcccatcttgccagactttggcaacaaatgatccggtcacagcaggggaccctcacacagcattagctgcagagagatgccaattccacagatgtttggctaaagccccttattaagaatgtgtggttcatcctccaaaccccttttctgtgggattctagatggtgtgtgtgagtgtggggtggggaattgctcagcaaggggtttttgtgtggctcattgttcctgctcaccccattctagagaacgccagacagaggcaggagggcattgtgagcaattccatcatgtacttcacggaggaaccccccgagctgccggccaacagcccacatcccctgaagctgcggcgcatcctgaacctcagcccgtttacagtgacagaccacactccgatggaaacggtggtggatatcttccggaaactggggcttcggcagtgcctggtgacgcggagcgggtgagtagccggacatgtggccagaatgacctagggagaaaaagatgagtgagacatggtctcagccctgaagaatgtggagggccatggggtggaatagtccttgacagagaatggcagtaagctgtggtgaatgtgttgaggaggaaatgtacagggagcttgggactgagggctgggcagccgtgcagccagagaagggggtggtccaggctggactgctgcctgggctgagggaggttgagtaaaaaggggtggagccacaggagaagggcttggtgttgcttttctaccaccccatgtgac

SEQ ID NO: 136128 - DNA, 1937 bp, Homo sapiens
ccaagtatgtgtgccgaaaaaatacttatctttgccagttttactgctgagccaaccattcagataacatcacattaaagctccctacctgagaataaagagtattttaaaagaagcccgtatgaggttgacagtttggtcctttctctcctgcgtgagttggccttgaccttttcaggtgaggccaagctcctcaaccaaatgaaaatgggcctaacagagaacaacacctgtgtgattttaaaaaaaaatagatgagccctgtgatggaagaaaatattccctttaatgtttttgccttcattttgactctttgttatcaagtgtacgataacatcacatctgagagtcacaataaatgctgtttttgtgccatcataagctcccccctcgtccaaaagcaggttgattttattctttctaactggtggactcttgtttcaaaggccttgaactccagactccaggctgttactgaaagggctttcacatgtcaaaaggaagcatctttagctggaacaaaacagctcaaagcctctattctctctggtactgagccttgaaaatgaaaataaaagcaaggcgagggcaagaccaaccaatcacagcgcagatacaagagcccagcagccgagaaattcccaggggcccctgcactcacctctcggtgatattcttagcagtctgtaggaaacgcgcatgatcattctccttcagagagtgttccgcttgggagatgagtgatgctgaccgctcaatgcactgtttgcagtttgcaatctgctgagccagtttgcgaagcctcatcaccttgaacaaaagaggcatggagagagatggttacatgggtggtcttgcttaatgaaaaggcatcaggctggatccttcattttgttgtgttatccttccataaaagttcaaaaagtaggcatagagatatatcaaaatatggaaagctccgttatgggactctggtttagatattccttatctcattggagaagcattgctaattcgttttacgaggaaacactgaattgtgaattgcttccctgttgatgggaaaaaaaggtgttgcccagtggcaacttacaaagggtcaccagacgtcttccctggactattccacacaatgactgcaagactgtagggaaccctggaactttctctatctcaggtttatcttcttttcatcaagaagataaaacatctttataggtggtgaatctatggtttaaatgaaaaccattttctaaaaagtgttttttgtaattcatgtaataaaatcgagaatggaaagcattaagtgttactatttcccacactacctaaaactcatgtgttaaattaacagaaagggagcatttttcccattgattaatatttttcctgttgagcagatgagagaaagccaaaaaaagcacagctgggccatttcccctcactgggaacgtcatttccaggcactttgtgcttacttgataactaggaactattttgataagcatttcccagttgggataaaaacgcatgattgcttcacaacctccattccaattcctgattctgtctcgcttgaaaatgtccctcaaacataattgaccataacctccggggcaggccaagataagtccaaggtaacccacttgaccgttcgctcttgtgtttgaaatgtgctgtgagatgaagtcctctagccagaagccaagttaaaattagacagctaattggaattgctgtgtgcctactgcccccaaccacacacccagggacaggtttcaaccggctttatgataattctggaatggaaaatagccctgggtgaaagggtacggaggagaccagtcaatctgtcttacagacaaggctggcccaaggctctctccagaattcctgctaattccaagaaattctttctttctccaagtcgtcattac

SEQ ID NO: 136129 - DNA, 1035 bp, Homo sapiens
tgttccttagaggcctcaagttctgacatctctttccttccttttcttagattagagttatacagggatggtaatgacgacttggagaaagaaagaatttcttggaattagcaggaattctggagagagccttgggccagccttgtctgtaagacagattgactggtctcctccgtaccctttcacccagggctattttccattccagaattatcataaagccggttgaaacctgtccctgggtgtgtggttgggggcagtaggcacacagcaattccaattagctgtctaattttaacttggcttctggctagaggacttcatctcacagcacatttcaaacacaagagcgaacggtcaagtgggttaccttggacttatcttggcctgccccggaggttatggtcaattatgtttgagggacattttcaagcgagacagaatcaggaattggaatggaggttgtgaagcaatcatgcgtttttatcccaactgggaaatgcttatcaaaatagttcctagttatcaagtaagcacaaagtgcctggaaatgacgttcccagtgaggggaaatggcccagctgtgctttttttggctttctctcatctgctcaacaggaaaaatattaatcaatgggaaaaatgctccctttctgttaatttaacacatgagttttaggtagtgtgggaaatagtaacacttaatgctttccattctcgattttattacatgaattacaaaaaacactttttagaaaatggttttcatttaaaccatagattcaccacctataaagatgttttatcttcttgatgaaaagaagataaacctgagatagagaaagttccagggttccctacagtcttgcagtcattgtgtggaatagtccagggaagacgtctggtgaccctttgtaagttgccactgggcaacacctttttttcccatcaacagggaagcaattcacaattcagtgtttcctcgtaaaacgaattagcaatgcttctccaatgagataaggaatatctaaacca

SEQ ID NO: 136130 - DNA, 1049 bp, Homo sapiens
ccactttgagacaggatggtaaggtatcatgaggaccatagggtaaacttagcaatatacaattgcttagttttcgaaacttgggagaggaaggggctgccactggcgcacaatgggtcaaggccacggatgctgctaaacatcctgaatgcacagaacagccccccagacagatagtcatccagccccaaatgtcattggtgccaaagcggagataccctgagtcgaagcaaagcatctttgttaatgacataagagaaatgctcagttttactcttacagacatttacttgtttgtgtgacccctaaaccaaatctactttgagatgtagagagctgagacattgcagaactcccctcccgccatctgcagatgccctgagtggcagcctggcagcctggcagcctggaagcagccccagagttctttgcacagcgggcttctctcacccatgcccccagcccaactctgagcagtctgggcccgcacatgccagccttcaggctgtttcaacagtatttaaacctccaaaggcttatgaaatattctttaatcccttcccaaaacatgatttaggtgtatttgatattatctgctatcccctagatttcctagtgtttgcagcttattttcaggactaccttccaggtgtagccgtctgtgtcagagacaggagagcctgaggctttcctccaagtggggagtctgcagagaacaggctggcagctgagactttcgcccaaatggcttatatttgatgtataatagttttaattgtgatattattaaaagtgaattatttccatagatcaaaagttaactcattaaatctgttagtctattttaagttggtcttccaaaggaaccatttatatttatatagcattgcgtctttatccttgcaaaactgtggattctaaactcctcaagtcagagacttggaatagcataaatcagatgtgagtcttcattgctgaggctgaatttattcagtcataatttccaagcatttgttcctgctggaaggtactacttatttcacaagaag

SEQ ID NO: 136131 - DNA, 1228 bp, Homo sapiens
gcatggaggaatttgaggatgctttcattgataagacaatagatttgctttattaatttgcatatgtaaggaccctggtgtctttggaaacatttttgtccttctgttagtaaaagtttattacctgaagaagggaattctgcaattattatgaagaataatttcttgcaataatactaaactttgggggacatattttactcattagatctcagtataagagatgtttgtttatacaaaaaatcagaatatcattttgtacattacaatctttttctaagtgtaaaagaaaaagagataaaaattctaacatgttgaactcgtacaaataaaatcatccacatcatgtaaaatagcatcatgtcagtaatctaacgctttcggagactatgcattgagaggcactcatgaaatattgaagcaaagagaaaattaaggtagcatttcctgaactctactaagataaaaagagaaaagttttcctgccaagtgcaaaggtctctaagtggagcgtatccataatgtggatatttctttacatcgttttaattgaattttaagaagcctctcagtccttcaaacttggaggaaaaatttgatttgtgaaccacataacatataagagaatttaatataattaatgcattccagagttttcaaggaattaaaatgcagtagtcctctttttctgttccaacatacaaggttggagctcttgtttcttttctctaattatacctataaaaatatacaaattgaaaaaaactgacctttccttgcctttcagtttcagcatagccccttcaaattagctgaagctgaagttccaaactattgttttgctattcttattctaaaggctggctgaggaagtttgtttgtataatgcatgtttcaacggatcatcccattgtaattttttaatagtttgatttaaaagttcaaattaaagctcagcatttctatgtagcactttttatctggaagtgaagacatgagatttcattcttgggtttaatttatagattgtaaggttctatgtttgaaaaatctttcccagtttgcaactaggaaagttgtaagtgtatactgagctagacttctttttattataatttctataacttgtttcttctttgaaaaccagtagcaggcatagtgcaggttctagtgctatggtgtgtgatgcacacacatacttgcatatacatatacatacatgcattta

SEQ ID NO: 136132 - DNA, 1052 bp, Homo sapiens
gtgacccaagatcgcgccactgcgctccagcctgggtgaaagagcgagactctctctcaaaaaaaaaaaaaaaaaaaatcactctctaagtatggatagaaagcactagggaagaaataataagccaagtctccacatgtttgttcaatttcaggcaacagtgggtctaattattgaaaactcagctgagagagtttgagtgagatactatgttcatcagctaattttagatcacaagacaccaattaaaagaaaggaagtataaattaaaagctctaagtaaatatatattgaagtccttcctctcaggaaaaacacataccatgttgttgagcaaacaaaatgaatcacatgatcaaaagagtgttatcacttagaaaacagtgtcacctttaacaaatggtttctatcacctctccttagcgctaatgggtggttgtgtttactgggaccacatagtttattctgtgacagtgggattaacggaccacatctgggatttggctttgctatttcttgacatgttgagggaagccgacatgctgaagtcaattcctgcttctcaatgtcacttgggcaacaaaagcatcacctgggcagcatgtttcacttcaagtatccaaagaattactggtgcaaatccatctttaaaccatgtagaggaagtcaagcacaaggactcaggtgacacagacaacagaagacagccgctgacaggctttccagaacagtgcatggcagcacaggagaaaagtaccaccaaagttaatcatagcaaaggcaatgcatgtatgagctgtgcctctagagcaaattctgaagaaattgcgaaggctattaatttttacaaaccaaggtaatctttttttttttttttttttttaccccttttttggttggtggtggagctgaagggagaatatttaggataactgaacagagatgtttgatttttgttttccaaaatgtaaacatgccagatctttgtttctttattaaaaatgttcctttgattggatttgcactaccttttaatgattgtttgttaaaac

SEQ ID NO: 136133 - DNA, 1046 bp, Homo sapiens
aggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaaggttagtccgatccgccttaagccaacccctttctgccagaaaatgtcatggaaataaaaagtgtattcactgctagctacatggcaggtgaaggttttctcctcacctttgttatctgattagttttagcatgtttttggcaacctataaatgttacacaataagggtatcttgtaaaagttgactgctgcttgtaattttagcgttgtcaaggtgagggcaaattctaaaaatctggatcattttcaatccatgcagtttttctggatcattttcaatccttacagttcttccaaagagagtgctgcctctctctgagagagagggagagagagagagagagagagagagagagggagagagagggagagagagggagagagagagagaatgacagataaaatctggctttgggcatttggggaacacttacttttctcactcatctgggaaaactaattcactctcattgtacctgtatctagttactgcacaaacaaaagaatagagggaagaatgtctgtagcaaatgtgggattttagaggacacgtgaccttttattccttgtataaacgatatccagcttattggtgaaattcagtgctctgacaatctcaggtttcacgaaagaattccttttcgtgtaggctctttattcagtaaggttacagtcaagactatttgaacttcattttttacatgaaattattaacctaactccagcttgggggataatgattaatatgactatatgt

SEQ ID NO: 136134 - DNA, 1313 bp, Homo sapiens
tgcataaagcactatgccaggtgctatggcagtaaaagaaaatatctagttttgagcagctactattaattcgttcttacatgagttgcccctaagcactcgagtcacataatttccattgatgtcagattcaaagcccattgcatatcatttcccattagcactggaaacttgtaagtgcttgttcaagtcttgctccgccatccttgctgctgttgcccacacagcattttattcatacctctctgagaatgattttcatttatgttctggttatctgtatatgcctctatcttccaatacatggctcaacaaaataagatgtgcaggccaatgctggcctgtgacctgtttttctaaatatggttatgttggaacacagccatactcattcctttatgtattgtgtctgattgcttttgcactacagtggtagattgagtagttgcaacagggcccctttggcccacaaagccaaaaatgtctactattttaccctttatagaaaaagtttgttgacctctgttcaaatatattgagagatccttaaagtcaagggctgtgtttgattctttttggttttagctgaaaagtcagtacatttaatggaatcaatgaatgtttgagtcattttgtgtgctgagtgctgttctaggtgttggtggtacgttcttcaaagagcaaagcaaaatctctgctttcacagagcttatattctagtgttgaggacagtggggacagaaggagcaataaacaaactaaaagaatatgtcagtgataaatattataaagaaaaataaaccgagatgggggaagaattaccacgatgggtaggtggtatagtggtagaaggggaattggttttatgtgggttcagagagaaagtgacactggagcagagagtcatgtggattctgaagaccttgcaggggcgagcaggggattgatgtgcttggcatgtttgaggagtcagaacgaggccatgtgctcagagcagagaaaggagtgggtagcgtgggaggaagtgagctcactgtctgagtctgtgttttctggggctggtttattctggtgaatttctctctgggtgaaatgggaagcccttacagggcagagcaaaaggagatgcatgttctgtcatgttttaacaacaggctctcttgcttctgagtggaggatagactatagggggaagggcaggagtgaacagaagccaagagaccatttagaaaggtcttatgatagtccacataagagatgatgctggcttggcccatgataatagagatgaggtgatgtgaaccccagattct

SEQ ID NO: 136135 - DNA, 3182 bp, Homo sapiens
gtagtgaaggctttagagttgtacaaagtgaggggctggaagtaaaattattgatagaattgatagaattgcatgttctttttcatatactccaaattagaaaaataattgtatttcatggagtatgcagacataacctagaatacttgtaggaaagcattgagaggtgggtttaccttatcattaaaaaggtcaatgcctccattaagggaaatttgggataaaaattatggatgatgtgctgatgatgggcgatctccttattctaatggatgctgtaacaagttagcacaaacctgatggtgttaaacaatgcaaattcattatcttacatttctagagtcaaaagtctgacacaggtctcactgggctaagagtaaggtatctttagggctgtattccttttgggggcccttggggagaattcatttccttgccttttccagcttctagcctgcattccttggcttgtggccccttcctccatcttcaaggccaggcatggctggtcgagtctttgtcatatctcatcattctgactctgactcttcttcctgccacttccacgtttaaagagccttgtgattcctttgggtccacctagatgatccatgctgctctccccatctcaaggtcagctacttagcaatcttaattatatcagcaacagtcagtcccctttgctctataacctaaaatattcacaagctctgaggaggaggctgtggatatctttggggaccataattgtgcctcccccaaagagggaggagtagaaactgtggtgtctgctgtctggtgaccaggaggacagaagccctgtgaggagacaccaggagccctgtagagaagacaaagacaggctaatgagggaagaggataaatcccacatcatgtgcattccaagtctgaggcacttgcagtacatgaagcaaagaactgtcagtgctaaaccgggttccagaaaggggttctcgaccatcttgggatacaagcctagcagtcattctcagagaggcagtacatgaaacaaacaaaaaactggatggccctgtcaaaggaaccatagaccatcagaaaacacttaggctttgattagcaagaggtagaagtcagcagtggttagacagaggaaaactaggaaagtacagtttcagtgacatacagtgatgtggtttgtttgtccccaccaaaactcatgttgaaatgtaatccccaatgtggtggcattgggaggaggggcctagtgggagatgtctgggtcatggggatggatccttcacaaatcgcttgatgcccttcttgaggtagtcagttcttgctctcatggagactagattggttctcacaggagtggattagttcccatgagaatggagttgttataaagcaaagttccttctcttgagcagatgccagtaccatgcttcttgtacttcccagcctgtggagccacgagctaaataaacctcttttgtttataaatcgcccagcctcaggtattctgttatagcaacacaaaatggactaagatacatattatgagagaggaaaggaaaggaagaagagggaggtgtgaaaacatttacatcattattttccagcaaaacatctacttattaattttccattttaaagaagtactttcctcataagtcttgaatctataagaaagttttttcaaaagatgtatccaatgcctcccacgatgtggggcttcactgtaatctgtcactgaagactctcctgcctaggggagtgattagagtgagtgctagagggactgtagggaacatctgtggacactcacccatggatactcagacagctaataagtagcagaactgcaggatgtcttagattatcccgtcacctgtccagctctctcccctttcattcattattctgtgctgtgttctagatgtttaaaccatggacaggcagaggtgtgagctgtgatttgttgccattcccagtttgttgcaagggactctcaagattatctagatcctcttctcaatgaggaccaatctgcccattcacaaaaatgttaagctataggatttcctgacaacaatatgcatgtgtgatttccttttattgaagtagaaatgaagaagtttttttttttttttgaggcatggaaattacattatgacagttaagaaaaggcaaaagctgctgttttatgatattggggtttttgttgttgttgtttgtttgttttgagacagagtcttgctctgttgcccaggctggagtgcagtggcatgatttcagctcactgcaacctctgcctcctgggttcaagtgattctcctgcctcagcctcccgagtagatggaatcacaggcgcacgccaccacacccagctaattttttgtatttttagtagagacggggtttcaccacgttagccaggctggtctcgaactcctgacctcaagcgattcacccaccttggcctcccaaagtgctgggattacaggtgtgagccaccatgcccggcctgatactgttattaatgatataaataacaatgtaagctatatatatatgtgtgtgtgtgtgtgtgtgtgtgtgtgtgtgtattagatacatatatatatagagagagagagagaaagagagagagaaagggagagagaaagagagagagagagagagagagagtgaaaagaaagataacattttgcataaaattcccacccatgtaccactatctgcttggtgaatccctgttcatcttttaaaacccacttcatactttacctccttcaggaagcttctccctgtctcctctccccctatatagagttgattattccctgtctgtctttggcatgcatctttttttatgttgcattacaccttgttcatttttttttctcgatatgggctcactctgttgcccaggctgtagtgcattggcatgatcacggttcattgcagcctcagcctcccaagtatctgggaccacaggcatgtgccaccactcctggctaatttttttatttttattttttggtagagatagggtctcactatgttgcccaggctggtctcaaactcctgggatcaagtgattatcccacttcagcctcccaaagtgctgggattacaggcatgagccaccacacctggccttgttcatattttctctctcggaatgaaccataaga

SEQ ID NO: 136136 - DNA, 4817 bp, Homo sapiens
agaatagtggcaaaacatagaaaagagaaaaaaaaagactgaaatttttaatggagcgcaaaatcagacatatttttttacttttttgaacttctttagagactacaataataattcttatgtgataagtccaataagctatgatgatgttttattaaatgtaccatcatactagcagcttttgcagaatttgcatcagaagaaaagtataagatattaccaccatgacttggcaaaagcggtatactatattaatgttagccacttagttgctgtcattgtttctcagcacagtacccattgcctagtttccctgggagttcttgaaagctctattgaaaagttatatttaaagtgtaagttagagtgtgctgtgaatggagagaaaattgtttttctttttgtaaaaaattcactttccttgggactatatactaagttagctcagttatttgacagaaccagtatcttattttacaaagagaaaaacatagatctagaaatttccagaagcagatcactggttgaaagggcggggcgggggggggcatgtgattgaatgtgatttgaaggcagttttaattttatgacactttacagtgtgtgtgtgtgtgtgtgtgtgtatgtgttttaatgataacctaattttattgtcccagacttaaagatctgtgccacctggagaaactacagttcatccattagcatgtaaatctgttaagagtatttttgcttgaatttctccgagaaggctcccggctttgttctgtacagacacacagtcccgacgctgttcttaatatcctgttttcatttgtcagcgctgttgtccttttcattgccatgttcccatcattcctcttctttcatgtggtgctttacaataacattcagaacaaaagagtcactcctctttctgttgcctttaaaaaaaaaaaaaaaagacttcttcccctgactgcagagcttcagtgatcaggggaaatgtttaaagcatgttattcgtaatagttaaccaggagttgtgaataagggttcgttttccttactttttaagatcaggaggtagcttcagggtattgtgagcaaaaggtttttgtgtgtggctgactttgaagttgagggaaaaagcgattttctttgagaaaaggaggcatcatatttgagagaatttccaatctgctcacacaatgggaatcagttactctataacatcgtcattacctccatgagtcacgagactagtatttgttcttgtctttgaacttaagctttccagtgttcagagaacagttgtgaaatgttgcattggccatcatcaataactattttgctcctggttggtaataattgggaaggggagggtgtgtactttctctgccttctaggagagtattatataaataaagtgagaaaaagtttccccaagcggcaagcttttctccagggcacaatctattatacttgctgcaaaaatcccacttgactggtctttcagagaatagatcacttgcgtcattttgctcatttccaggtgaccttttgcagatatgagcaggcagttgtttttaaataaacattatctacaggtttctgtttctgcactaaggaaggaatgtttctgtaatgcagaagggatgctatgactgaggggtttgtgaagagtgaattctagccagtctcaaataattctgaaaaggtgcttttgtatatgtatatgtgtacttatgtatacatgcacattgtatataactacaaaaactaattccattatggacatatataggactttatacagacatagttatatgaatatatatagaaatacctatcaaactataaatacatttgagaaagcattcagggacagcagtgttaaaagcttttcatctgtgactggtttcacagaaattagtgacttccatttctgctaccatcacgctgttggtctgttcaccaggagggttgatttagacttctgccaggagactaggtgtggccatctctcaccctcttcctctctgtccagtctgctatcattgccttcagaaccaaattcttgcatgatacccagtacagcatagacctggaaaacatcggtcattttcaatataatgtaaaataggttctgtgtgcctttaaaactaaatgctttatttcttaaactgtaaaagacatgaaatgtctgagacattcagatagtgggaaatttcatctgcaagttgtcagattatgccctttagaagattgtaattttttttgttgtttatcattttctcttgaggggtggagtaaatatttctttcctgatgtttcaacttcagatgttcaggctaattttccactacagtgccaaaatagggaaaagttaggcctgtagaattttgacaatttaaatgttgttttaacaaaagccatgtcttgatgaaaagttctttagaattctacttgatgatctatgtgtgtctcttccgaggacaatgagaacttcttaaggaagtcatctatatgtgaaattgagtaatccttttattcattgttaaaagacaaatgaagttataatttggagagacataagccaaaaaatctatgtttgcatttttatgtcctaacatgtgaagcatgctttgatttactgtgaagtgttgcaatggcaataaagtagatgttgagacgtgcagactgggcagcccgaggaagcagttcttgcctctgcttcccctttatcatgaatgttccttaaacacctttggtggagtccaaatgtctggattatgaattgaattgtgcaagattctttttttaaacactttcctgatgatttactttacttgcagtttcttgtcttgcatggtgataagcaatatccttcaaagaactgcagcgcaggactttttttttttttttttcttttaggaagactacttccccttcctcctttagtcaatcaaattttaaaagattacttctttccattctcagttcaccctttctttgccattctggagactgaaattttggacacccatcacagatttgctattatatatataccgtgtatgtaatattaaatatatatatatatatacacacacgatgtttttatatatgtgtgtacataatgtatgcatacgtgtgtatgtgaaacctgtgtgtatatacatatattttaaattgtttatcaggatgatagattgctatttaggtcactatttttggaagaaataaatgactgttctttgtgtctgtactggagattgttcttcctgatataactttgaagaaaacttcttccagacattatacattaattcagaagataaaggcacaaaataatgtgtatattatttttttaaatgaacaagccagcatgcagagcataatgtgatcatgtgctcagtacgacactgaaaggccccaaaggcaaatgagtctagtgcctgttcccagccccaggagctgggcaggacggctcctattggtggcattgaaagctagcattcagccttctgccacaggacagtgtctcattcggccaagctgctgctggtccctgtaaggaatgagagtacagatcccgttgccaagtcctcatttttttggaccaggcagtgggtgttgagctgacctgagctacctttccatttgggttcagttgaacattgagtaggccagaggatagggaagttgtggcgggggccgtggaaaaggcagttgattcttcaactcgggcaaccctggcggagtggatgaggtggagctggccttcctggaattgttggaccgattttcctgttgtgtttcactgttgacgcactcacagacacacaggaccgctccagcactgcctgccacccaccgtctggtctcggtggcctgtctatcatttcgtgggtccccatcctctgcctacggcgatgtttcttcaaaaagaactagtgtgcagtccattggtgggtattcaaggtgatctctttgtcagaatctagagaggtgctcaaagaactattaaggaccaatgtactagttcctgtttttaacctgtttatcagtctttcaattgaacaaattggatttctgaaactgctgaggggttttctgcactattaggacagaacaggatagggtggttgttcctccaggaatctgggttgttcttttgcattgccatttgtctttgtgcttgtctgcttgtataaatgaacctcgagaaggagtgtttaagtattctgttaagtaaatttggaagactaggtttcaattaaaataaccagacagtgtgacccagcttccatttccccttaattttgatcattaaagccttcatatccccacagacatctgccatgcttcgaagtgattcttctcaggaatgttcattcattattaatcaggttgcatggtcaggcgagtatgtgattattttaaagaatgtcctagagatccagttactaagaatgagcatgttataggcagatgtgaaagtacagaaaagatttggttaacagtttaatttgatttgcatgaattccaccaggtgggtgtttggcgaaattaaaagtcttccctggttctcacttcagatatgaggtaaaaaaataataataataataataatttcagcacttcttaaagaagaaatgtcaagttattcaaaatatctattgtattaattattttaaaacttgaggctagcatctcagtgctcatctgcttgtcacttttttttttcaaacagtccctctggtcccctacaattttcttggcagaaattcttagttgtctgttactggttgagcaaatgaatttgagtgtgc

SEQ ID NO: 136137 - DNA, 1099 bp, Homo sapiens
aaacagcctttatctttgattcaggtgtcttctgccagcattcatgaaacgaaactggcaaatagcaaaaatctgaaacatttcactgttcttgatagtttcacatgctccatccatgccagggtcccttatttcctgcaaaataaaaaaattctgacaaagagtgcatatgggacagggtgaccttcactgggaagcggaagtgaagccccaagttcatggtgggagatcagtggtaatgaacagaggtatgtcatagtgtaggaaacagatgaaattgccaatgtgaagataagtcattagtgttaagaataaaaatgctagttcatttcacattcacatactgtttgttcacataagatgctccataaatgttattgaataaatggatttatatccttcttgcttgcaaaaatggtatgaagaggtttccagtaaaaaacacagataatgaatttattcaaagaagagtgggaagaggcgattcaggacaagaagggaagaaggaccccaatcccccatcccctaccaccctgtccttccataagagtgagaattttgtcaggcattttaaaaagttcacctcactaatcctcaaaggacccttaagattgctctcagataaggaaactgcatagaagataggaagagcatctgtgagtataagatatgtacagtatctggctccgatctgcctttgcaaggaaatggcagagccaggatttgaactcaggttatctggcttcaaggtactacatgttttttgtttgtttgtttgtttgttttttgtttttgttttgttttatatgactgagtttttttactctatcacccaggctggagtgcagtggcgcaatctcggttcactgcaacctccgcctcccaggttcaagtgattctcttgcctcagcctcccgagtagctgggattacaggcacccgccaccatgaccagctaatttttctatttttagtagagatgaggtttcactacattggccaggctggtctcgaactcctgacctcaggtgatccgcctgcctcggcctcccacagtgctgggattacaggcgtgagccactgcgcctgacctctacatg

SEQ ID NO: 136138 - DNA, 1029 bp, Homo sapiens
tcctctttaaaaatgtaccatttgctcttattttctaattaaggctttgaaggttaaaaatccctttgttgttagctcctttacaagtctcctgcctgagtgcagaaaacataagaagggagtgtcctcttcagagcataaccaaaccaactaaattttaaccaggtaaattgttgattagcattggatcatgtaaagaaacagtatgaaagtaattgagataggcacaactcctaattgtgtgatcccagggggcttcaaacattgtttgaaacattcacctcagagattatattccatgtctgatccttatgctaatttgaatactaggatcctgaagaaaaactttataggatttcttgagtccctaattggtatgtaaacatcgtcattcccaagctgcccaaagttgtgaattatagtataccatgtgtctcctgttgtgatatcaatttctacagcaatttttctgcttgttgtaggcaaatgtaaatatatttccctcctcttacacaaatagtggcctttcacatacattattcttcaccctggcttttttctgctttagagtataccctagagatctttccataacagtccacagagagcttcctctttaaaaacaaaacaaaactgcatatcattgcactatgacgatgtaccataattgatttgacccttcccctactagtcacgtggagtgtgtccaatattttgccattaaagcaatgtgcactgaaaaacgttgtgttcatcagtttgtatggggcggatgtatctgtattaaaaatccccagaagtgggattgctgggccaaagggcaaatgcagtttctaattttgataaataaataacattgtctaaccagcctgtgtgagagcactgccccagagcctcatcaatagagagcattgtccaacttgtgcacctttgcctatctgatatctgaaaagcggcatctctgtgtagctttgcattctcttctgagtgacgttgagtgtctctgcatgtgttgaaggtctatttgca

SEQ ID NO: 136139 - DNA, 1027 bp, Homo sapiens
tccctgcgaccgacttttcataggctgggggagaaaaggttgagaaacttgacattgtctcgagcagagtgcgtgtagcaacagatcaaagaaaaagaggacgaaaacgtgctctttgctgcccgtagatttcgccgggttgcttttgtcttgcgggctcctgtcgggttcggtgtttccgctctgaagactgcgacgcgggctccgatgcagctcgctccctgccggatgggtcatgggattctaaacatgaggcaggtaagctcaggcggttgcgctggcggcggagggggcgggcgccgcccgggacccctgcgacgtgttactgcggagagcttgctgggttagcaggcgcctggccgtagtcgatgcgtttggcggaaagacggggctgcattttcctaagacaaccaaagaagcacattttacctgagccaccccggtctggtcctcgccacccgcccccacttttgcctctaattgtggttgatgtcaggcagtcgttgtaaagggcttacaagcagtttgtagaatatatgtaaatcaattccagtttgcggccgctggaatgtatcgtgcaggatgtatctcgagcttttagtgcctctaccctatgctttgggctagaataaagacagctgaatgtcctgaaaaagaatttcacggggcctcttatctcattttggtttcgcattctgagcacttactgtgtttctggcggagaaggcggaaccagcttgaaatgagcacagacagtccttccagaaaaatgcaaatttgtttttctgttctagcagtttggaaactgtattgcttctggacgtgagaaggcagccctgaaagtagtgagcggagaaagggctgggggattacttaaatgagtctttgaaaagaattctaaaccaacagcttcttctgtggctctggggcatgatgataaaattccttatcagtccaggaagaggtttatagctttgctgttaagcaagaaaaggaaagaaaaagtggatgtaggaagccaaggaga

SEQ ID NO: 136140 - DNA, 1219 bp, Homo sapiens
cccagcctcccctgttatgaacatcttacctaatggtggcacatttgtccagactaagaagttcatctgtacattactattaattccttgtacttccaaatagctgctgtctctttttcaggcattaattaggagcccagataattctaatgttgatatttgattgaaccaggatacttccttgtgaataagaagtgggctctataaattcaacattgtacacacaagttatcataggtctttctttctttcttttttttttttttagatggagtcttgctctgtcacccaggctggagtacagtggtgcaatctcggctcactccaacctctgcctcctgggttcaagcgattgtcctgcctcagcttcctgagtagctgggattacaggcgtgcaccaccatgcctggctaatttttgtatttttagtagagatggagtttcaccatgttggtcaggctggtcttgaactcctgataccatagatcttttgtagggtccatgtggtcctaacaaaattccatcacctctggcaggcccagagaactgctggttaattactaaaaaaaaaaatacataaagcagactcctattgaaaccaatttaaaatatgtgtttgagtattcacaaacttaccctcactgtgtttgaaaccttcaagttttttttggtgaacacagaatatctgtttttgaacaaaacattctaacctgatgtgtaaatgtgatatgctcatagaaagggagctgaagattgcagcactcttttggacatgatatttgatacaagttagattataagactcaagattttgaaaagggccccttggaaacttcccagatgagatggttcaatggggaacataccagatggaatgtataggcctctgtcctaaacagatgttgtacagctgggaaagctgtgacaagaaaatgcaccccaaatgcttctgatggacagatctctgtgcacacatgcacacacacacacacacacacacacagcgttttaagaatcaaaatattcagattgcttaaaaattagaatttcaggtgtcagtcaccagtggtgtatatatatatatatatatatatatatatatatccccattgttggaatggcccagtttgtcagcatcaaatccatagtccatctgtgattgcccttgaaactgatgaattcacttcaattccaacctaatcaattctgaactagtgcc

SEQ ID NO: 136141 - DNA, 1082 bp, Homo sapiens
tcaaataagacaaaactgagctgtgaccaattcagctgtttctgtaagtcatttccgttttctgtatgtcactttcctttttctgtccataaatcttaccatgtggctgcactggagtctctgagcttcaggaggctacctgatttgagaatcatcctttgctccattaaactcttaaatttaattcagctaaagtttttcttttaacactacccacctcaggacttggagaccctgagaagttacataggttgccccaggacacaaagcatgctggtgacagagaaaattgaagagagccctcctgaccccctgttcacttggactttcagccatgttgcactgccccggctcaactaactgtacttaccactatggtagaaaagcttgagaacaaagtgccatgctgtcgcacctacaacatttaggaagaagttcaaaagatgtctgacttcaatcacggcaatgacaaagcagcaaatgcaagaaagaacaggatcaataaaagtcccagtggaattaaaaagaagacaagagaggtttaaaaggaaactgggctttggatacatactctttctgcttgtaatctgtgcttcttacactttctgagtttgaaaaggagtaatgtttttgtgtcacacttggaaattttgccacatgactgtcatcatgggaactttggaccctgttctggagctaagaatagctgagatactaattaggttgcttgaaaagtgctaaagaactgatcaagtccagagaattcacaatggaacttcatggccagaccgaggtctgttctaactaggattcttgtgttgccatcagcacatcaactgccccttgctttttcatatgaaaaactaatacctgtaatgatctcaaaattcaaatatttgagtatcagaatatttattctgatactcaaacatatgaataatgaaaaagaaatgtcgtggtgggaaccaataaagacagggtttggaggggccgaagatcctagggacggataaaatagggagatggctgagaggaaggaggaatgaaggtctcctactgaaatttaagcaccacacttctgg

SEQ ID NO: 136142 - DNA, 1036 bp, Homo sapiens
tttctgatttataaatttaatgatttcaatattatggagtaacttcagtgaagaaaaattgttttaggggcttactttcctgcaacgattattgccctattgcttttaattccatttgaatgcatgctatggagtagttgagttaaatccatggcatcttggttattcttcacggatgagttccagttctttgggtgatacaactaaaagctcacaagatgctgtgtatcggcactgaaacaatcagtctttgagctttggggaaattactcaagcagcgaattaatcattgcgattctggtcccccttcacaaatgctaggtctccgaaaagactccccccacacacccctgttcctggtgctcttattaaaggtgtaaaatttcataaaactttagtaaaacattatgaattctctttttgtgcaatacagctggtatttcttccagacatatatttccataattaaacatcctaaaatacaaatcccattattatttgttatgtctagtcagtaattagacctcagctggtagggcaatttcagaacagagtttaccaatttacatactaatccagcagagtctggtgggacatgattagcatagattcagtcaacatcttaattagccctaatcccagcatgcactccgaggtgcctttaccccacccccactcatgtaggtcttgtttagctgactattttccttcaacaaattccagctcttccaaacatattttccagtgctctttttcacagaggagatgattacatctcaaagtggtgtgccagggaggacattttgtgtaaagccagggaaatgtgaggcattgggccaggcgaggggtgcatacacaagtctgaagcaaaatcaaggtaccagaatctgttcttctagaatgttagagtatacccacttccctgtcccacccccaactctaggtagcaagatctgtaaaccattccaaacctgtgagaattttacctattttgtaagaagaatattccttattcctgtccatgatcaggagccca

SEQ ID NO: 136143 - DNA, 1092 bp, Homo sapiens
aaaattggagaaagttcttatttccctgctgtctaagaatttataaccacactgagaaaaccatattgcaatcataaaaaatagatgaccaaaaattaaatggttccaaggccctctggataaatatgaagtgagagcatagttcttttctaaaagagagtgggaaagaacaaggcaataagaaggtcaagatgatgggatgcagagccattgtgtacattcattgaatgacttaatgtgttatgcacttgcattctcccatttccaacaacactataaaataatggcagggtgaaatttgaatcccaaggtctctcactctgctatgtgtgtgtttaaagaatgttgggacagagctccctttgaataaaatttttaaatgccttaggaatcctaaaatgatgcttacattttgtaagatcttgataccttgacgtagttgttcttcattatcattatcattgactagttgttgggtggagctgccctgggcgtgtgaagatttcagtatcactcaatataggtgggtctttaaaagaaaatcatgccaagaaagatagatgtaaacttatttttttttacattctcttttattttctttaatattctgtatctttgtagaagctataatatggaattatagactatttacttatgggctttaaaaagcactgtggtaatcattaggtaataaatttcttaccaagagatattactgaaaggaatgtggtttttattcttttatagccagatcaccaggaagatatgagaccttgccatttaagtttgctttttaatttgtgtaacagaaagattcacatttaaccttttctactagacatgtatttaacaaacaattatttggtatctactatgtgaaagggacacattttattccatttgttccttgcaattcttgttcggaaagaccctctttacagtggaagaaggagaatctcagagaatggcccagctagacttgaactcctgtcttctgtctcagcccagaagacttgctcccatgtcctttaacctacttagctaagacagatattcaaagccactgaggaaggactccatatttcttcattt

SEQ ID NO: 136144 - DNA, 1037 bp, Homo sapiens
gaatgctggcagtcaatttgggagtcctgagtgtgagataacagttaatcaatttatctgtgaactgtgaagttttcaggttttgatcaacattattcactattctccaccccatgctcattctggttataaagactatttaccttcattattatatttgaacctgagagcgtcaagtttattagaattgattttctttccaggttgatcttctgaaatactttggccatttttcactactgccttatgaggttatcattaatctggcatatatttattgagtgcttgggtgtcactcatatggcacacgtttgctgttagagatgaaagctatgttttgtggagtttattgcagaggcgaccaaggctagaagggaaagaccaactcgtgctgttctaacaattgtttgccagctcccgtggttcagttgcgaatgtggtttcagcaacaacgaaaaactcttaattcttctgaattattgatacattaaaatatgttactggctacttggaacctgtgagctgagttaatcaataaccctctcacattgcacaagacccactgtgtgttattctcatcactggccatttaaataattcaaaagaaaggtttctcgtgaattaaccttgccattgcacaaattgggaaaatacagaacaaaacattccagcatccttaatctttagagcttataaattactgttccttctcatttttttcttgatgtattagttttttctgttagatgacttttgttaaatgttttgatatatcataataatacacataatttgcaataatgtcagtaagaaaaaagaatcatgggaaagaaatgaacatgtcttgaatccaccatataccagacactgccctggcccctttacaagcatgttatcatttactcttctcaacaatactgcaaaataggtattattgggcccattttaaagatgatggaatgaaggaccagagaatttaagaataaattcatgccacactactaaggtagcaaacccaaatctgttccctgctccac

SEQ ID NO: 136145 - DNA, 1057 bp, Homo sapiens
cccccatctgaatttcctgccctaggaattctctcattgccagcaacaagttcccacacctgtaataacaattgaccgtgaatgttggaccgccaggtagcttctttccccagacaaccccagacacataatcttcccccaatggctagacccataaattcggggcagttaaaatgagctgtctcatttagaagtgaataattcctttaaaaaagaagaagaatctgctgtctttctctctccccacatcctacacacactccctcttccaaccttctccagacttgctgactttttcacttcctttcctgaagtttgtcttttgaatcaaaatcgtcattgcaattaaagctgggtatactgagttagaacaaaacaagaaagttttaactggcttttataacctgtcacaagaggattacaactaccaaaatatcatgccatccaaaaatgtacagggttcagaaaaaaggacccagtgatagttaataaacagcatgtgaattctgtaccacgtaagtgaatccacttgtataaatttggactcaagtttcaatttcagtgggtgacaactatgatggtggtcagaatttgctaactgcctctggctgcattcactcaagtaatattcatctacttctagaaacttgtcaagtcaccaaattctttcttagacaaatgagccagaaagggcaaaactcgcctaacccgcctgaagcctgctgttctgtctctcccagatattaaaagacccggaactctataataacaaccatgcagttcattgcacacatgatatttctaacagtggaaaaggaaagataccatcagctaacaactagctaacaacttcttgttcttttttgaagccaatgactgatctacctttttggttattgctgttgttgcaaattggcccaatcacttaatgattggacaatgtcaacttttaggttaaaaacttcttgagcactcataccaaagagagttggaagtcagaacattggagatttttgaaccttgaaataataccctttgaattattttacaccattaa

SEQ ID NO: 136146 - DNA, 1695 bp, Homo sapiens
tattgggaggctccctttccccgctgccagttgtgaccaggtatcattttagagagacagttaacaactgcctgaccatcacctgatggtcacctgacattcctgggggtaaaggggaccctctccttccctactcatgtcagactacctacttttaactgtcactgctgataatgcttgaaataattatttaaatatggactttgaatccaacaaactgaattggatgtacataaatcagagtttctcaaccttggcattatcgataattggggccggtaattctttagtgtgggaggctgtcctgcatattgtgtagcagcatttctgtcctctacccagtggatgccagtaacactcttctcccactgagttgtggtaaccaaaaatgttctagacattgccagatgtcctttgcagggaaaaaataaccccttgttgagacccactgcattaaatcattcacaggtcactaaaatatagaaaagcattagaagatacattcgtaagaacatgccactataatgcacttgagcttcactttcaacagctggtcactacaaacctttatacactgcctattgcatcttgattctttaattcatcaacttgatgatcctaatatttgctccttctctttttttctaagaggggaaaatcatgaaaggagatgaaaaccacaattgaaatacagtgtaattttactttgggctacttgaaagaggcacagccagaattcctgaactgttcctattgtatatgggatcaatatggctgggagtgttttaatcatgtttcatgtcatatacacctcaatgtgttttattaacttataattattggagcagtttgcttggctttagtagacactataaaagcccaaatttacagaggcctgaaagaggtccattaataatttgaaacttgtcagagtattctggaacgagggtgagctctgaagttcctctcaccaattgaaaagctatttggaggctttcctacttaaaacaatacagaaaaccttcattaattgactgtcactttccttgacaagaaggctgttgttcatcctggcttcttaaagcaccatgacaatagctcattaatacaatacagagtctgaagtaagggaggaagggtactaaaaggttccactgcataaccatgcactcttgtctcttcactgcctaaacctgaggctggggggtggggatgtgaagaggaggcaccatagtgccatcattgaggaggagaaaagatgaagagccatttaatgagtgcggcagtcaggctaaagaaaagacatggccggtttctgtctcccacagttatggtgacaatatttccagagcaaaattgaggagcatggtctgacacaagaatttgtgtgacttccagatgtgaaaagcatctgggaaagggggattgaaagtcagcatgttggaattttctatgatatttatatggattatgtaagaagacaaaataagagaacatatgatatttttactctcccacacatgctgactaatgtgattgaagactttgtgtccagtgtttgaatgtgatcagtcaatgtttgtcagcaagagggagggataaaggaagaaaggaaagaaggaaagaatttggggaatatgccctggtctcctccaaagtaagagtggcctggctggaatctctcaaaacaagcta

SEQ ID NO: 136147 - DNA, 1045 bp, Homo sapiens
aaaattaaaggatgaaacgtttaatttgtaagtgtattttttttccttttcagaaagtcatagaatgatatatttggataggcatgtgattgctttaatttttgagcaaattttcagtgtattttccctttagaatcatgacttaagtaaggattagcattcggtagccaaggtttaagaatgcaccgtggatttaccgtggcagacacggttttggaatttaatttggtcagcctctgctttagcaggacaaagagagaggaaggtgatagcatgccttacattagctgtgttggaaatgtgaccctctcctttagaacggctcccagtttgtctgcaggagcaagcccctgtgacacaggagagcagtcaggaaaggacagtgagtgagcacggatgacagaagtgtctgtgccacccattcattagggactcacaaaggggtatagaaattctgggcttttgtggggattgagaagttcctatcaaatgtctgtcgggtaatttaattacacgggcatggtaggaatgacacagtggttacattaataaactgaagcattaaagaataatagcccagttattgctgaattatgggaaacacgctgcctattcattgctggtgatattagaagggagaaggcgggggcttcctactttatactcgcaatgcataaagaaacagtttcttgcctttccagacctgtggaaaaccgggtagaggggaaggcccaaagtcacacccaatagcataaatcttgctttgtttaagatgcttaaaatatcataagctaactctgtttttatggtgctaaataaaattgacttgggccagacatagtaatgagcatgtgctgcacaaacatctccaaatagcctttccaacggatctcattcctgataatttccatttgttgtcctgctcctcttgttaatggaagccattttataggatcacaggctactagcttagtagttttaaaaaagtagcctattaatataatagaagcaaacattatttttcattctcactcatccctctggc

SEQ ID NO: 136148 - DNA, 1030 bp, Homo sapiens
tgtcagtttttataactgtaggtgctggagtttcagactcctatctgagattgggaattaatgaatacagaaggcataaggaatatgagggcattgagccaaagggagaggtggggcgagggaggggctgtggtagcaacatgaacagaaaaggagaaaaaggacctgagttggaaaattgaggtctccatatcaaattactcttatttcaaaatgtttcctaggtttgcttattcctactgatttttattaccaagagctttatagaaacataatatacttttttattactttaagtacagctagttttagccacttatacctccagacatgccactcaactgtgaccttgagtatcatttattcataaagtaattttcttagaatgacgaagcatctacatttcctaaattacatatcactagttatttttcttgagacatcactttatatgactcattttacaagtttacaagttgcttctttactagaatgtttccccgtccccaacagtggaattagtcttctacttggtttaattttatggtgttcctgctgcaagctcagcaaattatgaacagttgtctcctttccccagtggacaggcatgggacaattgcctttctcctctaggttcttaataagtggaaaaaaaaaagattgttttcaaggactgaaatcttctttcttttaacctaagaaggaaagaatgtatttaaaaaaaaaaaaagaggggaatgaaaagaaagcatgccctcgtcctgtgttgttatcacttacttaattcagggttcagccgagagcccaaggctactgtcttgatctgcacttcctgtctgcacacagatccctggtgtataagcctctcacgatcctaaaacatttccagaatttctccttgctctgaccctcttagtgttgaaagtggtagtcttaatttatttccaaagtctatcttttctctccaaattaaataacagtgtcatgaaatgcttcatcttctaatgtcctatcagcaaaatcctagctt

SEQ ID NO: 136149 - DNA, 3245 bp, Homo sapiens
ggggaggggaggggaaagagaaaagaaaagaaaaaaagaaaaaacaaaagaaaagagagtggttttaattttcttaaaataattcttttggttatgcaagtagtacgtggaaacattcttattatacaatattcaaatttaaaaaaatatataaagtagattcatttaaaaaaaatagatccctcattacccccactattactacgcactcaagggaaaccagttttaacagtttggtgtttcagttaattttatatgctttaacatacatttgtttttaacatagctaggattatgtattttctactgtggtatcttttttcagtcttaaaaaattttgccatcattttctaataaatggtaggttattgagataaatatagtgtcccttttttagacttaccagcctattccttgtctaagttaactgtccacaataaacctgtatcttttcctactgtcttagaacagtttgagaacatcatatgtgttgtgtggactctgggagcttgttgaattacacttgtatttttctatttttttttttttactttaagttttagggtacatgtgcacaacgtgcaggttagttacatatgtatacatgtgccacatgtgccatgttggtgtgctgcacccattaactcgtcatttaacattaggtatatctcctaatgctatccctcccccctccccccaccccacaacaggccccggtgtgtgatgttccccttcctgtgtccatgtgttctcattgttcaattcccacctatgagtgagaacatgtggtgtttggttttttgtccttgtgatagtttgctcagaatgatggtttccagcttcatccatgtccctacaaatgacatgaactcatcctttttatggctgcatagtattccatggtgtatatgggccacatttttttcatccagtctatcattgttgcacatttgggttggttccaagtctttgctattgtgaatagtgccacaataaacatacatgtgcatgtgtctttataccagcatgatttataatcctttgggtatatacccagtaatgggatggctgggtcaaatggtatttctagttgtagatccctgaggaatcgccacactgacttccacaatggttgaactagtttacagtcctaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgaataaatgtcttcttttgagaagtgtctgttcatatccttcacccactttttgatggggttgtttgtttttttcttgtaaatttgtttgagttcattgtagattctggatattagccctttgtcaggtgagtagattgcaaaaattttctcccattctgtaggttgcctgttcactctgatggtagtttcttttgctgtgcagaagctcttgagtttaattagatgccatttgtcaattttggcttttgttgccattgcttttggtgttttagacatgaagtccttgcccatgcctatgtcctgaatggtaatacctaggttttcttctagggtttttatggttttaggtctaacatttaaatctttaatccatcttgaattaatttttgtataaggcgtaaggaagggatccagtttcagctttctacatatggctagccagttttcccagcaccatttattaaatagggaatcctttccccatttcttgtttttgtcaggtttgtcaaagatcagatggttgtagatatgcggcattatttctgagggctctgttctgttccattggtctatatctctgttttggtaccagtaccatgctgttttggttgctgtagccttgtagtatagtttgaagtcaggtagcgtgatgcctccagctttgttcttttggcttaggattgacttggtgatgcgggctcttttttggttccatatgaactttaaagtaattttttccaattctttgaagaaagtcattggtagcttgatggggatggcattgaatctataaattaccttgggcagtatgaccattttcatgatattgattcttcctacccatgagcatggaatgttcttccatttgtttgtgtcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgggttttgcacattgattttgtatcctgagactttgctgaagttgcctaatagcttaaggagattttgggctgagacgatggggttttctagatatacaatcatgtcatctgcaaacagggacaatttgacttcctcttttcctaattgaataccctcttctgcctgactgccctggccagaacttccaacactatgttgaataggagtggtgagagagggcatccctgtcttgtgccagttttcaaagggaatgcttccagtttttgctcattcagtatgatattggctgtgggtttgtcatagatagctcctattattttgagatgcgtcccatcaatacacttgtgtttttcacaatggcactatcagacaatctaaaaattttgaaaatacaactcgtaggccaggtgcggtggcttacacctgtaatcccagcaatttgggaggccgaggcaggcggattaccagaggtcaggagttcaagaccagcctggtcaatatggtgaaaccccgtctctactaaaaatacaaaaattagccgggcgtggtggcatgcgcctgtaatcccaggtactcgggaggctgaggcaggagaattgcttgagcccaggaggcggaggttgcagtgagccgagattgtcccactgcactccagtctgactgacagagtgagactctgtctcaaaaaaaaaaaaaaaaaaaagaaaatacaacttgtaagaggagttggcattgatgttagttggtgagttcccataatgaaaggcacatagaaaaccgtcaattgtatttgacattcaggttttcaaatctcatatgaatgctgccattgcccattgttggaaagtaacatacgtttcccattcacttt

SEQ ID NO: 136150 - DNA, 1061 bp, Homo sapiens
taaaatagcacttttcctctatatgagagggtaaaaatattatttcaatgaaaaaaagttagaatatttttaatattccaagactattggtaaatgtaactgttacctgaagtattgcaaatatcatattgtaagcacacacacacatgcacacacacacacatgcataccacccaatgacacatgcatgtgtatcaaacttgatggtgggtaaattacttaaaccttcctaaactcagaaatttctgggttccaggagctccagctacaggcttcggtgattgtcccgtttggactcccgttatgatcaggacccacatgtctggagtcttgtagtaaacaccagtcaatttttgttattgtctcttctgcttttctgccagtgccaactgcccccttttatctgggctgagacgttacctcaaagcaacctatttggcttggatgcttctttcttcctttcctcttcaaatttgaggggcaacaaagactttatggtcatattagccatcgtgttttctaaacaaacttgaaacatggtcttgtttaattttttctatttccagatgcctcccttgtaaaccttccccctttgatagcaacctctgtattgacctccttgtagccctggctcatgtttcccatgtgccccattctctttacattctcatcttccccaccagtctttgagcctttgaggaaagagactgttttcttttcccatctgtgctcccaatgcctaatgaagagtgtggtactcacaaggtgctgaacaaatgtcagttgaatgcctgcatgcgtgcacttaaaacttcaagaattttccttcatatatgctgttgtattcacccataacttccttatattaacattgcttttaagcaataatttatgaaagatccagatgtctatcttcagcaaggatattgcctaccctttcatccgtccattcaactgtcattagcaaaacaactatgttccctgtaaaatacacaaaattgtgccaggtcaggtgacagatactacacaaagaatcaaaatacaaacacacgtatatatac

SEQ ID NO: 136151 - DNA, 1029 bp, Homo sapiens
tatgtttatatcaatattggcctcataaagactgtgtaattgacagaaaggggctggaactattttgttggttgagcttttattattattattattaatttatttaaaaactatgacttacttttctgttatatacttgaaattaattctaaagtggcttagtgagcttcagaatctccgagtgagagctaggaaagaagcagattggtgggcctcagtcacagaaattcattcaaccattctgagaatgaagcctgagagtctgcacatctaacaagttagcaggtgatgctgatgctgttggtccacagacctccctctgcagcactggttaaaggtagggacggattgttgtaatggctcctagattctgaggagggagtgaaagatggtaggattcctgcacttcttggtcatggccagtagactgaagaaaccaattgctaagtctaatgtagaaatgaaacaaactcttctttggaccatttagaaaacgtgtcaggaaaggctttagatttgaggaattgtaatttatcaatactagttcaaccctctctgatcagtatagtcaacttgttaaccacacagctgcataacccccaggggactgatgaaaagtgtcacagagctttagggtttccagttcccatagtcacactggagaaatattaaacattgtttgcatgtttgcactttgctattccttgtcacttgcccatgctgtgaggcagtctcaagttttgagtgaagaagccacgtaagactccattgaggaaggctgtagctaggacatgtgagctcatgacatccctaagagccaagtaaaccattttctttcttccataatgagaaacaccatgtcgttggctgcttctgtctgtaatttcactggtgcagcatgtttagatgtgagcactaatggaagacaaggaagaagtgatttcttgttctggctcagcttgcactgaccattctgtgacttatgactgaccctttggggtcagttaagttctctagtgtagagttgct

SEQ ID NO: 136152 - DNA, 1050 bp, Homo sapiens
cactatctctccaacaaaacacaccaaagagtccccccactctctgccacctgagacccctagcaggaatggttatgctcagtcattgttattattcagggtctcaaaagaaagcagatggcacactcaaatgagtttacatggagagagaatagtgaactttttacagatggttgggcagggctaaaagactgatgaggaatggggttagcaataacgggaagctgcagctgccactcctaggtctgagtgggcaagagaagggaatgtccgtaatggcaccagaaagagctagagctctggaagtgggatgtcttaacaggagccatagctatagcagaatgcagtcactggcagaaccacagcagggaggaagtggaaagggtaattaccatgacctcttcctccgctcactcatctgtctcttgccagagcttcctcttggccaaacccaaccaaactacttaccacagctggtatgtagtctagatgatacagtccatgtaggtctctctgagagagacaactgggtgaaggtggatgggaatgaatggaacacagagactatctaatacagtttttttcaatttagcaaatattttaatgagcatttattgtgagccatgctgtctgttagatgctgaagttggaggtactctggtttgccttacgaaactcagatactaccaggagaacacggataagtaaactggcaataacaatatgatacaacaaaaacagagtattatggaaacacttaaaggagctagcccatacttaagaggtctgtgaaagcttctagaagaaagttaaatctaagccaaaaaaaaaaatgaagaattcattggccattgctgacttttactgaagactgttgaaagcgctttgctcattgtaacacatttcatccttccaaggaccctatgagtcaagatgtgttattaatcctcgatttaaagatgtggaatttgacatacagagacatgacttgcccaaaatcatatggcttttaattggtgaattcaggtgtctaactccagagcttccctt

SEQ ID NO: 136153 - DNA, 1101 bp, Homo sapiens
tccaaaaaaattgtcccctaaaagaaagtaaaaaataagagggctgcatgatcaatttctccaatttcattatgattttggttcctgtttatgctcgaataactttctcagattataaatcctcaaaaagaactcagtcaattttaggttttgggggtttctttattttttagatactggcccaggagttaaatcagctttggctcagaggaaccaattgaattgaatcaactgaataattgaataaacattgaaacagcactccagaagcaattcctatccatactgatgtctaaagaacaatgaaaaagcatctatagaaagaaatacaagtactggagctaaaaatttccacatacaaatgaaactgggatttactctgcactgtacacaaaaccagagcctgggtcatcaaatactttttaaataccttcaaatattgaaacacaatgcaggaacctacttaattcattttaaaaagcaaataaatgaatatagagacttacatcaaggttaaacattcagctgttgttcagttccagtgaaccaaagaagtgtacactgaatttaaaataaaatgaagacacataatatatgaggtactgaagtgctctttacatttgcagagctagcttatgcttccagacaagttcagacatacatgtacatggatacacacatacttgtgtatatgcgcatgcatttatacatatgtgtaatatatgtatatatattcacacacacacacatttcctaaccaaaaaggaaaggcttattgttttcatgttgagcctttgaaataagacattagcactgagcaagtggagaaatcagagtggaagtagccatcattcaacattactcccagatccttgccactcaaaatgttgtctctggctcagcagcaacagtatcatctggcacctagttagaaccaccccacacctctcagaacagaacccaagtttttaccagattgcctaatttatgtgtccaaattaaagtttgagaagtgctgccctggatatgtgctgtccattaccaaagttactagccacatgtatctgttcagctattgaaatgtacttattgagactgaga

SEQ ID NO: 136154 - DNA, 1040 bp, Homo sapiens
ctctccatttcaaaagccctccaacttggcatagggatgacctaagggctctaagattgcagctaagataaggacccatggatcccaatgctcagtgccctatgtcctctggaagttgctgacacatgtttctgagggacactcagaaaacctggaagcatgttatattagtgagcacattttggattttgagtgagaagtccagcttgagttaacttaagcagaaaaagaaattttgggatcacactcttaggaagtctggggtgggtaaagcctcaggaagggctggatccagtcattctgcctctatctcttggcctgatgccacttagtttgaaggcctctctcctaacttctttaacatttgggggaatttgctctgactgggtcacattctttcccctgaatcaattactgtgtctggggaggtgaggcaatatgattggctaggtctggtgtgttgtgattgacagcccacctgggaccacctgaaatgggggagaggatgttcctcagaggaaatgatgctgaacagacaaaagcagcatgaatctccaggcaaatcatttgtctgtatggacaggaagatcaacaagctggaaacaggaagtaatccattagccaatagtaaaattaatcccaattgctgttttgcttccttagattctaacataggcctaatgaaaaagctctggattcttgtgtaaataatttgggaaatgcctctactaattcaaagaggatcttggaactgttttctattgacaaatgtccataaagaggaacctgagttgtattcacttgcttcttttattcctacaataaggaaagcaccaggagttcaatattgaatgctgaaatgaaaaggaaacattctgtttaataatgaaaagtaccaacaattgcatttggggctaaaagtcccaaaattatccctagaaacctcttaaggtctacatattatttgcaaggctccctaatgcaaatgatctgctttctaagtcaatcttagtcatataaaacacatgccgcaacataaa

SEQ ID NO: 136155 - DNA, 1097 bp, Homo sapiens
tgctagaaaagtgtttcttggctacttcatatgtatataagctttctccctcaacacagtttctgctttttatttttggaatctcacatagcctatatcttgttttcagagtagatactatcactgtgggtggctgagttctcatctatatgcaaccaaggctaactggctctctaggttaccttgatgccacccactgagagtcctttctggatttagtgatttagtgctgcttattttcaccttctctcaggatggagcctcagaatagagaccaggttgaaaatcagtcttttacttagaaccatgaaagcagatactacatcttatccgtctatgacctggtgacccagaagccattaatttgacattaccaacatacctccacacaaagactttataatcttcagtgtgagaattaaacaaacaaacaaacaaaaacttaaaacaactttggaggggagaacgataacctaaattttaagcataagaaaatccctaacaaaaagatccaactaattgccactggggggcgatggaagttcgtgaactgctctgctaatccctgaggcaactgagcactttagttggtttatttattcaaagctggaatttggacgtgtgacccatcaagctcagggaaattcctggatgaggaacacagtcctgggagaaacctaccaaagatggaattagcaccttggcgaaccgccttcagcgcaaagaactttctttccttgtgtgtcttaagaatttacttcagttcccttctgtctgaagcagaggaagccaagttaaactgtgaataagcacgacaacaaagaagagttcttatttatcactacctgcaaacacatgtaagtgcacagtttaaacagcattcagacatctcacagccactaggatcagagttttggtgtgagtaggcctcagttggtaactttcctgaggaaaggagggaggttatagaatttatgttaggaaattctgagtcatagataacactttaagtgacagttaaggaatctagtgagagggactttggacaggtttagaaaagtaccctatggaaacaaaggaggaaaaaaaaagtatct

SEQ ID NO: 136156 - DNA, 1087 bp, Homo sapiens
agctagagcatgggcttctactttctcagcttgctcaatatatgtatatatacacacatgcaaacatactggcatgtagtgtgcattatgtaactacactgggactatttaactcattgccccttctttctacctaccccaaaccaacacacacaatcattcagaagcagaaatgggggcggggactcgctattttcgagtggtgaaaactgttattattattgaagttattatgattaagttgctgatccagttgttgccacaagtgggcctttatgagtcactagatttaacatgatgtgccaaaaaagatgggaatagcactggtaagaatgggtgaagtgaacattgctttggggaggagctctggagagccatgtgaatcaccacccacacaggcaggagagatatcagtatagtcttgcctagaggagtgaggaatttcatgttttcttccctatggaaataattagtagtggatttggttaccaatggtagagagaaatggggaaaccacggggttatgttaatgaaatttccagtgggtattggatttgccctccaatttttaaagcataaactgtaaccaaagaccttctgacatattattcttttaaaaaggaggagcatggtagattacagttgtttgaaattaccaccttactgcataaagagaaagctaaggtgaagtaaataagaagacaggagtaaaaaaatggctgctgattttgagaaatatttagggttaggggcaagatgagttcaggttagacacattgcacttgagatgataatggttatctaggcagtgaaatcccagaagcggttcagaacacagaattagaactcaggaaagagctggttgcagataaagaaatgtaaattatcaggtttggttggatgttaagacataagaatggatggtaaaatccttcaaggctttggttttctttgctctcattccaaatttaccaaagaactttgcgactttagtttggctttcctattaggaagagaatgcatcactagccaacctaaatttcttcctccttggcagtcttatttttttattctaaacattgtgaat

SEQ ID NO: 136157 - DNA, 1442 bp, Homo sapiens
agtgttaataaagaaacatatatctttctatataactatagtggctctgtgaaatacgtccagatgtcccctggtgcagaaagtgttgggggctcacagctttcagctgagtctccaggaattgtcctctgcctaagagaattgcctcacacaaaatcacttcccctccttggggacgatctgcatcctatgagggtctctgcaagggcacataagtccaggcccctagccccaaaggggacaactcagaagggccatcccagcatcagaactgcctacaggatagcccaaggattccatttcaactatcacagctcaacttctctctttacccacaattcttttgtccctcccacaattccttttcactcccgcaattctgttttgttacccacagttctgtctcccacaattctcagttctttccacaatcttctgtctctcccacaattccttatttctcccacaatcccatgtcactcccaaaattctattccttcccacaattcatttttctgtcccacaattccttgtcttgctcacaattctcttgtttctcccatgattccttgtgtctcccacaattcacttttctgtcccacaattccctgtcttgcccgtaattctgttgtttttcccaaaatttgctgggtttcccagcaagcctttattctttcctacaaattcttgtatctctcaaaattctgtttcccacagttccattcctcccacagttctctgtcttttccatcattccctatgactctgtctgtcacaattcctcaaaattattcatttccacaatgttctgttcattcacaatactctgttcttattccccagtctctcccataattccccattatctctcataattctgttctttcacaatattctttttcatgatttcctttctcccacaattctcccttcattctcataattattccgtctctcccacaacactgtattctctcccatggttccctgtatctcccagaactctctgttctctcccccaatttcctgtctctccctgagttctctgttctcccacaattccctgtgtctcccataattccatgtttctccccacaatttttggtttcctctcacaattctctgttctctcccacaattccttatctcaaccataattctgtattctatgctacaatttcctatctttcctataattccccatctcccccacaattctttgttctttcgcagaattctccactcttacaattctccattccctcaaaatactccatgattgttcacaattccccagtctctcccctaactcccattctctctcataattctgttttctcacaatattctcgttcacaattttctatcccacaagtgtcccttttctcccacaattttgtgtctcttccacaattttttgttctctcccacaatcctgtgtc

SEQ ID NO: 136158 - DNA, 1043 bp, Homo sapiens
aggtttgtgactctaaacaagttaactctgttagcctcagtctgtcatctgtaagatgaagatataataatgtttcacaggcctgtcatgatgattgaggtagtacatgagaacgtagtgagtactctaaaccagccccaacttcccaaagtttacttgtgcctacatcagtggttcttaactggaggggggcaatccccccttcccacaggggacatttgccaatatctggaggcatttttggttgtcacaactgagaggaaagtgaatagagggcaggagtgctcctaaacatcctacaatgtacagaacagccccccaacaaagaatcagctggccccaaatatcaagagggccaaggttgagaaaccttagtctagatctagctgtcttaataaataacttttgctcgtatagccatttcagtattttcgtatataaaagtaagccatcacttaacgggcttgctgtccattctttagataagaaaatgaaaatggaaaagctgtctttcatttttaattcattcatgtctactttagattttttatattaaagtgtggcttgaatcagtaagtcgtgaagggcagaagcaacatggtgtgcttactgagtactaatgtttgcgctgttattcatttcttcagtcagccagcctattctgagaggtcactgcccattctgtaccaagcattgctggattttgtttgtttctgcacgagagaataacatcatacaaaatggagctttgcctgatagagcttacattctcatcttcataagctatgtggtcttacgacttcataagctaagttttctccctattttatagtcaaggaaactaagacttggagtaactgatgctccaagtcacatagtaagtggcaaagccagcaaaagttctgtgaccttggacaaggacaggcagtgttcttctggggtttctttgtacaggaagaattgagacagatcagccaaagcaggtgtgctcctgttctgagtgtcctcagggagattctagaacccttactttggttttattt

SEQ ID NO: 136159 - DNA, 1102 bp, Homo sapiens
acctaaaaaatctgagaatatttttttaaaaaagcattgctgtacatgtgtgctatgagagttttccccagagaatgaatagtcatttttgaaaagcttgtcgtaaagtttttagaaatgcctgaagatcgtggcgttagtttctacttcttattccttggtgacattacttctaaatttgttcaaaggagaaagaggccaaaaatttaaccacagtgtttaccatatttgagaacttaatcagtgaagaaacacaacctcagtaatgtgactcttcaaaacagtcaaattatgtgagaagtctgaaattttgatgtcactgatttaataagtaatctgtgctttttgtgtgatgtattgctttccaggaagtagttaattatattgccttttactttatatcctataaaagcaaatctgttcattttatttagatgccaccaccaaatcaaacaccagctccagatcagccatttgcattgtctactgtcagagaagagtcatccattccgagagcagattcagagaaaaagtgggtttacccttctgagcagatgttctggaatgcaatgttaaagaaagggtgagtgaacatattatttaagataaaaatttcttgtcagaatatccaagagttatatgctaaagagattttttaccttcaaaacaatatagtacatttttatgtattaatcagtttataatcacctgatttttcacacctgtcagaatgtaagtgcgagaccagtgtattaaatcagggttctcaagagaaacagaaccaataggatatgtgtaggggggcaggagacaaggaaggcaggaagatatttattgtagggaattgacttacacaattatataaagctgtggagtcccaagatctgtagtcagcaagctggagaccgaggagagccgatggcacacttctggtctgaaagccagcggtctcaagatgcaagaagaactgatgtttcagtttaagtccaaaggcaggaaaagtccaatgtcccagctcaagcagtcatgcagaaggccttccctcttactcatggaagggtcagcctttttgtcattcaggtctgcagctgatcagatgtga

SEQ ID NO: 136160 - DNA, 1088 bp, Homo sapiens
acacacccagcataatgtttgaccaaatgtctgggcatcctgtggcatagtcaggttgacacataaaattaaccatcacagctagtaataggttttttaaaaaactgaaaacactgttagataaaatgtttagaaaaagttaggggatcattgatcagtggtactatctgaacaattgtcaccttaaaaatagatgattctgtaagtctggtttactgtgactcagtaaaatgagactaaggtgaaccttttatatttgttttcaatgcttctatagtagctttggatttatagtgctgctccatgatcatgggtaaatcttgaaaatgagccttagatctgttaaattcagagaaaatgagcattcttagttctttctcaaaggggaatgttgaataaatcatcttatgaaaatatgtggattaactttatggcattatcaggaacagttgtcaaattttaccaaatattctttcctaggtggaagtggaaggatgaggatatcagtcagaaggatatgtataatatcattagaattcacaatcagaataacgagcaggcttggaaggagattttgaagtgggaagcccttcatgctgcgtaagtatgtttgagatcttaaatgtttcaagcatctttgttatttcatatcagctttctagagttttaacattcaaatcatttgttctaataaaacattttatgtagcaggcatggctcagtgacaattgttgcatgacaggccacccttcttagttgaaaaatagcaaccattttattaggcttgtggattcagtgggtctgggtagccaaggacagggcaaggatggcttgtctctggtccttgatgtctggggcctcagctgcaaagacttagtggtcaggatggcttccgagccgtgggctagagtcttctgacggcctgctggtttactcctctggcgagtggtcatggcctctgaatatggctgttttcggcttcgtcatatggtggctaggttccaatagctagagttccaaaaagcatctctatctccattttctgacccagcctgggaagtcccaaagtgtcagaagcctgcccagat

SEQ ID NO: 136161 - DNA, 3254 bp, Homo sapiens
gctgtgaactccacgaggacagtgctcagagggtcttgtatagcaggtcagtgccctgctataccctggtgcctacagagggctggcacctagagagtcctcagcaggggtctgcgggtagagggagtgcatttgccagctaggactctgccactcctcatcttatgtgtagttattaaggagctggtccaacattaattacaatccatttctagggattaatccatcattttcttttcttcataaaggctgttcattggtttgaaatgaaagaagagtataggattttcttgtttgtctgaaaaaccccagctgctctgtgccaaaaagaagcatgatgcacaatacttgaggctgtttttttttttaatttgcctttcctcctccaccaaatggaaaggccctgtttcctgactcctcaaagtgcagtgtagatatccagaaggaaggggaggcaatggaatgcaccagtccagaaggaaagaggaacatttttaacaaataggcacttgttgtttgaattattttagaacttacctttctctgtaaatgttatattatgtgaaatgtatacaggaaaaaaatggatattactaaaaaattagaacatcatctttgtcaaagaaaagaaaatattttaacagacttttcttatttggggaattctagagagtgtccttgtggtccatcattgatccggtttggagggaaagcaaaagagtattcaccaagggcacgaattcgttcctggatggggtgagtgtcagcgcagaagtgttgtttcaccatcctcaggtcagggtcaactttctcttcacaccaaaaccagtctaagaattgcagtgccatcttgcaaaacttaatgcatattcaactgtagatgtctttctctccctgaggtttgcccattaatgggcagatttattagggtgtagtagattgcttcctatatatcatagggttgaatggagttattgtcaatgttcttggatctgccctcttactcttcccgtgatctgtgtctttgggtttatgcacttagccatcctccctttcttttctagcatacttgagattttttgctcacacctgcatctctgcagtatctcagctgacctccctggcttaggtctcttccccattggccttattcctttgtagacagatgagctgtcatctgatacggacttatcacagttcttcagtgccatcttcccttagtgctgttcactgtgtaattcttcaagtctgacttccccagttaggtgtttgggagcaggtgtttgcatgtgcttcttgagttttctcatggcttaaaccgggactgaatgtattgcaagcattttaacactcagtggcatgtttttattccaggtatgagttgccttttgataggcacgattggatcataaaccgttgcgggacagaagttagatatgtgattgattattatgatggtggtgaagtcaacaaggactaccagttcaccatcctggacgtccgtcctgccttagattcactttcggcagtatgggacagaatgaaagtcgcttggtggcgttggacctcgtaaagcactgtttcagatggaaaaatataaactatttttttctgagcgatacattaaactattttccccagattgaattgcactcatgatgtaatgggaacttcaagtgggtaatcacactttttccttcacttaacgaaggatactatgcactgttcacttttgacttgtgttgtaccttgcagtttatagcagatcattttgttttcttcctacttagcttaagtgggaagcagtctctcagtttttcctttacctgcagtattgtctgtatatttcatctcgaaaagcctgaacaacctctgaaaaagagcttttaaaaagtgatgaaagttgcttttttttcttactattttctcaggaatactccagagatgtaaagcctgagagtccatggtgatgctcaagagctttcatctggccaaatattttaactaaagctgttcattataaataagaggtgattataccttttttaaaaaaagttaccattatttctaaagcccctatggtatgattgtgacctttaacaaaatgcaaaggtatacactggaaaggtactcagcaaaattctctccaaattctgatttatatgaatttcttggactggatagagtactttcaactataccttcctttggaacataccttttaaaaaatgttccctttaaatcctgttattctaatatgtaactctgctcccaacaaacaggtctcctcattgtccttggcatttgacaagttatcccaacttcgaatctcatttcttcctttgctggcagcctccacccttccccacatcagtcggcctaatccaaaccttgaaagcctggcttaagtcccagtatcagtgatggtccccctctaaaacatgattttatatttggctgagtgttaaaattcacaagatgagcatttttttcccagatggagaacgcttcaactcagtctagattttttttgtttgttttaaggaagctctaagtttgccattgaaactttttgtaccagtaatccataaactggttgttctatttatagcagcatgttacaaatgactgctttttttttttaactgtctatactattaaatcctttaatttatcctgaatgctgtagtgttaaattagtggatgaaattggcagtctgtgggtgattaatttggtatggatttgtcagttttgtgtggagtttaagaaatagaacagccttaaactctacatttcaaaatacttgtatattttaaaataaagctgattagttcacaggttttgaaaattttttggaataattttacacttaacgattgtttcttcagacgtattatctttataaaaccaatgctttatgatagaatgatttataacccagcacacatatgtttattgcagcactgttcacaatagcaaagacttggaaccaacccaaatgcccatcaatgatagactagataaagaaaatgtggcacatatatactacagaatactatgcagccacaaaaaaggatgagttcatgtcctttgcagggacatggatgaagctggaaactataattctcagcaaactatcacaagaacagaaaaccaaacaccgcatgttctcaagagtgggggttgaacaatgagaatacatggacacagggaagggaacatcactggggcccgtctcggggccggggggggg

SEQ ID NO: 136162 - DNA, 1023 bp, Homo sapiens
gtgtgaacccgggaggcggagcttgcagtgagtcgagatcgcgccactgcactccagcctgggcgacagagcgaaactccgtctcaaaaaaaaaaaaaaaaaaaaaaagaaataaaaacgtgctggttgatccctacagccaggaggtccccatcctcctagttgagcagccggcttagcatgagccagtaacgtaattattttaattaaccaaaacaacagacaatgcaatgtaaatgcataagccaagtatataaagactaatgaatgataaggaaggctttgaaggagaatcccaaaaaatgttgccatgaaactggaaggggtttagaaaatatcataaaaatcagaataatttttcactcactgctttgtagtcgtttcttaaatttgctgttaaaaaaaaaaaaagccctggaactggaagaatagatgatgcacagtggatgtggttcatccactgtgcattagtaagaaggatgaagtggcactgctgacccaccgcacccagagatgcaaaaggccttggctccttgttgaaagattagtaaatgatgtacatttatgctttcaggtaaaatgtaacatgtgatcattttatgatttctagtttcagctggatttttttaaaagtatgatttgacattgttcaggccaagcattgccttagaacagcattttggatcttgctgcctttccccttccacctctctcccttttgtggtttccccagcaagatgcttttcaagcttttgtgtactatgtatcagaatcccctagagggcttgttaaaacgcagatggctgggcccccacccagaattcctgatcctgtatgcctggggcggctgagaattcttgtttctaacgagctcccaggagatgctgatgctgctgggccagggggcccaatttgagcttcactttcctctggcatcttttgaatcctttgagcttccatccacccccatctttgtgatgcatttacagttgcctcatagtcacatagccgtgggtcgaagtt

SEQ ID NO: 136163 - DNA, 1099 bp, Homo sapiens
aggagtggctcctctgggcatgcgtttatttcccagatatctgagacttggagtgtggcctgcagggaccctcccagccaacgactgggctcgccataccttcctcttcctagagtaggcgttcagcaggtactcggtaaatgcaggttgaattacagaaacatcaaataagggagagacgaagagaaggtccgaagagccccacaccatgccacatgcaacaagaggagggtcgcttgttttggccagcgcctgctggccaggctccagttacctttcccaagccttggtccaggagaactttcccttgactttgacgacgacaagtggcccaccagcataaactgccctggcactctgtaaagcttctccgagccccccggggccgcgtcctcttgcatagccagcagggagcgctcagacagcactggggagttgttgtcataaggggagatgtctccgctggaggccttgttggagtctgtagatgaatgcctccctcccacggaaaaggaaacttccgactgcagcatgtcagggcttctggcacaatgagacaattacaggtgcgtgagtttgttaacaagtagtgaccagatttaaacaatatggctattacacaaatgactggaggagtatgcgtggacacgggctgaaacaaaaagaccattttgagcaatgttccaagacatgtacatccatgacgtgaaagggtttcaacgatatgaccagcagagggcagtaaaacccaacagatataacaggaaaaggcaatgatggagaaggcacggtgagaatgaaaccgacaaggagccctgcatttgccaatgggcatcgctaagtgcctcagggactcattcctgcttccatttttaagtgaaagtctgatgctcactatctattaggtaaggatacactagtagataactctttcactttcctcaatatcctgcattaaaaataattcagataaaactatggttgacactttgcttgaagttcattatggctttctggacaacttttccatcccaccaaaatacttactgtacttagtgtaaataaatccatccttcatgtgataaagatgttgatgcca

SEQ ID NO: 136164 - DNA, 1050 bp, Homo sapiens
tgtgactccatcagaggcaatgaaaaccctggaggttttccctgagacttctaagagaggatacagggcctgtatccatatgaggcctgatgattgcgctgacaattgagcaaacaataccaagaaatagagataaaagggatgtcttgatatcatctgagtcccgggacaagctatgtctgaagccatatttgcttgtggattgttcagctatgtgagccttcaaattacttaagctagtttgagttttgcattgcaaagaaaaatacgtacttgatgaacctttgatacaacagctttcaaatttgtctgctatttccttaacatgtgcagcacatttcttctctatgtggttgtcagaatgccatggtcaagacactcatttactggaaactctttttattcccatggctgaagccatccacttgcatactgtcctcaatctgtctttcccatcttctcccctagcagtcattccacacaagctctacttcagcaccactgtgcttctccctcaggtcttctcttccctcccttcctttcattcattgcataaatgttgagtgaatgcttcctgagtgccaggtattggatgctgggaattcagttacaaaccaaacagacaataatccttgtcttcatgaagctggtaacaaatatggaaagacgggcattaaacaaacatacaagaaaaacatagagaaacacaaggcaaagaagggcaatgagaaatgcttgggaagacgcagttttcaataggattgtcagtcccagagaagctgacattttagcagaaaactcaaactgatgaaggagttggagaaaatcattccaggtagaaggaaggaaaagaaagccaatgataaaggtcttgagtcaagagtgatgaggaggtctgtgaggctggaagagagtaggaaaggaggcgggtggtaggaaggggtcatagggccaggaccaggtgtcatggagtcttatgggtcataataaggacttctgcacttacttgcagtgggtggggatccactggagattttgaacagatgacta

SEQ ID NO: 136165 - DNA, 1038 bp, Homo sapiens
caaatctagtatttgataactaaagaaatagaagaagatgaggtcatgtagccaatatataacagggacaggacgatagtaaattttctggttccagagtcagtttcttttcatagaccaagacttgagatatttgtctccctcttcctcccactccactgttatttttctgaatatatgattaccagaatccttctaaagaggtcaagaatgattacattaatggttaacttactccaagaaaggtatccttaatttctccatgcccaaatcttttcatacgtataaggagtaaggcttggtaatatggaaatcatatgtcacagaacaaccattgagtcattcattaattcaaccaatatttattgtgttcctaccatgtcccaggcacaggggtaatgcagtaaagaaagtactatagatagaaatggaccaaaaaaatcatcctgtcatgtagtttacatttctagggagtggcgaacataaacgagaaatttgtaagacccaatgttaacagtggtgagtgctaaggggaaaaagcagggaaaggaaatagggagtgatgatgtgtgtgtgtgtgtgatggagggtggaggtgcattttagacaaggtggccaggaaaggcctctatgagaagtaaagactataactggagaccaaaaatatgagagaatgccgacatcaatccctacagagaatggcaaacaaagatcagatttgggaaaagctggaaaaggtagaatactgatgtttttatactgttcttagtaattcaggtggcaggaaatggaaagaagagggatggcacaattaaaatggcagcagctatattttcaaagaagccaggaaaacttttgttggtatctgagttgaaaagaaatgctcgatgatatgtggtttcatataaaggagaactttgcttagataatagaattaagtttgatgagaagtattattttgttaaaaaaatccagagaacatgaagtaatgccaagactacttggcaagatgatatgtgacttaaacttgatgaaaat

SEQ ID NO: 136166 - DNA, 1112 bp, Homo sapiens
ccaggctgtagacttgatgctaactagctttctctctttctccccacctccctcacttacccacgtcgctctagtctactctcaaatacctttcgttgacttttcttctctttccctcatggcttctgctccttcatgacatctgatgtctcttggtttctgctatctctctatctacccataatttcttgatagatacaatttattctataacttaaaacattgcaataatttttatatttgctttccttctgctttcaatgccttctggaactaggtggaatctgaatgtatgtatgtataaacgaatgaatgaaatattgaatcagatctactaactttgtctttgtatcctcactggctgcccatgatgtcatagttgccagttaatgagtactatataactgccattatgccacttacacatttcttcaaccttcacacattcttaagaagagatggttttatggactgaatgtttgcgtcccaccaaaattcctatgttgaagcctagccctacagccagtgtgatgctatttgcaggtagggcctttggggagtgattaggtttagctgaattcatgagagtggggctcccatgatgggattagtgcccttataagaagaggaagagaccagaccttgctctttccctgccatgtgagaacacagtgagaaggtggctgtctgcaagccaggaggagatccctcatcagaactgaactctgctggcaccatgatctcagatgtccagcctccagaactgtgaaaagcaaatgatattttgttttggcagccaaggctgactaaaaccagtggtattcctctcccattttttaatgtataaaaaactatggctctcacagatgaaattgctttccttagatcacaatgcaagtggtaaggccaggaattggaaccccaatacctgaattattttatggttttctgcattcattttataaaacaataagccaaaagataaatgaacaattattttttaatgaacgtgaatatgacgtatttaatgaattttatctttttgttctgcttttctattttggtctacatgacaataacacatcactataggcatatacgttacttaatat

SEQ ID NO: 136167 - DNA, 1138 bp, Homo sapiens
aagtctgactcacagtcttttatgttttgaaaatgttcaaagaaggtggaaccaaaatgggtgaaaaaaacttgacacatatttgaattgttctcatttgttcatatttgtaattctttaaaacgagacagacaaacgtacagcatacttttgtggccaagaacttgggaatcagatcctaaatctcaatgcaatgttgtactttgggtttgtgtttggaatcaggcatggtttcaaatcccaactcttgtatctactaattggatgacttccagcaagttatttgtgagccttagtattatatcataattgagtcagcagacctatctttcagagatggagtcagaattaagcagaatgatgtacataaagttattggacagtgatgggacaaagtctgactaaataataacaccactgaattttaaaatttaacatgttatcagatctccttcaattatttatatgtatatatgtatgcaatgaaaacataatgcactagcctttttactgaattattcttattctaaaacaggaaatatatacaatcatatggttttatttaagctaacaaacatttgctgagttttggtaatgtcaaataacttactgttggatactgaagggtatatttttgttcaggtcgtaagtatcctaatatcctgtacatatgaatggccgttaggtcacagcttccctcctgtagctcttaacatgtaatgcctctagccctgtggctctcaactgggggcaattttgccctcccccacccctactcccccaccaagggacatttggcaatgtctggagacatttttgtgtatttgcttgccacatcttggggagggtgctattggcgtataagcaagtagaggtcagagatgctactaaatatcctacagggcacagaacagcccctacagcaaagaattatccagacccaaatgtctacagtgcctaggttaagaaacatggtcttgatattatgtatttttctagagtttattatgtctttcatcatttgtgactttggccatgctatgaggactgtctagataaaaattgtccagtcatgagctggttggacataaagctgtgactacttgaactcaaggtgatacttacctaatagcatcgt

SEQ ID NO: 136168 - DNA, 1048 bp, Homo sapiens
gtagttaagacataaacatcccactgaactagacaccagacttctaagaaactcgactttctaaaatcaaaagcaaaaacatatctgagcagccaccaggactgtctatataatttgataaaaatgttgcaaaactgaattaatagttatggttacacaatttggtacatttactaaaatatcattgaattgtacacataaaatgcataaattttatgctgtatcaattataccaaaataaagttatcttcctataaatatatgttcatttgtttatatatttatgtttattatatatgcatatataaatctaacgtaaacatataaataaatgtttatatatttcatatatatttgtatattttatatatatatatatatatatatatatatatatatatataaataatgtctgccagtgacacaggcccaatatctatattccacataatgaagtcatagcaacagggccataatcttatcttattcatcttattttgggatattttggccttaaccatgtgacactgaaatttgcttgggactgttgaaagcattccccttgtttaaagaggttctactaaaaacaacttttcacccatttttttgtttgtttgtttctctctttttattttttctagcacagtggtaacaccctattcccactttaacttcttttccttccttcttttttgaaaattttctaacttgtatttataattctcttgctcatcaaggtcatccagacactatggttctgttcatgtggaattttagtctcatagcaatcagtaagactgtcttgcgagagccggaaatgtgttcattaacttgagaggccttcctgctaagtggtcaaacatggaaacacaaagttatgtagggacattttgctctgtaaactcaaggtatagcatcatttgtttaaaccctctctattgagatgtaattcacatgtgatacaattcacccatttaaagtgtacagttcagtgggttttagtacattcacggagttgtacaaccatcaccactagctaattttagaa

SEQ ID NO: 136169 - DNA, 1127 bp, Homo sapiens
tgtggtttttcttgttttcctaatttttgcatgagtttcttttgttatctgttgattttcatcttaagtgtcaaacataaagagtcatttcaattcaacagacatttattaaacccttattaaatgccagggaagacatcatctctaccttcaaggagtttccagtctagcagtaatttcaaacatgtaaaggagtggtattacagtggggcagattgttaccaaggtgctatgcatcatggagaaagggcattgtcttactctggggagcaggggagtgacacctgtgcggggtgcagaaggtactgtagacagagtgagcagcaaaagcaaagctgaaagtatagatgagtgggggttgtgagtctccagaatgttgttcttcagaactgttacttgtattgctagattcgctttcatataaaccctctttcaacttgaggaaccacgtttgaatatttatcatcagttgtaactaaggttttacttcttgaactgtaatgcttgagtggactgattgttctgtgaaagcaattagcaaatcaagtcagatggcaccagaaagctgcactgtgaactcaaggggtacagaaaatatactccggctttgttgctatggtaacaagtggttctcctgcgttttagttccattataggccatggtgataacagtttctctttgggtaattatgaaaaataaaggagagagaaagaaaagccacatcttggtgtttgcccctgcgtctaacagctgcattttattcctgcaactgttaagggtattggaatgaattcttgtaaggggcagctattgtgataactcttccctgaggatccatgtgacattggctttatgaacacttccaatgtgtgcaggttacagggaggctaagcatccctgggcaagctatgctgcacagccagatccacgaatgggaatgctggggtctctcacctgcactcatattaacagccctcttggtaattctccagcaagatgccatcctttggaccagtggtttgcaacggaggtcagcggtggggaaatgggggaggattttgccacccaggggacatttgataatgcctggagacattttgattgtcacaacaatggagggaggtgt

SEQ ID NO: 136170 - DNA, 1020 bp, Homo sapiens
atcagcttcacttctaaatacatactctagggaaattctcatatacgtgcatgagactgttcattgcaacattatttgttatgggaaaaaatcagaaagaacatacccttatgagaatagataaattaattatgggataatatttcagtaaaaataagtgaaatgggccaatatgtgtcaacatggataaatctcaaattttggcaaaatataatttatatattgaaattcaatcaaattcaagcttacagcaacaataatgatatgctgacttatattctagtatcctattctgattgcaagataaagaggtggcagccaattgtgcacaactttggggattatacccgcatggaagaatgtcgtgtatgtgagcatcattgtttggtgtgttaaagtgaaaaaaggaaggttgagaaccattactctagagttttgttgttcaagtagtgatcaattaggaagaaaaattttcatgaactctgtcttagctcaggctgctataacaaaataccacggactgggtggcttaaacaatgggaatttatttctcatagttctggagactggaaaatccaaaatcaaggtgctgacagattcagttcctggtgaggcctctttacctggattgcaaatggaccctttcttattgtgtcctcacatggcagagagagagagagagagagagagagagagaaggagggagggggaagggggtgggaggagggaggcacactctggtctttctcttctcataagagtactaatcccatcatggggtcccaccttcaagacctcatctggacctaattatcttccaaagaccttgccttcacattccattacattgggggttagggcttcaacatatgaattttagggggatacattcagtccataacagattcccagtgttgacttactctaattttactgaaatagggctatagttatttatgtaagactatgaataaacttcttatgttcagaaatcttatctatataatccaactaagttat

SEQ ID NO: 136171 - DNA, 1010 bp, Homo sapiens
gtgcggccggcagggggcgctcacagggcgctacgcccgggagtcggggcggggtctgggatgcttccacttccttccgtcaggccgggcggcgcacgcgcggttgggagcctcgcccatgctttgtcgcgttaccggggctaccgtttgcgcccccgactgcaacggtggccgctgagggaggaggcttctcgaatacggtttctgtcttcgcgttaaatgtctccttctgtgcggcctggtgccgggtgggctcctgtgggacgccctggccgtccgatccaggttctaattcatagttacacggcgctggccgctgacttgcgacgttgtgtccctgggaccctagtccagtttaggccccatcccgcctgtaggccgtgaaccccatcccgagggcaaggttggcccagtgttttcgtaccccagggccttgcagcatttacgttttcaaactctgaaggatttacgtgggtctgaccatagttgatgggaatcgcgccccgggccggtccacctaagtctccgggagctgagccacatcttgcagctcctcagatttgggtggcgggcaggagttggcaccaggtctcccagatccccaaggaaagcacccaggtgctttcatttcagagacctgggttcctagggccacctgggcgaagccttaggcggcagggacaggggcagtcccaggtgtgtctttggcgatgtctggacagctctgtccattagagatgctaaaggacatccctaaagggatgagcatattctgccttcagttccctcccctgctgctcctgtcttttaaccgcgtctgctatccctctttctcctcgccctccagcctcctcggggcggaggggggggggcacgccccatcattagttttagttgttccctctagggacacaacagggagggattccagagtctccagctagccatcctggcactggacataggggagcccaggagactacaactcccagagctctcagggctgcagc

SEQ ID NO: 136172 - DNA, 1873 bp, Homo sapiens
tttaatcctcccagtgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggtaagttatatagcctgcactttcaccctcacatgtcagcagtacaatgatcagatccttgttttgaagagttcaatctgatggtgtgggccaacatgtttggaggagggaaggaaatgaaaagtgtgtgtcctggtggttttcttttttcctgggtaagctaagtcatcattcactttcatatggctctggcagattttaccaagtgaagaccccagcatagagaacttaggtgggatgatgagcagctctcccattttggggaagacggtagtgggtggggtgaagagagcacaggccggggagggtggaaggggcaggtttgaattgagtcccctcactggctgtttgtgttagttgcagaggtttcttaggagcctccttcttttgcaggtgtgggatggacggaaggcaggcctagctagtagtattaaatgggaatgttcacacagggcctgcaaactttggccttcagtaaaagttacttctcttcttgctctgcgatgtcaccacttttcctccctcagttaccgagcatgctctgttcttttttgagggggcagggagggggatcctgcaacctaaagtctttcccttaatctctataaggtattgtgctcgctccctcttccctctcttcctgagagagtggtctgttctcatgatttccactcatctgtctcctctgttaaccacttattatctgccttcatctactgctgtgctgcaaaactttgcctgcacgtgaactgataacctcccacttgcagtgtgctgccctttttctcggccaccttgccctgccctccctttctccctctgcttcatggctgtcagctccccagcttctctttccgcctggccgccatctcctctcagccatccttcctttggtagcttctctctctcctttccctttccccatgtcagtttcaccccaggtgagaggcctgcaggactcactggggacctatgtcaaagtccccagggcctacttcaaaccttgagactcctccggggtgggttgtgtgttttcacacagcaaccccaatgcttttcttagtcctgccagtagttacgtttcaacgaggtggtagggtattcttgttctctagaccagcgtttctcagcctcggccctattgatgttttgaatcagatctttctttgttgtggggctgcctgtgcaatataggatgtttagcagaattagtggccttcacccactagatgcggataacacctctttcctcagttgcagcaaccaaaattgtctccagacattgccatctgttccctgtcagggcaacattgctcccacttgagacccactgctctaagacacatataacaggggcatcacaatctttaatgccagcgtgccttgcagagttatggagagggtccaagtgacttcggtacatatttacgaccctcctggagtagagagagcatttcgtgtcttcagaagcactccatgttctggaaaggccctttgagccatgtgtgacatcctccatcttccctaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacagg

SEQ ID NO: 136173 - DNA, 1021 bp, Homo sapiens
agagtggagagtatcccagccagggaaatcgtcttgtggttttaagagatcctttcatgtaggcattttgaataaagtgtccatgagtggaattagacttcacaacattttcttggaaacaagtttccaaaagaccctcttccctcccagcctcttcctcaacaaaacccacaactctgtttggcataaaattttgtaaactgaaatcaaatagtgccaagaaaatatgaagagtcagttgcaggatagcataggaaatcctgctaattttgatgcatgcctaatacaaaatagaaattagaattttaggaagtaacttaggaggacttactaataaacctagtaagaggttttaaaaacgtattcgaagatatcaaccagaatcaatggactcaataatgatcataaaaagagtacactcatagaagaaaaagagttagctatccaatgagttttgactcaatttatactgaagaaggtttgcacatttttaggaatttgggcaggtgggagtcactgggaagcaagcataaggcaaatgtgcttattagtgaatattgcacatgtgagaatgtcttagccctccatggcaaaatcagttgaagtttgagtcaagatatcatatgtatattgaagattcttgaatgaccagcacatttttaacatccgtcttcatacatatgagtctttcctgtgtcttggtactgttagctagaactgtaacatgttttggcatggcaaattaggacaccaaatgccattactagttgttctgttcaatttttgtatgactttgctcatataaatgatgtacatttctgaagtgagatttattgtttataatcgttttttattttttattttgtttatttatttatttttgagacggagtcttgctctgtcgcctgggctggagtgcagtggcgtgatctcggctcactgcaagctctgcctcccaggttcatgccattctcctgcctcagcctcccgagtagctgggactacaggcacccgccaccac

SEQ ID NO: 136174 - DNA, 1040 bp, Homo sapiens
accacattgtctctttatttgttagcattaaacaaatttttttttgcaaattggttttatttttttgatgaagccgagcaactctgtccaaaaaggtttagtttgtactcggaaaccacaaagtagtctcaaagtattttagagggaatcgatattgatggcaaaagaaaatttgcagctatgcatttgcttctaacggttccctctctgtgaaacattatttttggtgatctaaagaaagcattgcctttcttatttgagattttacagctatactttgttgtgtaatgttatggttccctttctgtaaaatgttatttttggtgatctaaataaagcctgtcttgtttgaaagaaccaggagagagagttttcactctggccttgtcctctttaatgcagggtaacagtggggtaaccttttgactcataactttaggtttcattttgtttttcctttgtgcctttttttgttaaatccctctttggttttgcctcacttggcagcaggaccagacagtggttcctagaagttcctgcagttctgtgctgtcttgttgctgcattgtggtctcatctggggctaacaccagcttatcctcctcctccctcattaccaactgacagtctctgcagtcactcctctaatccttattttagtcgcacatgcctcccctatcttcagatgttttagaaagttctaacttcgtagaaatggtatcagtaccataccagcattgaatatagcacctgccttgtaactcaactcagcagaccttaacttccaaagatcactggttgtgaacaagggccacaaagattttttaaaaatctgtagatggtttcatcaaagtgacttatgcatacactgaccaatgagaattaatactgtgcacttagttgctaagttagacgtgggttttggtgtctcatccggagtagtactcaggttcctggtagcttttatctccatttggtttatgcaatgcttgtttgaatctggcgcacctgcagtgtgctctgaattgcttaaaaagctg

SEQ ID NO: 136175 - DNA, 1012 bp, Homo sapiens
gccgggaagccagagcagcgcctctcgcccaggcctcgctttctctggacgcccggcagtccccggggctagagcgcacggggcggggcgcgagacccgggccgcgctccccgcccccgcctcttgcgccctgcctggctccctctccattgagttttcctgcctcgggtgcctatcaatggtcctgctcggggatgcacacgcagctcgcggccggaggggggtagcagccgccgcctccaggtgcaggttctctccggccgccgccgccacccgctgtcgccgcgactcgagccccgggcgcactgaggtcttggccatggggctgcggaggctgctgttgctggcgtgagaaggggcgacggagttgtcgcgctcgggggtccccagctgcctgcatggatgtcttcagctttgtgaagattgcaaagctttcgaggtaggggctgcgcgggttccgtttgcacccagggccgctgccgcgggcaacttggtgccttatttttcgggaggctgggtagaggcaaaagctggaaagcgcgacggggcttaagacaaacgaagtggccgggggcttccacgttcaacttatttctcactggctgctgaggcttgtgtagcggcgggtgtagaccacacacagagaggtacatacatgccctcaccaacacaccgacattcacgacagtttgttttccctaaggaaaagccccagcggtgtttggggtcccatgtataattcagggctaagagaagatggttgtaattgctactgctagggaaacccagaagtgcttggagcttgggtgcctgccttccaagctgcaaagaccaaaagtgccgccttcccccaactcctaaattacacctccacacctccacaaagtcagctcctagattgaccaggtgctcccaacggtaacctagatggcgaagtcatgtagatagaagagaaagactttcagcctttttttttttggggggggggtaactatattcttaagcctcgaaa

SEQ ID NO: 136176 - DNA, 1048 bp, Homo sapiens
ccattaaggactgggcttgcaagttggtgtatcataatttctgtcatatgctgttgggcaagtacagagccctctcagattcaagggcgggagactagaccctgctccttgatgggaaatgtgttaagagtctgtggctatcttttagttaccatgcccgtttattgttgagtcagtgacgctcttcagcgtttttatttgggggtcaataaagatcctctggcagaatggcaaatggatgctgccttctagccacaattttttaaagacctagaataaaggtagtcatgatcatctttttgagtagaagcaggactagctttaggggaaaagttgccatggtgatgatattctctgtcctcccctggactgctagtcatatgagaactgaggttcctgagtaaaaacaggccaaagaatctaatcttgtgggataaacgtcataagaccaggagttggcaaagtttttctgcaaagggccaaatcgtaaatattttaggcagtgctagcacatgtagtctctgttgctgcggtatcttacagttctgtaagttacggtaatgtctgtcacaggttagcagggctgtattctcttctgaggctctaggggagaatctgttcccgtgccttttccggtttccagaggcagcccacattccttcactattggcctcttcaccttcaatgtcagcaacaaaatgttgctctgaccctgcttctgctgtctccctcttgcatttttaagggccccatgattacaatgggccaatttaaataatccaggataatttccccatgttaaggtcagctgatgagcaacctgaatgctatctgcaaatttacttcccctttgccatataaactcacatattcaaaggattaggatgtagacatctttagggggccattattctgcctaccacgccattcttaactcacaggccatagaaaaacagcctatgtgctgtgttttgtcaacctctcagctatataatactgtacttgatttctgctgtagttcattttgtgctgctataacagaatacca

SEQ ID NO: 136177 - DNA, 1064 bp, Homo sapiens
gtacatgtgtatgtttgtgtatttctaagtggctccattcagctgggtacactgcagttttctgcagtctcgggataagaggttgtgcataagaaaacatgaaattcatgctatgctcaaattgttccaaataatatcaatcattggaacaaatttgccttttcaaaacatagcagagctgaccatcttcttggtttggacgcagagctctgggaaggacatgcctgagcacacagcactattttctgtttcttcccaccaaaggaatatgccagggatgagctggctctccctctcatgttggacatccagaattctgtacctggaaatacagaaacttccagacatgcaattttcaaaaacttagctgctatttactctttctccagaagctacgcaaggatgccaaccagcaaaacaaggaagtataccaagaaagaggatacagaaaatggcaaatggagtgcaggagagggggcagggaatccccggatggcagctgtgcacaggcagagagataacccaggcctgccacccctgggagggatgcctgcaagacgatgaaatgcagatgggacttgaggcctctgatcttgggagattttgattgttagtgaagggtttagggtggaatctggattcaggattcagaaaacttagcagataaaaaggtaagagaatgacctccagggaaaataaaaagaaaagatgtgcataaaaagaaaatacaagcattcgtttaagttaattgcatggcagagctctgagcagcatttgcgcagttaaaaacgtacagtcaatctttaatgtgaatattgatctatattgggatgatggcgagatgggaagtttacattgcaagtgatggaactgaatggaaatggagttcagtcctcatcttccatagtgagaagtcaatacactttgcctaaaatgaaaaatcaagacacagcaatacacacatagtagctagacttgaaggaaagtatccaaaaaccctatcaagagttgaaattggtggcctctgggcactttctctgttatacgtcttacagaatggtttg

SEQ ID NO: 136178 - DNA, 1031 bp, Homo sapiens
ggctgtgtgagggtctcttgacctcagtgatctcacatgtgccactctgtccttctagaacactattctcctcgcctttgctaaacttgccttaaaagtgatttcctcagagggaccgctaataatgatcttgtttaaactttatgcccttcctactactatcatctctctctctcggtaccttttatttctacacacttaccatgatttcagttacacagattgtgacattacatgtacatatgtttaactgtttgcttctttcatatttgttctctatacccagcgtcaagcacttagttttgcagtagtatatgtaaatagtaaatatttgctgaataagatggaatgaatatatcttttgctgtcacaacatgtataattttctttttgatgcttcgttgattgcatctatgatttatccttctcatgtacgtcttagtgggaggaatctaacagtatccatcttttcctgttataaaattaatgttcttacttgtagagtcgtgccccaatttctgcaaaacttgtggccaatatgctgtcggtggctggggcggatcacatcatcaccatggacctgcatgcttctcagatacaggtatccgtgttttccttctgcaaatggttaaatcaagtctgttaaattaaataatcttaggtaacattacttgtgtttgagtttatatatggctactctcttggatttttgtctttactaaacttgaaaatataatttgatattagtacttccagtctctatcaccaccttgccccccagtcaattttggaggagtggggatggctttttggtagtaagctctatatagttccatctcagcttatggaaaataattagaacggcagtcataatgtacactttttaacttcttcataacttattttctttgtctctaaaacaggccaaattatactgtgccactttgtgttatataatgaacgtgaagtatttgatttataataactacttaagagacaacaaaccttttccctcaccgtcctgcatagcc

SEQ ID NO: 136179 - DNA, 1062 bp, Homo sapiens
aatttattttggaataaagaatgaaataagaatccagcccccccacccccgactctactgtctagtttttccaaaactatttattaaataatccacctctattgatttgaaatggcatctttcatcatatacagagttccccatttcaaatagatagctatttgccaactcctacttttaaaaaaatgcagaataaagtaaacagaataaatggctggggttgagatgctgttttgttttgttgagacctcctttcaagcagtctgcactcaatcacccctgctccctctgccaggaaaatcaagctttttagggaagtacatttcagaatttttgtcacctcctttctcttttccaagtgtttctgctacacattattgtcatcctcatattctagcccccaactgacagtctcctcagaacagccttgcgggtaatacatgacatatgcagttgacattatctgtgacttctttgcttgatgcaaaaggtcatagttagcaaaataaaatactgtaaatttctgtctgaccaattggagcttgttgctttagaaaaagctttgaagcttgactcgttccgggtaaaactgaatgttgccacaggaggtcactcttgggtaggctttgtagcttggttgggttgaccacggaaagaaaattaaacctaagaaacctacctaccactgctgagatagcaagtgtcaacctaaaagtggtatgggaagagggtaaaactagataactcagatttaactttttttctgattacataatctttgaagatgctctataggaaatttggaaagtagaaagaagaaaatcttaacactttatatctcaaccagtgatgccactatgaataatttggtgtactatgtatctgtctctcctgggggagctgatatggcacatgcacccacagagaaaagattgtaaatatgtgcccagaagaaatccaaaactgtatgtatataattttcgttctgcctttttctgcctaagatttcagtgtggtatgttgtgtcaacatcatttgttaggagtatgtattaggtctcca

SEQ ID NO: 136180 - DNA, 1076 bp, Homo sapiens
cacaggaaaatctgaaatgccccaggctcaccagcaagcgaggcctgcccactttctcttcctgttggcagctcagctcctcctgagctagtgatttttttttttaaagagatgggatcttgctatgttgtccaggctgtattcgaactcagacgcaagccatccttctacctgcgactcctgagtagctgggcctacaggcacgatgccatgcctggcaccattgatgtctgagcatttgccttagatgagcagaggagctggactcacagtttaaagtctccttagaccttgaatgcaatgaagcccatcctgactagcctacatattagatggctgtattaaccaggacttttgtccccactatctgtgccacaaactgggcaaatagtagttcctaaataacttactttaagttgtacctgtcatggttttaaaatgctacccacaaatactaacaaactgaatatcaaattcttacccagtagttctatccagtggccagggtgccctgacggtcattcctagctgccccaattgcaaggtccgccattagcacatttctccctgtggattgctaagtgcctgccccagaccatgcctgggctgatcaagagaggcctgattcttgcatcatctctcgggtgtggttgcctgctacattcccaaaatacaactttaaaggcgagatctctagttgactgtatgaacatgttcatttgtgcctttgccagggttacatcaattgcagacaggttgaatgtggaatttgctttgatccacaaagagaggaagaaggcgaatgaagtggaccggatggtcctggtgggcgacgtgaaggaccgtgtggccatcctcgtggatgacatggctgacacttgcggcaccatctgccatgctgcggacaagtacgcagggcggtggggaaagcgttaggacttctcactaggaaagggaaacacatcagcttttagaaattgggctcttttttcctgattattgccggtcttggcagtggagttttagaccaaaggagattctaggcccttttatctttatacttctttctctggtag

SEQ ID NO: 136181 - DNA, 3296 bp, Homo sapiens
aaggtcaaatatgttaactatttggtcctctatagtttgctgacccctgagttagatgatcacagttgtgctcttaaatgacgcagtcaccgccttttcagaaacagaaagaaaaaccttccgtataatgattaaacttaatttaaaacaacaaatgcccctggaaaaggatgtctctggttaacagtatccctgaaaagccttctgtctctgcattgaaaatctcccttccaggatcccatatgggtctggttcaacgggttgtaatttgaagacataccccaaagctgtctgtcctctcaaaagtgtcggaagttttgatagcaacacatcatgtatgctgcagaaattgtttctcagctttccagcttttcaatgtttaaagaactctaactaagatgtcctgcttcccttctccctttgtttttctcattggcatttaggtcattgacatttccatgatcttggccgaagcaatccgaaggacacacaatggggaatccgtgtcctacctgttcagccatgtcccgctataaatccagaatgggaagtgtccagcaagcctactctgacttctgacttgtttttgttttctggatttttagctgtaggtattcagcaatgataggttaatcactggcaaaagcatcagatctttgtatatgctaagatttattgtttccccttctaaagctcaagatcatttctttccagtttttggggaaatggtggtggttatttggtctttaagtgaactgtcttaaatgagaaacgtttttgtcattttgacttttaacaggtacaggtgatctcttcctttgttctttcagtactttgaggcgacaactttcaagtatataatttcattgtggaagtcatagtttatatatttcgaggttgccaaaggtgacttcagattaaagccttctgtgtaaatatatactgataatgcctatggacatttgggtaaaaccctgtatagaattaattatccttttactttggagtgaaccttggaaaatttataattataataccatggattttgaattttccttttttttttttttttggataactcagtttcagataaaccatcttggttactgtgcttaatttggaccaaattttatttagcttaatatggacactgacacattttggggggtatacattagacatatcagagcagtgtatttctggatcattttttaaatgacctcttctaaaacataactgtcacttacctgaaatgctgcatcctaaaattccaaaattatattgagcaatcgccaaggcctaaagccaactgacttaaaggtaatcatttcagctaagattaaatttaaagcctaagaatgtatagagctagttttaaaataatgatctcagatttttaaaaaggatataggaacctgcattgtcattctctgaattaagaactgatggtttctatcattatttagccccacctttgtattttaaaatccttcagaatacatttatgaaccaatgcgactggacttagccacacacaatggaaattcagaccttgactatttggtgtttccagttcacaaaggtgatgaagactgtcttgggagcagcttaatcccaaaatttgtacatttcttgctgctcctggcgtggaaacttaagtgagaccaccaaatacattggtcctgtccaattctactgaatgggggtggacctggcatttatctggccaaaaacaggagccagagaaatatgaatataccaaagttgtttgtttagcctccaacttaaattacattagtcaacttatagatactcatatgatcacttttctttttagatactacatcaactagattcaggagtatatcatttgcagtgcttgtattggtttaaaatgtaagattttaagatcctctaacactgtactaaaacatttcaataaaatcattctgactgcgttcatagtttgtatgtatcattgtggagtaatatgttttgacggagtgatgtgttgcagtacctgaaaatgtttgctactttacgattataggccagcatacaaaattacagaaaagccagaagttaattgatgtcagctgttttccattttgaaggtgtttcttcctgaagaacttaccagcaatcgcctttcctcaaagcgtaacagctgtgccacataaggtgtccacgttgttaattccacatgtttcctataaaattaaagatggtacagtgtgttcacgcatcagagtagtgatgttcaatatccatctattggagcaaaccaaacttaaatgtaggctgcataaaacttgttcatattcattgatttcagaagcaccgaggaggattcctgtccccatagaacagcctgttcagtgatacttcaaactactctcgtgagcgcaaagtcaagtcataattacgttcccctggtgaagctcagctgtaaagtatgtgtaacactaagaatggcaacatggtgtcttgaagtcacagtgaaatatgaagaattacatccaggtccatctgagaaaaaaggtgatcacagtgtgagagaacatgatagaatgtactagaaaggagggaagtgaaggagaagtgaaagccaaagacacttcatcagctttacaattgcacttaataatgctgccacacctcttcagagacgtttcatttcctatggcatgtcctatctaatcccctagctgaactacaggggacagggaagtagtgaagggaaagatggagtactaaggcgtgcagaggttggaatcacgctggggataccaggaagggctcggtgatcaccattagacggttcacgtcggaattttccagaaccctatggtgtgttccagtgtggactgacgcaggacagcagagggcgtttggtacatgatgtgtttgagcaaggatgtgccagggaagatgggagttaggggctgaaacatactcagctatcctgtatctaaattgcgtgaaatcaacagggctcctccttctcattaccaatatttatcttcctgatttatctccctgtgccccaggaacacatccctccaccttttttctgcccctgctttccaagatcacatcctgggtggtttcctttattgcagtctttgagctctgtttcctattctgaaagcataatgcccaggaacacagacttcaccacttaccggagtttaaaaaccaacagcaacaacgaccttgggctggttgcttaacccctatgcctcagtttccttacatgtgagatggggataataaatgagacgttatgtgtaaag

SEQ ID NO: 136182 - DNA, 1060 bp, Homo sapiens
gacggtcacctgcccctgctcacccccacctccttcctccccaggaaaaaggaagtcaagtagatggagaaacggggaagtccaagctgctggcagtggcattcaagggtctatatataaggttgactctaatccccagcgagacaaaagcctgtgccataaaaatgattagcaaggggtttctaaaaacatttccccaggccacggaaaaggagaaggaatattttgcacactgccttgtctcttagaaataatcacagctaggcctctttataaccggcgagtctttttcctttcacacgccatttgcaggcgcgtggcatggtatttgtaactaattttcagtagcaagtgggtcactggtattcacagagtcaggtgccattttgaaaactgcttccctctacccgaatctcttatatttccagatgcagatgcacttcagcgatgtcctagtgctggaaacgctcccttgaaaatataatttgatttttgaatttcatcttaagacattagagataatgtaactgtagtctttggaattcaacgctggcctccttagccatcacttttaaaatttatgaaaataaggaagaggaaggtaaagaacttcctcattgtccggcagtaaagtcaatggcagagcttgagcttgacttattttgctaagagggaggtgttttaccctataaactccaaattaccttacacccagcaaatactactgttgagtgctcacaaaaattatgctgatgaaacaatatggatgtttcagtgatgaaactttctcttttaaaatcacttaagggtgctttacgtcccacccaaggcaagaggaacgccagcgaggaagacaaagaggcccggggtggggcgcatgcccgccactggactgaaagctgagtcacaggaatcgtacccctgcagcgggccaggccctccagggagggacaccgcgcccttgtgtggagatgtccacagtagacaaaggcagtttcgaaataaaagaatgcctgtcaccccaggtgccaccccgacccttagttattatgcactggtc

SEQ ID NO: 136183 - DNA, 2438 bp, Homo sapiens
cctccttcctcctgccgtcctgcctccgtccccgccctttcatcatccgcgtccctgtgaaggcattccctaaatccgagcccgagtggttctccccgggaaggctactttggggagctggggggatgcgaaacaccctagatactggataatggggtggggaaatcgatgatttaagaacaaaaccgaaaaactggcgttttgccgtgccgctcggaggggacattaaaaaatttcttagtgtttgcccgcaaaggtattgtgcgttgccttggaggctgagatatgggggaatagacaagtcctttgttctgaggttcatcttccgagccccgagcctcctcccagcctcggacggctgcgcgggctgcatctgtgcagcctggcggcggcggggctgtgctatgacatctttacagtccttcttgcagagacatgtgtgccagggatgccgaattgccgggagagcaggcaagaccggcttcggggcgcgcggcggccgctttgtgtgcggggctgcattgtgacgcgggcgatgaagccggtagggcggtggtcggaagctccagccgcggccgccgcctttgtgagaggactagaaagccggatccggcccgcatccttgcggagaggccgcggctaggaaatggaaacgcttttcctacctgggctccattttaggaattcttgccgatttttcccacttgaatttggaagtggctttcctcttctttccttgtcctagccagcctttaattttaaacgctgtaattaacaattcgcagtggtcaatttcctttattctgcaagattcggctttgagaggcatccgccctctttggtccacagcgttttgaaatatggggaggaggggcgcggggggtgtcgcctctttttctgtagaaagaggaagctcgtgagcgcggaacggcagcagtaggagagcgagaagggtttttttcaggctgcgggtcggagggcagaagtgcagttcccagcccagagacagcggggcgggtggctcttcctcacgctcgctcttggcttgctccctgcagcttttcctccgcaaccatgtctgacaaacccgatatggctgagatcgagaaattcgataagtcgaaactgaagaagacagagacgcaagagaaaaatccactgccttccaaagaaagtgagctccgacccacccccatctttagaaaggctgggtgggagcggccggtgggagggcgggaggctgggagcggccgcgggaagaattcgggaggggggagtgcgggggaagagccgacagttgatgaatgtggcttgcaaaggttaattaaaaatggttttgcagccaacaaacacggggctttagtaatttagtaatggaatatttaatatgccatattaatatacaaacatttatccattaaaatgtatttctatttagtatattcaatatacatattttattccattgtggaataccgtgtagaatgtttatgatttgaaaagatgctttaaatgaaagccctttagtctgtactgaatcctttaatcatctccctccatcttttttttttttttttttctggtcacagcgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccatttttttttttgttcaaatgattttaattattggaatgcacaatttttttaatatgcaaataaaaagtttaaaaacttagctggtgtgtctgtttggtttctggaaggatcgcggatgaaacctttgcaaagaggcctacctcttggtccattggggagggacaagcatctggtgactggataaattcccttatggcatagaaatgggtttcacccaggtatgcaaaataccttgtctatactaggagatcattttctcaggctgattgaattcctagtatgaattgtgtgagagctttaataaaaatatctttgcagttcttacgggttttgataagctgacattgcacgtgctcaagaaaatgaaggtgataatttacagcacagtatcttatttcagggtatcaaattgaacttggttatttaaccaagtgctagcattaacatagatgagtaaaaattacatttttagcagct

SEQ ID NO: 136184 - DNA, 1006 bp, Homo sapiens
taaggtccttaatggattcctcggttctgtagggaagggtggagacttttttttttaaataagcaccagttttattaagccgaaacaacagcatttaagaaggctcttagttcactgaatgttctgcaaagctaaattttacaacgcaaatgtccaagaagttaaacatttttctctcaaaaccgatttatgaaaataccctttttgaagcggaggggtagggaaaattgttgatcactattaaattggttgctttcatttcctttgctcaacgcttattttgagaaatgcacaggaaaccatttacctgtggtttagacaatcaagtagaccatcaggctagaagccttgctctgcgttgcaagggaaggggtgtgtacaggctgctgcagaggctgctacaaaacctgaagcgccacagcccgcttagctccgtgaagagaggagtaagcacaaaggttctggagccatctcaagatggagacgggcctggagccctgtagttttcttgcctatagggaagggtgtgggcacagtgcaaatgcccaaggcacaaagagaaaccattcccacgtgggcttttgctgtgtgcctttttcaaacaatgcaaagacgaaagaagattttaagaaattaacacagctccagtgttcctcagttgaagaaggaacatttaggaaaagggataattcatggactaaaagacctttctcccctagagggacgaagctaaaacatagcacaaaaaaaaaaaagtaaaatggtaatgattgaattcaggctgcttgacgtgtggaatggggaaattcagaagcttctgcccatatcacactctgtacacttaactgctgcacacggggatgggagagaatttatttttttaattttgatgggggattctttgtttttcccaagagagattcttcccagaagggctgggggtatttatgagtcagtgtggggatatatgttcctgctatgtaggacttgggagtcgacagtattt

SEQ ID NO: 136185 - DNA, 1030 bp, Homo sapiens
actctgtctcaaaaataaatgactaaaattttttttaaaaaaaacattattatatgagccaaatagtgcagcaactccatgtactaggtttttgtgagaaaatgaggctgaaatggcaaagcgcttctcttgggcactgtaaatcagaacggtatacttctggccaaatgtgtctcccactgaagactaagaagagaacatggctgtcctttatattgtcactgttgataaataggccctcctggcagcatgccaggtcatatcatgaaaggacagctgtgggtggtgtgtatagtgtcagtccatgagaatgagtcatgaggccacgcggtgcaagaacgaaagataaaggaagcagcaccgaccaacgcttcaatgtttaatgcttatgtctcactatgccgatgaactgctgttacaaaacgacttccctttaaaacaaagactcaaaaaccaaaatgaagtgaggcatttcatggggcagtccacatgtcaggatcacctccagactgtactactcctggttacaagccactctggcagaacaaaaccccagatgacaggcctcagtttggatttcttcatagcaatggaaacagcaactgcgcaggcaggcagaggtctttgagtagagttggtgtccccttgttccatttcattttgtaagtgttctatatttttctgattaaagagaattttgaagaatccctagtaacaaaatagtaaagatgttgcactgcctctgaattttcctcttatgatatgcaccaatgtattagtacattctcacaccactgtgaagaaatacctgagactgggtaatttaataagcaaataggtttaattgactcacagttctgcagggctggggaggcctcaggaaacttacaatcatggcggaaggggaagcaaacatatccttcttcacatggtgaaagcaaggagaagtacagagcaaaaggggaaacaccccttataaagccatcagatctcatgagaactcactattacaagaacggcatggtggtaa

SEQ ID NO: 136186 - DNA, 1017 bp, Homo sapiens
gccattagttacataaggcttgatcacttgaaatgtggctagtccgaattgagatgtgctgtaagtgtaagacacagtgaattttcgagaattagcatgaaaaagaatgtaaaatatctcaatttgtttatattaatcacatgttgaaatgactattctggatacactgggttaaataaaatgtataattaatttcaccaatttttattttttaacatgactactggaaaattttaaatcatatttgtggtttacatgttatatatatgttgcacagccctgctctagaaaagggtcaacaaactatggcctgcagccaaatccagcctgcctgtttttgtaaacaagtgttaccagagcaagatcatgcctatccatttatgttattttctgtatctgctgttgctgctacaatagcagcagagttgagtagtccatagagattgtatggcctacaaagcctagaatatataccttctgatctttaacagaaaaagtgtgctgaccccctgctgtagaacaatgcctggtttggtagatatttttaagccttttaattgtagattcacatcctattattcacacttactgtgtgacagccatagttcaaagcactttatcaagactttcatttaattctcattaatcctaggatgttggatttctcccattttgtagatgaggaaattgaggcacagaatggtcaagaaacttatccaacttgctcagcacccctcacttctgggaactggacctgcttgaccttccttatgcaaatgttttgacccctcaaacccacttcattagcccacagtgggcaccatggtttttttgtttgtttgtttgtttgttttgttttttttaacaagatttatttgaactagaatttttgaatgatttttttgaactagaatcgagatgggcttggtctcctacgaaagaagccaaggggcactgggcttaggtgcaatgagtacaagcaagctggtgtgtagtgaaaagaaatgaagctcccaa

SEQ ID NO: 136187 - DNA, 1151 bp, Homo sapiens
ttttagtatccagaagctgcgactagcaacggcaaacttaagaaaactgaaacctcttttttctttgcagctgtaaagatgtctgacaagaaccagatagctgccagagcttctcttattgagcaactgatgtccaaaaggaattttgaggatcttggcaaccaccttactgagctagaaacaatttatgtgactaaggagcatctccaggagacagatgtggtcagagctgtgtacagagtcctcaaaaactgcccctctgtggctttgaaaaagaaagccaagtgtttgctatcaaagtggaaagctgtttataagcagactcactccaaagcgaggaacagccctaaattatttcctgtgaggggtaataaagaagaaaattcaggaccttctcatgacccaagtcagaatgagacactgggcatctgcagctcgaattctctgtcttcccaagacgttgcaaaactcagtgaaatgattgtgcctgaaaatagagccattcaattgaaacctaaggaagagcattttggggatggtgaccctgaatccactggcaagagatcgagtgagttgctggatcccacaacacccatgagaactaaatgcatagagcttctttacgcagctttaactagttcttccacagatcaacccaaagctgatttgtggcaaaactttgcaagagaaattgaagagcatgtttttaccctttattcaaagaacatcaaaaaatataaaacttgcatcagaagcaaagttgccaatttgaagaaccccagaaattctcatttacaacaaaacttgctctctgggaccacgtctccacgagaatttgctgaaatgactgtcatggagatggcaaataaggaactgaagcagttgagagcctcctacacggaatcttgtatccaggaacattaccttccccaagtaattgatggcacacagacaaataaaataaaatgcagacgctgtgagaaatacaattgcaaagtcactgtaattgacagaggaacacttttccttcccagctgggtgcggaattcaaacccagatgaacaaatgatgacttacgtaatttgtaacgaatgtggggagcagtggtaccatagcaagtgggtgtgctggtaactgtaaatcagtgttct

SEQ ID NO: 136188 - DNA, 1068 bp, Homo sapiens
acttttaagaagccagcctttagtttttcctttagaagattatgaagttatcatgattgcttctctagaactttagtagttatttggattcctaaatctaagacaatgctgtggcagtctggtgcttttagtatttttgtgtctgctgtggtaaattcctcgtttatactacaaagtttctcttctggagacttttgggatctgggcatattttttcgtttattatttggaatgttagagtagataggcaaacactaagtagaacatcattggctttgactccaagccgggttttagagataagggaaataataccttagtgctatcacttcttttccaacctctctcatctctttttgtttctatctcaaccatttcttctgtctggactacagtactctggaggcctaaagagaagatccttgagttctcgaaattatttttttttagcctcccctcatttctgaccatttattgagcactcactctgcggcgaatattccgtacgtgtaaatcctgtacgtacatcattttatttaatttccatagcatttcttcagtaagagctccatgttacagttgaggaatttgggggggcataggaaggttcagtctgttttccaagatgacccaggttgtgatggggtggagcggggattcaaagcaggtctgggtaattttagagtagtagttttcaactggaagagaggacaattttgtcctcgtaggagacatttggcaatgcctggaggcatctttggttcacacctgggggcaagggaggtgctgctgacatctagtgggtagaggccagggatgctgctaaacattcttttttatttttatttttgttatttaatttttaaattttgctgctaaacattctataacctacaggacagccccccacaacagagttgtctagcccaaaatgtcactagtgccacggttgagaaaccctccttttcagcagtccaagtaaccccagagcttacatttcaactgcttttgtagtttttcaaatgcaatgtcgttttcctatttgggatacctcatcattttaacagt

SEQ ID NO: 136189 - DNA, 1459 bp, Homo sapiens
ttctgcccaggcaatgtgttaagcagcaggaggaggaagtaagccaaatggaagtgtgtgtgtgtttgggcaacgcatctaacttgaaaggtgtatagataatagactcttcagtcagaaccaagcataagagaataggatttgtgactaagtaggccatcaacagagaacatttattaaggacttttttgtagaggagtgagggtgaactcaaaaaatgtttcagggagtttggtggaaagctatgatgcaattggaaggcgaggatgcctgagggaggagacgtggagccacctaggtgtgtaggcagaggggagggaggtcggaggcggtcccaggccgtgttgccagagagcccaggggtgccagggctagttagataacttggaggagaaatctctgtttctcaccatgactcttggtactgtgcatgttgtgaagctgtgtgctctgggtatttccacattctggatttttcaaatccttttgttaatttttgaccatggtgagttcaggcgttgttattatgttgcttattatgaatacagtgaggatgactaggtgtaaatgaatgtaaggtaacagctagatctgcctgaggtggagagagactgggtgtgtattttggaaaaaaaatggagaagtgaaacaggctgttcaggcttcacattctggctgcatggaagccagctcattgcattctccaggagttctctgggagtctgtggacacagactccacttttgtcttaggcctgactcgtacaaacatattctgttgtttgacaggggatggagaaacactatagaacaactggacacattcatttcattgccacattctttattcaagtgtgacagagagcaaaacagtataaaggagttgaactgactactgtattttaatttcaagttcctgtgaattggattagatttttgggtacagaagctaaggtaatttccaaaaggttagtgcccataagactgtctatgttctcagagttagaaaaacctgggaaaaaaaaaagccttacagacctctgtttctacaacttgctgtgcagaactctaacagataggagtgtttatgcagctaggtgactgctctggtctgtgcagtttcacacctgtgtatttgatcagatgtatatacctggaaatacatacataatgtggttggaagtcagattagaactgcctgaggactacccattggtgaatgcagaacattctttggaatgagtgctagtattcttaaataacatttaaaaatagttgtttgggagcaaacagttgccaccctcataatccactttaatttgtgcccagtacttgatttttatcacagcagtcctggaaaacctagcttcatgaagatatgatgtcatcgaaaggaatgcagtgcaatctaattaactcccctccagtggggtgccctacaaatgtcaagtatctatgtt

SEQ ID NO: 136190 - DNA, 1051 bp, Homo sapiens
actgcagttcaggtttcctgtgcaaatcgtccctccagctccactttcctttgtgctttctctccattttctgctgggtgcaattccttaggaagtgggtctgctagggtagcacagggatgtgggtcatggaatctacagcctttcagggacccctcgagcctccggacccggcctgtctggagaagtctcgagaagtgcccgtgtgctgttcagttcttttccagttctctggtgggaatcagctttctcattgttggctgctgctttccgcattaggtttcattgtctcttcactctgtcactcccggaccatttgctttccactttctaaattttgttgctgtcttgcatctacagttgttctttcttggtgtcctttttggatttgtaccttacgtagaccttttctgtcactgggtgggagtgaagataacacatacttgacctgccctatttagttagacctggggaagtttgtggacttctgtttattgatctataaaacatggatgatagtgtccaacttgcaggtaattttaaggtgctatatgccaggtacctagtagatattcagttaatagtggctgctaatataattacagccatagcatttattatttgagcaagcaaggcaatagcaataggtagtgcgaaaagtggacatatttcatgtgtggctgaatgaagtgcgtaagagaaaagaaagagattttcgaaatggagaaaataattagctcagttttagatatgttgaatttgaactaccatcagggtaccagatgaacatactatacaaggggttgcaaattcttgtctggctcagacatgcggatgtagactttaggaatcactggtttttatagcccagggagataccatctggaaacaggtaagggtttcagtctcgtgaaatagcttcatgaagagcttgtcaggaaagggagctgtctatgttgaagaaagctaaggggccaaggaggagagaaagcagaacctattatcagagtggttttatggacaattaggaaacattttcaagaggattact

SEQ ID NO: 136191 - DNA, 1011 bp, Homo sapiens
tatagttccccaacccctagctttgtctgctgtaaattaaagacatttggtttcttatcgaactggaagggaggcctcagaaccaatgtttctttaggtgatagcagaacgttgcagatcatttttgatttgtgttttgctgctttaatatatttttctgacatatatgttcaaattcattcctttcataatttgtttttcttcctgaaatatctacctttaattccccatgttctcatcttgtgacttttatctatgtctttgcattttaattctgtcttccaaagtgcactctattgtcaaaaagtattgtaagtaccttttacaggtaagtgtcatcgcaggtagatttatgcttggttcttaaaacttaagcaaaacaaaaaaaaattattctcacttctcaggactagcagtttcccatgagtaaggctgttcactgaactatcacagtttatggtcaaagtgtgatattcataaaagtctcatgggtgagggagaaaaagaggaaattctgctaaagacagaaactcttgaagggtgttatgagctacagaaatggatcacacataacatacaaatgatgcaggcatgtagcaatcagttcttggtgtccaaactccttaagatctgatgaaacattttttgttctttccagaaaaaaagcgcaagcacacaagcttccaccaatgctctcatccttatttcacatgtgattctagggagtgtattttctccctgaagctcatttcatggactcccaattaaccacactctaggcctgcactgtccaacacagttcccactagcctcatgtagcaatttaaactagttaaaattaaatgaaaaattcagttcttcagttagaccagctactttccagtgctcagtagccacatgtgattagtggctaccatattggacagtgcagattatagaacattgtcgtcattgcagaagggtctgttggattttgctgcactatatagtttcatgatggtttaagattta

SEQ ID NO: 136192 - DNA, 1101 bp, Homo sapiens
ctaaatttaaaccaggagtgataaattcattttaagtttttggaggggttacagagtatgtgttttaaaatctcaagttttgagaaggcagtttacaaatgatgcctgctctccctttggcagcttattaaggaatgtagtcgtttttcagcatttgccagctccctgtcgcagtcagtcaatagtacttattttaaagtgggattctcattgggattgcaagtaagaatcaatgtttttgttcctacccacacattttaatagacctcaaaaatagaatgcggggagaactgatagagaaacaaagaattttaggtacagaaagcacaaatagaataataatagaataacaagaataaaagaggaagtaatatactcttcgttctcaatgtagcatttatttgcacctcaccaaatgtagagcattgtacgagaagtggcagaacaaaaaagggacaagtgaatggatgcaattaggtgttgtgtgtccctcccagggagttgacattgtaattaggaaacagacacatacacaactgaaggtgattagagcataagtaaatgagagctgtaaagaggtggaaatgatgagagcaaagaaaagagaaagattaggttgctggggcggtcctggcttcctacatgaggtaatctggactaggcttctgatgactaagattgtcatagctgtcgaagtagggaggggcctcccaggccaaagtaacagcccgagcaaagatatggacagaaaatgccagtgataggtgcggggatggtgagtagtagggatataattgggacaggcttgtaactgacattgaatagctctttgaatgccatgctcaaaatcctgtataataaaaataataaataaatgaatttagttatctgtcagaatggagacaattagatccaggaccaataaaaaaagtctaacttcagtcacatacacagtcatattagagatttatattctttttttttggagacagagtctcactctgtcacccaggctggagtgcaatggcacaatctcggctcactgcaacctctgcctctccaacaatcctcctgcctcagcctcccaagtagctggaacta

SEQ ID NO: 136193 - DNA, 1062 bp, Homo sapiens
ttaaatgatataatctgattcgaaataactggggagaagggagagttggaggggttatggaggaaacaagatttgccataagttgataattgtgaagctgggtttagagttcatgggagctcattgtattgtactcattatatagaaattttgtacatgttttacatttttcacaataaaaatgtaagcagaaggattaaccaggaactgtgctcccaccagcacctagaagtagctgtctgtcaacgggcatctgaaatctcaccccccacaggctggctcttgtagtgtagtaaagtttttaatcctgccacaggacttctaaagaacacatatagtaccacattttcatttaaggtttatttcattctacctgaaaacacacaagtagcagcagtctcatgttccttaagtgtttgaactgcccaagtgaatcttgtggatagaatgtgctagattatattaaaaattccattgctgctgacattaatttgaacaaattcaaaataatgttcttaatgaagagaataaagtccatttactcagtggttggttcatactttatttcacagccaggtaagtcagtttctgtctctggctttcctggttaacagcacctgtgtctgaagagaggtggagggagtagtagagaaagtccctggtaggagagaggccttaagtgaacaccatcactgtgcactgaagggctgtttgaagttgttaagagaaacatgtgggctgggcatggtgtctcacgcctgtagtcccagcactttgggaggccaagacaggtggattgcttgggcccaggagtttgaagccagcctgggcaacgtggttgagaccctgtctctacaaaaaaatagaaaaattagcaaggcatggtggtgtgcacctgtgatttcagctacttgggaggctgaggtgggaggattgcttgagcctgggagttcaaggctgcagtaagccaagatggtcccatgcactccaacctgggtgacagcgagatcctgtctcaaaaaaaaaaacaaaaccaaaacaacaacaacaacaacatgcgaa

SEQ ID NO: 136194 - DNA, 1058 bp, Homo sapiens
aagagcctgagagctttccttttgtgattctgggtaacaagattgacataagcgaacggcaggtgtctacagaagaagcccaagcttggtgcagggacaacggcgactatccttattttgaaacaagtgcaaaagatgccacaaatgtggcagcagcctttgaggaagcggttcgaagagttcttgctaccgaggataggtcagatcatttgattcagacagacacagtcaatcttcaccgaaagcccaagcctagctcatcttgctgttgattgttagattgttgatgcattctaaccaactcacacatatacacaaaatcaacatggggatggagaagagaattagcgtttgcagcagtgtatcatctactaataaaattaaactaatgttgctgcttcattagttggtgggagaagggacacatccactcttggaggaatatatttactcaataatggcaccttacatttataaattgtaacagttgtctaataacgtttctttaatttaaatatgtaagttgcagagctaataaatgaaatgaccaagactttaattataataaaaataagaaacttgactattctagaagttatacttggattttttcctgggaaaatggagaactactttttatatgtgtatgtttttatgcaattagcattgtattcttggttcagggaaatactttcctaaagcaataatgttagatattaaagattaaaatctaatgtatttgcaatgcattgttaatttacttcttcattctcttcaaaatgatttaaccattcctgttttcattctacatactagaattactctcactagtaattactcatcatttgtgtgccattcatgcacccccacccccataaatcatgttccacagtctcaggcggagggtgggcccccagtggtacaagagttgcttcatacagtctgtaatacatccagctaaattcaagttgtctatgaatggaaagcctttccatagatagagttcagttttaagaaaaaggctaactactgaacttggagaacagacaaatgtgcat

SEQ ID NO: 136195 - DNA, 1061 bp, Homo sapiens
ttggacagaatttcttgcatatcagcacagtaatacaatttaacagtattcctagtcagaggtagtaagtaatatttagccctcttataaagatgaacaatgtcaagtgattaaggtataaaaatcagcaatgcctttcctcattagtgattccatttaatgattttctgtcatgcgttatgatacactaatttgagaagctgatcatttagcagtcttgtgttaaaggagagtattaaaaacctgattgttaaaagattaccacacaagaatagctttttctgaactctgagcacatggcagatttttttgttttatgtagccaaagggccatagagattaatccatttatttataatgaatatgagtatttcacacacacggtaaattctgaaagttaactgacacaggcaacatttatcatactgccattagttttgccacagatacttctcaaaaccaaaacaccaaaataaaaatttccttaagaggatgttattaacaatgcagcattttcaataaaacttaaaaatgtggtctttagactttggaatgtctttggtttttaatttaaaactttaaaatgatttcctttcagaaacttaagatttgtcagcttttttgcttcactaatactttcttctttcctagttttcaatgaatccattttatgaacccaattctcctattcgatcaagtgcatttgacagaaaagttcagtttcttgggaagaaacaccttttaagctgaatgcagaaaattccaaaataaatgatgtcaccacaatggtgtatactcaggaatgtgtacattgtaagttacttgattaaatagcctggaaaacttttgtgtattctcagcttatctaaacctaatgaaattccttttatatttaaaaatagtacattctgtctcatgtcacgtatcaatagatcaattggtatttccttgtgaacagtgttatttataaagagttcattatcaataatcatgttttttttttttttttttttctgatacagagtctcactctgttgccaggctggagtgcagtggcgcaa

SEQ ID NO: 136196 - DNA, 1147 bp, Homo sapiens
tatctgtccagatcttccagttctaaaatcatattataccatatcattacaatagcataaaaattcttacgtactttggattctgccttcccagctggcaaaaactccatttcaaaaactggattatcatggtggccaacaattacaaagtagaagctcccagacatggtcttcaatatatggctcctaattaagtgaaaaatagtacatatttttagtagtcaatcttcaaattaaaaaatgactaatgggaagtgtagaattcttttttaaatttaaacctgacattgtagaggaagatgctactaagcttggcagtttccagtatactagcgaagatacgtagcttctggaataaacaaattatgtatctatgatatgaatctgtgaatctaatgtattttcttaagtaaactggaagacctctaacatgaaatcacaaagacaacattctcatgatctgaaaatatggctcattcagctcaaggggccctaagtgtctggtagagtaagctgggcttcatttggactggaccagttagtagcagcacggacacctagaaggattaacagaaggtggtggtaagtcaaggacaatacagagtagtgggaagaccaaggaagtaattaccttgccttagaaatttccaggaggcatccgtcgggggaagctaaaaccaactctacctcatgtcacttacctagaaaggacagacactgtatcactgattcgcagactgcgtgtgctgtatttgtcttctttctacttgaagtatgtgtgctataaatgtaagtctttgcaaatctaagagcctatgatatgcctctttatataccaatttataagaaaggaagagttttgtattctagaaaagatggaagaaataatccataaaggaagacattctgaggcactgaaagatcttggaactaagtttaacatgttgggcccggtgcagtggctcacgcctgtaatcccagcactttggagggctgagatgggcagattgcttcagcccaggacttcgagaccagcctgggcaacatggtgaaactccatctctacatgaaatacaaaaagtagccaggcatggtggtatgtgcctgtagtcccagctactcaggaggctgacgcaggaggatcacc

SEQ ID NO: 136197 - DNA, 1029 bp, Homo sapiens
ctccctgtccttcccttcactttggagaattattgccagttcttctagttttgcatagcttttttatcattccagctcgtctttgttatccactttttctgtttggacctttttcttatctttcccctaaaacaggggcaaacattttctttaaagggccagatagtaaatattgttggctttgtgggacagctggtctgtgtcacaggtgcttaactctgccattgaagcgtgagagcagccttagatggtcgcaaaatgatgggcaaggctagatttggcctgcagtctatagtcccccacccctccacccctgccccaaatagcattttaaatcttacgtcatcatgccaggagttctgatctgccttttcttccatagtcatggccttccaattctagagttaaaagtgccagctgtgccttgatttcctttataaaatgtgtcattcattagcaagtacatatcagatttcttctgatttcattgtgtgttctgtgtgaatcagcagaaggcccaatgaggcttgctaagtcttggcttctaacacacctcagatgtatgttctaggagactgactgtaactcccggtttacttgatttccactccgtgttgagaagttactagtcaccacatcccagtgtgcatacggtctcccatgttattccactaacattaattgagcatgtactgtgggtcagacactgtactgggtactttacatgcattagattgtgtgatcctcataagtgcaccataaggtgctacagtgttagcactatttaacagatgagaaaacggacattaggaagttaaggactgcctgtggtcacactgccagtaagtagcagagctagacctgaacctaactttgactccaaagtccttgtgttaaaaatacacaccgtggggttaccttggggtaaatccatccatgcccccacccatccatcattcatctagatttcaattatctgtgctaaaagccatggaatcacttatatttttccccccagtttctcgtagt

SEQ ID NO: 136198 - DNA, 1014 bp, Homo sapiens
gagtcgtgcctgggtcctcgcccttgcctcagaaccgcgaagaaaggaagctcgcgtgtttgctagaaaacctagttgggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcaggtagacacacctgccccttctcgggcggaaataaagtcttgttttgtgttcgttaaactttcgccgctaggcctcttatggcttccccggaggccactggtctgttttcagacgttcacgttccctctgccccgcaggtaacctataaccattttgtcttttagtccaacatgtttaccgtggctgatgtgttgagtcaagatgaactgcgcaaaaagctataccagacgtttaaggatcggggtatactggatacactcaaggtatcggatttaggcgtatctgtgtcagcttttacaagtgtaacctgtaacaggtagttcaaattcaatcaaggtttaggttttaataatcgtatgatacatagattgtattggtgaattacatttttatattcccgaataactctgtatcctgaaacattacagtctcttgaaaatgtttgagaaaatgttgagtttgagtcgtcttaaaggagcatattcaaataattaattgaactgacaataagataggagaaggaaatatttgtataatgaacacagtaagattaggcttgttttataaatatggcttataggttcctaaattaataagtgggtttgtaatacatttggatgaaggacattgacaccatatagaaaatactagtgtactgcttaataatagtttgggaaatgaaaaattttatctttaaactatattgaaatgtatgaatgtttagtttgggcagaaaatacctattagtatg

SEQ ID NO: 136199 - DNA, 1309 bp, Homo sapiens
tcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtaaagtctttccttttctgtttctgaagtttttattaacaggttcttcctctgctgacagtaaagtgctgtatgatagctaagtgctcctcgactaggtccatttctgtttcctctttgaattcacattgtacctgcacataatatatttgttatataacaagtgggtactaaatttgaaattaatttcttggcgtctcatttagtctcacataaaacagtgatgtatagaatctctaaatgtttcagacctataattgatctatctatcctctatcttgtctaataagactctgccaatctgctgaatgtctgctgtaagcttggcactgtgataggcacactgcagatgttttgtgtgttacggatgaggaaccagactctggagaggtgaatcaatttgcccaacatcaagtaacttttaagtgacaatgcagggtggtaaatctagatctctaacatgagctctttttttcctgcactagtttcttcagatgtttctctttgtaattagataagtgagaaatacgtaatttaaaaaatctgtaaagttctcaaatattaaaaacacttgttttttttttttactacttttctaattattttaactatatttcttcaccattactgttgaacattagtactactttattattttaaaggcagatacagcagactttccctgtggatatgtgcgtgtttttttttttttaatagactttattttttcagagcagttttgggttcacagcaaagttaagtgggaagtacagagaattcccatatacctgctgcccctacacactcatagcctcccccactgtcaacatcttgcatcaaggtggtacatttgctacaatctataagcctaccctgacatgtcattatcacccagaggccatagtttacagtgaaggttgcagtgagccgagatcatgccactgcactccagcctgggtgacagagcgagactgtctcaaaaataaaataaatttcactcttggtggtgttcatatgtttttactttctttgtgttttctgtaattatccaaaagtttcatattccaaagttttagtgacacaagcttagtacagtatttgaatgaaaacttaaat

SEQ ID NO: 136200 - DNA, 1872 bp, Homo sapiens
tcatcagatatttcagtgtcatctgtaaggcattaaacatttaggcatatcatctttgatgtgaagtacttagaagttaattagatgataaagatattttatccttttgaccttgatatgtttatagtaatttatttaacagtgtaagaaagagcttgaaatttgctttattagcatagttataatcttatttaatctgaaggatgtttcttaatttcatattcagaaacatatcctaatttatcatttaaacactgatataaaaatatgtctacttagtaacctattttttcttaaggtatttactatgcaggatctattacaactcattaaaatcaaccctacttccagtctctacaaatcactggtaagatggcttagtttctgtaatctactttggtttgttaattataactgaatagctgaataaaagtgaaatattttcttttaacaggtttcaggatctgataaagaaaatcaaaaaggtaggagccgtcatctttgtagagaacagcaacagttttctatgtactttttcctctaaaagaatgaagcaaatttttagggagaagagtaaaatttaatttgatttaaattatttgatttctgcaggtcatttcccctatatttccatttttgtaataacttttagatattcaattaaaaaaactgtagacagtatcaaaggccctacagacaggctgaaagatactgtttgtaaaaatacccactgttgggaatatttctgcaaaaaaaaaaaaaaaaaactaataacttttaggccaagtgtctttgtatactaggtatccctctcaagtataattggtagggtattagatgtattaatatttccttaaagaatgagagttgtgttcagtaatgtgttatatatcttttgttcttaaatgtttatacaggccgggcgtggtggctcatgcctgtaatcccagcactttgggaggctgaggcgggtggatcacctgaggtcgggagttcgagatcagcctgaccaacctggagaaaccccgtttctactaaaaatacaaaaaaattagctaggcgtagtggcgcatgcttgtaatcacagctactcaggaggctgaggcaggagaatcgcttgaacccggaaggcagaggttgcggtgagctgagatcacgccattgcactcctgcctgggcaacaagagcaaaactccgtctcaaaaaaaaaaaaaatgtttatatagacctaataaattgccttaattttggccttgataatagccattcatagagtccataactactgtgggtttcaggccattggttagacttgatgatgggctttgtagcatgaacataagctggcaacttggctttgatgcatagttattctttaggtcttttaaaataatctgttagtaatagtccttttgtgttggtacacccttggattttgtctgttgcctgcactatcatccccacaaggacattcatttattcatccattcattcgccaattcatttagaacttaatcatttgaatacttattttctgccagccattaagtctgtgacttaatcgccaagtctcttggtagtaatgttagcagaatataaataaattggagcacaagatattctggactgcccgcaaactagaccatctctactgaagttcagtatggtaaatgatcctatattctgtactctaagtgtcgtccagtgtgactctctgtgattatggaaatgtctgtgtctatgctgtttaatgtggtagctgctatcctcatgtggcttttgagccttgaaatgtggctagtgtgactggataactgaatttttaatttacatttaattagctacacttgcatagtgactaccatattagca

SEQ ID NO: 136201 - DNA, 1074 bp, Homo sapiens
tacttgggaggctgaggcaggagaatcgcttgaaccagagaggcgaaggttgcggtgagccaagatagcgccactgcactccagcctgggtgacagagctggactccatctcaaaaaaaaaaaaaaaatctatgtagttactatagatacattatccttaaaagtagtttttccatggccgggcgcagtggctcacgcctgtaatcccagcactttgggaggctgaggcgggcggatcacgaggtcgggagagcaagaccatcctggccaacatggtgaaaccccgtctctactaaaatacaaaaaaaagttagccaggcctggtggcgtgcacctgtagtcccagctatttgggaggctgaggcaggggaatcgcttgaacccaggaggcagaggttacagtgagccaagatcacgccactgcgctccagcctagcgacagagcaagactccgtctcaaaaaaaaaaaaatagtttttacacagtctctttaaatgcatctggttcagaaagacatctggccgacagcccttaccagcttcacctagcatcccagtaaaatttctggaagccagaaaaactatgagtagcagataggtcaggcatcctagtgccaaaatttggatagaactcttagctaacaaaatagctcctggtaagataaaatttttttaaaaattggtgtcttctaattaagtaacagaaaacatgtaggaagatattgtgtacttaaccgttgtctgtcccctgactcagacctatggtcttatcctaccatatctatgctcagggggtgctaagctgttgaatggccttggtacttttcctcctagattctagtcacccattcttcccactgctaattttcctttcagagataatgatatctgttatgcgtgtctgtgtgaagagaccaccaaacaggctttgtgtgaggaacaaggctgtttattcacttgggtgcaagtgggttgagtccgaaaagagagtcagtgaagggagataggagaggggcagctttatagggcttgagtaggcagtggaaagttacagttaaaggtggttatttattgt

SEQ ID NO: 136202 - DNA, 1048 bp, Homo sapiens
atgatcagtttgcagatgcttaccctcagcgtatcaagttcgaatctttagaaataaagctaaatgagtataagagagaaatagaagagcaacttcgggcagaaatgtgtcaaaaggtaagctttatcttgttactgtaaacaagagtgatgtttttgtttgtcttctaaagtcttaaccataggtatatgggaaaatatctagaacttttaataacgaatgggatactgtactgttgtgcaaatttttttttatttctggtgacatttgtttatgccttttgagtgaatcctacaaatagagtgaatgagataaaactaacatgaaataaatatatttggacagagcattaatgttaaacctagatgtagagagagaacttgttcctgtttttatagtataatagttggtatttttaattttttgtgatcaatttgcagttgaagttttttaaagataccgagatagcaaaaattaaaatggaagcaaaaaaaaagtatgaaaaggagttaaccatgttccagaatgattttgaaaaagcttgtcaagcaaaatctgaagctctcgttcttcgggaaaagagtacccttgaaagaattcacaagcaccaagaggtggtatttacaaatattttatgggtggctatttcctgcagctattagtaggttggctcgagatccagcaacaggatggtacagttgatggaacaaggccccagaagagcaatagggactggggccaagagtgcaaatagaaggatggtccttgaaaaggatacacaaatttgcttcctctgagactgatggaaaggcgagaactgtggaggtgaacaatcaagttgggattatgagaaacacaccctaaataagctccatctcctcaggcagattagagggttagatcttgggttttaggagcagattggaggtgcagagtagttcctgtgggtaagggaagaacagccctttaaagcagagaggactgatcacctgtattgagggctcagctgtggttgggggagcctggaattgagagaggtcaaaccagg

SEQ ID NO: 136203 - DNA, 1159 bp, Homo sapiens
tgagagggagtccatgttggcaagcaggattggatctactcctttaaatcatattcctttcccaagggcgtgtcttagaccaaactagatttacagcactatttccaacatacatccagaactactgctgtcagatgttgaaagtaggaatgcttccccctagtgtccactctcgcctggggcttctcaataagacctagttgtttaatgctaagggcaccccctctaaaattttgtatagcatttctgggaattgggtttgcttcagctataaaaatgaatgtcagaagcacatatctttgagatgattggattgtgtttagactaataacttcaaccttcaagataggtgactgactagatccctgtttatttatctgatcatctgaaggctttgaagaagattgtcatcctcataagaagcaccatgtctttattccctcacctggactgtccatccccttctctccctgataaaaaccatagtgtctttcaagacccagcttggatgtcacctgggtgatgccgtccctgactcccactgagcgacccatttaggcctcattcctgcatcagtctttatgtacttcagttacaaaatcatcacatcttagtgtgattgtttctcactccctgactaaattgtgaggtctttagagatgaggactatatctgtctacctttttatatccagttcccagtatgctgcttgacatgtcataggtagttagtaaattctttctctgtgaacacacaaatggaaggatggcccattcttttaggagttcatatgagcttgctaactctgagtcagaatgacccgtgaactgaaacattcagacgacaccaccactaaaaaccatggggattcaattcttttggagttttactgctgaatgtacattttgcttaatttttctttctggggaacttgccaaaatttaggtaagggcgccaggtgtggtggctcatgcttgtagtcccagcaccttgggaagccaaggcaggcatatcgcttgagtccagaagttcgacaccagcctgggcagcatggcaaaaccccatctctacaaaaatacaaaaaatcagccggacttggtggcgtgtgcctgtagtgcctgcagctactcggtaggctggggtgggaggaccccttgag

SEQ ID NO: 136204 - DNA, 3174 bp, Homo sapiens
tactttgctttttggaatgtaggaagcagtatattcattcaaatctgttttgctttcattagcttgcttgctaaaaattaatgcttttctatacagattgaaacaaaagaaatttatgctcaaaggcaacttttactaaaagatatggatttgctaagaggaagagaagcagagctgaagcaaagagttgaagcttttgaattgtaagtaatgcatgttcattttggatattcagaatgatgagattaaaaagaattactaaatatatatctaaatattctaatgttcattgccaagtagagttcttatttgtaaaggggatatcacctagaaggtacaaattaagaggaacaaacactagggttttgtttttgaaatattaaacattaagatgaaaagacgaatgagatgctatcatcaggctacagtaagaccagacagattatttggagaagctgttaatactggaacagatcgtatgttttgcagttacattcagtccctcagatctgatagttccgtgtgtgtatgtatagtaactgaattccatatatccaggcctgcagcttttaccagctgtgtgctcagaaaaggaagtatggtggtccaacttgacttgtacttggtgaaaccatttctttgttactcactgtttctaagtgctcacaaatgtttcatccttgagatcttacctgggattgatggcaagttcacctgtctatagtttgtgcaataagccttctcttcctttgggaatctgctattgacacccatagatactccaggaatcttagttcattaaagaatttggctccattaatgtttttttctcacttctataggcttgatttgtttgatttcaactctctgtctaccttactctctttttggcaataatgaaaaggtaaattgatcaagagagaggaaataggcacaaaattggggcagagagagttcatcattcctttacctccattttctctactcttgttccctccttctcagcatataaactaaataaatgtagtttacctctccatggctttccagattaccagcagagggagctaatacctagagcctttacctgttcttagactagtcagcattttgtagcacttctcaggatggctggatctcaccacccatgaacctacctccctggctaaggagttggtgctatggttgatttaaagtctcactatgaagaccattctattcttcagtatttggaagccctgattgatccatctatcttttgccctctcttttggtacttttttcaatattcaatcaatagggttttttgtttgttttgttttgtttttaagacacagtgtctctctgtattgcccaggctggtctcaaacacttgggctcaagcaatcctcctgcctcagccttctgaaaagctgggattataggtgcgggccaccacacttggctaaagctgattggttattaaatgacaaaaacacatattgtaccttgaatatgtatggactaattaattaaatcccacagttagaaacagcattatagaagatttaagcacataagtacacttatttgttactttgtaactaataatatcattatttcatcccaggattgattttggctatttatcacctataaccattgtttgagtgtttattttcagtgagaaaccacttccctcttgagactctcccactcccctcagcccaaagcacagtcaattctgctagtttcaatatgctgtaactaggtcagttcataaaatacactgaggacttctggctctttccttctacttcccagtagtgatatcatgtagcagttttagtctgtggaactagacacatgtgattttttcctaaatttgttagctcagctatggtagtttatttactttttatatttttgttaatttcaggaaccagaagctccaggaagaaaaacataaaagcataactgaggcacttaggagacaggagcagaatataaagagttttgaggagacctatgaccgaaagctcaagaatgaacttctaaagtaattgtttagcatttttaaataactaatatgtttaaattaaattggtagaaacataacaaaaactgacaaagtagtctgtaacttaggcaaactttagtgtttgaaaaaaaaaaaacatagttttatcgatacagtcaatcctttcctgcatttgagttaggatagtttttaaaagataagggccgggtgtggtggctcatgcctataatcccagcactctgggaggctgaggtgggcggatcacctgaggtcaggagtgcaagaccagcctagccaacatggtgaaaccccatctctactaaaaatacaaaaattagctgggtgtggtggtgggcacttgtaatcccagctactggggaggctgaggcaggagaatcacttgaacccgggaggcagacgttgcagtgaactgaagttgtgctactgcactctactagcctgcgtgacagtgacaatccatctcaaaaattaacaacaataaaaaaatacagagaagcacatcctctgcgcttcttatggcttctctaacgtttattgtgggctgtgatttgctttaattttcaggacaccttgtgacttgcttagcttgcatagttgataagctgtaaaattggaattataaccacttttagttatcttttcctctacctcactcatacagtcagaaggatggggttatctgacaatatataaattatactagtggtcatagtatttgtcagtgaacatgtgccttgtattccttcaagattcagcaaagccagaatcaaaagagctaaaattaactatgtgaggcaaaaagtgatatagggaaaggaaaatatggacaactatggtaactttggcttttctgtagtctgagttttgtgtatcagtgaataatatctcagtgctacgacattatgcccatgtggtaacatttctcttcagtgtgtgggaaagcatctggcacataaaaagtgctcagttaatatttgttgtaaatgtgtcacgaggaaatgattcaactcaggtgctctgggcatttcttatttggcctcttttattgcctttctcataatttgtcatcgatattccattacataatattgcaaaggtttcttgaggtaatcctttaaacaaatcctattttt

SEQ ID NO: 136205 - DNA, 1059 bp, Homo sapiens
agttggctctcaggactgtgcttagtccctgagcacaaaagttcttaccttggttgggggtgggcagatggtacaggtggattggaagtgaccgtctgattatcatttgggattgagtctgttgtgtgctgtgtaaatttaatttacccctttgctctttgtgtcagttgagaccaactgaaaagtgattgctttcagtaagtaaccttatgataacacgacgcttcattttgtgtgattgagttttgggacccagtttataggatcaaggaagggttttactgggcattttatgttcaggggttatatccctggctttagtattgaggactttgaagtttacaagttgtcatgtttagcaccctcaggtgctcctgtgccatagataagctcctgcactgataacagtctttccagaaaaatgcctgaggagctcatatttagtcattctgattctcaggtatcaacttgaactgaaggatgactacatcattagaactaatcgactgattgaagatgaaaggaagaataaaggtgatgtttggggggaaaataagctgtatttttcagttctgctgtaggttattagcttcccaagttgggtcttttctatattctaaaaaatacagcttacacttcattgttcatacaaaattacacattttttgtaattttaattttataaattaaaaatcatggtcttcactgccttttgaggaaccttcatgtttaatagtttgtatattcacaaaggccagtgatttatcatggatattttatccaactttatttcatatattttgataaatctgcaattgtcaggaacgtagcagcaacttattgctgtcaagtacgtattactcctaaccatgagagactttatttttcacttacggaaaacttttaacttctctgtcctctgtgacctagtttcttatttcttttgcttctaatatatttttatgctttataatatttttacttgatgtataaccttctgaactcttgtgtacattggcctgagactatggaagttgaataatttttcaatcttcagat

SEQ ID NO: 136206 - DNA, 1006 bp, Homo sapiens
ttaggtctgacatactggccataaatattaaatggcttttgtattcactaggaaaacattatggtgtttaattggtgggctcttttttcagaaaaagctgttcatttgcaagaggagctcatagctattaattcaaaaaaggaggaactcaatcaatctgtaaatcgtgtgaaagaacttgaggtaattgttaagcatgttggtttttgaaatagattttaagcaatatatgaaattttagtcatacataatttatcctaagtcatcctgttgagatgtttggactgccatttatatggctaagaaggtgttagctgaagttaattcaatagttcttaatttcagtcagtgtcacataggaaagtgtagatagagctttgggtcctggagtcctgcccacatcctgtctgtgtctctaactgcttgtgtgtcgctaggtaagttctgtgactgcaggttcctgagctgtaaactaggatgttttccacattatagggttgttgagggaattcagtaagctaacttatgtgcctagttcatagcaggtggccattactattagtttctacatcagcctgttatctccttccatcagcagcaggtaaacaaaattcctgtcattacattgttatcttacagattaaaacaaaatgaggtacatttttcacatatcattgcttctttacttttctgttcattcgtgtgcttgctgtctgaaggatgaagctggaactttaggtacttacaacatattttgtatatgaaatttattttagcaactgtgacttatgtgagaactttgtaggctttttactcaaatatgagatatactaagaaaagggaagcacttcacaacattttacagaatcttttttcctttctttcccttttttttttttttttttttttgagacagagtcttgttctttcgcccaggctggagtgcagtggtgtgatcttggctcactgcaaccaacctccacctcccgggttcaagtgattctca

SEQ ID NO: 136207 - DNA, 2694 bp, Homo sapiens
catgctcagccatttttatcttacctttcatatttaaaaaatatatattgctatgatgtgtgattattgttgggttcttggttgcctctggaaaatgggatgataatcttagaaggacttgcttcatgggatgcggcctataaaagttctgccccaactgtagggcggaagataattttcgttattgtagttagagtcttattgtagagaatcagacttctgtctagtgaccttaattaaattgtgacaccatgcttaaaggagcctgccagcttttacttttgcagtactgtaaagtcattattcaaatgtaaattttcctttttgaattttagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgtatgtatttttcttttcttctgacttgcgtgttttagtaattcgcattaggtcagtattataaaactatgctttgtacttgtataaggtagggggcttacattgggaagatttataaaattaagattcttggattaaactctgcaaacctgcctataggtggtatcaaagcttcccttgccctctgactgctgattgggtttggccagtggggacaccagcctctacatacagtggccctaggctggccactgtgcctcatggccaagtgaggccatagtgcctgcgattacctcttccaagtgctctgcaccaccaccctgtctctagtgctgagaatttctccctcctctgattccccaggcccaaggagcgctaacagtatggccctgttactagcccacccagggaactccaccatcctttgtgcataccctgaataagtcaacctttattaaagggttcttagatgaccttgaccgtgagagccatctgccttctgcctggatcccaactgctgctgtcagatgcccagatcatattggatcccagggctgtcatcaacaggtagaccagatagagagctccttctgtgcacagtagaggagagaaacaggctttcaggttaatttgagaatttgaaagagttcttttacttggagtaggactccaagggtaataaagtttgcattaacatgcactaaattcttttgttgtgaaatttgagagtcaggattgctctgagctcatttaatagaattattatcatatttattgagtcagtacaaagcaaagaacactttaaaacccctttaactgtttttgttaagttaaataagaaaacttaaggttggtaatgactaggattttttttttttttttaccttcttaggcctagctcagccggctcctgaacttgcagtctttcagaaagaactacggaaagccgaaaaggctatagtggttgagcatgaggagttcgaaagctgcaggcaagctctgcacaaacaactgcaagacgaagtgagtattgctcttcttcagttctagtgtgataccagtacacttcatagttacgtaaacttggcacaagtcacactagtgtaaatcagatttattttaacatcaaacattactcccccaaatatgctaaaggtatcctttctcatctgagaaaattctgcagtgataacgtgactttatattcgtaatagtaataaaatggagaagaaagcaaactcacctaaacataaaattttctgagtgcctgatggtgcccactgttatctctcgattctcaccctgataagtattacaaacattcactgtcttctgatttctgcctgcatgccctagagttctttgatatgactgaaaaagatggtgaagaacttgtttgtgtgttctgcttgtgtttttttttaatagggaccctgttgtttactgtcataaagcttcttggaattggcagaacaaaaagagtacaaacatgataagagaacttttccttttgaagcaagctgtgatttgttttacattgatttcttttcctattctgaatcttttcagattgagcattctgcacagctgaaggcccagattctaggttacaaagcttctgtaaagagtttaactactcaggttgccgatttaaaattgcaactgaagcaaactcagacaggttagagacgttttaacccataaatatttttgtatgtataaagcttctggtgtctgtgaaaatgtaatgatcataatttattgaatattaattattgttttaggggaaaagccatagaaatatgtgtcatcttagaagtaaaactccctatccattttggtaataccatctggatcatcagcaaaagtattttgcttcataggtgcctcatggcttgggagagtctcatgccccaataggaaaggcgtggtggtaacatagaagtccccatattcattataggatttccttttttatttgttaccccaatgttaacaccaattcagtagttttacggattccttgatagatatataaatatacaggacaagcagggtggtttagcaaaaagaatattgccttcagaatcagaactgttcttcttttggacccgttttgaagttgtttgaccttgggcatgttactttaacttccttgggcctcagtct

SEQ ID NO: 136208 - DNA, 1024 bp, Homo sapiens
tatccaactgcatgggtggagggtagttcccctgattctgaccttgagtttgtagccaatactaaggcaagggtcaaagagcttcagcaagaggccgaacgcttggaaaaggctttcagaagttaccatcggagagtcattaaaaactctgccaaaagcccactagcagcaaagagcccaccatctctgcacttgctggaagccttcaaaaacattacttccagttccccggaaagacatatttttggagaggacagagttgtctctgagcagcctcaagtgggcacacttgaagaaaggaatgacgtcgtggaagcactgacaggcagtgcagcctcgaggctccgcgggggcacttcctccagacgcctctcttccacaccccttccaaaagcaaaaagaagcctcgaaagtgaaatgtatctggaaggtaagccacccgcacaaagggttgcggggtgctctggagttgggtagccaccctgcccacgacacagggttgccgtgagggtcagcgggccagagtggcaaggtctagtgtttggcacacagagctgtttagagagtgatagttgccttgcctttgctgcctgttggtttcctgcattttattattgccactgcaatttaatttaggtgcttgaatcattagttttctggatcttatgcatcataattggctatttgtgaggataacagtttattttcaaactagtagagctctttagaaaccacgttggtatcttctccgtgcaattggtaatattcttgccttggttctttctgcaccttaggtctgggcagatcacacattgcttcccccagtccttgtcctgacagaatgcccctaccatcacccactgagtctaggcacagcctctccatccctcctgtctccagccctccggagcagaaagtggggtaagtataacgttctgattgattagcttcagctgaataatgttacttgctctgtcagccttcacttgttttactgggattttttttttttgagataattatt

SEQ ID NO: 136209 - DNA, 1271 bp, Homo sapiens
tgcctgggacgaagctagtgctgtggggtttccacatgcggatggcaaggaactatcagaaatgtggacgcgaggctagggagagagaccaggagtagaggaaaagatagggaaaggatccatatacaagtgatggctaaaaccccaggaagggctgccgtcagtttggaggaagtggggaatgaacagtgagatggctggaatggcggggggagggcagtggtgtgatttctgttctgttttgttggggtaggacagacttgagcatctttatgggagtaagacttctaaaactactgtgtacagaaatagggattaatggctcagtctgggtcctaaagataggggagggattataatcaaaggcagaggcagaaatgcagggtttgccttggaaaggagggaggagatctgtgaagaggatgagaacatgtgacatggaaggaggacagttggagttggttatggtgagggtgacgtatttgtctcagtcaagtgaagtagggtacagttcaaggagtggggtcgggagcttgaagtcggtgaaaatgaaatagtgacttgaagcaggtcacagagtcaactaaaagccaagcagagtctccgtgggtcttggcaagggctcctgcagactggtcctgcattcatttgaataatctgatactggaagctactctttattttctgtcctattaggtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaagggtaataagtatgacttgattctctgaactggttgctccattgtacacctttcgtaagtacattgagctcagggaggggagtcaattggtgtacaaagtcagaggtgcggcagatgccttaaaaggcatccctgtcctctccttgtcttaaaagcagtgggaaaggctgcacagaatgtgaagcttaggagttttgtagtaaaggatagtttttgaaggtaatttttgtacattctcatctgatccttaaaacaagcctgtaaaaaaggtagactgtgctttgctgcagaactttgctttgaaaacagggtttaaagaagagactgtcagtgccagctagctgggactagaacccaagggaggagtggctgccagttcacagttgcttccaggggcacacactccctccctccttcct

SEQ ID NO: 136210 - DNA, 1767 bp, Homo sapiens
ctgtgggtgggggacatccagggcttccgtggcttaacttcttgggacgggaatccgtcttctccattgaagacaaaaaggtgaaaagtatagaaaatccaaagttcaaatggaaccttgagtcttttaaatatactattcttttgacaaaaattcatagcttttttgcttaaggtaaaagatttaagagattttaatttgtaaaagttggggtggctcattaagaaagaaaagatctatcaaatgcattaatactgacattaatattttatgtaagtctgaagtattatgggtgttaaatgcataccctatagtttattttgatgtgcttgctaaatttcatgtttaaaagtcacctcttttttagacttttaaattacatatatatttcaaaaatggttcttaaagtatttcatgaaattaatgcatatctaatttcaaaattttccaccctctccatgtaatcagagctcaaaaaagatggtccaagaaggctccctagtggacacgctgcaatctagtgacaaagtcgaaaggtacctgttttccctacacactttcatacacaaactgttaattgcttattttgtcagccaagagaaacagatgtttgagattgcctgtaagaagttattgaatcagtcaaaattagtgactataaaaacaattgagttttttgacttgtgaaattgatcctgatataaattgtaaactagggcagaaaccccccagggaaggaattgagaacattatgaagatagcaaataaacttgacacaaatttttacattttaatttttatctttccctaatttagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtcatagtatttctcattcattataataaaagtaactggcttttaacctccttatttttgtcttaaatttataaatgagtataacctatcttactgctcaactgcaggcctacattttggaagtataagctgtgttctttcctctccaaagttgggctgccacctgtaaaacaggaggtcatttttcctagcacactcctgttttgtccctgaacataaaaacagatttttctaggcattagaaatagtaagaaagatactgcctctggtctttacttctgatgtctgtggtttgtatgtatgtgtccctccaaaattcatatgttggaatttaaacccccccgtgtgatagaattaagaggtggcaccttttgcaggtgactaagagtgggattagtgaccttataaaagggctcaatggaactagctaggcccttttgcccttgcaccatttgaagacactgcattgatcccctctggagaacacagcaacaaggcaccatcttggaagccgagaccgggccttcaccagacatcgaacctgccagtgccttccttgatcttcgacttcccagcctctaaaactgtaagaaatacatttctggtctttgtaagttacccagtctaaggtattttgctatagcagcaggaacagactgagatagcatctttattatggaacctttggtcctcatacttaatgaatggg

SEQ ID NO: 136211 - DNA, 1021 bp, Homo sapiens
ttaagaaaaagcaaaaatgaaatacgagagggtgcttttttttttttttttaataccattttgagagtaattttaaagactaatgcgaaagttcgggagcacattgtatatttgaaataagtgtagtgtgtgcaaagaccattttctacctgtggataaaaatcaattcccccaaaggcctaaaagcatgaacaatgtttattttgagtaaataattaaactacatatttaacatggaaaaaattaaatgaatgtcaaaaccaaaattaagaactataagcaaagcatgcagtctctgttaacaaaacttagttgtgaaactacatttttcattttgtaaatgccattatttcatttcataaaatgtaaaaatcctcagtatcattctttacacttgatgcggcaaacacttctttcctattttcctcgtatttcctgcaaaataaatctacatctcaagttccttatagttcatactttcttctcaacatatttgagaccttcaggtccaggcctattttctcttcccgttaaaatcttacatgcagcttgagaactagctatgaggaaacagttagttattacttaccaaaacacacaatttaaggttaccaattttgtgggctctaacagaatgattgtgttgtaccaaaaaaaaaactacccacatataaatccttttttttttttttttttttttttttccagagaactgggtgacctttttcttcaaattttcatctggcttatttgagggtcatttggtagtgaaccatgtgatcataaaaaaattgttttcaatttagaacatatttgcaaagtattttccaggtgtgacaaaacaaaatccagattaaaacggttctcttccatttcatcttcagcacttgttttcattttcatcattgaaactggttatcaggcaatcaaaaataacagaaaatgtaagtattccaaagtgttaataattcatttaaagatactgctctctaatgtttaagtatgagaacattattttaaa

SEQ ID NO: 136212 - DNA, 1113 bp, Homo sapiens
agttaagagtgacccgaaaggccctgacattgcttcgggcactccaattctagatcctctagctctggggaatgtggctggctcttacttcccctgctcccgtgctggcttttccttcttgctaccaatgccggggcgagggtccccacaatgtgttccacaggtcagtattgggcctgaaaatgcacaatccttccacttaggggacacacatctacctgtttcagtgatgattgtccttcctcttgttttggcctagttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtacttccttctaattcacccctcccccagttatttcattatcctctcgtgcatatgtctggacctaattattacatgcgcatccttttaattgtcatgatctgtttcatcccttctattagagtaattttatacttttcccttcaatatgctattttctgggtggaaacttcagggaggcttttagcttgctaggtatcaaaatttcgttatattttcatgttaagtgtgtagtgaaagaagcttttcttaatatgaaactactttataatgcagttcaatcaaaaaagacttctggatctccgctacaaaaagattgtattttttctttattttcagttttataacatccaactttccattcaaaataatattgcacacattgtataattcaattaatttgcacatccaactcctcaaatctggtctttttaaaatgaccaactgcttaaacttcatctgtattgaaaaatacaacattagatccagccatattttaaagtcatcagaacatactctataaatcattatcagctgttagaaaccagttcaaacattttctaatgagtgagatccttacaatggggatctaaggttggttcattgtgacaaaccccagaagagaccactggctcctcctgtcagttaatttgggacttgacttcgctgctgagtaagagag

SEQ ID NO: 136213 - DNA, 1049 bp, Homo sapiens
ggaactgccatccagggaggcttgcatttataactgagagacagcggggtgagttagaatgctaagaagggggaaatgggctgggcgtggtcacacctgtaatgccagctatttgggaggctgagacaggcagatggcttgagcccaggagtttgaggctgcagtgatccatgatcgcaccactgcaccccagcctgggtgataaagtgagacctggactctaaaagaaaaaaaaaaaaaaaaaaaaaaaggaagtcggtagttcaccaaggaggctttctaaaggagatggactttagcccgtgcctttcaggaggggacttggagctggggagatggggagacagtgcgattgggattttggcagatgatataaggcaaatcctcagcagagcaccccgggttccaccagctttgtggttgagttgcagactctttgagtgagagaataacccagccccggtggtttctgctgaaccgagaaggaactgctccagaaacatgacagggattccaataacggcggttaaacagctaacaaagaggagtctggaaggctggcccttgttcatgttggctggaacatgctgggtagatgagttaattgggggccctcacagggaatgctcattgtgccactcttaatgagagaatccaagtgccccatgggatgtaataattaggaagcatgttgtcagtagatcagctgtctgtctcctgatgtatgccttgtgtacacaggaagaaatagaagctttcctttaaaaaaaaaacaaaaaaacaaaaaacagggtctcactctgtcacccaggctggagtgcagtagtgtgatcatagctcactgcagcctccaactcctgggctcatgcgatcttctcacatcggccttctgagtaactggaactataggtgtgccccgctacacttggctatcttgtatgtatgtatgtatgtatgtgtgtatgtatgtatgtattttaatagaggcagggtctttctatgttgcccaggctggtcttgaactcctaggctcaagcaatcctctgcct

SEQ ID NO: 136214 - DNA, 1034 bp, Homo sapiens
gctctgacactctgaatgtcactggccttgtcttaggggccttagaaaccaatgagtgataattaaggaactggagcttgtatgaagaaggtgccactttaagtgtccctgatggttttgagttgccactaaagagctcagagccctttcaaagaattcagtctgagccagatgaatcttaatttctcaccctcaaattgagatgcagtcctttggagaattaatatttagtggcatggaacacaaatcatttcttttgctggactcttaaagatgtactagattgattttgtttttatgacctttcaaaaacatcgcagtctgttttgctagctccagcctgttgaagttttagaactcatctttagcaacatcaaaggtgacagggacagcctttgagaaaggtacgcatgaagtgattgctggcatcccatagtcaagtctcaggataaagcatccatattgcctttttttttttttcttttttttcctttttactagtggagataggaaacctataaataagcatggcagaggtgtcccctctgaagattgccccttactaagtatttacagtaactggatttctttattttgtcagtttctccaggaagaaaggtgatgtcatgctccatagcaagatgagagaaggagtttagggtttgtaatttttttttaatcaaagaatttaattgcaatttaatgacgagagagaggatgtttattacacggtggtccaataaatactttctaataagtttttaagccatttgagggaaggcttgctacaacaaaattgacaatcaggcaagccgctttgaaggaagcaaatccatgaattttcagacactgttgctaagcgcagctttgctttcccctctgcttccccccccccccccccccaccaacttgctttgaaaaagcaaagcttaaaagcctctattgtgtggagggggggaatatgctaatttgcagcacatttcccatcagactctttttttggcctgtcatagctgagatatgaatgatgataa

SEQ ID NO: 136215 - DNA, 1047 bp, Homo sapiens
ctattgaaataaaaaataaaatattaaaatgaatttttgtgttaatggtctcatattcaggtgggaaaaatcttcttacagttgccaaaaatggttacctggtagtatgaaaagggtaagagttgataatcctcgagaataaggataccttcctacagtgttttcagcatagcttattttgtgtgattctttgagagcaaaaaaaaaaaaaaaaaccccacgttttgggattgtagtgactgctttgccttgattgggctcctcatgggagccatttcttatactgaatctttcaccataccaaagagtgttataaccttcatgtacattttaaatgacagtcatattttacccttcccaacagggtttatgtaacatctttgtgcagtatgcttaaaatccacaaaactaaaatatctcaaaggagaaaagagaggttagtgatgaataaaaattgtagtgaagattgtcttgttttttccttctaaaattccttcctgtgtaaaagccgcctggccaactgatagtttttctttcaactcactgtgaaatatttttcttagcttgcatgttagcaccaagtgatgtatccattgtcactactgtgtgatatcagttgctgaggtgataaaacatggatttcttttttaacctggtactggaatggaggatggggaagaaaagagagtcaagaaaaggaatgatgcaactgacaggcatacattagtgaggtgccctattcatttatttcagtagctgtacatccttactttccagcactattgaatactctgtgggtggtaggatcgtgtgggggaaagagcatagttataatagctgacatttattgaacatttgctattctaagcacattatttatattaactcatctaatccctatgacaactatatggattagctgggttcaaatccggactcctccacttcctagctgtataaacttgtgcaacttcacttttttttttagatgaacaaaaactatccatctcttagggtagatgttagcattaattgagatggtagttc

SEQ ID NO: 136216 - DNA, 1035 bp, Homo sapiens
tcctacttctcttaatgtcccccatgtgagcagtcaaaccattcaacctccgttttaaatgaggctcatacacaaaatgaggctcagaggatgactgctactcagcctgtgatcactttggtgataattgccaccaaagatgttacagttacgaacaagtgtggtattgaggaaagcatcaactactttttctgaaatcgttattttaatttaacgctaggcgtttggatttgtacgtggaattatcacacggggaccttctccagaacagctttcacaatactttggactgatttaggggtagggtgggcttcatttttaaacaggtgtggagttgggtgcagttctcatgaagcaaaggcccgagccagagacctgttcttaaggaagtactttgtgttttggacaattgttggctccacatttcaattgccaatttatgttaatttgtgcatacttcactggttctggcagtatccttggttttggttttagtttttacattaaaaagaaagttcccttcatgtaaaaaaggaaacatactgatttcctttggtagactcttagtaaatacaccacagggccatgaactggttttatttttccagatgtatttaattaccgtgcatcctcttatgaatgttttaattgaaatgatttaacgttgggaaaattctgaccattggcccattaagtcgggactttggttcttaatacaattagttccttaaccaggatcagttaatttactggtaaaatagatgaggtttgtagaaataaaagtcccttcagactcaaattttaaggtatttgcaatctttaacctaaaaataaaataatgagtagtggtgatatgtgtaatttcacttttcattacatcttgaaagaaaacatgggtttttcattgttaagccagtttttttatagccttaagatgtaattcacatatcatacaattcacacgtttaagtatacaagtcagtggtcttcagtatattcagatttgtgcagccatcactactatctaatgttaga

SEQ ID NO: 136217 - DNA, 1012 bp, Homo sapiens
agtttatggcccagtatttagtgagctgtcttgctttagtcaatgaggttgaaggatgaaattgcagtgattgagcacaatcctgacatgcgtgtgtgtttcatctggtgcagatattcacaggtgcacaaaaccgatcagtgagatgatacgtgttaatggctgtagaaaagtggaaaggaacatgaaaatgcacttctgttgtaaaagtaaaaatggcggttgtccagtaacttcaggattacatttgtcatggggcaagggatgtgcgacgaagagagaagaccagtctgaaatggctccagttctgctggcatgtacctgtgttctgggtggttgctgacaagccagaaatgaggcattcatggcatacatcaagtttgtgctttccctcggttgtgctacaattattcattttggcaaaatagcagaaaatataatcagaaagatgtactagtcctaggaaagtgaggggaaaaaacattctttgccacttgctgcctccatgctttatcctctaacatgttctgcctttgggctctatgtgtggaataatcttggatgaaagttttcctgctatataagattctctgaagtcctggtaactttccatgattttttttttcctttatggactattacgtgatgtgacattggtcacatcatgtagacaaatagattgatgtgaaaaataccaggattatgtatcctgaacccagatggaatccagtaaagcttttccttaataatacatgcctattgttcttgttttaacctatatgcatattaacccttgtattagcctcccagggctgctgtaacaaattacacaacctgggtggattaaaaaaaaaaaaaaaacagatttattctctcacagttctcaaatcaagcggtcaacaggaccacacgccctctgaaggctgtagggcctcacctcttccaacttctggtgtttcctggtgttccttggcttgtggcagcatcattccatctctgcctccatcttcat

SEQ ID NO: 136218 - DNA, 1002 bp, Homo sapiens
caagccagatgagcttgccagcctcagcaaccagccagggatgggggcagggctgcccaagtaggtggggcaggaagcccagccctcaacaaaaccctattatattctttgtcttagtgaggaagttcttactgttgtgtgtattattggaagacatcttctgtgatagggttattattgcatgtacagagagattccttggaaccgcatatgactcaatctatctcactcagatttctcaccataccttcacttattttgctgcagtgtccagcagatctccttgaaacagtgtgtactgaagacctaactaaatcctccaaattacctggttggttcagagaaccaaatcactggagctttgtagggaaggtttgactttcagggctttagccagagtaacttatttaatgattggcttttaatgtgtttctgtgcaaagatcaaagcaggtgaattttcatgtatttttagaattctagtagaaaaggaagataggaaaatctagttcaagtatacattctagtttttaggggaatttgtgtttttattttacttttttggttgctacgatttgtcctatattctatatttataagaacataaatatgtaattaaaagaatatatttgatggcactacctgtcaacaaagccacttatttgtgaaattttttggtaacttgatggaaatagtcacattttatccattgaaaactacaaagctcttatctattgttctttgtgtatatttatgcattaaaaatagatcctgcaggatgagcagatgtactgaagtgtaaatccgttttttaagagaggctatatggaaaaatatatcattcaagactcagtctctgccttgcctataggcctcgtcagtgtttagtgaatgacctcaaccctgtttttttccttccttctttggtggttgaggacagacaatgaatggtctctgtactcgcctgggctcagctgggtggtggccattatgccattgtgct

SEQ ID NO: 136219 - DNA, 1052 bp, Homo sapiens
ccactcggggtagccgattagcaggcagcttccggcctccagcactgcaccgcctgcggtgcgaacgtgacgtccgcgacacagggggggacttccggcgcgccgcgccacgccacgtgttccgcaccggaagcgcgcttccagtcgccccggcaacagccgcctccctcgcgtcccccactccccctctgtctctccaaggaaaactaggcccctgcgcggccaacgcccaggatccgcaagctgcgcgcccacgaggtgacttcggggacggctgggtttcctttggggagtgagggaggagcttagacgccccgggccctggcttcttctgatgcgcagagagccgaggtcttggacgtcacgttgctctcataattatcttaatcccgcgacaaaaggtggggccggaggcccatgagattcctaaatcattgcaggttaattgtgagaggggaccagtcccagaggctctcagctctgcagtgcttccgaatcactggacgactctttaagaattctgatccccgggcccccatcccggaccaatgaaatcagaatctctaatagtggggccctggcatcggtagtttttaaagctgcccaggtgattctggggtgccgagaaccaccgtgttaaggtctgtaggtgaattcggattttgcccatccagtccagtatctgaatagaagatcgcccaggacagccacatacttgaaggatgtctaggatattgccctctctgctcaaaaattcgggtttctttcttttctcttgcactttaacctctgcaggaggtcagcttttggtgggagttatcttgagacatctggcgcctacagtttatgggccttgtgtctctgcccacttatcagtaatgagctgtaattgaaccagtggccaacgaagtgcattttagctctgaaatcttgatgttcccttagtacagatcagatggttctgaacaattttatttttttcaggaatgatgtttttaaactcgtttgacaggctaggctgtgtattcagctgttcttcatctcaaatcaga

SEQ ID NO: 136220 - DNA, 1070 bp, Homo sapiens
tctaccccaaggggcatttggctatgtctggagatatttttttttggttgtcagaagttgtggggtcaggaaggggtgaggcaggggtgctatgggcatctagtggatagaggagaccagagatgctgctaaacatcctactatgcacaagacagccccctacaacaaagaattatccagcccaaaatgtcagtaatgcagaggttgagaaatcccgtcttagagttacttaagtgaagaccgaaatggcataatagtattttggtctaaatcttttaaaaacttcatttttttcttgctttctgcttagtaaaacctagcatgtaaaaatcaacttcaaatagataaattaagcaaggttgtcaggatccacaagtttctgtaaatatcagtatttctcctacagaaatttaaatggcagattgtctgggcgagaccattaaaatgaaaggttttgaaacccttgtcaatttgaatgttgttacaaagctgccctgaaattatgtaagtctataagaatgtgaaaattgtaaggcatttttcagaaaagcatctctctttcaaaaggctaagtataccttacaggccactgtttaaagaaaaaaaatgaaaacgcttttaagctatctgaaattccaactctaggcaaaattaaaatttaaaattctaactaaagtaacataaagaatatggcactccttagggactgagaaatttaaaaataaatgaaaattcacttcagttaagaagtgatttataaggggtccagtgagatacatttcaaagggataaaaattcaagctagtcttttctttgaaaaataagaatgctggattaataagagaacgtcaggagaaagaaaaagacgcaaaaggatatgggccaaaataaatattcctgatcctttttgctctaaaatccttaagtgagatgcaggtttccatctcagttgagagaaataaagatgattatagaatgtggcatctcgtgcttgtggctgtgaagtgctaattctctcatgccttagaaatgcttatacctaatgatcttgtgatgcacatggtttttag

SEQ ID NO: 136221 - DNA, 1031 bp, Homo sapiens
tcctttgtaatctgtaggtatcctttttctgtcttttttttttttcatgcaaagtatattttatagaagccaggcagtttaccctgtgaagttctatagactggattttgctgattacttcctgtgatattgcttaacatgtttctctgtctcctgtatttcctctaaattgatggttagatctagagactgggtcagaataatgcctgaatttttgttaacagaatacttaatagtattgttttcttccactgggaggtatgtaaagtgtgatcagtttcattttgtgatattagcagctattgatgctcattacttagttccattgtttcattagattttataacatggtggtattctaattctattactgcttctttatttattagctggaatacttctataaagagaaacctcttctcatcaattatttagttagaccctcaagtatagtttgtaatttagaaatcagaatttgagtgcaagaggtgcttatttatcctcagtgggttgttgtttctgggcctttttagtaagcagaggtaggaaatatgtgttttgttagtttggtctgttgtggttttggtaagtccatgctgatacgtccaattcagattaaggacttcaggtttttacttatcaccatgatgtaaaaacttcaaggtttttacttaacatcatgatgtatcttctttctgtatcttctgtctccgctattgataatcccaattctctgttgcacctactacataattactctacagtatatatgtagtgttcataaaacagcattcccaacaaaacaatagttcaattagtgcaaattaagatttttgagttctttttaaatctttagtgtaactcattagacatatggtcaaattcctgtattaaaggagttttcagtattaaatttctacattcaagttctttctttggtcatgtcaccattcttacctgttttacttgataaactttgacaatgctggaatgtgctacagtaagcctgtatatatttgtaaattattata

SEQ ID NO: 136222 - DNA, 1033 bp, Homo sapiens
gtgtgggttaaatgaattgatacacaaatggcatttggaacagtgcctggcataaagtaaacactcaatagatgttgtatattattattatcgttactattattcttattactactctttcgaatgttatatatccacatgtgtgtggaaatgaatatggcttggactttaagaataaaattttagcaataagctataagtagtctaaagatagtttaatcagttttattcatacaaaagtttacagttataggcttagtgcaagtcactgataaaatacagactggattattttcagtataactggggtacatattatcagacttttttttttcaaaatggactccaggtttacctcccttttggctctttgttggataccccatcttgccataccccagtcatgccatgcctcttgatctgaatagatagggaattttatatattttatacatttcattttagtaaattgtgtataatctataatatgatatgttatttgtttttaaatgtttgggccataagccctagccaaaagcacacttaacttttttttttttttagttttgctacagacggtacgtattttataatcagttatttaaacttttttttttagaaggaatgtcttgttcctctttgtggtgaagaagaaaattctgtccatatcttagatgaaaagttatcagacaattttcaagattcagaacagctagtagagaagatatggtatcgtgtaatagatgatagcttggttgttggagtgaaaactacatcttctttgaagctgtaagtaaattccaacatgataacactgtcttgatgctccagaacagtactgtccaatagaaattaatgtaagccacgtgcaattttaaatgttctagaggccatatttaaaaatgtaaatagaagcaagggaaattattattactgttttttttgagacagagtctcactctgttgcccaggatggagtgcagtgggatgatctcggctcactgcaacctccacctcctgggatcaagcaatt

SEQ ID NO: 136223 - DNA, 1028 bp, Homo sapiens
cgatactagctgtattcccctccacacccacatcagggtttaaggttttaagctcatcttgactctattataggttattttccattaagagctcttaaggtgtctactagtactgtctggttacctgacagtactgcagctgtcaggtatgcaacagaatgcaactgaattccttgggtaatttgtctgatcataaatacatatacactaagacttaatgggaatgaaggtcatccttaaattagctgtgcgagagaaggaatcttcactagagtttgactcatgataaatgttagaatttccaaaggttagtcatgaaaagtgttagaacttataaatagattacaataaaattttgatatagaaatcaagaatgtgacagtccctggacaaacctgaataaaatattaaatctaagtaccttgctatttataaagtttttataactcttatatttcctcatcccctaatatctttattttattttagtttttactattttcattactcatttataagattgagttttacaaatgacaactacatgaaacaaaaggacttaatttatttatttcacattcgattttttcttgtctactcctcctataatgctccctttcttttaggttgctgctaaatgggaaaaacttagcttagtactgatagatgactttattggaagtggaactgaacaagtactcctactttttaaggactccttgaactcagactgcctgacttcatttaaaataacggatcttggaaaaataaactattcggtaagttctatttacttattatatggtattttaagaaccattttagaaaatttaagtgctcaaaagctttgacctatcatttaaatattggtggttttatacttaaaattttgaactttaaaaatatatagattgaatcttttaaatatatacattgaatctcctttcaacaaatgttatacaaattgaccatgcttttgatataaatttgaattgtagtacatttggtggtcacttaagtgacagcag

SEQ ID NO: 136224 - DNA, 1050 bp, Homo sapiens
attcttagcaaacttttttaaagcgtctacagaaataatatttagaattttttttataagtatgatattgtcaaaatagtataaaaagcttaaaatgtttacttaataaaatgtgtagttacctatgttgtagttctctaacagaaacgtgttttcttttcaacccttcctacttcatggcagtttttcctcatttcttttttaggtttagaaacatcaactggaatcaatttgcatttgaaaattagatcagcacaaagacttgatattgtggaatgactagcaaacaagcaatgtcatctaacgaacaagaaaggctcttgtgttataatggggaagtccttgttttccagttgtctaaaggaaattttgcagataaagagcctacaaaaacacccatattacatgtcagaagaatggtatttgacagaggaacaaaagtatttgttcagaagtccactggattttttaccataaaggaagaaaactctcatttaaaaatcatgtgttgcaactgtgtgtcagatttcagaactggaattaacctcccttacattgtgatagaaaaaaataaaaagaataatgtttttgaatattttttactaatccttcacagtactaataaatttgaaatgcgtttgagttttaaactaggctatgagatgaaggatggcctaagggtccttaatggccctttaattttatggaggcatgtcaaagcattcttctttatctcttctcaaactggcaaagttgttagtgtgtcaggtaacttttcctctattcagtgggcaggggagattgaaaatttaggtatggttttattgggactaaaggaatgttgtttatctgaggaagaatgtactcaagagccttcaaaatcagattatgcaatttggaataccaaattttgtgtatattctcttgaaagtcaagaagtattaagtgatatatacattattcctcctgcttacagcagtgtggtgacttatgtacatatttgtgcaactgagatcatcaaaaaccagttaagaatatctctcattgccc

SEQ ID NO: 136225 - DNA, 1064 bp, Homo sapiens
ttatttatgcccaagggaggaagcagaatacaggcagaaattaggcaataaacaagatcttaaaggtcatcttggggcaacctcctcatttttaaaatgaagaaagtgaggtctagagagattaagagatttgctcaaaatccctgatgttattggctaggccaggactagtgctcatgtcttctgattttcactacagtaatcttttggcaataccatgatgtcaagttagatcatgtcactctccagcttgaaacccttcagtgcctttccaactgcgtttagaataaaatcccaattctttatggtggcctgtaattcaaggccatgtgtgatctggctcttgccagcccccacccgccatcctcatctgttactactctgcttgcttagtgcagatttgaccaccgttcaaagtaagatacgtgttatatgttgcaacccaggacaaacgtgcacactcacataactgaagcaaaatttcattaaagaatacttctgaaaacatgtgactctcgatgtatttttttctatttgacttccttttaaaaaatgaaattacccacaaacttaacatcacaatttaaaatgtgacccccagttgaaaaaccacgactagccacactgccttgtgttcctcaaacagaatggggctgtttcaatttcggacttttccacttctctttgcctgggaagattttacccaggtattgcgcatggcttggtccttttttctcttcagtgtttaaatgtatccgagaggccttcactgattattaaatgtctccgtcttgtttattttctctgctttacagcccttatcgtaatctgtaattatcttgttcattggtttgtgtgtttttcatttcctccagtagagtgtacatgggttccgtagcagcctatagacattgagagtagaggccttgtgtgtcttactcacctttgtatgcccagcacagttctcaatatatacttactgaatgaatatagcaatacttaaatatatacataagaagattggtccaattttaaagatttgcatggaaaaagaaaatagaagc

SEQ ID NO: 136226 - DNA, 1802 bp, Homo sapiens
agtcaggaaaaagacaatgatttctgctattatttcaataactctacattatataggataacttagttatgaacgtggcaggaaaatatgaggtataaagtttgccaatcttgtcataggcttatgataacaacacaaaatcctctaaactgcctaatctagcaaagaaatgtaaggcttttatgggaagattaagggtaacttcagctttatctatgacattctagtccttttattaaaaaaaaaactgaagcgaataacttaatatttgttaattttgggttacagctacataaatatttgttaacattattttctattctataattttttaacttttcaaaagggaaggaaataaaacagtttattagtgaagttctgggtcctcaatgaactcaagatctactaggggatagacttgtacatggctaatcattcagtaacaaagatttagcatgtacttactgtgtattgggcagagttggagggagcagggtgtgacttttcaaagtccctgacttcatggagcttattagaggagacagcatcagtccgactcctctcatgccatcccctatttgaggagctcctctcaaaatgactgactcttactattatcctattagttttgatgaaattgggtttacattctcccatttgaccaaaatgagccaagggaatgattgtagatagtgtgcttatgcgaagaccttgaggcagagtctgtaatatacaggaatagaccaaggtccattatatctaattaacctggataactggctggtgactgatgaggacctggagaacagttttgaaagtttagctttgtttgttcaagtgtactaaggaatccagctcttgaaggataagaactgaagcagaaagcacctcccctttttagagtagaccagagatcagcaaagtcttgtttttgtatgacccttgagccgagccttttaaagggttgttacatacacacacatacacacacacacacacacatgcacgcacacacacgagagagagagagagagagagagagaaatcagcaacagagaatataataagaatataatatggccctcagagtcttagatatttgccatctgggcctatacagaataagtttgccagctcctgcagtagaacaacagttctcaaagtgtggtccctgaccagcagcatcagcagtatgtaggaactggttacaaataccaattgtcagatcccacccagaattagacagtctaggggtggggcccagtaatttcagttttaataagccttcctaatcattctgatatgtgctgaagttgaagaatcactgctataaaccaatggcttaatcccattataaaagattacctgtctctcagtctcaccagtttcacaagaaagtggagattcagaataggttgtggccaactagcagagaataatcttgaaggaatattttgttcttttgtcttgatcacacccattactgacatttatgcagtccagctaatagaaatagtccatccaatacgaatgctctcttaatgccccagaaggactttcagtggatctatgctcagagtcatggagaaataagagatcctaagatgttttaaactactataatgatctagagttatatgtttgctgctttggaatattaactgttctctagttttcgttattagaatactttatattttttcaacctttatctgaaatttaggcacatttgtaacaacaatgtacttccaagattttccttactggtaaactaataggtaaatttaaatttagtcttcttt

SEQ ID NO: 136227 - DNA, 1067 bp, Homo sapiens
tctacttttctcctgcctctctcccccaacccccatgtgcctagctgtcaaatctttgtcttctcttttctttcccctactctgatttcatttctatttgtctaggggtaaatggtcaacaactagcatgttatatgtaagaacattaataaaaatcattttaatataaatggggctttctaatttcaaagatcaacattgctgaaagctatcaaagagccgtgggctttaaatttcttagtaatggacattcatttgtttatggtattccctagtgatggtactagcagtggtggtaaaaatgacaacaacaacaatagtgttttattcttcttaatatggctaatatttactgagtttttaccacttgccatatattgttctaagtaattggtttttagaatatatctggggatcctaggagatgcccaagactttcagaaagctatgaggtcaaaactattttcataataatgctaagatatcatttgcctttttcactttctttacatttgcactgattacacagaagcaatgatgtgtaatcagtactggctgcttcgcccaaatcaaggcaggtagtcattgtagtcctcattgtcagcactcttagtttaaaaaaaaaaagacaattttattttagaaagtccctgatgaaacagtaaattgtattaagttttgacccttgagtacatgtcctttcaatgttctgtgtgacaaaatcgggaagtgtgcataaaacacttctgcatgctaagtatgtttgagttgccagctgaattagtcacctgtttcataggccaccctttttacttgaaaaaaattgtaaaaaatgtgttttgaatactgatgaattttcaaatagcagagctaaacaacaatctctaagattacctaccacagaaccactcattttatagattagaaaaatacaacccagctattaaaagccatatccaaagcagcactcttacaaatgcatgatttatggcctcttcttatattttatagtgctttaaatttccactaaatttagtgctttaaatatataaaattagtgctttaaa

SEQ ID NO: 136228 - DNA, 1050 bp, Homo sapiens
aggaaagcaggcatcacatggtgagagagaaaaggcaagagagaaaggaggaggtgccaggctcttttcaacaatcagttcgtgcgggaactaagagcaagaattcagtcgttgtcatgagaatgataccaaactactcttgaggagtcctccccatgacccaaacacctcccaccagaccccacctccaacactgggcatcagatttcaacaagagacttgggggaaccaagcaaaccatatccaaacaatagcaccatcaatcttttaaatggcgcttttatctgaactacatccctgagtctatcctcaaatagcttaactttgtcttggaagtctttcttctcctttgccattagtggttatttttcactgcagaattaatctgacttggatgtttattactgttttttccctagataagtcagataaatatgatgcacgtgatgttgaaaggctacaacaagatgataactgggttgaaagttacttatcttggagacataatattgtagatgaaacactgaagatgctcgatgagagttttcagtggaggaaagaaatttctgtcaatggtaagctgttcaatttaaccttgactgtaatatatactgtataaatggtattgttttacatttatctaatcatgtatttgcacatattcctagcagtcatcataaacaccagaatataattatttataaagacccagtaatattttcaaaggaacagcttataagtcttttaagtgggatcattcataaggaaatcagatcaccagagagcagaatcacactcagattcttcattcacagcagagtttcctaatctgtgtttaattcagtaccattaagcaatagcaagacagtatctttgctactaggcctagaaataaggagatactgtccatttttctcagttgttgcctatgcctttctctgtccccacagttccttgtgctaataggttaataggtacgccatatagaattgttaaatgaatgagagtcaccccaaaaatgcaagcttatccccaaggaagcctatcaca

SEQ ID NO: 136229 - DNA, 1050 bp, Homo sapiens
aacaaacttaatattagattggtgcaaaagtaattgcagcatttgccattatgtttaactgcaaataccacagttacttttgcatgaacctaatagaaaaataccattttactaaagaaaccaaagtgatttttttctactaattctgaggctgcaatgtggatatttactagaatgttctcttgaaactctgacagtgatatttgtttgcaagtcattatgtgaaacaatcaaaatgtggaaatgtatccacataaataatgacctgtcaagggaaatggagtttgtccattttggtcccctgtgtcattatttagtttgtttgcttggtaggaagcaccactttatattgccagagatttttttttgaatgtttgggtacattatatcatttttaaagctcagaactactacataacattatctttacattatgagttttatttttaaacccctaaattacaactactgatcaaagcttaccactttttagaccttaatgaatcctccattcccagatggttattggaaattggtgttatttatctccatggttatgacaaagaaggtaacaaattgtgtaagtatatttaatttatgttctggcttttcaagattttgagattgagatatctatgtcaactgaattaagaattggcagaactttctccatctgtagcactcctcaggtcttctgcaatgagggattggcaggaccatttttacagagtgttagatacttagtagctgtgcatactgtttgcattataataaagtaggcaataaaggcaaaaaataaatgctgcatcctacagcataaacaaagttatttaattcagagtcattatcttctttctaatctgactgtgatattaaaactcgtcttagtatttttatggagaatttttttgacagtcgctaaaggttgctaaataggccttttccttttcgagtctcccataatctcactctagctttttctgaaatgtgtattataatgaaaggaacagtaacaatcatctcttttgttccaatgactcccctgttata

SEQ ID NO: 136230 - DNA, 1566 bp, Homo sapiens
ggcagctttagctacctcccccggcacagtattgaccccacaccatccccaggccacatgcacatacctagctacccactgactgccccctcctgactgtcagcagcctttagcacaacacactactgaacatccatgcctgtccacttgctcactttctgtattgcccacctcaggcccactcattggctcttcctctaatatagcttcaatttggccttttatccatcctcaccagctacttcctcaattcagtttctaactactacacctttgccccagtcccttcccaggtcataacctggtgggtttccttctctgcctcctccagtctgccctctgtgctattgcccgaaaggtgttctaaaataggaaaatgaaagtgccctagagtttcattcacagtccttcaagtccagttctttcttatttagcttctcctctcaccactcatcacatttcatcttagctaccaccacctgaacagtttaccgtgctccacacacacgcacggcactggctcatgcctccatcgccctgtgtcagtatctttcctctggacggaacattttttccagtgctcgacaaaagcaatgactttcttttttgttaagcacaatgcagagcacatttagattattatcaaatagtgtttgttcacctgtattttcttttccctcttacaagtgaaatttgtttatttcctaagggaaacagtctatctctctgctactcttcaatttaaggcacccaagtgcaacagtttctcattgaaaataagaaagagatgtttttgatctaagaaataaaatgaattgtaaatgaaaaatgtcaagggaaaggcaatatatatgtataataatattataatgccataagtcttgttcttatttttatcttctgcttaaagtctggatcagggtgaagtatcatgtaaaagaccagaaaaccatattggacaaaaagaagctcatagcattctggttggaacgttatgctaagagggaaaatgggaaacctgtaacagtgatgtttgacctgtcagaaactggaataaatagcattgtaagcattttttcattcattccaaatcagtgtttatcatggcttcctccctttctcctgtccttgctgccaaccacatattgctgtaaaattgaggtaactaacttatattagggatttattttttcaccttgcagtgtgagtgtagtcaaacatggaatagggtttgcagagaattaaatttgtttctgtatttggcgttgaaactgtcgatttcctagaaatgttccttgtctgagacacaggatggagaggtagcatgtcgaggctggcaaggtatgaatcgatgtgataactgtgaactttgatatcaaagctaatatcctatagcacctgccccggtgtgtgccacatagtaatatattcaggaaatatcaagtaaggtaatataccatctcgaatttgttatattcataccatgttttacagttgcaagatgttcacatgagttttgcacatataacactttgtgattttattgagtgtttttgtttgcttgtt

SEQ ID NO: 136231 - DNA, 1027 bp, Homo sapiens
tttaaaaaaggttgataaaatatattttattgacactattatgtggtgtaaaaattaggattaaaaagcaaatatatgagaatttacatacatgtgtattattatcccaagtagtctgattataaactgtatacttgtttcaataattctttagttattcaacagatttttagaatttctctatggagattgcttttagatccattttatgccctgttgccttagtagcctgaagtgtgtaactagtttgaggtaatgtgaataattttaaaacatcactaagcatctggtttcttcaagtcagttttagggctgattattataaatagcttaatgacctaaaaccttaatccttgagaatatagatatttacatatgagcttactttttaaagaatttaataattgtctcacttgtatttaataatttatcacctttagaaatgtgcaattttaagttctctaatgtggacagtcttaaagatttaatctttattttaggacatggactttgtacgctttatcatcaactgctttaaggtttattaccctaaatacctctgtaagtaacttactcctttataaaaaatataacatattgaaactgtagacaatgtctgagaattgtggagccttatgttattatagactttcatacctgaaactttgttttctgatgaagaattttaaatgtgttcatagacattattgtaacacatacagaggaaagtttttcataagtattcattgtccttcacagttaattttaagagtttaagttctaaactatatatatggcatcctataacacacacacccactcacacacataggtacataaaagcatacatttatttcaaaattatctcatttttactaatatttcaatttagaaattcatttcaaatagtatttattatatgaaacttcttgcatacaagaacagataagcagtattgatagagtacactgtataataagcaatattgatatataaagtacactgttaccaactgctacttaaaaat

SEQ ID NO: 136232 - DNA, 1018 bp, Homo sapiens
caaattcttccaagaaatagaagaagagggaatactttccaacttattttatgaggcaagtataaccataataccaaacatcacaggaaaagaaaactacagactggtattccttatgaaaatagatgcaacagccctcaacgaagtactagcaaattgaatccagcagcatataaaaaggattatacaccatgaccaagtgggctcaacatatgaaaatcaactaatgtaatctaccatattaatataatgaaggggaaaattatgtgatcatctcaagagacacagaaaaagcatttgacaaaatctagtaccctctcatgataaaagtactcaacaaactagcaacgtaaggtgcaaagagttgaaacaactaccaagttagaccacagtagtccacacaagaccacccccatttctgacacaaactgcaagttcaggaggtgctcaaaattgcccttaggtttgataagtctagtgaaggactctgagaactcactgaaaactattatactcacaattatggtttattacagggaaagaatttagattaaggtcaaccacagaaagtaaggtgtagggcagagtccaaggaagtaccaaatgttgagcatattacttcactggcatcaatgtgtggcaatgtgcatggagttagtcaacctgggaagctcacccaagcctcagtgttcagagtttttattggaactccattatgtaagcatgattgattgcccatgtggttgatcttagtcttcagtctcccccaaggtctactgatactgtgtaacccaaacgcctaccctgaatcacactgttggtctttcttctatggccagttcctaccctaagtcatattgtcccattgtcacttaaggcccccagacaaacaaagacaatcctatcaggcatgaagattacctctcagaagctgagggcaaagtgcagatctctctttgggtaaggctaatccttcacagaaaagaacttcctccacctgtttataaagggcatatat

SEQ ID NO: 136233 - DNA, 1029 bp, Homo sapiens
atttgtctaaaagtaattaatttaaaactttgatttagttcctttctctaatttttaaaagagcacttagtagttgtcactttttacaagtaatcaggaacttgatagatggataaatacaatgttataatttagaaaaatttaaagactcttaagggaaggaccatattgtattttctagagtaacctatgttatgtataatagtaggcactaaaatagatgttaatggtcatgttaatatatgctaaatagttatcctttttttttgtctttagattaacccaaccgaatctacttccaaagcagaagaaaatgaaaaagttgattcaaaagtgaaagctttcaagaaaccattgagtgtatttaaaggccccttactacacatcaggtaatcgtcaaagattttattagctataattttataacatatcttgatcaccttgagggagccacaaaattaagaaaacttctatttggtttttgaaactgtagaaatataaaaccaagagttatctgaagacttaccttggtttccagacgtagtgcatatgtttagctaccttgctttcttctattatgttgagtgtctttaaagggttctcatcacacatcagataataaaactaaatatttatatattaataaatctgaatggcatgtattttcctcacattactgatactattagacttgcccaagtttgggaatgccagaaatgacactaaagtaaggatttgttgattttactttccagaagccaaagatgaactggaaaaataggtttgtgactaaagccaaacttcaggacatctctatttttctgctaggttatttgattcaaaagattccaggttgtttctttcagcattgtataaagacctttttctcactgatgatgtttttggttggtaaatatattttgccttacgttacattgctacaccaactttatgatctcatgtagcattttctgtccctttacttgaaacctttctgtatagctatgttttatgtatatctcttatgaa

SEQ ID NO: 136234 - DNA, 1393 bp, Homo sapiens
acctatttaaagatgtatctcaaaatcaacggcttgctgaaaattcactttagttaaattattcacctttttatataaaacaaaaacactattcttcccattgttttgagccacctgatacaatttggctaatgtaactaaactacacaaactgcttgaatcttttaaatttttttttaggtcataggcattacaatggaaagtaatagtaaaatttaaatattgaagctcattgattttactatttgattagttcttcctacagctcccatcccaaacttacttttatgtttacttttctccttccctattacttagaaaagctgctatatagtaagaaattattctgttaaatacattcctaatcatctttctttttaagttatgctcttttctgttggtgtatagaaatatgcctcattctaattatttgtaattaggtaaagttgaagcagcaatatcttctttgctttattatctataaccttccaaatagtttaaataagcgcaccttaagatagtgctgattataggattaatcagagccttcataactctctcttctgttcttcctggtttgcttttgatcttggggaaaaccgtaggactttttaaatagtgtgcattgaatcagtaagattaaaatacaaaattgtattaggtaattgttttgtaagtcttttttggtgaaatgtctttatacaaatgagcataagatattaactaaatatttttcttcaagctaaatgattagattgtcatttattctgattattacaaatgtcttatgtttttgtcactccctagcccagcagaagaactgtactttggaagtacagaatccggagagaagaaaaccttaatagtgttgacaaatgtaactaaaaatatagtggcatttaaggtaaatatcttaaagatacaataaattatgtttgagaatttgacatgggaagtgattttagacatattctaattgaaagattgaaaattttgaacttgtacagtgtttttatttatgacaatttttaggcatgttgtactaccttctggttctaaccaagtcgcatagctttatcaaaaaattttccctgaggtctgtatctgaatcttttacgtgcagtaataggttaatgtctaagttaatacaagggtttaatgtttgttgtaaataacaacccaagaaaaattactctttactatgtgaataatttaatttataataacagtgaaacataaaactataaaattgatagtgcattttccccaagtgtggtatattctggagtgtagtttatatcggatattaacctgatactgagcattaagtgtaacaagactaagtccgtcactaccccgtattgtaggttttcctgccttaaatcttctattt

SEQ ID NO: 136235 - DNA, 1041 bp, Homo sapiens
aatagcagctgtgacccgggtgcatcagtggatatagttgtgtctccccatgggggtgagttgtcacttagtagccacagcaggtgttgggtgtggtgggggtaaggggacctggaccttggctctgagtcagcagagatgtcaggctagaatctagaaattagcagagtatcacgagtcacctcacctcgctgtagacatcttttttcccacatgtgaaatggggtggtcaaagaggtctctaaagccctttccagcattaaaatgtattgtttctaacaagtaaaattgtttaaactgacaccaattgaaattgaatttcaaaagagaaatttcctcacttttagaactttttcctttttaaagacatttccattttcttctttttccttaatgttgagttccagaataatgctttaaaccacatgcatatccaaccgctttgaaggttcctgtttatatgctgaattacccttttggaatgcaggtttaacagtctctgcccaagaccgttttctgataatggctgcagaaatggaacagtcatctggcacaggcccagcagaattaactcagttttggaaagaagttcccagaaacaaagtgatggaacataggtaagcttttccctcacattcttctcaaatgtagtgggaagaatcagaaagagaaaagtgcctccatggaccaggtggcctccctttcttcttgcatctgctgggtgccctgcaaggctctggggatgcccagatgaaagagacctggtgttgctcaaggaggtcactgatagcagaaactcatttgcaggccagtgcaagagtctggatctgtccagatcacaaacacagattgtctcagcagttctccctgtaggagtgcttaccttacatactagaatgttttttgcagcattgtttgtaatagtgaaaaactggaaagaaagaatctaaatcgtaaccagtaaagcaatagtgagatacatttgagtatatccacactaaagtgtgctgcaaccactcataaaggtacagcaagtctatt

SEQ ID NO: 136236 - DNA, 2907 bp, Homo sapiens
gaaattcagacctctcaaaatgagaataagcatagacatatctgtccaccaaacaaatctaatgccctgttgcacttccacctccttccaccagccttacagagtagtgggccccatcctttcagtgtttggatttctagtattcctgtttgtcatgcccatgattaatggctgttttattgatataaatctttcatcccctcttccctcttcagctcagtcgtttactagaaagcaataggaagcttgaagaccaagttcagcgttgtatctggttccagcagctgctgctttccttaacaatgctcttgcttgcttttgtcacctctttcttctatttattgtacagttaaagaagtggtgccgggtaggaaccacggttccttcgtccattagttggaaaaagtaacagacctaaaactctaccaagctactaaaaacattgcacatctgtgcttcctaaaaggaaatatgcagcacgtggaggggaacacatacatgtcttgaaaataaactgctagaataaagaaatgctggagaaattgattataagagactatagctatttagtaaagtaagtaaaggcatatccattgtgtaaattaatagtttaaatataatttattttttccttttgatctgaatacttttaaagcttaagttttatcgtgtaaatacattagctaaactgaaaagtataagtaacatgctttgttgcagccaaaaaatgtaatctgcttttttatgacagaattattatagctgagctgacttactagcttttctatactatgtatatagaagaacatgtatattgagaaagaaaacatacttatatagaggaatttatgtaaccatgactttgtaattttgagaattcctcccagtgatggtcagtattcttttggaatgtaaaccgatttaatgccaaaccaccttaacctttgtttctcagtgttccttaacagcctgccttttattaatctcaggcttttttatgaacactctcatttcagtagaatttggaaaactaagcgtggttggaatttctttgaattctgttagtaatgcccaaaagaaaagtctcaagcagtccccctatccagtcatttttatggagtttcatgttgtccactatagctggacactgaaccttttgcctaatttattataaaggcctgaccctctattgtcccatcttcacccccattccagagcagaggagtctctgtggaccatgaattgcactgtctccctcctcatttctaaatgaaaggtattagatataaatttttttgaaaggttagttgtttgagatgctaagcaggataataaatttagattttaaaatgttccctgtaaaagtcagcccatgacaaggaaatttacaaaatactagagtatctagaagggtgaaaacaaaaaaaaataaaaagaaacacagacgcccaggtgtcagctctccgtttaaagaatgaaaaatgtaactcatgatgatctgtgaaaccttcaaactaggaccaattgacttacttgatattctgcctttgatatggtagtacccacccggtattcctaaaatcctaaaaagatacaccttgcagtagcagaggcaatgacatgagtttgttttctcattaatatgaccagtttgggtctatgttggttcacatgtacatctactttatatgaaagaaaaaacagttgtctgcctgtaaaatgttgagtttcgattgagccatgtttggagattttattactattctgaagggtagtgttgttggttttcatcttcaagaagttgattccaaaactgagttatgaagaatgatataacagttccttcaaaattggcctaggaaataaaaccttaaaaggacactggtgtgctactttgtcttaatttgggcttttctgtttcagtttgccacctccagctgtgaaatggactgcagtccaccctaagtactgtgcacagtatctccctgtgtgtgtgcacagtggcttccccttacatggtagatttttggccttaatataatctaatcccaaagtagttgtgtatgttttctgttccttggcaaataaatgaagaaataattagccaagattgaaaatgtattgtcctaacggtgtccctttaatgtttcatatgaaaaattatgttgacccactaaaatatccttgctcaatgtctggtcagttgaatttaataacatatcttgttaatgtttgtgtgtctattaaatgtgactaagcaggattactgaaaattcactataaaatcaaaggcatctaaacgtttgtacttgtcttgattaatcatatatttacacttgatttttttctgtcttcatttgtttttatttaatcataattgcatgatttttttggtactctaatcagtaattttatttttaatcatgtcattacctattcatgaccaaattaccaaggaaccaacatttagatttagatatttgttttcacttaggaatggaaattaatagattttccatgaaagcattagtgaaatatcattaccttgatctgcaagtagcctaaaaatgcgattgctggtaaacctggcctcaaatttcatactaccataactgtttttatatattgccactaattttgactggatttaatagcactttattgtacaactacaaaaaaaaatatattcctagaattgttgccagtgtaatttctctaatgttctggtgcttttcatatattttcagtatttttattactatattggtattttctttgtataaattgattgattaaaagaacatgttttctattttaatatgttttagaaaaataattacatttatgaaataaatatcatcaggaaaaaaacctctggtctctaattgataaagcatcttaaagaaa

SEQ ID NO: 136237 - DNA, 1004 bp, Homo sapiens
agtttctgaatgcaagaaatttccaaaactcctaatattatgcctgaccctttcattgctgaatctgagactataacaaaccaagaagccaatcatttctgtttctcaatccagtacctatttatcttttttgcatcaagttttcactctaatactatcatacagattcgttcagtagaacttatgaaatttgccctgaactgtcttcgcccactaccgtgcaaatatggttgaacaacttgaatcaaataccaaataactgttttcagtcataaactaaatgtcaaaaatgtgttttgggtacttttccaatattctagattctgtgactccagctacttccttttagtgggggtgcagaggaaggaagctattattagaagcaataacaatagtataacacagtccagaagaatttaattttttaaaatgtggctgaactggtaagttactaaaaaggataagtgaaaggaaattgacgtaaaaagcaaagcttccttgcaaatcctgtatttactgctctgggatttcttaaaactgcttaagaacttagtcattaaaggtggaagtgcatcttacacaggagctatattctaaagtcagtgcttaggatagaattgagtatagttagaactgttctttaaaaatcattaggaagatgtcagctgggttcggtggctcatgcctgtaatgccagcactttgggaggccgaggtgggtggatcacctgaggtagggagttagagaccagcctgaccaacatggagaaaccccatctctactaaaaatacaaaattagctgggcatggtggcgcatgcctgtatttccagctactcgggaagctgaggaggagaatgcttgaacccaggaggcagaggttgcggtgagccaagatcgcgcctttgcactccagcctggacaacaagagtgaaactccgtctcaaaaaaaaaaaaaaaaatcattaggaaggtgccacaacagaaatggccataataactcata

SEQ ID NO: 136238 - DNA, 1389 bp, Homo sapiens
aaagtgtactcaaaactgaattaccctgtcctcatccaaagatgtccgataatgtgtggaccaaaggtggttggcactgattctgtatagggatgggacagaatgtggcgctgttctcaccttgttttgctttgttgttggaccctccaaaaggcctgacttgggtaaaggtagattttaagaataatgtaagtggaatgtatctatgtggatttcatcattttaagatgtaacacaaacacttcatttcaacttgagattcaacccctaaatcctctaagggagagaatattatatttttaacaaaatgccatgtaactacacaattaacataaggctttgaatagactactagttgtggatttgacctgcctatgaatattcacccacaaaagtgacagccatatcagttctctgtgataagtgcctcattgtcactccaagcaactggtcactgctgactgttagaggacaacatatgtaccaagctagggcaaccatattttctgtcctagaaattaaggatcagattccttccaccatcttgcagcctgtggagacctgttgggaacaggacttctaaaaggcaaagatgtctggaaggctatggtccaaggtcattttgccgtctgtaagtggggtctctagaaccaaagggagcatacatttcttcttaaaattgaaggtgtttatgcctgagatgaaactgaattctatttgggcaagaaatgtgcttatgtgtacaaagggaagaacaacacagtgactcctggtggtaaaccaaacaaagccataataatctggggaaaggtaattcaggcccatggaaacggtggcatggtttgttccaaattccaaagcaatcctcctgctaaggccattggacacaaaatccgtgtgatgctgtatccctcaaggatttaaactaatgaaaagtaaataaataaaagtgggtttgtgctcttgtaaaaaaaaaataagaatcaggattcagaaaaggatagaaatcctctgtgtctggcttaaactgagggaatggaaatccagggtctgtggaggggtgacactgagcacaaagaaacaaagatagttgaggaaagaaaaagagagtaaaatacatgagcagggagaagatgtcctgagagaccatatgctatcatatagtgggagagaaacagagacaaaagggaaactacctttgttcttcaggtcagggtttctgtttcctgctgctgggattccaagtactgtatgtgctttaaaactttgcttccgctcatttaaagtgagactcttttatttaccctaaaaggaacttgattgactgttccaggtttcagaaatatgaactctctagatgaatgttgcctgttaaagttttcagcttca

SEQ ID NO: 136239 - DNA, 1011 bp, Homo sapiens
gaaaaggactaaaagagttgtattcatgtattttcatacactggcattctaccaggtaatataagctcagtaaagtaaatcttatgttaatgtctgttccttgagagttaagacgactcaaggtctttatagtgctctgatacactgaaatcgatgagctgtatgttgtgactcaagattgtattcttacatgtcagctttttaatgtagtgaaacagttcttaaccaggcagtcattctaatttgcctgcatgctaggagaaattcccatatttttgcataaatcatttgttaagatttattaggccacttgtataactatattttggcttgtcttttcaattgatttttaaaatttacaaaatcgaacatagccaagaatgaaggcagagacctagagtgatgaggaaaactaaaaataaacccatttcacttgtgttggccagctgataagagaaaattgcccaactagagaaggttgattcatgaaatatttgggtacttcatccagaacctagggcatctcttttgtccatttcactatgactcttccatgatcaaggatagcccacatttttcagaaatgggcaccacctttaccaatgcttgaaatgcaagtgaatgatcaggagggaaccttgccatgggaccttgtcccagatggaactaccatggcgagtagtctgatgcttctagtgtgacacttacttggagaggcatccaagataggccttttattaaatacaggcttggccgggtgcagtggctcacacctgtaatcctagcactttgggaggccaaagtgggtggatcacctgaggtcaggggttcgagaccagcctggccaacatggcgaaacctcgtctctactaaaaatacgaaaattatccaggcgtggtgacgcatgcctgtaatcccagcttcttgggaggctgaggcaggagaatcgcttgaacccaggaggcagaggttgcagtgagccgcgatcgcaccattgcactccagcctggg

SEQ ID NO: 136240 - DNA, 1073 bp, Homo sapiens
tatatttgtgttttgtttgtactaaaatgcaaaagcaagagtgcaatttttaaaatctagaagttaggggttttgttggagaaaaatggactgatctttaaactattcagtcttactgggatttttatgcatagaaactcacatataaacatgaaataaacagtgccagtattcataggaaagtgagaaactgtaatatttggccattattctattcaacaggttttagaggcatgccaccattttttccttatatttttgcttaatttttttaaattgtcatttaattcttaaactgtcatttatttgagatggaaataagatctaaagttagttgcctttgcctgtaaaacatgtgatttgcaaattattatttttcttttttttaacaaatggaagtaaatttgtttcacgtaaatcttaattttcaacctttctggataccttaattgtaactgtcagtttgcactggtcggtatatggaaacacattgctctaccctgctacttagttgattttaaagtgaatttacagtgatgagaaatttgtgaaaaatatattgtatttcttttgatgtttcaaaaggttgcctatgaaaaactgatttgttaaaacatgctacatgtccaaaaataaagaccagaatgacattttgataattttctgagtttgtcttattttatgaacagactattatttactagtggaacaggctatccctgcccccgacacattctttttcagtgcaatttggatgtgttgcttggtctattagtaaaacaagaaataccctttgggcgatgaattactctgtcattttttgtttctagaatatcttctctctctcactcatggaatagcgagttcaattgtgcctttgtttccttacccaaataagcccttgtttttcattgccctagcattatcacgtgagacaaggaaaatatctacaaactatactgtgtatgtgagctacataattatgctttctactttgcccaacacaaatttgtaaactttcttaaaacattatgagacttgtgattttctttctttctttctttctttttttt

SEQ ID NO: 136241 - DNA, 1527 bp, Homo sapiens
gccactacgcccggctaattttttgtatttttagtagagacggggtttcaccatgttagccaggatggtctcaatttcctgaccttgtgatccgcctgccttggcctcccgaaatgctgggattactgggattacaggcgtgagccaccgcgccctgcctactcttacttttgaatatgtacgttttgtaattgttaatgaactagattcttaaatagtgttgacattgttgggactttggatagccactcactttttcagactaatagggcataatttactttattgttttctattacctgagattgtgtttatatattataagaaaatcattttggagaaaaaaggagccaagatgcatccttttgttctatggactgtagtgatctaacagttgatgccctgctgccttcatttaccctcattccaggaaagtgggctatagctggtttgaacttaaattttgcgataatgtagtgttcactgcaaaattctctgtaccagccacattttaaacaaagtggaggcagcagttagatttcgttgcttagccttttcctgtggcagtaagtgggatcacagactgatagaattttatagctgaaagagactttaggtacataggtatctttattttatagatcttgaaacttccccacgatcaatgggcttgctggttaaaaaagctgggaaaagacccagatctccaatcagctgcctgctctggagaaaacgaactcaaaccttagccaccttaaatataccttttttagaagtacgcaatgtataaacacaagtgaataacttaaagaatagtctgttgagatgaaacagaatagtccatattttgggtgtgtggaaggtaatgcatgtcaaggtctacgtcttcaagaattgtaactcttgggggaccactgccagtttgcaaacaattccactcctggaaaaggtttaagagagtttctctcctttatggagtgcatagctaatacttttcaaaataagtggattctcagtcgttctggtgaatttttttaagtttaaatattaatatctccaacattcaactttatattttcagggatcgatttgcttagtggtataatacctgaactctgtcagaaatatccagatttaaatttcataattggaggagagggaccaaagagaatcattttggaagaagttcgggaaagataccagctgcatgacaggtattgatgaatttcatgttgtcttgagggagaagatgtcaattatctctatttggttttaactgcatgcgtaccttaggtgtgttgcttctcctgcatgtaattgatatacatataattgatataaatctaatgcaaggactgttttcaaaatttttatataaataggaaacctagttaattcactattttttccattagcccaatattatttgactttggggggccattgttggaggcaccatgaaaggcacaaaaaacagctgctttaactggaagcgtttgcagatttccaggccatactgtgtagtga

SEQ ID NO: 136242 - DNA, 1073 bp, Homo sapiens
agtgagtagttgtattaatggtccattccttattaacaaattaatttcctcaggagtttattggaccagatatcaaagtcccactggaatgtcttaagtgagagagaggataaatcaaagttttccttatccaggctttttggatgtctttttcctgagcctcctcttccaagcctgttttgctctcagtcaggatttaccagcactctgcatgtgtaggcacgctcacctgcttccttctgtagtggtaatgacaacctacatttgtattctgcagttgataaagcctgttcgtggtacaatacctcatttgaccctcccaacaactgtagggtagatgttatctacatgaaattgagtctcagagagggtaagtaactcacccaggttacacagtaagtaacagagatgacacacgagttcagcttttctggagctaagttctcctcttcctccacccatgcccagccactcatatcctaggtgtagatcagaaggttcttaaaaatattgttagactgagctttaaaagcagtttggatcagagattttcattgtctgttttgtgttcacatggcagtcgaaagtctctaggttccattgcattatacccttcttagaggctccagaataaatttttttatagtggtggggaaaagcccttattcttagaataagaatatagatcattggtaatagtaatcagttccatttcttatgagatacttgtcaggattaaatgacataatgaatttaaagtatattgcctgtcatagcaagcactctgttactgttagctattatcatttatgactattgctctatgttgttttttgtttgtttgaagaatgggctcttaaccttgtacgagaaagaaaagggtgaggaagaaaatggattgaaggaattgtaggagactaaatgttaaaagtcattaaactaccttctggtttatctagaaatccaattgagtgatttgttagtagacatgaaacaaagatagctatgattttaatgagaagccttcatattcagaaaagctgcgtgggaatttttgatacatacaataacag

SEQ ID NO: 136243 - DNA, 1040 bp, Homo sapiens
tgcatggtatctgactttttctacccaaatatgggaggcgtggaaagccacatttaccagctctctcagtgcctgattgaaagagggcataaggttataattgtcacccatgcttatggaaatcgaaaaggcatccgttacctcaccagtggcctcaaagtctattacttgcctctgaaagtcatgtacaaccagtctacagccacgaccctctttcacagtctgccattgctcaggtacatatttgttcgggagagagtcacgataatccattcacatagttctttttctgctatggcccatgatgctctcttccacgccaagacaatggggcttcagacagtcttcacggaccattccctttttggatttgctgatgtcagctcggtgcttacaaacaagcttctaaccgtgtctctttgtgatacaaaccacatcatttgtgtgtcttatactagtaaggaaaatactgtactaagagcagcactgaatcctgaaatagtgtccgtcattcctaatgctgtagatcctactgacttcactccagacccatttagaaggcatgatagtataactattgttgttgtcagcagacttgtttacagaaaaggtaatgaaatgatagctataattgcattgtagacttttttccctatagaaagctgttgaatacttgtatataatgattgtttggcttttcattttgttttatggttttataatgctataaattatagcaaagaaagttctaatattggtttatatatccaagaagagcgatttttcaggatggtggtgaatgctgtcccccaacctttgatgttttaatggttactaaaaataagaataacctgatgctgttaaatttcagatctttttaaaaattaaaacagccctgcacatgtggtaaagaagtagagggcaggccgtgtacggtggctcacacctgtaatctcagcactttgggaggctgaggcaggcagatcacggggtcaggaggttgagaccatcctggctaacatggtgaaaccctgtctcaa

SEQ ID NO: 136244 - DNA, 1380 bp, Homo sapiens
tgatccacccgtctcggcctcccaaagtgctgggattacaggcatgagccaccgcgcccacccggggtttagagctcttaaacaacaatgaaattggtaaaatttaagcagttattaggatattgcttaataataatattttaggaaggggaggtttcagatcatcaacctgtttagttcaatctctcattgtttatgtctatatatgtttgtttttttctttaatggagggaatatcattggatttatatagcaagtaatttattcatgaatagaacacttggaggttactgattcacttcagtagattttgaatccatgtgggataaccatgcaggattttatactgacattttaaatacatgtctggaaaacttaatcaaatcagagcagagttattcttttgaatccagtcattgattctgaattctcatctttattttcttttgcaacagctgtgaggacagatgcccctttcataccagaccatgtgcaagtggcaaaacagcatgtgcaaagcattgccgctttccaaaggagaaaagggctgcccaggggccccacagccgaaagaatccttgattcagcgttccaagttccccatccctgtcatttttaacagcatgctgctttgccaagttgctgtcactgtttttttcccaggtgttaaaaaaaaaatccattttacacagcaccacagtgaatccagaccaaccttccattcacaccagctaaggagtccctggttcattgatggatgtcttctagctgcagatgcctctgcgcaccaaggaatggagaggaggggacccatgtaatccttttgtttagttttgtttttgttttttggtgaatgagaaaggtgtgctggtcatggaatggcaggtgtcatatgactgattactcagagcagatgaggaaaactgtagtctctgagtcctttgctaatcgcaactcttgtgaattattctgattcttttttatgcagaatttgattcgtatgatcagtactgactttctgattactgtccagcttatagtcttccagtttaatgaactaccatctgatgtttcatatttaagtgtatttaaagaaaataaacaccattattcaagccatataattttatgttatttaatatgcttccactctatatttatgctaaagaaaaagtgttttaaagaaagaaaggaatttcaaagtggaaggtgcaggaagagacacaaacactggacctcagttttgggaaaccaagggaatagctctcagaaaggttaagatcctaaatgaggctaagcaaatgtgacccaagaatccactgcgaatcactctgtgccttgagattaaattgaacttgacctgatccccatcccatggca

SEQ ID NO: 136245 - DNA, 1067 bp, Homo sapiens
tttttgtatttttagtagagacagggtctcaccatgtttccagtctgatcttgaactcttgggctcaggcaatcctcccacctcggcttcccaaagtgctgggattacaagtgtaagccaccatgcctggccttgtatttttggataatattgagtgaaatttgcctcaatacataaaaatcctttcaatatgcttcaactctaaaatctttaaaaagctgcttggtttcattattttcacgtggaagcagcattgtcacaaagttttattttgaagactgaattgtatatggagtactgtccaactagaagagaatgaataatcaggaaaagagagactattgacaaataagacttaatggagaagcattgaatttcaaagctgccagagacattagcaattgttcagtttcatctccagatttcttagatgaagaagctgtggcaagccaatttcacaaacccgatctatgatcctcatgctccccactcctctcactcccacaattttgccttgattcaaactttatcgaaaagtgagaaatcacaggtatgagctcactgagcttcccaggcagtcttgccatctacaaacccatgtcattctgtattttcctcttgtttctgacagtgatcctctcatctagtcacactacatccacttatctctggcacttatgtcaaaacaacccctctaggtcctgccttagctctcctgcatatgctttttctttcttcctgtctgttgcctctttcccccagcttataattctcccgcttttattaaaaacatgcacccacagacacacactcacatctggattcccaagtgcgataaccttgtagattcatattttcagatcgttcttagtccacagaatataaaattgattgaatgatggcaaacatctgcagatgacaatcatttacagaaatggcactaaagccatgaagctgaagctgcaggacttatggatctgggctagaagacaggggccatcaaaaatttagcttcagttggaaatcggctcttttagtgcactacatcagatccatgaaagaggaag

SEQ ID NO: 136246 - DNA, 1067 bp, Homo sapiens; identical to SEQ ID NO: 136245

SEQ ID NO: 136247 - DNA, 1067 bp, Homo sapiens; identical to SEQ ID NO: 136245

SEQ ID NO: 136248 - DNA, 1080 bp, Homo sapiens
caaatctgtttgaaaatctcaacttaagatttcaaatccactgtgtatactatttagctgttaagtttctcagtctaagaagaacacgttttcctctagaaataagcttaacccagtacctatgcatcgttcattaatataatcagattacggcctagatgtggaatttatttctgtttctattttctccagctttttaatacagctcagacagtcatatacagttgtacacgatgtgcactgcacaactctagggtgctccatgcatatagacatatctgtatgtgacagccctaagtacaatgtggtagacactctggacatttggtaaataagtatctacatcctcactcttctctcattcacattggccttctggccagcactatttctggtttatttaataaacaattcttgtcccccagaaattctgtgagtcttctgaagatgctggggaaagccagccttcataaatcttttcaatgtcactaatgaagacatgtcactattgcaacaaaggaataccaggccatagtaggctttcacaacttttttctgacagaatttgtttctttctgctttatcttccctgtgtactgtctttttttatccaccctctttcttaattacactggtagaagaatattggtgggtgatggagtcattcacattctgtgtaagactagaatcagtccaagatccacaggaatgtgggatacttctttcatgagaagccacatggctcacaagacttctttacatttgtgttacttgccttctcctgaaattgtctctacagtgaatcaaataacaaggactgaggtgtattttccatatttaattccaggaagcagtcccactccttctccctgcccgatttccagttccaaagtcatgtacagggaagtccattgactttgatgttggtcaaatggcccagcaagcttttgtccacttttctgtcagacacagtccttggcacaaaagacatctgaaatacttcccattaatttcttctttatttatgaccttgtagttaagtgtgttgaattatatgcttctatacacatctgttttaat

SEQ ID NO: 136249 - DNA, 1049 bp, Homo sapiens
aaaaatgatgctcttcgacttgaaatttttataatcttctgtttattgtcaataggtgctgctgattttcaaaaaatgacttagaatcctcaaataagtatacagccttatatgctgcttagacaccaaagctatgataagatttgtcagttctttgtatcagatgggttcaattcttgacatcagctaatgttataaaaataactacaaaattggttgtaatagaaccaaatctaagactctttttaataaaaaagatcaccattgctggtgagaaacctatactgaatgggtgagatgccattgcatttatctgaagtttcgtctttataatcaataatcatatacaatcctagtcaagaaactcatcttacagtccttggggattgaacactgtgaaaataaacttttactcttcggatgtgcttggattttgttttaaattaagaactacagaaatatatatcatttctagtggtagaggaaaatattgccacccagaactttctgaatgtctctttctgccctaggtccatttgtgatgaacaccaatgaagagatttctcaagctattcttgatttcagaaacgcaaaaaatgggtttgaaagggccaaaacctggaaatcaaagattgggaactagtggaaagcggaagagcaggtcttgatgtgtcctagaattttgccatttctgagattgagccattgaaggcattccatttctaaagcttatttagccggtgcttctaaagaattccacactaacgtgataacatggtttttgtaacaataaatgtaggatatttcctggcacatgcaaataaacctaatcattgtttctttaaaaatcagtgtttttcatttgagatacctaagttactaagcttctgtttaaaaagtcgttttgtgtatgtttgcctttttttgcatgtatggatggatgtttttattatttttgtgcatgtgcaggttttaaaaatcatatttgattgctttctgtgtgtcattggcagcagatgcatgagcatctgaggtcccttcttaagcaa

SEQ ID NO: 136250 - DNA, 1081 bp, Homo sapiens
agaagaacaggtgcagccaacatagaaaagagtcagctgaaaccatcaattcactggcaagcagcactcctggctccagtggcatcgttctgttatgtgcaattctgtaattgttgctgtgtataagcatagcctgagccatcaaaaccttagaaagatttctatgaaaaaattgatattaaaaaatcagcatttaaaggcagcatgtgtcacttatatccacacaatagtagaaagtcccctttagattacagcagaaaagaaattctgaaggtttgaatcttggctttactgcttgttagctgttgtgactttggacacgtttgtaaagccctctgagcttcagtttctttgtctgcaaaattaaaataatactgccaactgcaagtgattgttagaaagaatatttgagattacgtatattacaagtctactccagattgagcatgggggtcagtaaattatgtccaataggccaaatccaaacctttttcataaagttttattggaccacagccacacccattcgtttccatattgtctataggttcttttatccaataacagtggaattgagtagttgtgacaaataaagcctaaaactctctggccctttacagaaaaggtttggtttactacgttgtagatgctcaataatggtaactggaaagtttatgaatccaaatatctaatttgatagtcataccacatgcatgttacctaataaggatttatacagtagacctgaaggcttagggcacataacagtttctacaggtagaagaaggctccaagagaccctgactcactcacgctccaagccagtgttatcctcacttgaacctagcattagcctgaggatttgataaagaaggaagatgtgactgcccagtgccgcgccaatcccatttccactaaactgtggtcaagaatgagaagctgattttttgcctggctttttttctggctctgttcttcctgcacttttactactcttcctttctgtgttctccaccatcacacccatttgactactggttgaccagtagtatgggcagtatctcctatagtggccaatctc

SEQ ID NO: 136251 - DNA, 1081 bp, Homo sapiens; identical to SEQ ID NO: 136250

SEQ ID NO: 136252 - DNA, 1081 bp, Homo sapiens; identical to SEQ ID NO: 136250

SEQ ID NO: 136253 - DNA, 1050 bp, Homo sapiens
tgataatttttctaactatttttaattcttataaactttataatttacctaaggaaacatgagcacataatgccaaggactttgcttatcaattaaagtgtaaatggaaacacacgcaggattcatctccttgtcctttttcaaaattgaaaacaaactagtttcaggctttaataatagcaaatataattaaccaagagattcaagggaattactaagtccattatttctcaaattaaaataaatgttgtggtgctatatagttaaccaaataagtaaccatataacaaatgtactataatgggtattaaattagtgtgtcattggttttgtagggcccgatgatgcacaacaaaaaatagaacctcatcacacagcagtgcttggagaaggtgacagtgtccaggtggagaacaaggtaagtatgttattttcctttaactttcttaacatgtactttctactggtttccaagaaaatgcctaaatgttgtggataactgaaagtttttctctcttccttggagaagaaattataccagaagtttatcatgtcttttcattaatttctgctatttctatgggtttattttaaagttttatctttattgattctttatcttcagaaatcatataaagtccctattgtttacccctggaaatttgaatctggaagcaacacatctttgttgtctcttaattttctttctttatacaattgatttattttgtttttagcataagtgaaaatagatcagccctatagaagtagaaatataaatctacatgcatactcacatagagccctttgaaaagaatccccaccttggccgggcgtggtggctcacgcctgtaatcgcagcactttgggaggccgaggcgggcggatcacgatgtcaggaaatcgagaccatcctggctaacacggtgaaaccccgtgtccactaaaaatacaaaaaattagccggacatggtggcaggcgcctgtggtcccagctactcgggaggctgaggcagaagaatggcgtgaacccgggaggtggagcttgca

SEQ ID NO: 136254 - DNA, 1053 bp, Homo sapiens
aatcaggttagttctcccctttactcctgaaagccaactgttaaacattatccagcacactacttcctctgggacagaagttgttaatctttttactgccatggacctttctgacatctgtgaagcctcctgcctcctcaaataatgtttttaaagtcagtgcagttatgaaaatgttaaaagaacaggtttcggatatagctatatgtgtgcttctttaatgacatttgacataacatgatctagtagcaggcctgctctaaattttaagtaataattaacataaactatattttgagatatctacaaaaccataatgtgatatgaaaatatctatgatttctgctggagacaaagtcatcagcccagctaatactactgtggcttgttggctacattcatgattgaaggagaagatacgtttcaatttaggtgttagtgaaagtaaacatgtaatttatctcctatcaaagtccacccatgccctgaattgtatccatagaccccccttgggaggacattgactccacgttgagaactcctgctctgttagaatcctatttcatgtttgcaagcatcagaatgaaccctgctgcctcatattggttatttccaaagtggaggtgagaaggtcttctctagaaaatatagttgtttggactccaacaaatatgtccaaaattcacaaattatgtttctgtttacataataattgctcaagctattgttttcatttaaataagcatttccttattgattattcagctccaacttgtcacatgaatgcccttatttacatcccaaaagggcatgcaggtgtatctcccaagacattttatgggctgctcattcaatttgaaaccttctctctcctgcccattaacatatcagggtttttcccaactgcaagacctaatccaaatctcaccccctctctacagccttctgtggtgcactttggcctctccagtctgtagccttctcttgcagaaccactcttgcaatcttcaagtcactacattcttctgctcctagtgagaatcatgttagaat

SEQ ID NO: 136255 - DNA, 1053 bp, Homo sapiens; identical to SEQ ID NO: 136254

SEQ ID NO: 136256 - DNA, 1053 bp, Homo sapiens; identical to SEQ ID NO: 136254

SEQ ID NO: 136257 - DNA, 1191 bp, Homo sapiens
aaaaaaagtcttgtagtagtatcataagtttatatgtacacagcttaaactatattaaccatctggaagagatgatatatcatttgtttttatgatcttctgaaaatcctgagaaaaacatagtgctttataaaaatagaaaaaaacatttttatggaggtagtgctcccgacttatgatttcaagagcaacaaaataatctacacaaatggaaatgaagaaagcacatgaattttaaggtggtaaggataacagaaatgtttgtgcagaatgagaaaaagcagggagaagcaaactttctgtaaaaggacagatcacaaatattttcatctttgcaaggcatatagtctcagttgcaactacttagccctgcccgtgtctcacagaagcggccacagatgatacataaacaaattgggtggctattccaataaaacttcatttatggtcactgaaatgtgaatttcatgttttttcatgtgtcatgaaaggctttttttaagtttgtttcaaccatttataatagtgaaaatttttcttagcctgtgggctctaccaaaggtgacagttgattttggtttaaatgaattgcagggaatgaaggggaaagaaattaacgagtaattgccaaaacctgttttaagcagtagttagagccttgtttcctgacagacctttagcctgagaagttaacaagtgaaatgctctgcagttctcggggtaagaatgacccacacatccacttgtttttcttgagatgaggcaggattttcctgagtcatttctatttactgacctggtcccccctcgtgaccatgggccacagtgcaaaacatctggcaagggatgggtctgtagccttggagcaaagttgcatctgtctagaataaactggactgtgaagagaatccagctcacacaactggcctcttgggactgtgctttaaccagtgagtggctggctaaatgacctcatttgaattttatctccttcccttcctcctaccaacaccctaatgggggggcggttaatgagaaaaacaaaagggcaagaacaaatcatcagggaaaaagaaatgacgaaacagaaatagctcttgaatatgtactgacttataaaatcaatagagaaaatccagaaaatgttttctgacttcactgcctcaattttgtcttgcttataaaactagg

SEQ ID NO: 136258 - DNA, 1029 bp, Homo sapiens
aatctaggtgaatggtgtacaataattctctgtagtatttttgcaactttttgatatgtctgaaattattttaaaataaaaattaaaaagaatttggtggaaggaggagcgggagggaagaaccaggcaggtctgcctcttgtcctaggaggccagggttgaggtcctagatgaaggagttacctgccaaagctgatgtggggacttccggtggcgggggggaggttgcgggtatgggaggaggatcttagggaccagggttgctttgcggtctggcaattatgtgatccagagtttgtgaagggttgcaatctctccttagcccagttgcccttatctctgttaatggtgttggtgtgtcaccaggccgtgtttttctattttttctgcacatacaggtgtaaggaatacttgtaagttcattggaataatgaactccaagactgaggcagaaggaaaatgacccgggttaaggcaaggaatgtaggctgaggaaagctctcactagggacgtttgcaagaattaggagcctctctggaaatgagagcaactgccacagaaaatgatttacatattttttaaaagttttgggtttttaatgtttggctaaaggaggtctgacttaaaatgcgttgctgacttaactgtcctaggaggccagaacgaaaatgtgacctccctcccagctcattttattcatcactgcccaagggaagggaagagcttttcagctgcaaagagacagtagcttgcagaccatatttgtaggagaaaggaaaatgtagcagggtgtgaactctgacaaagcaataaaaattgggggatgacatcaattcttggtgcaggacataaaagtgggaggagaggtgagggaagaaagaaagatgagaaggacctgaaaatctgacaagagatctcttctgtggctgttgttaaacatatagtaagcattcatgaaatttggcatttgttttcttttgcagcaagctgaagaaacaaagcttagtggaaattaaacaaattaacag

SEQ ID NO: 136259 - DNA, 1029 bp, Homo sapiens; identical to SEQ ID NO: 136258

SEQ ID NO: 136260 - DNA, 1029 bp, Homo sapiens; identical to SEQ ID NO: 136258

SEQ ID NO: 136261 - DNA, 1061 bp, Homo sapiens
cctctccctgatactgggaaaatgcatatattccaagggaaatccagttaagggagactgaaaacgtttctcatgaatcagactaggttttatctgagttccttcccatgaatactatttgaatcgatttttaccatctctttatttccttcaggctaggcacgtttctcttgggttgtgctaatcttgcagaaaacagatgtttcatgcagtgatgatttggaaggcagttgatatcaggaattgagctggacggtgcatcacttacaaagaatctaatttgtcgagtttctgacagtaccagattcctttcacattggccacacgttttttatattagatcttggctaaaataagagtaagtagttttttaatggtgacttttaccatttcttgcaaggcgcaaggcaatctgactttccttttgctgtaaactgatttacagataacactgtttgttaccattaattatgaaggacataaatctatatttctaggaaaatatcagtcttttccaagaaacatgtgccttcttgtcctcatgtcccccttgtcttctgactgactgtatcacagtttggccctcaacagccactctgtttattttcctcatttccttttacagcacctttgcctctagatacttaaaggcaggatctggaatgttaaaaatggagagctgttatggaaaaaacttgattttatgaacctttttgcttttcctcaccttataacttttcctttacagtatatgtagatcaataaacaaaatttatttagaaaccatatagtctacccctctgtggtaggcaaaataatgtccccccaaagatgtccacgtcccagtttccagaatctgtgtatatgttatgttccatggcaaaaacgactttgcagatgtgactaagttaatgctgctgagatagggagattagcctggatgatgcaggtggaccctgtgtcataaatgagaatctaaataagagaaacagggagacagggagtcagagtgagagaaggacatgtgacaatagaagcagaggtcagagtgatgtgattac

SEQ ID NO: 136262 - DNA, 1061 bp, Homo sapiens; identical to SEQ ID NO: 136261

SEQ ID NO: 136263 - DNA, 1061 bp, Homo sapiens; identical to SEQ ID NO: 136261

SEQ ID NO: 136264 - DNA, 1046 bp, Homo sapiens
atggccaagcagcttcccaaagtgtttataccaagttatagtcccaccagcagtgtatgaaaattacagttactacacatccgtgccaagcttaaggttatgtgctttttcattttcatatgcattttaagtttataaagtagactggaaccactggagctttgtgataaacaatgagacatcataaagtttgtagcaacagttctaatcccttgaattttagtctatgccaatgattcaggatggtattatattaaattagaaactctgcttaactcttgatggaataaaagttactgtttataatggaaaatcctgcaaaagtttgcctttcttacatttggagttgtggctttttcaagcgagcagtgtcggaccatttttgttagccagagggccaagtaagaaaaaataaaaaatatgtgcaggccgcatttttaaattccaaaatggaaatggctttcttgagacatggggaagaaacatacatttggttgtgagataacctgccatatcaagtggaagactggaggtgggaaagttggagcaattattggccagtaaaatgttactattggactatatttgagaactggctgtagggagacagctgtcatcctgaaattagcttgtcaaccacattgtaaagctaggagggctaacttccagaccaagacctttaagaggggctgttttagcagcccacctcggctttaacacttccctaggaggaactatatatataatggatccaggtccaggcctattacagaagggccagctgaaggaaagaagaaccttattcttagaaaaaaacactgatggtttccttttccttttcagtccaaggtttacactcgcacaccaaccttatatttggacttcaaattggacccaggagccaaacattcccaacctatccctaaaggtatgatgggttctggggtttagtagtcacgtcaggaaaaaaaaaagaaaagaaaaaaccaacaagaggctgttttgcctggaatgtgcttgtttctgaaactcagcacaaagttcta

SEQ ID NO: 136265 - DNA, 1066 bp, Homo sapiens
agcaaatgtaactaataaatattagaagccttgtgaggaatattctagcattggttaatagatttgctgactcagtcttggaacacattacccatggattggagttaacaaataggaaggctctgtgttagcctatttgggggccatttgtggttttattatactgttgcctttatagggttgtagatggattatttatataagacatgggaatttgttctttttctggttttaattttccaagaaattagaacatctgtaacccaaattcaggcaaggatgctgactcaaagggtgaagaaatcaaagtccagtttcacaattaacatgtctctggttaaatttcagtactgtgagtccccgtcatcatctttattctcttcccctttagtccttctttcctcactactcttcccataaataaaaggtgagaaagagaaggacaagagtattactactgattaaagggctacttgaaaaagaatactatagactgaatttggctatgtttaaaattcttggtcagctagacagcttgatgttcaagactgtccacagtcttttatggttgatagaagttaaaaatgtttttttggccctctctaactcccaccctacaaagagtcattggcattttgcctaagagttccttgtcttctctttgtgtaacacttcatgtatatgtcaaaatatgattacagagttttaatccttcccacgatacctttggcactggggatggaaactaatctttcccattgcttatcagaattgtttaaaacaatcaagaattcagaattcaaagtgctttggattggatacagaagacatcattttgttgaagagcatcagcctattctaaaaatgagttagaagtttgctttaaacagtatggtaaatctacttttcacttcctcaaagccttaccatctccaggagaaatgagaaagtatggctccccatgcaggggcaatgggatctggcagtgagtctcctgagtgtgtatggtagtgcagagactaggtctgtgctgatgcatttttatccccagtgcaaagcccaacag

SEQ ID NO: 136266 - DNA, 1066 bp, Homo sapiens; identical to SEQ ID NO: 136265

SEQ ID NO: 136267 - DNA, 1066 bp, Homo sapiens; identical to SEQ ID NO: 136265

SEQ ID NO: 136268 - DNA, 1013 bp, Homo sapiens
aggatccagagcctccgtaggtcacttaggtcaagcccagactctggagcttctggaactcccaccactgagaggacaatcaagacgatgtcagaacttgacagtcggctaggacaggccaaggcatctggcgatgtcaacagttgcaacaatgatggcacctacaggtctccataagaggccaagggctgaggagctataatgaggctgagcgactctgaggaggcatgtaaaatgtgtgcaattgaattctcacaatgagatagggaactgaaacatagtgaggttagcaacttgcctagggttacacatatagtaagtgacagaactgggattctaactggatggtctggctccagggtctgtgctcttaatcacatgctcacataggtccttcaccagtttggcacagcccagtagaaatcagattttttgttgagagaaggttttgtcttggaaacttttaaagactgaaaaggcttaagaggagagatacatgttgaagcgttcaaaaggaaaaccttggcccatctgtcattttgccaaggatctgaccactccctatttgcacaggaattcatgaatgatccctgacctgaattggggatatatactgatcccttgcatagtgctccagcctttcagcagatctggtcaattcttcaatttttctgagctggtgctgaatagcagggaactacttctcctcttgtttgtggatacacaggaggccatattcaatacttttaggacctatttgaatactgtatttagatgggttgatgtggtaaatttggggattggggagttgatcaaggaagagacagtttcatgagaagcagtaacatacaaactttatttgggcagtgctcagacaaggttgcgtaagagggaaagttcttcatagctggagattttccagagacagtggcacaaggccacccctcagaaaggaaatagggcaagagacctgaaggagtaggggaaatcagagaggaggcttacatgtccag

SEQ ID NO: 136269 - DNA, 1013 bp, Homo sapiens; identical to SEQ ID NO: 136268

SEQ ID NO: 136270 - DNA, 1013 bp, Homo sapiens; identical to SEQ ID NO: 136268

SEQ ID NO: 136271 - DNA, 1016 bp, Homo sapiens
taacactgaatatagggtatgccccagaaacttcattcctagtatttattccatcaaaacttcaccaagcagacatatgacagtggtcatcccagcatcgtgagtaatagaaaggagtcagagttgatataggtgttcaccactgagagaatgaataagtgaaatatggtggttacatatgatggaatatggtgtagccgccagaagcagtgggctgtattcacttgtagttattagctctcaggaaaaaaatgaggaataaatcagaaaagaaagcagtttagcacacaatactactcatttttcaaggacacccatatatctaaataaatacactgtgggtagattggaaggatgtccattacatatgctcaactgagagccaatggggaatggtcttgagatgggggatgatggaggaaaataacacaaagcaagaggggtgcccatggatgtatgatgaccctgtgccatggaatatagtgtacagccaattcaattccatgaacccagggccagagagacagagagagagagagagagaaatttgtgtctaacaccagcttttaacttggttggtgtaggtgacctcctgtgtggctgatttaagggattctaaaaagcccaacatatgacagaaaatctcactgtcatgttattaaaactgtaccattagagtccatccttcaacagtatgagggactgaaaggagcataggctgtggagtcaagcacacctgggttcaaatctcagctctgaccttgggaaatttgttttgagcttttatttcctcatctgccaagtggggatgataatacacagtccttgaggtttttgtagggtatttaatgtgcctagcaacatagagggtacttaataaatatttctttccttttcccttatctatcttttcttttcccacattcccttttatcattagtctttactgacagcaaatctctagaaattcttgggatgggaaatgaaagtggccaacatcttttatgggcttatga

SEQ ID NO: 136272 - DNA, 1016 bp, Homo sapiens; identical to SEQ ID NO: 136271

SEQ ID NO: 136273 - DNA, 1016 bp, Homo sapiens; identical to SEQ ID NO: 136271

SEQ ID NO: 136274 - DNA, 1057 bp, Homo sapiens
aggaggctgctcttttcttctcaagctcaggagaacaatattttgaagtagcattaaaaaaaaactattaaatcatggaaacaggtaacatatacgcgcacactttttttgcctttgaaatattccagcaagttcatggatctagctaaaaaaaaagaaaaataacagatactctcctaatggcagagagtgtgagaggggcactgggtttctgacatagggagcttgagtaaacaggctccagctgtcccagagagcaagcaaaggaaaaacaacacttgcttgggaaggaattctcccttccaaagacctctcttttaatttattgtatttataaatcagagcgctctgtgatagatttaaaaactggatatttaacaaatgttccctttggggtgagggtagcagggataaggatggacctgaaacttccctcagtatgtcttttaatttttacttttgaaagatagaaatgcttacatatttaaaatatcaagttaaaccagaaaagaaaaaagaaacaagtcttaaaatcaaaaacaaatagaaacaagtgaagaatctaaaattggtataaagatattggcaacataaccacacagagaaaacatttatttgaagggcttttaaacatgatgtcctggctgtatattttagtgggatatattctaaagacaaaaagaacagcaaaaaatattttaaactttactccatagtctttgttgttagtgttggttttataatttcataacaagttaatgtgtattatgaaataaaacaaattagtaaatttgttaatgtttatagaaatcaagattttcagtataagaaaaatggatacaaatataaaagagctaagaaaaatactgtaatattcaatgttaaattcaacattaaatagacattttaaaacattggatggccattatttctttgaggcagtttctggaaacaatatgattttatcattttaggagtccaagatttttgatgatgcaatttatgtttctttctgataacaactccattctccactgattatttccattgatttttt

SEQ ID NO: 136275 - DNA, 1057 bp, Homo sapiens; identical to SEQ ID NO: 136274

SEQ ID NO: 136276 - DNA, 1057 bp, Homo sapiens; identical to SEQ ID NO: 136274

SEQ ID NO: 136277 - DNA, 1086 bp, Homo sapiens
atctattaaataggactttttgtgaagattaagtgactttttatacattaaactctcagaatagtgccagacacattgtaagcatcacataagtggcagttattattttgattaatttacggtaacttgaacaggagctgggctgagatttatgtctgccatctaagctaaagggatttgctgtgatttgggaagggttattaacctgcactcaagaaaggacaccagtaagagtcattttaaagatagggagcaactggtgatttcgttgtgggtctcataagaaacatagttttgcacatctgaagccttaatatctgattaacaaggaatgactgggtcttaaaaggtctagacctaccataaaaagaaactgaagattgtttcgcatcaggaagacaattttaggttaaattacaaggtgaggctgagaatatatatttcaagagattagtgtatttataaccaatacagagtcaacaacaacttccatctctgcaactaaaatacctagaaaatggaattagcaataattccagcacttcttcaactttaatattcatgtgaattacctgagggtcttgataaaatgcagactctgattcagcacatctgagatggggtctaagagtctacatttctaacaggctcccaggtgatgccaatactgtggtctggggaccactctttggaacatgcataatgggtatgggatccaagacacaggagtttacccatcttgagaaatcatttgattaagctcctatagaagatgtcaaatgatctagtactgtgaattttggcaaatcttatttagcttttctggacctcagtcccgacatccacaaaaaaggtgaggggggttttgaataagatactgtcgcttttatgagcaacaaaactgcctttttgatactaccaagggtagctgtatgcctgtttcccaggttgtatgtgtctgagcatttattcaacccttggaaagccaagacagaacaagattctgccaggacagcatggtctaaagtgaaggctgaacagggagaaaaggttaaaatgggatagtttgaatagttcctgtcactt

SEQ ID NO: 136278 - DNA, 1086 bp, Homo sapiens; identical to SEQ ID NO: 136277

SEQ ID NO: 136279 - DNA, 1086 bp, Homo sapiens; identical to SEQ ID NO: 136277

SEQ ID NO: 136280 - DNA, 1743 bp, Homo sapiens
gttgatttcaagtgaggaagcacaggaagcatttgcaaaactggaaagggccccagcaattgtcactgatgtttattattcccctcgatgcccaggggctctgatagcagcactggtaagatgtctcacttagtgatggtgttgtaattgttccacctatagacttattaggagcttggttacatttccctcttgttggttttgtgtttgcagtggatgactgcgggccggggcattctgcacgctgagatgccttgctcagaggagccagcccatggcctacaactgtgggttaatttgaggagctcagagaagatggtggagcctcagtaccaggaactgaaaagtgaagaaatccctaaacccagtaaggatggtgtgacagttgctgtcatttctggagaagccctgggaataaaggtaagccaggctattgtgtctatttaacctgaggcatgcagtgacataaggctggccccttctggattgttagctctcactaggtttaccaaaattcatgtcccatgggatggacttgattcatagttgtcagaataagtgcaacctaagaaaactcagaaatttttcctgcctacaaacccatagagttaggaaaattacaagaaagcaagctcatataaagtttggtcgaggagcaattttcaaagtatgtcttaatatgtgtgctgatttagcctaattcctttcacttatagtgcaattttatgctttaaattatagctccttagtacagcaggattgctacctttaagaaacaaacaaccaaaaagcaagactaaactccacttcacaaagatttatgtaaattacttatgtccaacttagtaatgtaaggaaagcacactactacattgcagaaagtttatttttaaattttaacttgacaatttgtccaacccatacacgacatgccctgtacattcttttcaactgggactttatattatttggatttatagtctcacctttttgattaaataagtcaatttaggctaaagattatggacatatttgtgggaggaaaggggtgcggcaaatgccatgttaattgcacaccagaactgctcctggggagcataagattcctcacaccaaccaatctgaggtagtgtgttttcttaggtggggtttcccagaagcagaccctgagatgaagattcccatccaagagatttttaagtaagcgttcctaggagaacagtaaaaggaatcaggacaaattaggggaggaagtgaagcaaggctgccatctcaggcagagtcctaaagagggtggctttaccttgatcctgcaagggactttgaaagatcaacgtgcctcagagatgtccgagcccatccctggcaagggagccgggctttcatgctcccttacccaatggtcattggttatggccattaactttgaagtggaggcacagaaatggttaaaagggatctgaggggatctgggagaagccttgacatcgggtactacacatggaacctggcattgagtgcatcaagatagtgggagttactctgccattctcccagtgcacaaccagcacttaaaactatctaaaactaacttctgtaaattttaattttttgatgtgtaccatcagggataatggcttggcagtggctactaaccaaccactcaatgggatgcatgggatggttaacagattggtcatggttattggttgggacttaccagtttttgtatttcctgaacta

SEQ ID NO: 136281 - DNA, 1053 bp, Homo sapiens
agctatcccttctaacagaaggatctgggagggcttcagggaaaatttgcccatttagtaaggccttaaccaataagtaagatttgactctctggatagtggaggtaaaggtgaaagtcgcggtatggggatatagtagaaacagtgagtcatctaatcgggcttacaaatgggatgtggaaggatgggaggtggaggagtattatagggtctaaaattttaggttgggccattattggggaaggcccaagcttcgaagcccaagcttgatctctagctatagatgaatgaacaatatttcacatcctgaaactgtcaacttaacacaatcacgttaaaataaaaccatctttagcctaaaagttctgctttttgtggagtgctgtctatgtcagtggttctcaactggaggtgatttgtccatctgggtcatatggcaatttctacatttgatcttagccaaaagcccaagaagtgactcatttgcaatttctgtagtcatttctgagtgtcacaactggggagtgctactgccatctagtgggtagaggccagggatgctgccaaacctcctacagtgcacaggccacttcccacagcaaagaattaaagcctcgtctgtgttaacaagcgtaggtcacatgagggagagtagaaatttaactgaaatattctttgaaagtagtccaaataaattcccaacaaatttccctatacatcctacccacaccacattgcaattacaaacaaaaaccattcatgtcttaaaggctacattccaagagtttttaagtagaaaaattgagtgttgggggggtggggggccggggtgcgctgggcgcggtggctcacgcctgtaatcccagcacttttggaggctaaggcaggtggatcacttgaggtcaggagttcaagaccagcctggccaacatggtgaaaccccgtctctactgaaaatacaaaaaattagctgggcgtggtggtgggcgcctgtaatcccagctactcgggaggctgaggcaggagattcgcttgaactcaggaggtggaggt

SEQ ID NO: 136282 - DNA, 1053 bp, Homo sapiens; identical to SEQ ID NO: 136281

SEQ ID NO: 136283 - DNA, 1053 bp, Homo sapiens; identical to SEQ ID NO: 136281

SEQ ID NO: 136284 - DNA, 1115 bp, Homo sapiens
aactcacagcctcaagggatccatctgcctcggcctcccaaagtgctgggattataggcatgagccaccacgcctggcctgattggccttaagagactaaaagaagtagattggaagctgccacttgaattcagcagctaaaggatttagaactatttgaatgaaaagaaattctcatgtggctcaaaaacgttaaaagattgtcaatttgatatgtagagagagaaagatgtgaatgagttggggacttagtgaaaacattttagaaaaatcagagttttgtaaattagatcttgtctaccgataacacatgtttattttacatgctattgaattcctgctaaatgtttagagaatgttaggaagtttgacgaggactaatacccagtactgcaaataacactttagtacaacagtctaatgcaagatattcttactttttggagggaaagtgtgtcttacacatatcaccaattttctggcaagataatcaattcatccttctgactcttacctcaatcagccccctagcttcttcagtctctttcttgtgctggctttcttcctatgtgtgttcatatttcatggattggtgaccagaaggatcaaatgggcaataaatatgacaaatagtactgatttggtctgaatctatgtgtcttccctactcctaattcctatcatgaaacctaacactcaatatgatggtattaggaggggaggcctctgggaggtattaggtcatgagggcagaaccctcaggaatgggattaatgcccttacaaatgagaccctggagagctagctggctccttccaccatgtgggacacagccagaaggcactgtgtctgaaccagaaagttggaccctcaccagacaccaaatttgttggtgccttaatcttggacttcttagtctccagaactgtgggaaatagatttcagttgtttataatccagccagtttatagtattatgttatagcaactcaaacagactaagacagaaaattggcactgaaattgggatcattcttccattgtcttgaacaataggtcctggtttctgttttgatggctgacaaggctccttattaaatggtgaaatggtcattt

SEQ ID NO: 136285 - DNA, 1115 bp, Homo sapiens; identical to SEQ ID NO: 136284

SEQ ID NO: 136286 - DNA, 1115 bp, Homo sapiens; identical to SEQ ID NO: 136284

SEQ ID NO: 136287 - DNA, 1043 bp, Homo sapiens
tccctggttcaagtgattctcctgcctcagcctcccaagtccctgggattacaggcatgcgccaccacgcctggctaattttgtatttttagtagagacggggtttctccatgttggtcaggctggtctcaaactcccaacctcaggtgatccgcccacctcggcctcccaaagtgctgggattacaggctgagccactgcacccgaccaagaggttatttttcaaactctgcaccaaagcttctgtctctaaagaaatatctcataaactttggacccagagctattttagcatagtgtctacaacagcactcaatattcacagccgcaagtgttttgactcctttgactgcaaatgtggagatagaagaggaatatacaatgctctcactgagcctttctgtgatttaataacaaggaagagatggagtggggctggcccacacccttcatcacagttatacatgggccagcctagccagactggaatttgaatggctgagtagcataggtgctagggagtggttcctctgtgctcccagcaggagggaaatccactactaatctgcacttgcttctatgcccactcctgctaccagacactcctcggtgtaatgtgattctccatgggtcactcttatttttattttgttaatgaagaatttcaatcatcatagaaaagtagagaaatagtatgacgaatctccatgttccttgcatccacaatgatcaactcatggcagtcttatttcatccatattatcatccatttctcccctcaaagtattttgaagagaattccagccattattttatttcacttataaatatttcaatttgtatctctaaaagataacttgaaaaaaaaaactacaatctcattatcatacttacaaaaattttaaaaatcccttaatatcatcaaatagccttgactaatcttgttcttcactgatttagcctctgtagatgatgcttttcattatcaaggtctctagatattgaatcaaggaagtgggccatatagtcacagctcaagtcca

SEQ ID NO: 136288 - DNA, 1043 bp, Homo sapiens; identical to SEQ ID NO: 136287

SEQ ID NO: 136289 - DNA, 1043 bp, Homo sapiens; identical to SEQ ID NO: 136287

SEQ ID NO: 136290 - DNA, 1447 bp, Homo sapiens
cctgggtcggggacagaatggggactgataggggcgtaacctggaatgacgaaatgacgtttgctgcgtagggacgtggctaaacgtgagggggcgtggccaagatggccgcgtgcgggatcctcgggtaccgggagcgaacgaggaggttctggctcaggtaagtcgttcgggtaagggcgggcggcagtaaggagcgtgggcagcagcagggcgtggtctgcttgagagggcaggaactgtgccacttgccgcaaacatgaccgcgtgccgctatcggccctggagccagagaagcttttggtgcggcgaggttggccggggccctggcggggcttctctgaggaatgggagtgggaggctggcggcggggaaatagccacttccccactctagccctctttctccgctatggggatcaccagacatccttttaggattctgtctattaaaaagtagaacagctttcccagagacattgcgggatgagaggagtgtccagaaaccaaggagcagcaagctgggactccctcgggtctgcattgttgatattcccacctgactatgctaggggctatggacagacacagccaccccagagtagatcaaaagcacagttgtgtcccttggacaaatctgagtttttctgttgtgccttgccccagagccggaggagaggaacctccaaaatgcagacattcttggtggctgggattctgtgtgatattcagcgttaaatgctgctgctctgaggctgctggaaacgcgttagtattaatatctgtgtacttctctcacatttacttttgctggaaaagcttgggaaatgacttaacgaagatgcgtaaaccttaatttgtttatatgctccttattagccactgaataccacattgctttctgcttccccttcttctttactgataatctgaccatttccactatgcactttgaaagtcttgctggagtatggagaatagtcagaaatctctggtaagatgctgccccgcgcatctctcagaggagtcactattcatagcctgcatcagagttcacaatgaaccaaagttcaccccacctcccctgtcttcagggacttagtgaaaagctgcactgttcttgaatattttggaaatgaaaaactttctgggctattttaaatcagtacctgggctggaattaaccgaaaggcgaaacagcaagggcaccattctctgtgcctatacgtagctgccctgtgcttggaaccaagcaaaaaggctgccactgctcacagttgcaatggaataaaggttgagtgccttgtgattgcatatgaatattaaggaaatctgatggaaagagggaaattcatcatgtcactggccacactggggcagttagttgcaacacacaaatcaggtataatatattttgaaacctttggcaacctcagattgggatcaca

SEQ ID NO: 136291 - DNA, 1034 bp, Homo sapiens
gcctttctcatctcgttcccctcctggaaatacaaggtactatctgcagctggatgttgcagggattctccactgtggcacgatggacattggggatggatcattctgtggcgtgggggctgccctttgctcactggatgttgagtggcatctctgatctcttgccagtagcactccccaaatgatcacattcagatacgtttcaagacattgctaaatgtcctctgggagggagggcaaaataaccctgggagagaaccgctgagatgataggagagatgtctgtgatggtggagagttgtgtttaatgaattggctaaatatatcttttgggtttttttaatatattttccactattcacaatgaatttacatagttttcaaatactggcttgtttcaggatttgaggtttctcagattgtgctcttcgggtttaccctttttgaacctccacgcacataagaaaaggaattccgttaataatgttgatttagctggatccattgccttgaaagtgcttcagaagaattttttattacaagtttattttgttttatcccaacattgactatgttctcattgaaatgagttggtcggggtcataacaaatttatgattgctgggtgtgcccatatcctacccagactggcttattccgaaccctgggactgcattctaaggcttaacgtggaaaaaatttagtcatatttatctagttactaacgttttgtgtgagtgtggggtttttgccttgatatttagtttgtctttatttgcagaaagttgaaagttaaatgcctaaagtccaatcagtctatgccattaggataacttgctgcttttagtgccaacagaaaccaaatagtggtcccccgaggagatggggttcacttgactaatagctatattatatgatgtgttcttgtttctaagttactagaaaaacacaggtggaagtcaacatttgattttgtttgtggtatgtttcactgttccaacctgttttccccaaggagaatattgtggtctttct

SEQ ID NO: 136292 - DNA, 1388 bp, Homo sapiens
gagtcccatggaattgcactaatggcttcagggttgtcttcagctacctgggactgacgattagccctggaactgaccgccaagaaatgtgggcttttagtctcctgtgctgataactgcatgtgtattctatggctaatggactcagcatccaagtgccttttagagccctgatgctctaacaaggcaatttgtgatcctgcgattatcctcagccaagtcatacagagggtccctgtgtatacacccatcactgcactaaggccaaggcctacacagatggtcttcagtaacatgaggaaacagcacatccctcgtaaaaagggtggtacatagcaagggaccagataaaaagcacatgagggtatagggcaacattgtcctatagacatataattgagccacatatgtaattctcagttttctaatagtcacattagaaaaggggaaaagaaaacaggtgaaattaattttagtaacattttatttaacccagtatatccaggatattatcactttaacatgtgatccatataacagttattaccgagtttacattgtttaccttgcaccaagtcttcaaagcctgttgggtgttttacatttacagcaccactcatttaggattgaccacgggggcagcatggaaacaccagcgtttggaaagaatgaggagaatggttagataagtgaggagggttctactagaaaaacacaggcacttggacacagaagtttccacttgatgtactgtctttagcacaggagcaccctgacaaagccggtaatttgggaaaactgagtggctgaactcagggggtaaagggaagtgagaaaagaggacaaatgaccaagaggctttgtgtgaagtccatggcgtagagttcagaactaggctagtggtctgggcaaggcgaggaagagctaaacctgaacgattgttaaagaaaaataatgtgatcagtgggggtaatgggaaataaagcaaaaagaagcaaacttcttcggtgatatacttcatctgattcatttgatccaccgtagttgttgaaagccagcttgcttgcagagcagtgggggaggccgataactaagtgcgtgtgcatataattataactatacccatgtaataatgttgtgaaggacaaaaccagaatgctgtgattaaaaattcaaggggatcatgttataggagggtagtcaaagaggagaggaggtgacaattaaggcaataacaggagccagtgccaagtggaatgaggggaatgattccagcagaggagaagaatcaggaaccgaggggcttgaggcagaaatgagctttctacatttgaagagcccagggacatacaaggaggctagagaaataggtggtgcaagcataaaat

SEQ ID NO: 136293 - DNA, 1048 bp, Homo sapiens
caaattaactagagagaagagttaaaacacagaagaacataagttttttacatttatatttgacaattacatatgtcttcttatgccttgtgtattttatatataaatattaaactctatacaaaatcaagacccttttaaagggaagagtgaaggctggaaatgaatgtgttcaaaactgtttaaaatccttaagggaattctgctatggaatctcaggataaatacagaattcaacaatgtttgtccagaaactttaatgtaagtccattttttgaatttgggatctatttttcccttagaaactaagtctaagtagtatttactatgcaaacactcaaaatcctgtataatgtataatataaactacaataatatttactcatacttgttttatgggatttttattgattataaagcattttcataagaaaaaaagcttccaaattctttttatgaagccagcataactgataccaacactcaccaaagattggacccccctctgaagaatataaaagaaaaaaaagctaaaaagaaaatattagaaacagaatccagcagtacatcagaagaaatatacactttgtccaagtagcttttactccagtaatacaagtatggttcatgttaagaatgatattaatgtaattcattctatcagtggatctaaatagaaaaatcatattatcatttccagggaagttaaaaagacatttgtaaaaatcaccattcagtttttgaaaatttttaataaaacagagctgaatagagacttccctatcttgataaaagagattgatctcagttcaaaagcaaatagtaggttttgaatggaaaggattgttaccgtattaagttttatattaaattacattctggaagtagccagtacagttagactggaaaataaaaaataaattagagaaacaataaaaaacgactacaaaaatcagagataatttggtaatcagtggaatacaatatcaatttctagaaatcaatacatttgacatatataaatcacaatcagctaaaagatatgata

SEQ ID NO: 136294 - DNA, 1082 bp, Homo sapiens
catttatttttaacaattaaccactgaattcattttcagaaataggcctgaattgcttgttaatttcattacaggaagtaactctaaaagccaattccacttccaaactataattaccatcatctgaatttaacagggaaagacatcttccaagacttcttttgggcggatgcttagttttagaatagccaactttaccctaacccatgtacaagacagttctccaggtggccttggactgacccagttctcccttcttccttgcttgtagttcttaagaataactgtagaatgcactgggaatgcaatatcctgatatggaggaactgcctgaaacaggttggccttgttgttgtccctcctagggaatgtaacatcttgatttagggaactgtttgagacagcgaggttgtgttcctctttcccctggaaggaggatgtactttaaagctttgcccaatgagttatgtggctcctatggtatataacccaaggcaggctgtggtgcaagtggggcacgtacaatcaagactccatcagccccgccctgggcagctttcttgagccctgggggactggctcacaatggagccagggcctcttttgtcccttgcttcctgtctgtaagtaataaatctgcttcatgtaatgtattgggtgtgagtgtgttctgtcacaatggaatcagacaggttggtaaccagtgtacactgaacctgcttggcaccatgtagccctgggaaaggagaaaggcggtcacagcttgccctatatggtgatgccagcacactgtgcactgtactgtgcaacagaaaaaggtgcactgaggaggatcggctgcttcttcccattgttgcttctttagtaaatcccctatgagtttttagtcgctttctaatctacaagttaaaggatatctcattaattttacagatatatacatatactgtaacaataggaaggaagtctttcaccaaccactaatactgtaaagaaagcattgtatcgatctagtattatttaatgaagacggacagcaattttaatacaatcttcttttccaagacctttgacagacctta

SEQ ID NO: 136295 - DNA, 2611 bp, Homo sapiens
gacgaagtctcgctctgtcacccaggctggagtgcagtggcatgatctcggctcattgcaaactccgcctcccagattcaagcgattctcctgcctcagcctcccaagtagctgggattataggcggctgccaccacgcctggctaatttttgtatttttagtagagatggggttcaccatgttggccagcctggtctcaaattcctgacctcaggtgatccgcccgcctcagcctcccaaagtgctggattacaggtgcgagccattgcgcccggccctcactaatttatttttataactccatttcttaaaacctgtagctttattttaaaaacatgattacaatgtacttttattttccttcttttggctgtttaggtgtttggaggcaaaccacaggagtctcttaactgtgtgtagtagtagtccaaaggtttatggcaaaggatactgggttttcagcgtgctgccatcatggaattgctacttttaagaataggggctgggtgcagtggctcacacatgtaatcccagcactttgggaggccgaggcaggtggatcacttgaggtcaggagttcgagaccagcctggccaacatgatgaaacgctgtctgtactaaaaatacaaaaattagccttgcgtggtggtgggcacctgtaatcccagctactcgggaggctgaggcaggagaatcacttgaacccgggaggcagaggttgcagtgagccaagatcatgccactgcactccagcctgggcaacagagtaatactctgtctcaaaataaataaataaataaaaataaatgcatagaataggaagggaaatgctttctgaatatgaaaaggtagatgctgctttgaaacttgctacccattttattgtcacctaaacatcactgtgatcagtctagagggaaagtcatagtgtccttttttctgtaaagtatgtcacagccatatatacctatgaaatgtaagagagattttaagttattacccattaggaagatagttgctgacacgtggtgcttttccaaaagctctgctcttctcgttctcttacacccacttgactgctttaatagaaaatagctttcgtgatatttgaatcagtcccaaaatgtgtcattttgctctcgtgtgtgtgtgtatttgtggattaatgcccatttcttttatctgattacatcattatactgataggcaaagattacatgaggagtggttgctaagagagcagaaggcacaagaagaattcagaataaagaaggaaaaggaagaggcggctaaaaaacggcaagaagaacaagaggtatggtaggaatcacgtaactagtgaacaaactgattacttcaccataataactctcatgaagagttgcctatcttgggaggttggagtgagctgagatcacgccattgcactccagcctgggcagcaagagcggaactccatctcaaaaagaaaaaaaaaaaagagttgcctatcttgaacttaaaaaaaaaaaacaaaaaactgatcttattcagtttgccagtgttttaagtttttcatctatgtgcgctgtatgtgaaatgtttttaaaaagtgactgaaacaaagttactttttcttcccctttaaagagaaagttaaaggaacaatgggaagaacagcagaggaaagagagagaagaggaggagcagaaacgacaggagaagaaagaaaaagaggtgattcctgtcatgggatgtgctgtgtgatgagtttgaagaataatcagtaggcatgtcagagtttgggttttttttttctctttttcttgtcatttcattgtttgtttggaaagaatcatatttcagtttagacataacaccagagttcccttctgatgctcttcttcgggtccgtgcagtggcagattccttaaagttttcttcagctttaccctatttaccctttatactgggcattggcaaatgttgtaaagggccagatggtaaatattttaggctttatggtttggtctctgtggcaaacatccaactctgccagtgtaccctgaaagcagccatcgataatatgtagatgaatgggtatggctgtgttccaggaaagctttatttacaaaacaggcagctagcccttgctttatagcaagttatgttcttctgaggttctgctgtatatgagttgacttctttagagaataatactttgttttgtttccacatttatttaggtcataagagaactgcttatgacatgtcagcaagaattagaggatttaaagaaatcaggaactcaaatattgaggaactaggaaacagtttttgttatttgtattaaatcttgacttcctcttccacttaggctatgaagataattgtagctaacacacagttgcttatttaaaaaaaaaaaaaaatctgtgaggcatatgtgtgtatgtatcttctctatcttccaggattcttttttaaggattgatttggtatgttttgctgctattccttgacagtatatttatttcagaggtatcacagctcatcttcccttgactgattcatcaggatttgtcttttttgtaatacagctaaatttaaatagcataaaattggataat

SEQ ID NO: 136296 - DNA, 1251 bp, Homo sapiens
ttttgagatggagtctcatgctgtcgcccaggctggagtgcagtggcgtgatctctgcttactgcaacctctgcctcctgggttcaagcaattcatatgcctcagccccccgagtagctgggattacaggtgcctgctaccacgcccagctaatttttgtatttttagtagagacagggtttcaccatgttggccaggctggtctcgagctcctgacctccagggatccacccgcctcggcctcccaaagtgctcgtgtgaaccactgcaccagacttttttaacagatcatttttactttactgaaacctctgcctcccgggttcaagcgattcttctgcctcagcctcctgagtagctgggactacaggcgcccatcaccacacccggctaattttttgtgtttttagtacagacagggtttcaccatgttgaccagaggacaaggagagagagaggaattcaagtcatatttttaggtttttagtttgaatagacagatagactggcaacactattcactgagggagcattcaggtggatgtgggccagggagtgtagaggacaagagttctgttttgagcaccacaaataagcaactagacatacgagtcttatgtaatgctttaaggggctagggaagataagactgtctgttaaacataggtacaacttgttcaaatgccaattaggtagaaatttactggcatattgcagaacctcctttgccttattaaaaagttagaattttctcctaaatgctaattaccactggtcatgtcatattttagcttctgctaaatgtttatgatttcatctagcattgttttttgggttttttcgtttgtttgtttgttcgtttttttttagacagagtcttgctctgtcgcctaggctggagtgcagtggcgtcatctcggctcactgcaacctctgcctcctgggttcaagcgattctcctgtctcagcctcccaagtagctgggattacaggcacgtgccaccacacctggctaatttttgtatttttagtagtgacggggtttcaccgtcttggccaggctggtctagaactcctgacctcaagtgatccacccgcctcagcctcccaaagtgctaggattataggtgtgagccaccatgcccggcctagcattgtgttttatattcactaatacccccttttacgaactaggacatggtatatatactcaaatatactaagtattactattattgaaactattataag

SEQ ID NO: 136297 - DNA, 2089 bp, Homo sapiens
ccaccacgcccagctaattttatatttttagtagagatggggtttctccatgttggtcaggctggtcttgaactcctgatctcaggtgatccacccacctcggcctcccaaagtgctgggattacaggcgtgagccactgcacccggccttcttggaccctttttagaatggatggaaaccttggcgactgcccctggtggcagtagtgataccagataaaggaaagtgaccaggagccaagagagacatggagctcatgtctcagtaccgttgtttgtaaagtcttgattgcctgttccaacttaaatgtttgcattattaaatgaaacaatgtttatctttgaggaaaatattttaatatactttgaaacatttcgtctttcatgggtttttactccaccagtaaagtcatggttattttcaacagttggaaaatggtaccacatggcaaaacccagaaccacccgtggatttcagagtaatggagaaggatcgagctaattgtcccttctacagtaaaacaggagcttgcagatttggagataggtaactaattttgttttatcatgtcagaatgaagtgattcaaaatgctgacgtttttgagttccccttttgggagaggcgcatgtttccatttcaaatgtccgtcatcagacatctgctgccttcttgctgctgctctcgttttcccagctgatcatcctctgctttgaccatccctgttccctctatccttgttccctgggtgggcttagcctagttctctgagggtgcttcctttgcattctgcatctttaggaagccactttgcttgttggtttcttcctgagcttgcattagtccatggtggacaactgggttggggaaataatatatttgaagagcttagagcagcttggctttattttttgaagggcacacactgtccccaaaacaggcttttaaaacttggcatgtgccaggagttccaggctgcagtaagctatgaccacaccactgcactccagcctgggtgacaaaacaagaccctgtctcaaaaaagaaaaaaaaaaacaaaacttggcatgtgtaaagggatatctgtgaaagacaggatccaaatgaggagaggaaaagtgttttaatttctgttgtcagtgagtgtgcccagactcaggtacagaccgttgggttcaaaacgggcttcagtggctgccagtttgggaaagttgcttaagctctgtgtgccttcgttctctcatctatgaaatgggattaaacatagtctcatctttctgagggggctgtgaggccgaaatgagcacacacacccgtagaacagggccccaggagtgcttgctggcattttcattattgtgactcttgatgttattctgtgagacactcttcttgttccctgccccttttgggtcaatgtttttgaaagaagacgttcatgtggaaacctagtgttgatctcttcagtcatttagcaagtcttcgaacacctattatatgccaggtaatggtgatttttataatttggcctgtttattaatgaacaacttaaagtaggtaaataattcctaatggtgaatgagtccatctgaggcaaaatctgataattatcaccatatattctgcagaagagaagatctaatcataaccttaacatcctattaatcctgaaaagggatatgaatagtaaaattcagatgtatttaatcagaaaccatatgtcatctgtcagctttactttattcataaaagtatccatgctgtgaggtttttttccttcttcttcttctttgaaaatatatccttctctatggttctctcctttttctttttgaatttaagcgttcacaccatttttcattttttaagaacagtggttcccaaccctggatgcacattagagtcatctagaaagctttaaaaaattatgtcctacctcaagttgagtaaatcagaatatcagggccaggcgcggtggctcacacctataatcccagcactttgggaggccaaggcaggcagatcacttgagctcaggagtttgagaccagcctgggcaacatggtaaaacctggtatctataaaaaaa

SEQ ID NO: 136298 - DNA, 1012 bp, Homo sapiens
agaattttaacctcattaaattagttccttgtttaattctctgcatgcttcatacttataacattttgattcactgttagtgttgccagtcaggttgagtctttgctctttgttctatcagtagttgggaagagggatctaattacaaggtctctaattgaataatccaggaggtcatttggaaaatagaaaatttcacgttaatgaacgttgatgaagcatttctgagctgagcatggtgtatgctgggcattctgtaagcattatctcagtaggtgcttagatagacattacagacatggaaagtgagtattattaaacatttagtcatttcagggccattgttgttttttcccaacacgtcctattcttcaactttctttcttcctaaattctgtggactcccctcgccaaaaaaaaaaaaaaaaaagtttttgtcttaccaatttttaactagcaacctaaccaggaaaattttgtttatttggaaccttgaactacatttttcctccacattgtatgttaggagaaggaaggaagtaagaaagtaaactcatatgaaggatttttgaaatattactcaggtacagcctggtcagcttagccttggtccagtttaaactatgaaaataaaattgttcttcataatggttggccaccttcattaaataagaattaaatgatgcaggtatggtagctcacacctgtaatcccagagctttgggaggctgaggcaggaggatcacttgaagccaggagtgcgagaccagcctgggcaacatagcgagaccccgtccctacaaaaataaaattatccgggtgtggtggcatacgcctatggcatgcgccagctactcaagatgctgaggcagaaggatcacttgagcccggggaattcaaggttgcagtgaagtatgatcataccattgcactccagcctatgtaacagaacaagaccctgtctcaaaaacaaattgtatttattacaccccatcgtgaacaggcaccagat

SEQ ID NO: 136299 - DNA, 1032 bp, Homo sapiens
tctatctcaaaatttaaagcaagtgtttttttgtttgttttttgtttgagacggagtttcgctcttgttgcccaagctggagtgcaatggcacaatctcagctcactgtaacctccgccacccgggttcaagtgattctcctacctcagcctcctgagtagctgggattataggcactacaggcgcacgccaacacgcccggctaattttttgtatttttagtagaattggggtttcaccatgttagccaggctggtctcgaactctggacctcaggtgattcacccgcctcggcctcccaaagtgttgggattacaggcgtgagccaccatgcctggtctaaagcagttgttttgtgagtaattttcaactattggcctagtgaatttaagcttttctttcatacgcagatgttcacgtaaacataatttcccaacatccagtcctacccttcttattaagagcatgtttacgacgtttggaatggagcagtgcaggagggatgactatgaccctgacgcaagcctggagtacagcgaggaagaaacctaccaacagttcctagacttctatgaggatgtgttgcccgagttcaagaacgtggggaaagtgattcagttcaaggtgggcatgcgtgtggaggaggggactggtttgcttcaccctgcagtacttaatggcacaagagagctgggacacaggctcagctggggtcaggcacgctagcactctataaatgtgacttccctctttctctctttccaccccctaccttgttgccaatgtcacgtcaataccacatgaaatcataaacatatattagcatggtatttcctgaatgctaggggtctagattggaaaggatctttcatttatttagtagctttgtgctccagttcttttccagcacatgaattctctgtatcaggtcccctgcatatagccatccagtccttcacttagaagctgcatgtgacaaacggtgcattcccttccttcctctgtaggtggcttccgtgtgcagtgtgacac

SEQ ID NO: 136300 - DNA, 1030 bp, Homo sapiens
agtggtgaggcatagctttttgcctcacacagtagatgagcagagaactttatataaagaacaccacagtttagatctgtaaccgacctcaatgagtcacttgatagatgaagtgactgaggtcacaacgtattggtgacagaggtggggctagaattccagtcttccaatcttcagtcctgggctctgtgtctgacaaatcaggaagcctgaggagtttacgtctgtggaagccccatttcccttgttgcagtttcagaggtattttatattcattggctcacttcacttgagctgtttgtttgtttctttctttccatctttatccctaatgaatcttctgtcatgaccacctacgttaccttgcccatagcatttcctgccttacttggaataatacatccttctgtgcactagagactaattgtaggcttgggatcagttaaacatgaatgcagtcagactgacatcggacagtggcaacccaatcaggaaatgatccagtcttgtgcagaatagccagcagttttgaaggcctagttatgttctgatttctctcagtggactgttccctaggtgaaaagagatgagctctaaatgcctctggggagcacttatcttaccgtttacttgtgtttctttgctgtatacatgcctgcctaacgcaaagtcagaatctttggcaagcttgtcttccttggattctgtcattctgaaaccatttatgaagggaaaagaaagattttaggattcctggctaagggaaaccagaagaaccattacactttaaaggctcgggggatggaagaggtggaattgttcgctccataaaggcagttacttttgtcagttcctgggaatccagtgtgagttcagtgaggagcttctgagtgtgaccttgactcctccaaagcaggggactatttcattaaaaaaaaaaaaacactttattttccttattgactaaagacactgagcatcttttcattattggccatttgtatgtcttctttggagagatgtctgtttg

SEQ ID NO: 136301 - DNA, 1125 bp, Homo sapiens
ttgaagaaattggactgacataactctcctcccttgttgatgacttcttgtggcatttcacacactgtagatggtcactcccttcatgtccatgttagctcatggtgtaagatgatgtcttgtcagtattactgttttgctaagccgcttcattcatgcctacacaatttttttttaaaagggaactttagttaattaagtgataagggacttaaatatgaattagaatggtgcagaaagagataccttttctggatattttaaagtttaaaggtcagtttctcttaatctgattatgtgcacatatgaaaatggcacatcatatacatgtaaaatcaggcagtatacatttattaattactgtatttgacaaaggaaactcttaaattataatgtgaaacctggttttatgaaaccaaagactagtgcagcatttcagcatatgtaaaaaaaaaaaaaaagggaattgacatgtcacatatcaaatgaatggaaactttgttgaaactttaaaaagcaaatttactccaaagacttgtattggaaattacataccttttttttttttttttaaaggactacagattatttttaatgactaaattggagtgatacttcttacactaaaaattatttcttaggcattctgaatctgggatgagaaacaggattgtttcacaatagtaagcacataatttttaaggccaaggcacatttgactcctgagatgaattttttgtggtcataatcaaatacttagttgtttttgatgccccaaaataaagtgagaatggtaatttgccaggaattcttcataacagtatcttacaaaaaacgtgttgctctcttcacagtattatgtgtaaagtcattgtttaaagcacgaatgttccctctggggtacttgttaaagctaaatttattttgcttccctccacttagaagtgctgcacactttacagcagcttcctttctttccatggcactgcctagttaacagaagtcttataaaaatttaaaaagacacatttcttacaaaaaagagttgaatgaggtaaaatggcattagatggctctatattttttaaagctatgtaattgttcagcgtcacttttctaagtact

SEQ ID NO: 136302 - DNA, 1649 bp, Homo sapiens
ctgtaatgcacgacatttgaagcacctggatgtgctatcaatcaggtgggaaatttagcattatatattggaagcattgagaaacattggtctttcatttctatttttttttcccctcctttcctcctcctgccccacaatatattattcatctggttttaatgctacataaatatgcattgtctcatgcctgtttgtgttggatgccttgtgctaagctgtaacaaaatgttgcttcttttgctgtctgtatacagctgcttgctttaaattagtagattctgaaatagctttccttgcatgtctaaaataaaagtattgcatgtacttcgtctcatgtgaatgactttttcttttccatccctcataaaataacgttttatattttcatttttctaggcaaattttttaaattgtggttaaaaacacataacacagaattcaccatcttacgcagttttaagtgtacagttcagttgtgttagttaagtttattcacattgttgtgcagcagatctgcaggactttttcatctggcagaactgaaactctatacccattaatcaacaattccccatttctccctgtcccccagcccctggcaaccaccattcgactttctgtttctataaattttactactttagatagataatagtttttctgggtagttttgagctacaatttcagtgtgaacatgtgtaagttccattttatattatcaccacaatttattttaaaactctacctgtgcaagtctcacaagaataaaatgtgtaaataattctttgaaactaggccttttagaaaggacacatattttcaataatgcatatttgataagcagtatgattctctacaggaaatgctatataagattgcaggcagtgagcacatggggaaaagtctgaccagctccacggagtagctgtggggcatttttacatggagaagctgagaatgtaaactgtagaattcaatggaggcattatttaattgatacattcaaggctacatgaacctttaaactacttaacattacatggaaataattattttaaatttttcttgaatatttatgagatttagatgtcattctcagtgtatttaatgcttaaggctaaatataaatgaaagggattggcttacatcactcttgggtgttacatcatttccagtggactttcttaaaaaactttatcatgaaaacttcaagactcacgagtataggaaatagtataaagaaccctcgtgtacacatcactgagcttcaagaaccatcaacttaatactgtttccccaaccactccccgcatttttgcctcagtatcttagagcaagccctagacatcttgtcagtttgtctttaatacttcagtatgtgtccctaacagataaagtaccatgccccacaaaattaacaggaattaataattactatcttatgcctggctcaatttttcctaattgtctgaaaaatgcctttttatatttggtttgttagaatcagattccaaccaagactctcacattgtatctgattgatgtgcgttttaagtctcttttaatctttaacaaatcgtctgctttttcccgccttgccattttttttttttaaaacgaggtcatttatgctgcaggatgtccta

SEQ ID NO: 136303 - DNA, 4432 bp, Homo sapiens
ggggaaagtggaagtgcatgttttctaagaaggacaaataggaatagaataaaagaaaaagtatattggggctgggcatagtggttcactatgtaatcccagcactttgggaggctgaggcgggtggatcatgaggtcaggagttcgagaccagcctggccaagatggtgaaaccccatctctactaaaaaaaaaaaaaaaatacaaaaattagccgggcacagtggtgggtgcctgtaatcccagctactcaggaagctgaggcaggagaatcgcttgaacccgtgaggtggagattgcagtgagctgagatcaagccactgccttctagcctgggcgacagagcaagactctgtctcaaaaaaaaaaaattatatatatatatatatatatatatatatatatatatatattttggaagggagaatgggagtggaatcaaaaacattggtctcggatgagaagagtctttctcattggttatgtggtgataatggggtaaagctgtagactttttttttctttaattcatgagtaagatgagcaaaattgaggaagtgtcattttcttggccttgagaaatgacatcatctaaaggagaatcgttgggactggggagaaggggaggggtgtatagcttgaggacagtgtgaggagttggcagtagacttggtggggagcaaattagtgaggagcaaaaaagatttcctgggattgaaagcccgtttcaggttgaaataatacattgtcatccttattcaaagaataggtctccagagaacctgtactaaggacaatacatggtttatagttgtacaatacaactggattaaaaaattttttctcactgttttcattctgacctttattcccacttaattgaaatcactggggttttagtgttttaagaaacggatagtttgctgagtattatatgtgactatttcctacgggtgcccaggggaagaacaagatagtaggcctaggcctgcacagggtcccttgtgtgctatgacagactttactctcaccctccctaattcctaattgatataatttttatgtgactcacaagaggtactggtggtaagaggtataaactggaatttataattgaatctactttctttgtatctgaaagaaaaatattttggttaattatgggcatataatttagctaaaaaattaccttaaatgttaagtggtccttaaggcatttataacagaactttttcagaccctagaagtctaaactgggaaattatttaaaacgttattaaagcaatttaaaatggtaaaaataatacatttatttttgtgcattttagagtttcttttcttcttgaaggatgtttttccagtgaagaggggtttctccctatgaagagtattctcacatttaatagatggtaatttcttacttaagtacagtaatatggatcaatggctataaagaatagtttggcttatcatcaacccttttctttcctaaaagcagtaaaaggtgtgtcagggtataagtggtggaaatgcctgggtggtcacattgagaattgttcctgtagaattgctggtgtagttcatagtaagtctcctggggaggaatggttgcatactccgccctgtttgggaaaccacctcttctcttttaatgagcgtaagctctcgatggttggtttttacatggtatgatagaaaattaagagagaaaagaaaaagatgataaactataatataaaggctcaaagaactggtattatttaggcaaaaggttatttgacagattggtattatttaggcaaaaggttatttgacagacttaaacttttcttgttctctctccagaaaacagagactatgtatcacagcaagagtttcattgggtttaagaaagcgtactagaatacgtgctggagtactgacatgcatcaaaatgtagtaggatatataaattcagtttgtaatgacaattttgtcaagtttgttatttatattttagcattacctgaaaagtctaattacattaaatcccaagggatagtcccaattacttcattaaactggtattttcatagggaattttgcttggataatgatccattattggggcttataatttattttttacacagaatatggaaatagcttcagaggttcattgacaataaagcattcattaaatactgtgaatcactaatgccattgatacagaagaatttccctatgaaaatgagagcttctgtgagaaaatgaagtagttgggagtttaatttcttattaatatgattttaacttgctgcttcattccactatattctgagttgggggaaaagggcagctatctctttaaaatatttaggaattctttgaggattaaaatgtaactggcttttgtcctcagatacgtttgtaattaatggttgtgtaagtttagggatttgttagatatttttcttggaacagtttacatgattttgtagttcaacatttcaaagtttcaacttgaataaatattaaaatgaggatactttaaagacactcaaataagcaattttaaacttgctttctggtggggatataatccctttgagagtctgaaggatgatgggctgtcaccccaggaaaatttgcacatcattttgtttctaatttcagggaactctcagagcccctagaagtccttctgtagacactcaaatctggagagttcgttaaaatctgtcttgaggatttttaaaaaagtaatatcctcagtctcagtcaaattctttggattttttgcttttgtaggtataagtaaacggttaaaaaccttcattgctacttaaaataccagatgagtgactacttttccagtttttattgggaaagatttttctctaggttctttagtttatgtaatacaaatgaactaatgaatttaaatactggtggaaggggaatattctaattgaatttttggtcaactcagtattgaccagatgacttacactgaaaatcttttcataatattagtagtaaatatagtgttttaggattttgtaaaatttctggaggatgtctgtcatcattttgaacactgtatgtagtaaagttagaaaaaaatgaatctaaagtcttgggcattgtttagaagttaaatattcagccttaaaccaaagaatgaaagcaaacagaaacttaagttttagttatctttactgtgagctaaatgttctagaaatctgattgtgtctgtgtcagtttgtatactgtgtgtaagaatatatgcatttcttttgtagccacgtcatgaatattttaatgtccctgtgtactaaatgactactcatcgagtatgcagaatttcacagaggaaatagaatgctgatatacatatgaaagaaaatatcctcagcatggtgatttattgtcttgtataataatagtagaacattttagaactagtacttttatgattgtatttttttcctgttcacattccaaacttttctgttttattttcattctatatgtgatcttgatacagctcattcctttctgcaactgatttaatctcatcttgacaaaatatgacctagaagtgttttgagtaatattaaatcttaaacacatacatattattaatgaaccatctgtgatttatcttataagaggaaaacatgacaatcattaaaatgtttaccaaagaaaatatagctgaagtgctaggtcaaaataagcagtgccataatatatagtgtagtttggtcttcaaatatggaggttaaaaaaagaaactattttgtgtgattatcttacaatctgtatgagctaatgtgttctaatgtatcacataaaagtatatgtgaaaatattacaagaaactaaaattaatttgtaccattatataatatttaaggttaaaacattcagtattaagaaattttgtagtgccacatttattgaatcacatttgtgctatataataatatcaaacaatccctttaagaacttattagagagctatgtctgaagtctgttctgcaatatctgttgctgaataataactctttcaaagcattaatgctgagtttatatagttcaaaaattctaatattcattcagttttaatacctaaatacttatattttactagtgatggcattctaatatattaagtcctcatttaaatacttgatactttgttaactgtggcattatatttctgaattttaaaacctttaatattggtaactattgcatattcttttaataaaacatgcagcatatttttttataaaaggaaaagaattcattgtttatatctagagagcataaagcctaagttaagtaagttattaaacaataacttcacaagatgttcaaatcgatttatcactgaaagaagatctatgaaaatgtgttttgaccaaacttagtattaggcagg

SEQ ID NO: 136304 - DNA, 3102 bp, Homo sapiens
gatcctgacctagtaatttgatttcatgagccctagggttggaacctgcacagggacctgcaaagggaatagtctgtggtgtcggtggtgattttttttttaattaaaaaatactttctgaaaaatgtcacgtttgagtccttttttcacctactgacattttcttttgtttcctctgagggcctttttttaaaaataaaaattcccattctggaaaaattagcaaatacaggcaaacacactagaatataatcttacccaccaactagagccaattagattaactcagtggttcccatggagtgggagtggtgcagttgtgcccctctaggggacattgggtaatgtttggacacatttttggttgtcacaattgggggtgcagtgctaccggcatccagtaggtgaagaccaaggatgctgctgagaattctgcagtgcacaggacagcccccttagaacgcggaattatctggcctcaaatgtcagttgtgcccaggttaagaagccttggtttaatttaacactatggagtaaagattccatttacatttatagactgctatatcttttcaatattatatgtagaccacagtataaataagtggctaaaaattaatcaaaaatgcaaaaaatcaagaaaggataaatgtgcttaagaacatacaaatagctataaaaatcattcctaggccaggcgcggtggctcacgcctgtaatcccagcactttgggaggccgaggtgggtggatcacaaggtcaggagatcgagaccaacctggacaacatggtgaaaccctgtctctactaaaaatacaaaaattagctgggcgtggtggtgcgtgcctgtaatcccagctacttgggaggctgaggcaggagaatcgcttgaaccagggagtcggaggttgcagtgaagcgagataacgccactgcactctagcctggcgacagagtaagactccgtctcaaaaaaaaaaaaaaaaaaaagtcatctctatgattcaccaaaattacctctacataatgaccagttactggggagataatctatggttgactttagaatccaccctacagcaaggcttgtaggatgtcactctataatttaatttcctcaacaacagccaaatctgttaacttctattaaggtaattgagtttttatgtggaaactgaattgagtataccctgcagacagaacacctttgaattttctgccaatctccccagccactttagggatttgttaatttcttaaaggaggaatagttcaaatgaccagaatttacatatatagacttttgttgcatatatagactttttgttgttgttgttctctggcatcctgttagccttaaaggttttacttagtgaagatatttagtagcatttgagtatttgaaattctgtgattccaagaaatcttttacctttgaaaaaccctaatttagggtattccaaggcaaatacaatacagcatgtcctaaaacatgcttaaaatatttctttgcagtctaaaattatatttgctagctgggcacagtggcacacttccataatcccggctacttggaaggctgaagtggaaggatcccttgagctcagaagtttgagaccagcctgggcaacatagtgagacccctcactcttaaacaaattatatttgctaagttaattattctgcttttttttgtttgtatatttgttttgagacagggtctcactctgtcaccaaggctggaatgcagtggcaccaccatggctcacttgcagccttgaactcctgggctcaagtgatcctcccacctcagcctcccgagtagctgggattacaggtgcacaccaccatgcccagctaattttttaaaaattttcagtagaaatggggtctcgccatgttgtcagggctggtcttgaactccgaggctcatgcagtcctcccaccttggcctcccaaagtgctgggattacaggcgtgagccactgcacctggcctctgcttttttattttaaaagcacaactaactggtagataaagtgatttgtctttagtatttgataactaatgggttttagagtgttatttataagatgtagtaaattatcctcatcattatttttaagacaaatttataagacaagtgtaatagaaatagatcaacagcacaatagaaaaagatggcagaaaacatgaatatgtaattcacagatgaaagcaaaacaaatggtccttttattaagggaatgcaaagttaaaaatcaactagacccttttttgtttgtttcttcttggattggcaaagaggagcacttaaaagctgtattttgttttggaggattagtttggttatgtctactaatgactaaatgtgtacatacattttgacccattagttacacttcaaagaattttatccaacaaaaatgtactgagacacattgcttagtataataagccattgaagcttacccaaatattcatcaatgagaaataggttaagaaaattatagtacaaccatacatgaaactgatgtagctgtaaaagaaatgagatcgatttttttttgtaatgatatggaaggatactcaaagtatatcaagtgagaaaagatctaggaacaggatattattattattattattttattttttgtagggacagggtctcaccatgttgcccaggcttaggagcaggatattagctaactcgtgttacttctgaaaatctttgaagctccccctgctcttttttccagaagtgtaaaaacaagcatgtatttagtattacacatttttaaaaaatgaaaaaatgctgctgtgtgaatgaaagagtatacatcgtgttgctccagatggtaaaactagagtagaatttactaaaataaagtttcagcacgtaaagtaaagcacttctctgctcttggccattttagacactaaccatctggagcaaccatgtaactcttgccactcatagctaacttaatgtaaaaaaaaaaaatcgcttgactttcttagcacttcacaaatgcttgtaagactgacaccaggagccctgtcatctaaaaggcactttatagagtgctttcaattcttctg

SEQ ID NO: 136305 - DNA, 2257 bp, Homo sapiens
cactccacaaactgctggaaaactttttgttttggataccatgacaacaaaaataattatgatggtaactaacgcttgagtgcttgtatgtgaggccctgggctcagcagtttgctttaagcatcctgtgctaatcctcaagacaccctgtgaaaggttagaggtagcctaatgagaaagtggaatctcagtgaggttccatgactggtctgaggccacctggttagcaactggcaaaaccaggattctaaacccagatctactaggcttcacagctgtgtaaaatcttaaccactgtgcacttcccctaaccccagttatgtattgtcttggtatatatattttaaacgttctgttttagatatgaacttctttgtttctcagtcatatagtgagaaattcataattctcccagaggtttttctgtgtggaaaagagtagatttcctaagacagtgccatctttgacttcttagactgcaaatttttattgtccagattatcagcagttggaattttttattggatatgtagatataaataatatttttcaacctatttcttgttggattgatcaaaatgcctggatttataataacttttttggtcttatagtttggggtatagcattcacttaatcaatttcatgaaatgattttgcttccaaaattgtaaatatagctgtgaagatctaaattcagacttacatttgtagtagaagtcctaattggtcaattttaatctactttttcatgtgtcattatttttctgtttagtgtcaggtcttttacttgaattgattatttctaagcaccaaagatgactttgaacttatcatgtacttatctgttggcttaaaggtgtatacacatctcaatgattttgatttttttttaatttgtgaaatatacatttctatccttaagaatgcttattttcttcagaaaaattaaaaaaaaatttctcttacccaatttgtataaacacatagtttaaggtagtccttcattttatagccaaatagggaagagggtcagtggatacagattttctgttagcatattacagttagtaataaaaatgtaacattaaatgtacattcaaataatagttgctaaaatattagcagatattgtgattagataataaagatatcttttttattttacttcattacttggtaaataaaggattagttttgacatttctagaccaaacttcatgtttattccttttggtgtttggttgtatgaatacataattagatttgggggtaaagcccagaaattggcccgttatccattttttaatgtttggctgtcttaacatgccactggtactaaagatgattcttaaattattaaagtacaacatgctgaaattgctaaattgatattctttgcaatacttggaatacttttccccaccacctattttaagctagatttttggagggatatggtggggggtggtgatgtagttggatttatttaaacacacacatatataatgacaaaggaaataatagtatggctttttttctgtaaagtcaagcacttaccagtttttctctgctccttaattttatagagccagaatgaagaatggggaggtttgtctgaggatatcttatgataaagagcagtctaaggctttagtccctttgatccccaacttatttattggtaactactaaatttaccatttttgtggcatggataaaatggagtgctatgcaaatactgttgcacgtgagatgatttctaagtccttgcttgatccgtgaagatcaaatagttaaatactgggcatttgggctttaacccttagcggttgatgcatgatggtgttgattagtgctttgagatgtgtcaacctttcttttttatactaacagcatcattttgaaatttgtggtgttgtttttcttttgagctttgtttgctgttggtattttttctcactaaagtaatctgtgaaatgcaaaataagtgaggtaccaaaagcaagcataatactcatgaatttgcttttactttgagatgatccactttatgaatagatttactggatttgcagttgtttatctgcctcatctagaaagtggtactctacggaggattagcgctgctaaaattgatttgttttagtgctgggggctgcatgatatatcttagtactatgctatatttttgtgaaagtaataatctgtgggactgcatacaaatggaaaggtaagaatcttaggagaaaagtga

SEQ ID NO: 136306 - DNA, 1786 bp, Homo sapiens
aggaggtaagctacttattctcttcactaggcactagcatgttttgctcttgctggggaagtctcattcatcattcttacagtttcagaaagtactctgaagcatgcttgtcatgtagtgtccatccatgtgcagtttattgactggaatatgtgtcagtcacgtcaactcagttatctatggatggatggttcagtttggagatggtctatcggtcaggcctcttcccaatggccctttttggaccctaaaacactggagtctaaacctttagaggacagactatttgaagaagggaaaagattggctgaaagtagcagtaagttgagaactctccatctattgcttcaaattgtttaagataaccccctttttcattagtgtagataatcaggagttgactatgagattatgacattttaattccaaattggctcatatttttacctcatgtccattaaatgcaaaagtagccaagcaaatgatagtgttttctaattatactttttgtagaaacttccaggttttttttgttagcaaaactaaacagtatttgcatttctctttgctcttcttaaataacaaaccatgttctgtcaaactgcattcttgtcttacctccatatccccagatgtgtaactcccttttctttctaattaccatagtcatcttgggttaattgtgcagttgatgctgatgtaccttctatttctgaagcttaacatttcatagataaggctacctttttccaaaaacttaatgataccttaattcagataccaaattgaattatgctttagagctaattgtgatttttatcatatggaaagcttacagcatgagaagtgattagtaaatattgaaaaatgaaatgtgttttcactaaagtagttgttaagtgtgtgtttgcatgtatgtaaaagtcttgaatatttttggctcactggttcattttccagaagcattgaaaatatgattttgtatttccagtttattttagtcccttctttgttacatacatgtttatcagtttgttcttgtctttttttagtcaccaaaggtgactttcagtcccattttttagccttggaggcattcagttttaagggagtgaaataaggggagaagagtaacttactttctccattttaacttcttaactcttggactctgtgaggaagggaaagctgtttgagaatctcactgcatcagtcactgactgggacagttgtggggattgcttgaagttgagatgacatcatctggatagacatctactaaatgtgagacaatgcattgtacacttaatgatcttgtagttatcagaagagtggttaaggtgcctgcaaaagtgaagtattagattggcagccctggtgccatctactcttcagtagtgaaatgaacacagaccttttgccttgtgtgtacagtttgccacagtggtttaccaattgattggaaatgttattctggaggtttgtttttaatatcaggtgcgctgactataagcatatactctactgttgtaaaattggtttttaaagttagtatctccttattttgctgttcactaatcagacttttttaaaaattaggtcaaaaccaggattagaaattgggaatttttcatataggtcttcccttgatcactttcatattttgtcacagatctgtattctgctctgtcagaacctggcatttcttccaagtttttctatcattttctgattaattacattggctttaaaatgtatttaaagttattgaagttcaacttttaat

SEQ ID NO: 136307 - DNA, 1095 bp, Homo sapiens
ttattgagcttgtaggacttaaggtcttctctgtgtatatattatacatattccaataaaatatcccaaaatattgacctcaccttggcattatcctcaacaagtcctccttcagttggaaggtttgttttcttctctgtacttacagtttgaattaatctgctatatattttgttttaattaagtaaacttaggaaaaacctgggtctgctatgttttaaaatgcttatagaaaagaacctgaaaggaagaagggcaaaatcacttattctaagtggtatgattattttgattttttctttatacttgcctatgcttttcaaaatttctgttatgcgtttattacttttgtagtctatgagaaaaatctgtactgtcgtgaaagaagaaataaactgtataaacttggggcttttcataataggatatgaaaatatatttagaaaacatcattataggataacagtttttttcacatttgtactttgttacagatatgctagtctgtatttttgctgtgctattgaggatcaggacaatgaactaattaccctggaaataattcatcgttatgtggaattacttgacaagtatttcggcagtgtgagtagtattttattttaggaaattgaatgccatagtatattttggaaccttttctctaacaagtttattttttggttgtcttggggattctaaccgcgggagagggtgggaatgactatttattagtagaaattattaagttgtccatattgggaacatgcagagcccagtcttatttagcttgtaggaatatgttttcaagtacttgagatttggaaattaagcttacttaaaccagtgatacttagtcatttttagaaagagttaagattgattcactctagttcgattttattcactacctgatagtgaataagcatcttctgcttctgcaagttttaacaattttttcttttcttttttcttttttttttccttttcaggtctgtgaactagatatcatctttaattttgagaaggcttattttattttggatgagtttcttttgggaggggaagttcaggaaacatccaagaaaaatgtcctta

SEQ ID NO: 136308 - DNA, 1390 bp, Homo sapiens
aaaggagatgaagaagggaccttcagagtggaatgagaaatttcaccaatgccagatgttgcataaagttcaatgaaagtgaggaaggaatctggtagattttacagtgagcatttcatataatgccctttgccagaacattttcagtggaatagtggagatagaactctcgatgtaatggggcgaagtgtgaagaggtggagaaatttaaatagcatgtgtagactattttggggaactttgctgtgaaggacaggagacgaggtggtaaccactcatagacataggagtgggggacaaggtttttaaaaaagaaggtgtgagaggcttaagcttatttctagataggggaaggagtcccccgtgtggaggaggaaaataccagcaagggattcaatcccaggaatgggctgttatgggaagaaaggaaagcactgcttggtgttcatgcacatgtcactcagtctgtccgtgttgagccactactttttcttttgaaagctacaaagggtatctaatccaactctgatacttatatcaagcacctttaaataaaaggtggactttaaaaaaaacagctttattgagatatcagtcatatacaaaaggtggaatttatcagttctttctctatacgttcccccttccatttcatactgaaaacctcatctactctaccacttacggacatattttttgttggtataaacaggtggtttgttttccctactgctggaagcgaagagctttttaagcaggagaattactgcttagcgcctgagaaattctggactgggacttctgctgttcatatcagcaagtgatttttgttgtttttgttaaattatctcatctacattcttcatcctgagtatttggcatacaaattcccccttttgagaggggaatgatggataagaataatattagctgaaaagacagactgaaaatctggggacttaagttctgttccctttgtaacgttagctagttttatgactttaaacaagtcactttgtttccttatctctaaatgctcttgaagatcccttcaagacagaatactgtgcttttttgattcctgttttgtgtagcattttgtggaagagtcactggattaaggtcttttaaaattaatttaaaaacatatatatctccaaattactagcttgataatttgttaaagaatacttactgattttctttactaacaaaagaatttttaatgacataccagtgggtattgagaacacttcagctacattcacccacagtcagctgatatttagctgatatttagctgactgcggagaagtcatgtgttttgaatataagaataggcactttcagatgttctctgagtgccagtaattagagtaagccttaatcc

SEQ ID NO: 136309 - DNA, 1682 bp, Homo sapiens
cccctccccgtgttcaaattcaagatggtgtggtgaatcttgagaatcatgcttgaatcttatttgcagtaacgctgttaaaggaacttaacagtgattaaaagaaaaaaggatacctatgtgaattctgcctttaaattacctttgtagaaacaatacttctgtttgcagttgagatgaccaattggattacaaaaagcttggcgttaaaaatgaaacatgcagactaatcaacacatttgcagatcacaaataaatacatacaaattagtttaagtataaaacacactagaattcagcatccattccatctgtagatactattttttattttaaatgaagtatttcatgtaatgtttcaatgctgaatcttatttaataagtgtaaatcttattgtggccttttaaacgtttgttttctttttcataatacattaactcagttctagattttgtacatatttaagttggaatgctttaaaagtcagatgaaaacatacttttttattaatgaaaatttgtatttatgggatttttcagttaatattttggatcattctgttttgcttaaaatatgccatcataaactgaggagaacattccaagacataagctactgtctgcaagtaattcaccctggaactagaacggcctcaggatgaaaaatagcaggtcttctgtttctttcaaaagtacccaaaccagatgatgtctaccattctcttttgatgcatatagagagtgcgcaatgtatagcacaggtagaaaatagtttcttaaattgaaagagtgatctttatttttcttcaaaaatttcacttcagcttattacccatttttcttttttctcctgcacactccccttcaaacttaatgtggaacaaggtgggattggaaggtttgcatctagaggaagatctgtccaaaagaatttcttgctattttaattggcatagaaatattgatggctactaatcatttgtcatgtaaatgccccatcccccaaaacttctctgtgaaacacataatcttaactttattgattcaaagtattacatgtaatcttgattttatttatcttaacagatgcagtttatgttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaaggtataatttttgtttgtcagaaaggtgaaatagaatcaaatgttaggtcatttaggaaattgcagacttcagtgatgacatttataaataacgattaataaagatttagatgaaataggtttaaggtaaagctttgtgtttttaaaataactagtgttttgattgataattactgaggctgaaatgataaaggcagggaaatcctttgaaaactagttatataattaaaggcataaatgattattcatgcttaatcatctttatagaagagtttaatgaattcatttcattgcaggggaaagtagggtcagtattttaaattgtgtgagtaattctctgaattgagacaagtacagatagagtctaattctttttccccgaaaatctataaagtaatgactaatatttgacatgcct

SEQ ID NO: 136310 - DNA, 1090 bp, Homo sapiens
ctggtgtgagccacctcaccctgccgaggcttcttaaaaaatatagattccccagaggcagggacccaccctgcgtttacgccatcaggagaaacctgacaatctgtgttttaaactagtgcctcaggtattaaaatttatgcaggaccaagcagaaggtgagcctggatcctgtggctgatgatccaaaaatattatatccagggctcacaataagcctaaaatatattatgacattttcctaactgcattttataatggagaagttgggttgcttgcccagtgtcacacaggcagcgggcaacagatggaggattccatcgtagatctgtctgactccaaagtctttgttctgtctattcttataccactttccataaagccactagggctgaagtgctatcttactcagggcacattctggttgcctcatctcccttctgtgggggtgatggtttctgcagaagttccctaatctgacctcaaattatgacatcagtatctaggcttgagtagaattgtgcaaggagaccagactggtgaattaacaaggatggtcccctccttcttccccttctgttgtggttaataactagtaactcagaccctatgatactgatccccatagggatgagaaacagggctctcttgggtaattgaaaatttctggttgcctgggtattgaggcagtttccaaaagtgatggaagcaagcacatattgctcctgccctctgagaccttattttgttccaataaatccctagaaagaaaatacagcaatttagtacagcaatgttaaatagtgatagtagagggaacagggcaccatctgggacatttgaataattgtcaaggttggcttttctttaaatgctgcttattgctcagtccacccatattaaatcactagagctacaagtcatctggtggtgattttttggcattacaagattgcgcttgcatattaaattcctcaacttaggctcagtttgggaattcaaaatgcagcatttgatcctcatctgtatttaatcttctgttgttggttacagctccttttacaggtttatttaaaaaacttttgattct

SEQ ID NO: 136311 - DNA, 1016 bp, Homo sapiens
gaaggctagacctccctgaaagccctcacctggaggtagtaaaggggaagcctgatggataaatcaattcttcagactgttctcagagaattaaaaattatgttagttaccaacatttacagatccagaaaattaccacgaacaccaggattccatttatctccttcactggaagatctagaggcgcatgcttacttcttcatgcggcaataatcagcaattgctgatcctggctcccctttcagtggagctcccacagcccccacctagcctgctttgcacaagtgctttactgcttacccttagtttgtcatgctgcattgaaaccccaatgtcaatccagagcctgcagtgctagaggactttgtctctgcaggactgccagcccatgccactgagcctttgctacccacatttagggaaagtataaacagcccacagggcctatgtcttctacttcttggggtgttctttgtttcccttctgactggggttagtctcctgggtcctattgcaaagacactctgtgccttcatttctacttaaagtcattaggagactgatttgagactggctggaaaacaagtttattctgccatctcagcccaagtgacctgcacaggacagcttgatcaatccttccaaagctgtctgggtctcgtaaacacattttgttatattgcaaagcaaagcataaacatttctagcaaacattagcgcccaccagctatgtaaccctacatggcattcgatgggtcaaatttctttaacttctctgggttctagagtcttgacctcctgatcatttctaatgcgcattctgttggtggcagttcccctgctccccaggcaggtagaagatgaagctatgtgtgtcagttcacctggagtccacctccctctccgggagattactgtggctgagagcccccaatggcacagcttgagcaaatgcagggctcttcccactgtattctcaattccaggccggacttccacaggatcttttccatctc

SEQ ID NO: 136312 - DNA, 1015 bp, Homo sapiens
tgccttctagagatgtaatggaagatttgtgaaataatgtaaaacaaagcaaaataagaaataatgtaaaatactgcacaactacacatatttgggctaattatattggcgagtctgaaaatttgactatttcaagatatgcatctattacttctttaaaatataaataataattagaattaggctccagggctgtctgtcacatataattttcttttattgtaatgcatagataataatgatagttggcttatttatagtgagaattgtttctaaattagtatagcagtgttaaagcaatttataggtctctgcaatcctatttatttcttgacaaagccattcctcttgcattttaaatgacaaatttgcccagagtctgttgaaaatattagtaattttgatttaatgcagtgcaagtatgtgagctattgttggactcattaaggttgctgcggtaatcatctagatggtaggaaggactagagatgatcaatgatatgactggggtataagaacttactcatgtcagaactagggtcaaaacagagatggttggacacacatcctgtgttcattttctctagattccaaagttctagtttttaatcttcaagaaatgtccctgtaggaaaaaaaaatgattttttcttcttacctcataggatcttagttagaatggacttctgtaaaaaaaagcagattaacaagagaaaaacaaagagtagttaacatgtatattttacttacatttaatatgtatatttcacacatacgtgggagacacccagagaatgagtagttctcaaagaggtggtttgaattccaccttatatagcatcttcagcaaagaacagtacatttttaggtaagtgacaagacaaaggaaaaggactttgagtttctagggacagtaacagtaacttgtgggaaggcaaataactggccagttagtaaagcttgttgatgtagattcctctggtgtaatctcccaaccaatatgggtctgccattt

SEQ ID NO: 136313 - DNA, 1074 bp, Homo sapiens
gcagtggataagtcatgcattgaagttcattcaagagatggacgtagagtctagttcaacctcttgtcttcttggggtgagctctgattacaggactttaaggaatggttctttttcaataggttttccggaggtattttatgtatcttacaattaggaactgtcaaaacacttcagtttcagaaatacaaacagctgagaagctgttaattttcagaggcaggaggaaaacttgtattttcagtggtaagttattgttttaataaaacattgtcttgcatcaacctgttgtactaattctccttttcaggggcttttcactaagctgtgcctatgcagatagataaggttgccccacttttaattctttactttttgtaatgctgatggagtttgtgaacaatggctcaagtgagcatggcttaagtttagagaaacataaaaacatagaaattattttaaaagacctataatctctcctgctaatctacctgtgaattgctccaaggaactgggaatagcaattattttaacagctttattgagatataattcacatacatacattttacctatttaaagtgtacaattcaatagtttttaacatattcccagagatgcaactacccccacaatctaattctagagcattttcatttgcctctaaagaaatcctgtatccattaacagtcattcttcatttgctgctcccccttgccctaggcaaccactaacctactttctgtgtctctggattagcctattctggacatctcatataaactgaatcatataatgtgtggtcctttgtgtctggcttctttcatttacatgatgttttcaaggctaattcatgttgtagtgtgtatcaggacttcatttctttttattgtcaaataatagctcatcatgtggatatatgaattatgtaatttataattatgaataatgttgctatgaacattgtgcggatgtgttttacttttccttgcatatatatctatgagtggaattgctggatcatgtgataactctgtgtttaacatcttgaggaactgccagactgttttccac

SEQ ID NO: 136314 - DNA, 1057 bp, Homo sapiens
ttaagagccagactctgagagggaaccattttttgtctggttgagatgtaaataatttctgtcccgtaaaataaatagccccaaaagatatttttgttgctctgtagggtattagctacttttgtatctaagtaagtaagtttttttctttttccctgtattaggaattcataatttagtaatcttattcctgcattccctctttcagtgcctgtgtatacttggtctctcaaattctgctttgaaccagctttactatcctgttattatctgattaatgagataaataaatcaatatgtgctcactttgtattcatatgagagtcatgttttcaatgtttagagtatcatgctttgataaacgccggtctgaaagttagaatttttacagagaagtattaatgcctctgagaaagaattttaaaaataaaactcagtgtgaaagtttttcttcttctagcaaatttggaacagtcagatgagaggtaaacagccagaacatttagttgctaatgatagacagtgagtccagacagcactgttctgaatgttgcaaatgtgatcatcagaaaaaagtattaggagtgaggtagtgcataacaaagagctgagctggataatttgccaggtgagtgtttgacttttttgaaaaaaaaaaaaaagaaaaaaaaagaaagaaaattggattcatttaactttaaaatctgtgtcagttttgaatgtaagataaactattacttgacagttcttcctacctaacagaaacccataaaaatgaattgagatgaaaatgctctagctcttttattcttttggttgaacatgtaattttcaacaatcctctcaattcttttcattgtttgccatgtatccatgggtatgtgtcaaggttaaaaaacttacttggagatactactatcttttgttctgagatatttgacaggtttcaggtgtgtttttcctcataaacttctggaagagacattggtgctcccataatggagatgtgtgggggtttggagactggaggcagtgtgatgtggtggtaaaaagttca

SEQ ID NO: 136315 - DNA, 1080 bp, Homo sapiens
tcaataattggtcctattttgaatactttctgtgactcaaggtaatcagggcattccatatatttctaattttgaaatttgcataattgtgaaaattatttctccaactcttggacctatgagaatgttggaagggaaaactttcacgctgctgacctaaaatcataatgaaaacatgatctgaaggagataacatttcaaggcaagtgtagagagtgcgttaacattttttatgtcactgcagggtgttttctgggtcttgagccaatatgcacgtcttagtcctcatgaccaccaagttcaagctcctgtgcaatttgctgatcgtagatgactagttcctccgtaatgaggaggtgctgtgattctcaagcacggaggccagcacagatctggatctagggaggtgctgtggtccttaaaacacagagccaaaagccaaactgcagctgaaaagaattacagcatttcgctaatgtaatcagggatacacagctgtgttcactgttctctagtcctttcatgttgctagaggggagaaaagatagtttttcctctacccatcataggttcatggccaaggccctgataacaaaaaaacagattaacaagcaaaaagcatacagttgggcacagcagcaggtgcctataatccctgttatagcaggtgcctataattccagttacttggaaggctgaggtgggaggatcccttgaggccagtagttggagactagcctgggcaacagtgaggcaccacctccccacactcacacacacacacactccagccccatttcttaaaaaaaaaaaagagacagagaaaagcatacaaatttatttaatgtaagtattatgggaaccttcataaggaaatgaagattcaaagaaacaggtaaactctggtctttctaaaacagacctgatgaagagtagagagtcatggagagttataatagagcaaaaagagtgtgatctcatggtaatatagtaggggaacttagcaaggcctgtttattcagattcttccctgggatcctgtgtcttcagagataaggatactcgtttcctctgggtatg

SEQ ID NO: 136316 - DNA, 1047 bp, Homo sapiens
ggggttattaccacaataaccagatatatgttgttcagaagattaccactgccaaccctcattctggcaaacaaccctcgcagtgttgctgttgagggctggcaggatctgtgtgtggtgtgcacgtgtgtgcttgttacacaaccctacttatttgtgtcattacctgctaggagaagctcacagctctctagcatttcctttcaccatgtgttcatatgggaacagcttcacataatttgcactttgggcatcttactgtattgatgttcacccctttcagtgcactgactttcaaactgtgctctcggagctggagtctgggctgctgcgggagcaggccatgggggctctgggctccttcctgcttcagctgagcagctccactttatctggctcatgtgccatggttctgcaagagagatttcatctgaagaagagcttcctgtgttctgagactgcacagcttatgccactgattggacatcctaatgtggtcccatgtcagatgtgggctgtgaccctttgcagccgttttacaattcccgttattttagattctcacactgaaaggaaggtgatagtgggacaagttagatggctgggagaaataactcacttataactatctggctgtttgcaaataccaactaatatacaaatcctgtctggctcgtgtggactgcccacctgtgtgttgtatggcctgccaattcccgcatggcgggtggtggtctctgggtagagcttccagcggggtgtggtggctcacgcctgtaatcccagcattttgggaggccgaggtgggcagatcacctgaggtcaggagttcgagaccagcctggcgaacatggtgaaaccccgtatctactaaatgtacaaaaattagccagacgtggtggcacacgctgctgctagggaggctgaggcaggaggagcgtttgaacccgggaggcagaggttgcagtgagctgagattgcaccactgcactccagcttgggcgacagagggagaccctgtctcaaaaaaaaaaaaggcttcctagt

SEQ ID NO: 136317 - DNA, 1068 bp, Homo sapiens
gcctcccaaggtgctgggattatgggcgtgagctactgcacccagccgagcctaacttttatattcaagaacaattcctctttttttcttaataacctgttaattccttaagggttatgaaaactatgaattcactttttctgaagtggagattataggtttgaattgatttggacaaaagtactggtaatgattatttgccctacttataagcagtgtgttcctagaagttcccttcctgtgttctatgtgttgtcttcatctgcaaaggccttttcctataaaagggctaatgacagtgtgtgtagaattatcaaagctgattcaagggtccttagaaatgagacattttgaggaagagggagagatttgttaaaggattcaaaataattaccctgatttgatcactatacattatatgtattgaaatatcactatgtgccccataaatatgtataattattgtcaattaaaaaaagaaagaagattttttctaaactgtattatctataatcctgtatctgagtattaactgcatatccatggtcttttccagacttcatcaagattagtttttatgtagtcttttctggtggcatcactttttcctgtatctggtcttcctgtctatgatctgtgcatatagtatttaatcgcgttaaggaggcatattctgctgattcatttcctactgataaaacacttcacatggtttctggcattttgttagaaaaatgctgaatcgaacatcctgacacagtgttttcgttcttttgaatatttccttagtatagatttccaggagttggattattaggtcaaagggtatgaacacttttatgactgataattctgccagactgttggaaagaagggctgagcaaggtcataatgacattcactgtacttgtgtccctgctttccctagtctttttggtaggattatttttcttcttgctgtattaatggaaacaaaaagagccctatttctgttcattgctaaaaagtgaaaacgttttctacttcgaatgttgatttacttgtgtatatagtgcccaggtctgaagt

SEQ ID NO: 136318 - DNA, 1040 bp, Homo sapiens
acatttttgagacaaggtcttgctctgtcatccaggctggagtgcagtggtgtgatcatagctcactgcaacctccgcctcctaggctctagcaatctttccacctcagcctcctgaatagctgggactgcagcctgtgccaccacacccagctaatttttgtattttttgtagagaccatattgtccaggctggtctcgaacttctggctccagtgatctgtctgccttggtctcccaaagggttgggattgcaggcgtgagccactgcacctggcctcctgttcttagttggctaattttactctaatctcaatgcttcataccagaatatttcttgaataccaaccttgccagtaactgaacaaactacatgtaaagactcttcttgggtattgggtattgggacccaacacagtgaggaagactgaagagtcgtagtgcacttctatcaagaaattaggggaggttatccctgtagtctgcctagatggttcaggttgtctgaaacttaaatggaagttgaggctctgaatacacgtaggacttctgaatctgtggcaggtggtgcagtcttacctgatttagagaatacatagagaggccaggcatctatgtgcaactcagcttcatcggccagaagtgaatgccctatctcacctcactccagtaatacttaacctagccataattagctaaccaaagataggaacaagatgccaaggccaagagcacttgagaattgagcagtccatctaacaagggaggtcatcgagtttcttctccaccctttccctgaagtaactcttggagcaagcttgggacactgtgttcagatggctcggaaagttctggggcactgataagatcagacattttgttgggaattttttacctcagaaaattccagttgtcaaagattcctgtagagcaatatgtggcaattacggtatgggaaaaaaacaacaacaacaaatgaaaggttttatgagagggaagctcaagcaattccattagaacaggtcgactcacccaactgta

SEQ ID NO: 136319 - DNA, 1028 bp, Homo sapiens
ctttaaccaccccagtaacaataaaatagatatgttttgaaactgtgatgttctcctgtctctcaggcttttagtggaaggaatgcaaggaacaaagacatttttgttaatttttgctgctgaatcaggttgcttataacccaagaggcagccagccatcatcatcttgtaggatccagcttgtaggatcatctgataactctgcaaggcagctggtgtgtcaggcttgggcaccatagtctctgccttgccctgaccttccgcttcctgagtgttggggttccaccagctggtgcctggcagcgttctttgcctgagtatgtgatggtgattcccagatgagatctcctaagctaggcccacacagaaccttcctgttccctccctccatcagcgacttgcctgtcaattctctccctgcttttctcctttcactgatgttcagggcaacatttggtactggagacctattttcacctgcttcccacctcttctctagcattttttgccttctccactggttcctacgctagcatgttttaatcagaggatcacagtggcatttataccttggattttctttctgtgctatcatttcaggagaaggtagcgtttattacttctgaaaacagcagggataatgtgaactaataccctagtgtaaggcctaaatactacattttactcttgatgacttaaacttgtattttcattagtaaaatacgatgtgcaaagtttaaaaagccaacagttctgaaaagcctataatgacaaagtcattaatcctcactccctctgtaccactctttagcttcttctagctctttctctgtgtttgtctccatgttgctaaataatctcatagtattctttgaggactttttagacttctcccgctttgttgaaggagtttttaatgctcttaggcagcccctatgcccactgcattttccttctctccccacctcccacccctacacttgacttttggaaatattttctggtcttcaagtgtttgtcaagttcat

SEQ ID NO: 136320 - DNA, 2406 bp, Homo sapiens
catgatttaaaattgccaaggagattgatttctactggaaagagttccatgaaataagtaggacatttccaagggacattgatctaatgctgattgtaactcacaggaaggggttccaggtggattttaagagcactttacagctttgaaacacttgtacacttccacacttatagaattttccctgactctgccttatatcacctacaaactgaggactggactattgggactgtatttctccctgatgtttctcagctctaaaattctagggccttatttacattggagaacaaatgggaaatctaatagaattccttaaaagcttcccgccagtcttgagcatttatcattccatgtgtctttgctgtcttgtatatattcttcttgtttttattatggattctttgactttgctatgcaccaatatagaatatgtattaactcactggttggagtaaagacaggcattttatttttagttataagattttacacaaaaatattctgattttggcaatgcattttaatcaagattttagaaaattgccagtgtttttacacatatgttctgttttcctgggaggaagtaggcgtttgtgcttaatcataacaagaactatctttttttaaacatcttttaaaaaatatttcagatctacagaaaagtggcaagaatagtgcaatgaacaccagtctgcctttcgactagattcactaattgcgaacatctccacatttgctttctctttctctggacagatactttcctccacccctgagtcatttgagaatcaattacaaacatccagatgcttcccccctgagcacctcagcatctgtctcctaaggacaaagacattctcctatgtaaccacaatgccattatcatagcccacgtcaaatctctccaattgttgaatagcatcttaaatcatcttttctctcaaattaccactagtgagctaaaatcaaatggggtgtttattatgttttgcatctggtttttttgtttatttttttgaagccacttcactgtgtcactcaggttggagtgcagtggcgtgaacacagctcactgcagcctcaacctccatgggctcaggtgatcctcctacctcagcctcccgagtagctgggactacaggcatgtgccaccatgcccggatacatatatatatattttgtgtatttcttgtagaaaaatacaacatgggttttgccatgttgcccaggatggtctccaactcctgggctcaaatgatctgcccgcctcagtctcccaaactgctgggattacaggcgtgagccactgcacctggcctattttttgcatctgaagaaatgattttaataactatatgtcatcttagtaacgatataggatgaaagataacatgttctatataatacacccatatattacatatgacgtgtgtatgtatatataaaaattatctctaagaaaaacttttggagcagtattggttaatagtcttctaggctacaaatctcttctttcaagggacaacttctgattagaatcagcccaatgcggccgggcacggtggttcacgcctataatcccagcactttgggaggccgaggtgggcggatcacctgaggtcaggagttcgagaccagcctgaccaacatggagaaacctcatctctactaaaaatacaaaaattagccaggcgtggtggtgcatgtttgtaattccagctactcgggaaactgaggcaggagaattgcttgaacccgggaggtggaagttgcgttgagctgagatcctgccattacactccagcctgggcaataagagcgaaactttgtctcaaaaaaaaaaaaaaaaaaaaaaaaaaaaagaatgggcccaatgctgcctattgtcagaatttatacttgtagcgaatgctagcaaaacttgaacttgaaaaacagcctgtgcggcttcttaagtttttacttgctcacttctaccagtcacatctcttgtctcttatttttctctttacccatagacttaaaagcatgagggtaaacttgcacttggaagcatgaaaaatccactaatagatactcttgtgaaacattaactaaaaatatatggagacaagtgataattacagggtgtgttcacaagagtgcgttttgaaaccagagaaggggggaaacgacaggcacaagggtggtaatgggaaaatggagaggcaaaggttatttatcacctcactgttcaattgtttgatctttggacaggcttaatttttcctaggaaagccaagagtaacatattttaagagctctgggcaccacaggcttctgtgggttattctgcttgaaggtgacagcatgcaatgtcttgaaaagcaccttcaggaagagggtacagtgttagtacct

SEQ ID NO: 136321 - DNA, 1053 bp, Homo sapiens
tctagcttctaagttacagggaatatctccagatggcataaactcaccttctctccagaccattatctttcacaccattctaaaaggaagcagagtattaatgcaaacagaaggagctctaggtagtaccaaaatcacactaacctggttgcccaatagtgaaacagctagaagaatcaaagaggagtttgaagagctgagcagaatcatgacacttttatagtctttacgggcacgccaccctgattatgaaaatttccttttgttggccatttaagggtaattattaatggtttttgaaactcaggcttaagactgcatgaaccccataattaagggcaagatccagtaaaggtccatctcgacagttgcttcatggttcagagtcgtaagcttggatttttttccccctgagattatattttccctccaatgtagaattatatttgctcacagttcacatttcataaagcttagatatagaggattcttttcaatttagttgcatatttaggctttaaaaaataactttcttcatatccagaaaaaataaatgctgccctgtgcggtagctcatgcctgtaatcccagcactttgggaggccgaggcaggaggattgcttgaggtgaggagtttgataccagcctggtcaacacagcaagacatttctactgaaaaatttaaaaaatcagccaggtgtgatggtacatgcctgtagtcccagctactgtagaggctgaggtgggaggattccttaagcctgggaggttgaggcaacagtgagccatgattgtgccactgcactccagcctgggtgacagagtgagatcctgtctgtaaaaaagaaaaaatgctgtcatagaaggacaatattacatagtttaaaaaattacggtatggccattgaagtccttctgatgtctttacatattagcagcttaaatatttgaatacatgaatgaatgaatggaagtattgcttcagaagcaggtttaagaagtggaaagaagatactcagtaatttgtggttttatttggcaaatcaatattga

SEQ ID NO: 136322 - DNA, 1032 bp, Homo sapiens
ggaatgtaatgagtcatgagaaatgtttaagagttttaataccatgagaatgctcttgtgttgaattagaatgatacaaattgtatttaaacagtccctcaactgtttataaaaatctcctctgtttcttggtgggttagaaatcacctttttttttttttgagatagagtcttgctctgtcacctaggttggactggagtgcaatagcacaatcttggctcactgcaacctccgcctcccgggctcagataatcctcctgcctcagcctcccgagtaactgggattgtaggtgtgcgccactatgcctggctaatttttgtattttttgtagagacagggtttcaccatgctgcccaggctagtcttgaactattagactcaagcgatccacctgcctcagcctcccaaagtggtgggattacaggcgtgagccactgcgcccggccacctttctatttttctggttaactttctaaatgtttgaaatggcttccaatgaatttcattttattattgggggaaacttccacacttattttctttcttcccaaatctccacaagtatactctcctcccaaaatttagatagttgtatttttctgattattccaaataagagtgctgagaggctaatcacaaagagcagcagccagagatttacaaagtgttctcttactattgaacattttcacttattctttttgataggacacacatccatatggctcagaaatcaaaatgtccaagaatttgtcaagtgaatagtggctctcttattcctgcccccccatctgcccagtcctcttgaagcacgtaaccaatgataatagtttctactgtgcacttgcagagattttccaggaaatttcaagcaccttgccttccaagtcactatataccagctactcatctcgtgcccagttcactttggtcaccctgtccccaccatccctgtgcttacatcaaccggtacttctctctctctgagctcaaacaccccagagagaagcctggccctgcccagcctttt

SEQ ID NO: 136323 - DNA, 1052 bp, Homo sapiens
atacaattcatataccacaaaatttagccatttaaactgtataatccggccagatgcggtggctcacgcctgtaatcccaacactttgggaggcctaggcaggtcaatcacttgaggtcaggagttcgagactagactggccaacaagttgaaaccccatctctactaaaaatacaaaaaattagctgggcgtgctggtgcatgcttgtaatcccagctgctagggaggctgacacaggaaaattgcttgaacccaggaggcgttggttgcagtgagctgagatcgtgccattgcactccagcctgggcaacagagtgagactttgtctcaaaaaacaaacaaacaaaaaactgtataatccaatggtttttagcatattcacggatctgtgccactctcattacaagcaattttgggccattttcattactccaaaaagaaaccccacacgccttagctgacacccccaagcctcctatctccaccagccccaggcaaccattagtctaccttctgtcttcatagatttgcctgtttgaatcatttaatataaatggaatcatccaatatgtagccttttgtgactggttgcttttacttaggataatgttttcaaagtctgtctatgttgtaacacgtatcagtactttgtttctttttattgctgattaatatttcattatatggacatgaaacattttatttatccattgatgaacatctgcattgtttctactttttggcattgtgactaacgctgctgtgaacattcatgtgcaagtttttgtgtggacatatgttttcatttcaccaggagtggaatttctgagtcatatggtaattctgtgtttaaccctttgaggagctgtaggactgttttccaaagtggctgcaacattttaatttcctgccagcaatgtatgagggtcctaatttgtccatatccttgtgaacatttgttatttctgtctttttgatgatagccatcctagtggatgtgaagtggtgtctcatcgtggctttgatttgcagttgcctgatggctaaggat

SEQ ID NO: 136324 - DNA, 1047 bp, Homo sapiens
attttcatttgccactacttaattagcatttgaaatcttaggctgatttttccaatttaactctttctgatgatgtcagagatcttaacatttttataatagtgttttgaaagaaccttaacctattttcattcagtttcttttcccagtggcattcttaattgaattgggtttctcagttagtatgctctgatgccacaaagacttatcgtaaaatatatattgaggtcagttgtgagaaattgtcacaatttcttcataacattgggaagatttcagaaaaaaagttcagggtgtgaagtcatataattggttctgaaaatagagcttgagcatagtcactagtgattggaccaagcattgcacgaatggctgaatacactagtttaaaaaaaaaatggatagtcaagtttaccctcattttgtattgatttcagtggtattcttgtgcctggaggctttggaatcagaggaacattgggaaaactccaggcgatttcttgggcaaggacaaagaagattccttttctgggtaaaactcatgtttattgaccctaactatgagtttattagatttttgacacctaggaggggtaacactaaaggtttgttatcgtaaaggtgtgaactcggatttgaaagttcaggtgccaaatagtctgctatagggtcaacaaactatattctaaatttggcccacagcctgtttttatgaataaagctttattggaacacagccacaccaatttgtttacatattgtctatggctgcttttgtggtccaacgtcagagtttcagaccctacggcctagaagctttactatctgaaagaggctagaatctttactatgtgaccctttacagaaaacgtttctcatcctaggagaacttgctgctattccagctgggtagcagaggctgggagaaggctccatctgcaactgtgcttaccttctccaattcccacctcagtctccagagtagctgggactacaggtacacaccactgtgcctggctaatttttgtgtgtgtgtgtgtttttttt

SEQ ID NO: 136325 - DNA, 1221 bp, Homo sapiens
cgactcactgcaacctccgcctcctgggttccagcgattctcctgcgtcagcctcttgagttgctgggattataggcacatgtcaccatgcccagctaatttttgcatttttaatacaggtggggtttcaccatgttggtcaggctggtctcgaactcctgacatcaggtgatctgcccgcctcggcctcccatagtgctgggattagttttctaattaaatgaagctaaccttgtgcaaattctgatgctagctttggttgctgggtttttgtgtgtgcgtgtgtgtgtgttatatcagtgtaaataaactgccagtctctgctgaattttgtttcattcttgtggtggcatatttgaatagatccatctaagtatggtgatttctcatcgccacttaggtcatatgtatccatgatgtttcttccacataccgagttcctgtgcttttagaggaacaaagcattgtgaaatattttaaggagagattgcacctgcccatcggtgattctgcaagtaatttgctttttaagtggagaaatatggctgacaggtaagcgaaaggaattacttgtataatctttaataatttttgagtttgggggtagaactaagacctacttgaaagggtaagcgtgtgtatttggcattttgcgtgtgcacattttggtctggatatgtctaaagatggagcatactgttgcggtgctttgctgtattatttgaagatttctggagcctttgattttgttatacataaaccaaagtgaattaaaggaattcgaattctggaaggaatgtttttttagctctggaaggattctgatttatttgatttatttgctagttcattttttagtttctgaatatttaaaatttttttttgtttgttttcttttttcttttttgagagtcttgctctgtcacccaggcgggagtgcagtggcacgatctcggctcactgcaacctccacctcctgggctcaagtcatcctcccacttcagcctcctgagtagctgagactagaggcacacaccaccacacccggctaatatatatttttttttttttgtagagacgggatttttctatgttacccacactggtcttgaactcctgggctcaagtgatctgcccaccttggcctcccaaagtgctgggattataggcatgagccaccatgcctggccttaaacagttttaaacttcacaggttttttg

SEQ ID NO: 136326 - DNA, 1035 bp, Homo sapiens
gcttgcctgtttttgtaagtaaagttttattggcatgcagtcacacccattcatttacatattgtctgtagctgctttcacactgcacctcaattgaggatcaggacagtgactgtgtcacctgcaaacctaaaatatttcccatctggcccttttgagaaaaagtttgttaaccccgatctagctcttttcttgtagttaatgaagcaacacttgtgagcctggactctgttcaccagagacgtctcgatgtttcgagttcttactgatacacttatgctgaatttgattatacttatattagtgctcagaccaatttctaatagtccagtggaatgtccaaagtgaacaagtacatacttggccaagtttcttgtaaaaagaaatgaatgtggcatcctgctgaaagtgaatcctgtttgctgaagcataactggctttgacagattgtctgccgaagttcaacgcccattgagatggccgtgaaggagaagatttctatgttttgtcacgtgaaccctgaacaggttggtgctgctctttagattttattgtctggcaggcacttctgctgatgccagtgttttgtacctcttcaatgatcatattacttttcacggcatttatgcaagcactggggaaccctgatccaaccatgattccctagcccttaagtgagataggatgcatgtttctttgcatgatcactcaacttatgtcacaaaaccagggtgggctttcttttcttgagacagagtgtcactctgtcacccaggctggagtgcagtggcatgatctcagctcaccgcaacctctgcctcctgggttcaagcaattctcttattttagcctcctgagcagctgagattataggcatgcgccaccacgcctggctaatttttttgtatttttagtagagatggggttttgccatgttggccaggctggtctcgaactcctgacctcagatgatccgcccgcctcagcctcccatagtgctgggattacaggcgtgagccatcgtgcccagtacca

SEQ ID NO: 136327 - DNA, 1303 bp, Homo sapiens
cccgcctcggcctcccaaagtgctgggattacaagcatgagccactgcgcctggccttattgttagttttaatgaagcaatgggctactgaagagtatacacgtggagaaatcttttttgaagttttattttttatttttatattttttcagagaaagggtctcgctctgtcatctaggctggaatgcagtgggatgatcatgactcactgcagccttgacctcctgggctcaagtgatcctcctgccttggcctcccaaagcgctgggatcataggtgtgagccgccatacccagccacaatttagtgattttgaacgtatttataaacctctgtgtaaccatcaaactttagttctcatgctcggtttattaagaactctttttattagcttgtgtactgtgggagatgtgtggtcatttgtgtctttttttgtttgttttccattcccagctgggaggcaccattggagacatcgaaggaatgccgtttgtggaggcgtttagacaattccagtttaaggcgaaaagagagaatttctgtaatatccacgttagccttgtcccacaggtgggctttccagataagtatgtggacagcaactttgataagttttcctatgatattctatgtgtcctgcatttgaaagtggggcaccattaatcatccataggagctagtgtccagtgtgctgacgggaccccattttttttcagctcagtgctaccggagaacaaaaaaccaaacccacccaaaacagcgtccgcgcactgaggggtttaggcctgtctccagatctggtgagttgaggacagtgggtaagtctatcctgaaggtctctgggagcaggaccttcacttcttttttttttttttttttaatttgagacggagtcttgctctgtcacccaggctggagtgcagtggtgcagtcttggctcattgcaacctccgcctcctgggttcaagcgattctcctgtctcagcctccagagtatctggactacaggcacatgccaccacacctggataattttggtatttttagtagagacagagttttgtcatgttggctaggctggtcttgaattcctgacctcaggtgatccgcccgcctcagcctcccaaagtgcttgggattacagccaagagccaccatgcctggctgcccttcacttctttatctttatcatcatctaagtcctttctcattctcaaacggctcctgtgacaatgaggtttttctatctgggagccggaaaaggcttattcccttagcctcaagtgttgcttcaatctgttct

SEQ ID NO: 136328 - DNA, 1612 bp, Homo sapiens
aatttatttgaagaaacaaggttgtctgtcctgtggcttctcatagtctagattctgctgacagcatcccattgtgttgtttaacaccttattctgtcctcttattccctgttgggcttggcggctttgggttagttttgaattgggctcaggaggaggctaaagacatccaattctgcgggaacgcagccctgcgggacctgaaaaggcgagactaagtcaccagccaagctgcctagaggcaatcttaaaatgggactggctaggactgtgacaaagacaccgtccacatgcctactaggtcagtcacctacaaagctggcgaatgaggaaaagagggaaggcagggctacgctgggaaagctctttgtcccctatccacgcgcacaaaacagttgtcacaactgacgtcaccaggggcggagcctttggacggaagtgacgcttgcgcggccgcggcggagtcgtcatagaggcggggctgcggcggctgcggtgttcctccgacttccggacatctccctgggagtcgcgcagagtggagtcaaaggcaaccagtgctcgctgcggtctctggggatcgggaccgcggcggcggcccgcgagcgggatgttccggggcttgagcagttggttgggcttgcagcagccggtggcaggcggtgggcagcccaatggagatgctccacccgagcagccgtccgagacggtggctgagtctgcggaggaggagctgcagcaagcgggagaccaggagctcctccaccaggccaaagacttcggcagtgagtctaccctggctctgggaccgggaaggggggggcgcattcctcctctgggacggccctggggcgcgggcccgactggctgggggatgagggggccgaggtgggaggcaggggaggaagatgtgtctgtcggtcagtcctctccgggtcgggagagattggtgaggatctggacgaggccagagcttcatctagcagtcaggtcctgtccctgaagttcctggtgacaagtctacaaagtttgcagacattggaatcaggtatgcagtcaagcagtgtgacccgacgtcttcaggtttgacaaggaatcttttttgttcaactcgaaaaccttcatttacaccccccagatcggggatagttggcgagcttgaattggttgaaaaaataattttttgcccctaggtcagaacgtgttgtctgaagtaaactgacagttactgaatgtcaatgtctgccccggtcaaatgctttttaggtacagagacctttttccttaaggagggagagaaaatgccaactgtctgctatacgcaagttgcagtactagatgttttatgaaagatatcccatttcatctgttaaacacccccagtgagttgggggaacaagcccagagttattgggccaaagttatactgatagtgagtggtagaagtggaatttgagcttcgatctttctcattttaaagcccgtgctctttccaagtttacagtctacaggggttgggggacaggtgataatagacgtggagtaaacacatgctgtagtaattctcatttctggagagaccatggtgggcttcagtgatcacagaaagcat

SEQ ID NO: 136329 - DNA, 1037 bp, Homo sapiens
cctcagcctcccaagtagctgggactacaggcacgcacaacgtctggctaacttttgtatttttttgtagagagagggttttgtcatgtggcccaagctggtctgcaactcctgggctcaagcaatccacccacctcggcctcccaaagtgctgggattacaggtgtgagccaccatgcctggcctcaagtagagttttttttttttttaccaaatgcatatgtgcatataactcataataataagtctggttattacggttaatgttcatatttggaacttattggtaaattgctacttttagtggtcatgcagaaactttcatgctttgaaaccatagactgcagtgtaaccatcatgacctatttttttctcttttcttctttgccattaaaaactgtatagaagcagctgtgcccccatgggttgacactaacgatgaagaaacaattcaacaacaaattttggccttatcagctgtaagtatcttgtggtaccccagatagaacatactttcttctgtcatgatatatctctgttgatgtgactttagtagaatttatttttctatacagtttttaaaatattttgagatgttaggaatgtacacattaacacatgatgtgtacattaacaaaatgtacacataaaatttattttttattttttttttgagatggagtcttgctctgtcacccaggctggagtgtagtggtgcaattttggctcactgcaacctccaccacccgggttcaaatgattctcctgcctcagcctcctgaatagctgggactacaggcatgcgccaccatgcccagctaatttttgtgtggttttttttttttttttttttttttttgagacaaagtctcgctctgtcacccagcctggagcgcagtggcacgatctcggctcactgcaaccttctcctcccaggttcaagcgattctcttgcctcagcctcccaagtagctggtattacaggtgcccgccaccacgccctgctaatttttgtattttgagtagagacggggttt

SEQ ID NO: 136330 - DNA, 1052 bp, Homo sapiens
gcaagatgggaggcccaggggctctctgggcttccacccttgctgcagacaactcagtacagttttctctggtcaacgaagtagactactgtttgcctaggccgggtgcagttgctcatgcctgtaattccaggactttgggaggccaaggcaggcagattgtctgagaccagcctgggcaaatagtgaaaccctgtttctacttaaaaaaaaaaaatacaaaaaattagagcctggtgtggtggcacatgcctgtaatctcagctactcgggaggctgaggcaggagaattgcttgaacccggcagacagaggttgcagtgcaccaagatcgtaccatttgcactccaacctgggcgacagagtgagactctgtctccaaaaaaaaaaaaaaaagattactgtctgcccttgacatttccacttgacagctttccacttgactgcccttgacagcgtccactgtcctctcctctctcattctctttgtccttgtgtttttatgtatgtaattccttttctgttactttcctggcatcttcagagggagcacagatgaacacatgtttgttttgctatgcttacccagccacatagcggttttaacaaatatttgctagccttttggttcacacagcagcacaggttttctgtctgtgaaaacaccactctggaagtgttcttccagactcagaataacagttatatggaatctttttttctttgtagtgaaactcttccctccataattattaacatattagtggtaaatttctagagccctccccaaccctcccataagaaaagtatgttttatggcaaaaaaaaaaaaaaaaaaaaatctcattagaaatttcatctttagactttgtcttttttctttctttttttttttttgagatggaatctcactctgtcgcccaggctggagtgcaatggcgtgatctcggctcactgcaacctccgcctcctgggttcaagtgattctgctgcctcagcttcccgagtagctgggattacaagcgcccgccaccacacccagctaatttttgt

SEQ ID NO: 136331 - DNA, 1027 bp, Homo sapiens
gagactccgtctcaaaaaaaaaaaaaaaaaaaattagcaaggcatagtggcatgtgcctgtagtctcagccacccgggaggctgaggcagaagcatcacctgggctggtgagatcaaggctacagtgagccatgttcacaccactgcactccggcctggatgacagagtgagactttgtctcaaaaaaaaataataataattaccaatttggccaatgggagactattcaagctgacttgtgtctttctaactcatccccatcatttcttcacacgtttccttgctttctggcacaagatagtattcttcctctgctctaaccctggaatcagccatttccccagggagctctggatccttttagtggaaagtctaaatcttggtattttgcaagatctggatgctaggtgtgctcattgccattggggtgccactgctctgcatgctctcagtggacacagccagggaatgtgtgtgtgctcatttctgtgtggaatgaaaaccatgtgttcatggtgctacctcatgacggaggtcattttcattttttccctttccatgtttgtagctctcctctctgatggtgagaaacctggtttctactatctttaatatttttacttattccctgtgcatgtggctgatctgtcatttttgctgccactcactcctctgctcaaacacccttctctccctgcttggttctcactctccgttccaggccacccccctgtgtggacacttacctcacccacttgggcaccaacacatcacaccaggtgattctaataggtagccaggtttgagaaccaccaagagttttcaggttgaactgcacttcaatctttttatcaagcatttcccaccccattgctaactcttactggttactagttattagcaagctgccaaacattctctttcataaggaacaacagccacaatgcttgcttctcactgctggaaggcatttaatcctcttgagaaacagcaagtgattggtggagtcctggctctgcttctggt

SEQ ID NO: 136332 - DNA, 1039 bp, Homo sapiens
cctgagatactaaaaattacagcagctaggactttacgtaggtaattgagatggaccgaattgtgaacaccagcattatgaattcagagagaatctttttcttctcctttgtttcttttagaggattctgcagattgggaaaaagaactgcagcaggaacttcaagaatatgaagtggtgacagaatctgaaaaacgagatgaaaactgggataaggaaatagagaaaatgcttcaagaggaaaattagctgttcctgaaatagaagaataatccttaacagtctgcaaactgacattaaattctagatgttgacaattactgaatcagaaggcatgaaagagtataattttatgaaattcaaaattattcttttttcaagttgaaacttgcctcttctactttaaaaaagtatatagaacagttacttctaataatcagaaagagatgttttatagaacatttctttaatataaagttagagatgtcttcataggcagtatggctatctttgccacagaaacataagtaaaattttagagttctgttttccatgaggtcaaaaatataatttattcctcagtcatggttttctaaatatctgtactccacattccattttaattgatatgagggtgttaaagtacctacttaatgggttgattactatcaaaatgaccaaattataccaaagaacttaagaggaagcactttcagaactattcacttgccaggtattttctaaaattccacctgaaagccaaaagataaaataaataagttgattttaatgatataagcatcacacaattttacattaagaaatactgtgcaggccatgcgtggtggctcaggcctgtaatcccagcactttgggaggccgaggtgggcagatcaccggaggtcaggagttcgagaccagccttgccaacatagtgaaaccctgtctctactaaaaatacaaaaattagccgggcatggtggcaggcacctgtaatcccagctactagggaggcttttgaacccaggaggcagaggtt

SEQ ID NO: 136333 - DNA, 5507 bp, Homo sapiens
ccccttttcagaacgccgccttatgtcccaatcccgatccgagcctgcgagctgtggccgcacgccctgctgggacttgtagtccactcccgagtcccattcccgatccgcgcagactcacacggcctctatctgcccttcggtcttgctgaagcccagcccagtattcaatgctccccatccccatctcgctccgtcccctcgggggccaacctcctccggtcacgtgggaagtctcacatgcggcgattggtcgtgggggctcgggggcggggcgaaaggccctgcgagattctgtgccccttgtcgggccgcttgtttggctgctgccgtcacctcatggcgacgcgggtagaggaggcagcgcggggaagaggcggcggcgccgaagaggcgactgaggccggacggggcggacggcgacgcagcccgcggcagaaggtcagtcagggggacgccctcgttgttgtcgggcccgggggatgtttgggctccctttttcagggtccacctcttctctctccctggttacctatagccacgggacgaacatccggtcttcttccctcccgggggtgacgacagtgggagcaggtgggggggggtgggaccgcgatggatggggtgggaagggacgacggttggggtttggcggcgcgcggcggggaagccgggagggagggcagggggcgcacgcggttctaagggagaaggggtgcgaggcgggggtgcgccaggtgtgacagccacgtgcggccagcaccgcggggatccgggcgccaggcgttccttctcccagtcaccgccgtcaccgtgctcccggcgctgagcgccgccgtccgggggctcgctggggtcgtgggctcgccctcctggcgtcgggcaggtgcgcagggcgcgctgcggggtgcccccgggctgctcaggctaggctgttgcgcagtaagataaccgcgcgggagccggggtgtgcttggccccccttcccccgcccccctgcgctccccgccactgcgcgggcgggcaggcgagcgggtgagtgtcgcagggccggtgcgagcgggacgctcggcccccgggacctagaccccggggctccgagggcttggctgcacgtggggccggggatggatggggaggcgatgctggaggacctcggtcctgcagagttgggatatcgcatgatagctggtcctcccagtcctatttaccaccctcctcttttttcccctcttttttttctttcatttattatttttttaatttgatgagtggaaacttgaatgccttcccgaccctggccttgggtctttcttaatctgggaaacaggccggactgttccccttgccttacttgactcacgtcaaggagttttcagtccctccctagatacaggaaaattgagacctctttcagaacgggacaattccacttgttctggagctcagtgggtggagtttgaaaaagattgcacaacgaacggggtacagggttttcggggccctggaatggataattgcggggactgagactgggaaggtgggaaccccatctctttttttccttgcaggtgaacatactgaaacgttcgacttgttggatatcttgcttgatcaccgagggctatttaatattacttaattatgtatttgaacactcttaactcctgtatgaaattacgaaataatatttttctaatgcaattcataaacttcaaatgggagaacaaaggtccagtttacgtctgagcagagtgttaagaattagctttttggggcctgtttctaaggtcaggtattttcatgtttctgcatgacagtgttactacttctcaattacctctctttctttctctccctctctttgtattctaaaagaaagatccagtgcttgcaggactgaaaaagaagctgtggaccaatgtcctgtaagggattcaacaccatcactttggacacttcacttattccctaagggtggagtgccaatctcagtgtttgatttcgtaggttccccaggggaggaggactctgataaaaagccactgcaattgaggatataagttcccttttatgacactgggataaggacaaaaagtcgttgaattaggaactgaggtttaatcaactagcatttaaaataaccaagataggaggtaatgaccctttgaggtgcagagctctggttaacagctggataggaatagtcatgtgtgtgtctactcatttttgtttatgtacctcatactccattcttctttgcttatgctcttctgagcatctttttctttttgatttctaactgacagtgacggcattcaaatacatggtaaaatattaatctttgaattttcatttaacaaattgggtgaattatcttgtgtttgcaagaatcatttttaagccagctatggtggcatgcacctgtagtaccacctagtcaggagactgaagcaggaggctagcctgggccgcagagtgagaccctgtctcttaaaaaaacaaacaaacttgttgtgttttttttttttttttttgagtcagagtcttgctctgttacccaggctgcagtgcagtgatgcaatcttggctcactgcatcttccacctcgtgggttccagcgattctcgtgcctcagcctcctgagtagctgggattacagatgtgtgctaccacgcccagctaatttttatatttttagtagaaacagggtttcaccatgttggccaggctggtcttgaactcctggcctcaggtaagccacccaccttggccttccaaagtggcgggattacaggcatgagccactgcaactggccaaaaatttttttaaaaatcatttttacattacttcattgtgtcccttaattttaaaatttcttttgggtcactgacttgaaaaaatatttcttaattccagcttaacttctatcctttttttcaggaagcagaaatgtttaatgaattgagttttttgaaaatattgaaagaattaaaagaaaagtgagtgttttgtcattatctagttacattatgggacctgaagtgaggaacaattggagatgggcttttttggttcctggttgctttaaccatctgcctagtcactcgcgacctgctcagttaattgtggcattgtttcataactacaaccatttgaatggtctcttgaggtaaccttttgcttctaaaggtaatgttacagtacattactaggggtctcttcaggaattttctaaaactgtgctgatagtagccactagtgacatgtagctaaatttgttaactaaaattaaaattaaaaatttttttcttcagttatactaaccaagtttcaggtattcagtagccagtgtggctagtggctactgtattagagcagatctagaatattttcatcattgcataaaaattttatcagcattggtctaaaaagatgagtacacaatatctagtatgtcaggcattttttagaacatcaggctcattcgttttacttcctaaatccctatgtagaatttgctttataaggttgatttaaaaaaaaattaatagactttttttgggaatggtttttagttttacagaaaaattgagtagaaagtacagtttccatataccccctcacacacaccctttccccctattattattattatttttgagatggggtttcgctcttgttgcccaggctagagtgcaatggcatgatcttggctcaccacaacctccgcctcccgggttcaagcaattctcctgcctcagcctcccaagtagctgggattacaggcatgtgccaccacgcccggctaattttttttgtatttttagtagagacggggtttctccatgttggtcaggctagtctcaaactcctgacctcaggtgatctgcccgcctcggcctcccaaagtgctgaggttacaggtgtgagccactgcgcccgacccttatcccctattatttacatcttgcattagtgtgatacttgtgttaaaattcatgagccaatattgctatattattattgactaagtccatagtttacgttagggttcactctggtgctatatattctatgcattttgacaaatgtgtagtgacatggatccacgattatagtatcacacagaagagtttcacagtcctataaatcccttgtgctctacctattcatccctctctcccttcccctagactactgacagccactgattttattttttttaaattttagagttgggggtcctgctatgttgcccaggctggtcttgaactcctaggctcaggcgatcgttctgccttggcctcccaaagtgctggaattataagtatgagccaccacacctggcctgatctttttactgtctccatagttttgccttttccagcttgtctaaggttggtattttttttctttactagatttttgcttgggaatgttaaaaattatttaactactattaaactaatttttaggtccataaaccatgtggaaggataatacaaggtacctaggcccaaattaacaaaatcttgcatttacataatgccctgtagtttttatggcacatttgcacatacattaactctttcagcaccagtcagatgctgtggagaaggctgggcagctttcactgccctcatttgctgatgacaagctgctcaacgatgttaactcacttgcctaaggggtgaagctgagtctggaacccaatactctttcatctatactacagtaatgagtagtgtagtactgggtaaatctatggattttggagttgggactcctggctttctgccgcccatagctctgcaaccttgggcaagtttctcaatctttctaagcttcagttgcatcatctgtaaagaggggataatgctcatacctaccacaggggattactgtgaagaaggagttgatgggacacatttggcacagtgtgggatatgtagaattttacatggtttggaggggaggacatatggaagagattaatttctcttgcatttagggtgctaattttgtaaatccatcttccaacctttatattctctcctcttcccagaatctctccgtgatagacataatgaggagaaatcaggtcagggttgggcaagagtatgggggcaggaaaaagccatttcattaatcttgtttttctccccatttgccaacttgatgaacttccactcttctggtacagagattaagtaatgagaagtaaagtaaagtgatcttctgcttacaccattgttttctaattgtatcaccaagctttggtaaatttatttttttcttttactgggatcaaataggacaagcagtaatgagaacaaaccagatacagcatattctgctattcatgccacattttcatatcatattatgtcatatttattatgttattggaacgtgttttatttatttatttttaatttattttgtttttttgagatggagtcttgttctgtagcccaggcaggagtgcaatggcgcaatctca

SEQ ID NO: 136334 - DNA, 1416 bp, Homo sapiens
tctgcaacctccgcctcccgggttcaagccattctcctgcctcagcctcccgagtaactgggattacaggcacccgccaccacgcccagctaatttttgtatttttagtagagatggggtttcaccatgttggccaggctggcctcgaactcctgacctcagtttatctgcccgcctcagcctcccaaagttctaggattacaggtgtgagccaccgcaccaggccaagatattttcttccagtattttcttccagcacttctctgtgtgtgtatgtacatacacacagatggttcctggcttactgtggttcaacttgcattgttgactttaggatggatttatcactgtgtaaccccaatgtatgttgagcagcatctgtatacatatatatagtgcgtatacaaaatatacagtacattctgttttgtaattcatttttgtacatcgtattttgggagcatctcttcccattattaaataggcttctctaagatggctgggccaggagaaggatgtttgaacagtagtagacagaaggtagttatgaagcagtatatttttgtggttaagagcatggactcagaagctagactgctagagttcaaatctttgccctgcagtttactaactgtgaccttaggcaggatacttaactttacatgccatagtttgctcatctctaaaatggagaaaataatagtgcctacctagtggcattgttgtgaggattaagctaattaatataggaaagttcttacagtagtgcctggatgtactatttactgtataagtattagctactactactattatttatataagagattgatccaagaaaaggcatccagaatgggcatcagagagagaagacagagtaggaaattgtactgggcatatgatatagaattctctggttgaggagatgaggtctgagaaatcatttacaatttaataaagttattggcctaagaatttgcttaatattcaatagcccaggtacagagcctcaagtaggttgttaattgaatagtccttgtggtagaaaaattggggcctgctatttcaagagtatttgtagactgtggtttgaatcaagtcctgttggaactgggcttattaataaacaaaaagattttgtagagccaaagtatatctttcattagcaaatgtaaaaaataccccaataccacatcaaaattagttgtacaagagagaagggaaatgtaatactgtcttgcttctaatgataaaataaaaatagtggtattttcattttttgtttgtttgagacagagtcttgctctattgcccaggctggagtacagtggtgtgatctcagctcactgcaacctccacctcctgggttcaaacaattcttgtgcctcagcctcccgagtttccaggcacgtgcca

SEQ ID NO: 136335 - DNA, 2650 bp, Homo sapiens
ttcaaataacttaagagtttcagtatttgtaagttttttctatctgaattaggcttagagtgtggcatcaaaccataactctgaaatagataacccatttccccttaatgtgttaattttttttaagatgtcaaagtattacatgcacattattttaaaagtgtcatgaaaagcagcatatctttaatctctcttcttagaggaaaatatttgttttggttcctcttacttcttgaataatgtataaattgcaacttttaaaataaactttactgaaatacataaattgagaaaagtatacaaatcataaatgttaggcttaatgaattttcacaaagtgaatgtgtcacctcatctagaccaagaaatagaacactacaagcaccccaggaggccccacccccaatggtaaccgctatcctgatttctagcaccatttattagcttgccttgtttttgaactttatacataaatgatttcctatagtagatactcttctagcacctttttcacaacataggtctgtgaaactcatctatgtggttgcatccaacagtagttcattctcactgctttgatactatagtttatccattctgctactgatagaaatttgggttgattccattttggagctattaggaatagtgctcctttattcttggactttggatacacatatgtacacacttgggcaaaatcccaggagtagagttaactgggttagaaggtatccatatattgccaaagagtttttcaaagtgtccttgccaatttgttcttatgaaagcacagtactggatttatcaacattagactataaaatataagattttattttccttaacctctctatcccctcctactttgatattttgagttcttcagttgcacaaaatgattataacctaaaatctcaaatatctgctctcccataaattttgaaagtagcttttgtccatttgtgataagagaaggatactaaacacctcctcacctcaacagtattattcagaaaaggaagaggccctctttcatacagagagtaaatgcacagaatttaaatttgtgccacatcatgaccaggaagtgttcacaaggggaaaaaactcaaatagggttaacaatgtgatagaagacagttactgacataagaataacatactggaataaaggcatctttaccatgtgtattagggcagggatagctgcttaaaatatcagtctcaaaatttccatggcttagcatgagagaagtttatttcttgttcacctatagtccagtgtaggttttctttgtaagtagggtggctttcctgtatgtacataggatatggaggcctaggcttcattaatcctgtggctctgccatcccttagggtcttggagatgtctgcattttgccagagtcggggagagatggttgagaaagaacttgtgcttctaagaataaaagtcttggacagtcgtgtcctatgcccacattcagttggtgggaacttcacgtggaagtcgccccttggtgtaagggggctggggaatagtccctggctgggcacttgtctcatagtgccaactccacaggaacttgggggagcatggggttttgatggatagctagctagccatccctgctgtactgtctccttgaggataagattagaataattaatattcattaactggggacagtttcacttctgttaaggtgctaattatgttaagtggtgaatttttatgtggaaatcaatttagatttataactaaatgggtttcttgcctcctttggtactgaatagttgtgtgattcattttaactaatttccttatactttatagttaggtcacctctcagtgaaacctagaaagtaccatatttacatcaattttgcaaaccactaaggaagaaaaaactatcaggctatgatgttccattgcttgtaaacattgattacattagatttaaccccttctccatcttttttctccttctcctttcttctagtttgaaattggcacaatggaagaagctggaatttgtgggctaggggtgaaagcagatatgttgtgtaactctcaatcaaatgatattcttcaacatcaaggctcaaattgtggtggcacaagtaacaagcattcattggaagaggatgaaggcagtgactttataacagagaacaggaatttggtgagcccagcatactgcacgcaagaatcaagagaggaaatccctgggggagaagctcgaacagatccccctgatggtcagcaagattcagagtgcaacaggaacaaagaaaaaactttaggtaataatccgttcagtggttggacgtttcacatgctaatcattttacttgtgttttctgcagcccagataattttgaacacagccactttagaggtgcttagccaacacccctagtgtcttcggtgaggtcagtccatgtgtctgctgcagttatgtgcaggaggcgaaaacagcagagaggacgcttagttttttttttttccaaataatcaagaattggctaattaaaaaattttttttgtagagacaggttctcactgtgttgcccaggctggtctcaaactcctaagctcaagcagtcctctcctgcctcggcctcccaaagtgctgagatttca

SEQ ID NO: 136336 - DNA, 1176 bp, Homo sapiens
gcctctctctgccaaagtccttacagtattgctaaggtctttccccacaggaagagctatcttgtcatcctttggttagttaaccttagttaacacacagaatatacttagtaaatcataagaaaagcacacgtttttaaattgttcgtaggaaaagatatgttctcctgtgattatgtgtgtctttggcaaagtgtagtaccaactgaaactccctttgaacttgcttctatattcgaacttggttaggaggaagctttaaaaaaaattccatgccctttgtaacttgccctttgtcttaacttggacatcagtgattaggcaaggaaatttataagcttttaacaagagttcttataaatagctcgcagtgttagtgaatgagttaagaaatttggggtgggtatggggaggggagcgaggcctgctaatccagaatttaaaaattgcctttttcattgagctggtaaatctcttatttataatcataggtgtaaattagtttactctggatgtcagagcacgggaattgttagtagaatttacaggttagatttgatctcattcttctgggacttatttcttttcttgttaaccatcaggaaaagaagttttattactgatgcaagccctaaacaccctttcaaccccagaggagaagctggcagctctctgtaagaaatatgctgatcttgtgagtattaagccaaggatgtgagagccatataaaatataacaaaatgtgtgtgtgcttgataagtttcttaaagtacaaatttgatatggccttaaatgtaaaattatattttattctgaaattgaagaagagaatctgttttgttggggctttttattggttgtatagtttcattttatgaggtaatatatagggaacattgtaatactaagatgtggcatagattttctaaaactcagttttagagtctaagtcagcctttccattgctatgttgtgatgccttaggtgccactcagttggggtgtagtggttcctgtcttaaacttttcctaagggaattctagagattgaggactgttttgattgagattgtgagttacatgaaatcatctgctaaaacaatactttgtctcagaaatacttctttagcatctactatgtgtcaagcatccttttttccattttctagaaacagtg

SEQ ID NO: 136337 - DNA, 1123 bp, Homo sapiens
gctgcagtgagccgagattgtgcaacagaataatagtccatctaaaaaaatgataatgaaaataaaaaaatcaaaaccccaaagcacaataaattgattgttaaaatatttggatttcagcgggttttttgccaggtaggaaatgatctagacagacattcacccagcaaacagcaattcgggacatgcctggctttagcactgagtcactcctggccttcaacattggagtaggtttcagctagaactggagctggtttattttccaaagggttaaggctggaatacttgggcagtgttcccagtgggcccaggaaaattcaggggcaggaggtatccagttgaagggcatcatccttcaaaaagcacaagatcatagctggaagttgaggagcccatgttgcttgtgagttgttgggttgaaagcagggagaagatctgtgatcagtgtctgaagtcagaaagctggcaaaattcaggaccccaggggatagcaggccaatacggaagtcaagaaagccagagattcaggctgctgggttcaaatcccacctcaccccttactgattatctgtactaattaaagaatgttaggcaacttattaatgtctccaggcttatacatttcttctataaaacctggataataaagggttgtgaaaattaaatctgtctaaaggatttttttttaaaaaagaaaaagatggattattttctgctgccctaaatttgcttacttttttgtcacaactggaagaggagagaagagaagggtggcagtgtagcatggcatgaaacaatttaaataatatattaaaccatagtatttgactttttgaaaatgtgttccatagctctcattataattctagccataactgtaagatttttactgtacttcctaaatacaaagtgcttatgaattttagctggaggagagcaggagtgttcagaagcaaatgaagatcctgcagaagaagcaagcccagattgtgaaagagaaagttcacttgcagagtgaacatagcaaggctatcttggcaagaagcaagctagaatctctttgcagagaacttcagcgtcacaataagacgttaaaggttagttgcttcatttgtctgtt

SEQ ID NO: 136338 - DNA, 1485 bp, Homo sapiens
ggtcttttgacactcatatcctagcaagaattgaaagtaagctttgaattttttgttttttctttttaatcatcagaaagtagttacagaaaggaagctttttgagatgaggattccatttgtcctttgccctttagggagtaagtgtgacccagaaagtaagctgcaagggggcaggatctcttccgacccatctaagatgatggcctgtgtaaccggcgagtattgcagtagagtgaattgtagacagccataacatttattttgtagcaggacagtttgcatctctctggttatctgtctacttaggaaaaactgcttgcttttcagtgatagccttctggtcataaataagggggaggaattgtagttcagaagcaacacgtcagggcagcaacaaatgaacccacattgcagcagcttctcttgtgagcatcttctctataggtctgtattattaacaaaaattattttgggtaataaggaggaaaatatgcagcaggcacgagaggaagaagaacgacgtaaagaagcaactgcacatttccagattaccttaaatgaaattcaagcccagctggagcagcatgacatccacaacgccaaactccgacaggaaaacattgagctgggggagaagctaaagaagctcatcgaacagtacgcactgagggaagaggtaatggcatttggtttatttaaacggcttctcaagattagcaaaagtgtcaccattcatacctaaagtaaaactgctgtcacgggtgtttcagaactttgcatatgcatagtggcagtcggttatttattaggaaacgatcaggcaccacaaatgagatcatcacttgatgtcccaggagtcactgggtttgggacttatttgaggttatttctaggagacccgtttaagtactgcttgtcttccatgaaatactggaagattgcaattttcgcatgtagattgttttcccttatccagactaatagtgaataaatatttgggccccaaataccctgtatctcagacatctatgataatctctacagtatccactaccattgcattatacttgtacagttaatgtttcagattttttttttttaaatgagggctttatattatttgggaggaaaaacctacttctaaccccttctaacccctcacacataagcccattgagggtaaaaagtttactgggaagatccatggctaatgaacttggccattggccttcaatgaagacttttggaattattttataagctaatctggaagttcagaggtagtgtcctctgaacaaagcgaggaacttgaaaaaccaggttagtacctatttgctagaaggtactaacctggtttttcaagttcctcacttttagagggccgatggacagggttagaggctttaggtttttttaaatggtgcatctctgccttttaacatttagtaaaatgttgggcttgttatgttatgttccttacag

SEQ ID NO: 136339 - DNA, 1030 bp, Homo sapiens
tttggtcagaatataatgatcaaattacttgcaggcgctctcttgagagcagtctgtggtgctctcaatacatagttagaccaccttacttcaccaaccagcattttcccctctcatgtagggtattgtaactggaagagttccgtttctccagctgggaagggattgttctgttgactttattatacatcagtaaccacttaacagttttgtttggaaatactaatgaacttttaccaaatgtctaaagtgtgccaggcaccaagcaccttacctagtgccaccatcgcatttactgttacagctctgcaaggtaggtggaggtatccccctgtacagaggagggcactgcgctccagcgtggagaggaattagcccagggccacacactggccaggatttgacctgggccattcctaccatcataccatgctgcctccagctaaggaatttgggaaaatatggggagggaaaaaaggaactgtgtgcatgatgtatggtttagtactttgctcttcttatccttctttgtcttggtgcactctgagccttattttcagtgtggggcagaaataggaaataccaagctggtgagggggacagcccatgtctgacagggtgggggaacaggcaacagtcaaagggccacgcttctgcccatgtgggatggtttgcaaggtggtgtcaaattgccgcttctctcagcggagtatacagggacagagagagagctggtgttcttagctgcagtggtagtagcagaacagcagggtgagcagggtgctgtaactgctgtgatgtttcctccccactgtgttcctttctttggtgagtgatggaagaaactctccttttcccatagcacattgataaggtgttcaaacataaggaactgcaacagcagctcgtggatgccaaactgcagcaaacgacacaactgataaaagaagctgatgaaaaacatcagagagagagagagtttgtaagttctacttcttaaaaacaaagacattattgccaacattgtaac

SEQ ID NO: 136340 - DNA, 1057 bp, Homo sapiens
gaaagggtcactgaagacaggttgactaaccgtcccaggctgcctgagacggggcatttcctgggacacgagactttcagtaccaaaaccaggaaagtgctgggcaaactgggatgaggtagttaacctaaataaagtggaaaataccaagagggccatgagatttctgcctcagtcctggtcagctctggctgggaaaaagcaaaaagcaaaaccatcttagaggagattgaagatatgcagaatcaaaggaaccacagatttttcttacaaattgtactatcccctgctgtgaagttacctgctgttttagttgtacttcttgctgtttcatttgttcgtatttgtgcctcgattctgtcgcttcttttaataactagaaaacagaaacattctggcaaaatgctaatggtaattacaagcaggactaaatatcaaatgatcagagttaggcttcatccttctattttagcaagaaccacaggtctacagatgaaacagtctgttccacaaattgccatttacctgtatcttctatctgtcccactggttaacacttaggaatgcaggaacaatctttttattgctgaagcagaaaaagtaccctgggggcctaatatggtttctaaaactcagagttaaattgttgtgttttaggtgaaaataattacatgtacagtattagcagagaacacggctgataatcttgatattatctgggtgacttagaaaagccccgctattccctgaggcaagacgaggcagagtgaaagcgtatggggaaagcaacgcaatcaatcttgagacctggtttctgagcacttttttagaaagcggggagggggtggacattttcatttatatatagtacttgtgctttcaagaaaatcacaaagttgcatagtaggcagttgtgaaattcagtccctgaagtaaaatatcacacatagtccaaagaagcctagaaaagtcctactgaagcaaccagaaagtacacacatgtaatgaatatgagtgtgtgtgtgtgtgtgtgtataaaatttatattccaactttg

SEQ ID NO: 136341 - DNA, 1048 bp, Homo sapiens
gactgagttttctgtccattaaacgaattcctcagattcttgggaggacagcgatcttcagccccacaagacattaagaactgacactccaccacaacctccaagaacacatcagtttcagaactcaaggcagcatgattcaggtaagactccagtgaccaagaagataaaagtagttaatacctcagctttggtcatcctcacaattcgtgaggctgatttacttcagattttgctaaagataaagtgggtccccaaatcagggaagtgttaaacctatgctaccagaacacaattttcagaaattcaggatgcatttatccatgcctgtagctagctactttctcaatatgccttcatctactgttgactgcacaccagctctgatccaggtcggggcattgagccaggtggtgttaagggaaacaaggataagacagagccagtgccctgtgccttgggtaattacccacaaaactgtaacacaaggcaaaccgggacaaaggccatgggaagagctggtggaagacctaggttgactgctgacccatggtgatctctgcagccacggacagagaggaatgtgttccagtcccagaggaccagaaggatggcagatccaggaggcgggaactctctgttccacctcaacagtgagtctgtgctggcgtccagctatcacctgcactgtgcctaacagcgccccctcaattgcagcctcaactgaaaggactggcaggcagaacgaatctgctgctcatggaattctccagattaccaggtctaaaaatacctggaggtggtaatttgagcaccaatcagccacatggtaactgagtacatgttaatgtgccaagcactgtctgaaatactctatttcatgaagggcaggtttttgttaccaattttaacagtgaaggaacagaaaggtttaacaatttgtccatagtcacacgttctatgatgcaactgggacattaacccagggcgcacggtctccaccactatgtgagatctaataatagtcatgactaacatctactgaatg

SEQ ID NO: 136342 - DNA, 1062 bp, Homo sapiens
aggagcagggagagaaaggacaaggcaatgaacacatgcattccagtggagggagaacgaggctgatgtgcaacacagctgaggaaaatttatagattaaactattcaaaactgctaagcagcctcctgtaccacataagtccagtagttctaagaaaatacagatatggtagaaaaagtaagaaaattttcaccacaaaaccaatagttaactactaacagagaaagttatacacaaaatatatctctcaatacagtgatcacacctcatcttagtcaaccgactcgatggccggagcagagcctgtggacgggggcttttgcacagcgcttctctgactcttgggctcagcctccaggtgcgctcccagggctcttttcgaggaagtgttcagctccttgtgagaatccagggcagtacagggctgcatcacaggtgttgctaaatccctgttcgccgctttgatggccgctttgatggatacctgctctttcaggacttccaccttctcattgagctcattcctttctgtctgaagagccctgcacagcttctctaaccgttccagttttatttgaagggccttgtactctttatcacggactgttttctgtaagaaaaaagaggatttctgtaaccctgttaaatatcaatcaggttacaaaaaaattaagccagctcagccatattggacacttctcacctatggaacatgttccgtctcttcagcctcctaacattctagctagctagcatgactgcacccataactataccgaatgagatttagcatattgtttcagggggacaaaattaaattccttttgtcactttttttttttttgagacagagtcttgctctgttgccaggctggagtgcaatggcgtgatctcggctcactgcaacctctgcctcctgggttgaggtgattctcctgcctcagcatcccgagtaactgggactacaggcgcgccccaccacgcccagctaatttttgtatttttagtagagatggagtttcaccatgttggccaggatggtcttgatttcctgacctcgt

SEQ ID NO: 136343 - DNA, 1304 bp, Homo sapiens
atctctactaaaaatacaaaaattagctgggcgtggtggggcgcgcctgtagtcccagttactcgggatgctgaggcaggagaatcacctcaacccaggaggcagaggttgcagtgagccgagatcacgccattgcactccagcctggcaacagagcaagactctgtctcaaaaaaaaaaaaagtgacaaaaggaatttaattttgtccccctgaaacaatatgctaaatctcattcggtatagttatgggtgcagtcatgctagctagctagaatgttaggaggctgaagagacggaacatgttccataggtgagaagtgtccaatatggctgagctggcttaatttttttgtaacctgattgatatttaacagggttacagaaatcctcttttttcttacagaaaacagtccgtgataaagagtacaaggcccttcaaataaaactggaacggttagagaagctgtgcagggctcttcagacagaaaggaatgagctcaatgagaaggtggaagtcctgaaagagcaggtatccatcaaagcggccatcaaagcggcgaacagggatttagcaacacctgtgatgcagccctgtactgccctggattctcacaaggagctgaacacttcctcgaaaagagccctgggagcgcacctggaggctgagcccaagagtcagagaagcgctgtgcaaaagcccccgtccacaggctctgctccggccatcgagtcggttgactaagatgaggtgtgatcactgtattgagagatatattttgtgtataactttctctgttagtagttaactattggttttgtggtgaaaattttcttactttttctaccatatctgtattttcttagaactactggacttatgtggtacaggaggctgcttagcagttttgaatagtttaatctataaattttcctcagctgtgttgcacatcagcctcgttctccctccactggaatgcatgtgttcattgccttgtcctttctctccctgctccttgcacattatcatcctaatgaaaatttcactgacagggccgaccattacaagggaactttgttctgacgatggttccttgatgtgaaaacaatattaatttaaacgtcttagcccccccccccataatattattcagaaaaacaaaataccaaggcgattagttttgtctaataacccatttaaatgccaagtaaaaataaaactcctagtgttgggtcagaagcatatttgattgaaattagctttttgaaaacatttatatctcgggacaaattgagatggccacat

SEQ ID NO: 136344 - DNA, 1306 bp, Homo sapiens
ggtgcgctacaaagccacaacactgggctggtgaggtgatcactgtaggaagatgtccttctcagggggtcccatttgtttttattcacagggtaatgggaggaagggttctgaaaggacaacaaatgcatcccagacagaatccatatcctttcaacactataatagcatctagctaaaaatacaaagtaagccaaaagcagcaggccaagtactgttaatcacattgctttaaagcccttggaagtatgcaacaggcccaagatttacaatcttccacacaggacaagcaccacaaagaaacgtggtgggctacacaaatggcttaataaaatgttaagagctgtacatccagcagagttcttgtgaaataatgtgatcattagtactaattttaaggtggattatatttctgatctatacctgcattcccccccaccaccagggaaatgagtctagtattttagtagcagaacagggtgtactcctaagaggctgttggagggtggtgttttttgcttctgactcattttgatggtaattagataatctactttgtggatttattttcctccactgtggccccttgaattaacatgactgatagtggaggcttagatacaaccctcctccactccaggcggtttcctatctatctatctgttggacaattttcaattctttcaacccagtttcgaccatgaatgtgacaggactttacaaataacacttgtaacaaagagaaaacccttttaactggacaaaacagagtttattcagtccagtaagcaatttaacaagtgtcagtctgatagttttgctcagtggaatgtgctaacatcagttctagtagaaccttttatttcataaagcatttcaatgcaaattataccagggacaaagtcaaaacttccatcagtgcagcctgattaatcatctgcataactgcgccacattcaacattgaaacaaagaactaattcaaaagttatgtgcttaatttcaaattttcccccagtccaagtgtagagaccttgataatactgtggcttttcttttttcttcttaaaaaagagatggtaactaagaagggggtgagaaaacagactgaacacgtaagtaacagatcatgactaacactctgccaagtcttcccaaagtaaaaatgttggtgccagtgtttgttttggaaatgaaaatcaatttcggttggtactgatccataatgaaaattcccttttgaaaaacctggagtactttgctggtggaatttttgtagtaactttcaagtagccagaaggtattgg

SEQ ID NO: 136345 - DNA, 1196 bp, Homo sapiens
agataggaaaccgcctggagtggaggagggttgtatctaagcctccactatcagtcatgttaattcaaggggccacagtggaggaaaataaatccacaaagtagattatctaattaccatcaaaatgagtcagaagcaaaaaacaccaccctccaacagcctcttaggagtacaccctgttctgctactaaaatactagactcatttccctggtggtgggggggaatgcaggtatagatcagaaatataatccaccttaaaattagtactaatgatcacattatttcacaagaactctgctggatgtacagctcttaacattttattaagccatttgtgtagcccaccacgtttctttgtggtgcttgtcctgtgtggaagattgtaaatcttgggcctgttgcatacttccaagggctttaaagcaatgtgattaacagtacttggcctgctgcttttggcttactttgtatttttagctagatgctattatagtgttgaaaggatatggattctgtctgggatgcatttgttgtcctttcagaacccttcctcccattaccctgtgaataaaaacaaatgggaccccctgagaaggacatcttcctacagtgatcacctcaccagcccagtgttgtggctttgtagcgcaccccgtatctaccatattctagaacactgtaatgctactaggctggcccagaaaaggtttaaatgttgaattcacttaaattgcaattgttgcaccatcatggaatcgtgatgtgtattatttatattggcggtggactccaaggtgtagagaaaacttgggtcttgggtaatatggaccatttcatcctcagacttgttaggagtacatttcttggtcttgagaccagtatttttcagttatgtatgcaactgcctttattacacctggttatcacaattcaattctcaggtgttgcagaaaaatctacctctttcagactgtagatggaaataactgtgaaaaaaatgatgcagatatcttctagtttgtgctaaacacactgctttatttttacagcccacgtctttcatgaggatacgaattgttaagaggcagtctcgttttgcttttcaaagacattttgtagagatttttcactaatgtgaatctgattttatctacttgattctgtatagattaagtaaatatgtatgataaactt

SEQ ID NO: 136346 - DNA, 2913 bp, Homo sapiens
tagagacggggttttgtcatgttgcccaggctggtcttgaactcctgagctcgagccatccgcctgctttggcctcccaaagtgctgggattacaggcgtgagttttacccagccccacctcatatttttaacccgataagattattcggtaaaatagatacattgcataatacctagttggcaggcagagacctcattgtcaaactagagtcaaatcagactttgtcagaaagtgtgatgtcccagttccaaacagtgtatttagtactgtccttgtgaagaagtgtttcgtttaaatcttaattctaagataaaaaaataaggcatagtgcattccgacgaggttgtctcttgcggggaacaactgctctcttcagaattgtttagcaaagctctcaccttaggcatagcttatgagggactatctggagctatgcttttggagccagggattttctttcaccctggtgctgtctgtgtacgttggaaagatgggcaagaagtatgcctctctcagtaaagtggagaggggaagaaccagaagactcctcaggccccttgtataatagaagagtatgttacatggcatataacggattgattaccttagatgtttgcacctaactgtatatgagcaaatgatgctggattaatgttcatcataatcagtatggaaatggcattttgactaggaaaatgtcctcattcttaagggatgcaggctgaagtcttcagccatttcattgtataggctcatggataaagcatcagttatgctagtatcacttggtgaatctaggtaaagggtatacaggtatccattgtactatattctgtcacctattctggaggtttggaaatttgcaaaataagtataaatagattactgagcctgtaccaccttctaaaaccagacagcacccacccccagttgaaatactgatagctctaaaaacttagtaaaacctttgttaggattaacaggagagtatatgaaatcaaagctttttttgttcttgtaacagtttattcatggaggacacactgctaagatttcagattttagctggaaccccaatgagccttgggtcatttgctcagtgtctgaggataacatcatgcagatatggcaaatggtgagttaaaatgtttttcttgaatgactgtcttgtaaaggagagatttactacttacataatgtaataaagttatttcgaatatgtaggtgcatattatgccaaacatttacagaaaccgtttaaaagaactttttccatttcaacaatacaatctttagtcccatatggtgcttcgtccactgtttgctatttgtagcacctgtcaggtcaggagaaatctctgcatctgcactgattttcattgttgttgtgctcttcatacactggagtcttggcgtcgctactctgtctccagtgtctgttctgtgtggtaggcatgagggatacaggaaggagaggtcaaggcattcaaatgacagcaagttctctgaggatgagcactaagtagctgacatttctaagttgttgttaaccgagacttccataacatctgggctaccacttcctctaaacgatgcttgaagtgcctttggaaaacatctcttatgaacagtgattgaaataagtagtgcatcgatgggtggctaagtatacatacggaattacacactggcaaagaatttttcaaaatactggctagcctaccatttccttattgaagtttttaagagagaaatgtaaaaatgaaactattaagttctaaatagattaaattgtttttacatgaccatgtgaaaaccatagggagtttttacctgtgaatttatttggttatctccaggctgaaaatatttacaatgatgaagagtcagatgtcacgacatccgaactggagggacaaggatcttaaacccaaagtacgagaaatgtttctgttgaatgtaatgctacatgaatgcttgatttatcaagcgccaaaaaggcattgtatagtaggaaatgtaagtggggtggcttatggcttctttatcctctgattctagcactttcaagtgagctgttgcgtactgtatcatattgtagctattagggaagagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacacttcttgattggctttgcagaaataaagttttaaaataaaacttgtgtttttttaaaagcttagtgggggggggcgggggagtctactttttgagtagaaatgggtaaaatggtacctttggactcctacagttaaggtcacatggataatgaaagaatacacagaagctgttaagtttatcatacatatttacttaatctatacagaatcaagtagataaaatcagattcacattagtgaaaaatctctacaaaatgtctttgaaaagcaaaacgagactgcctcttaacaattcgtatcctcatgaaagacgtgggctgtaaaaataaagcagtgtgtttagcacaaactagaagatatctgcatcatttttttcacagttatttccatctacagtctgaaagaggtagatttttctgcaacacctgagaattgaattgtgataaccaggtgtaataaaggcagttgcatacataactgaaaaatactggtctcaagaccaagaaatgtactcctaacaagtctgaggatgaaatggtccatattacccaagacccaagttttctctacaccttggagtccaccgccaatataaataatacacatcacgattccatgatggtgcaacaattgcaatt

SEQ ID NO: 136347 - DNA, 1086 bp, Homo sapiens
gcacacttgtactttgtccatgagttttatttattcattttttctgtgaacctatggagtatattgaatgtccacaagttttcaaaggtaaagaaggtccttgagagcaagccctgcacacagaagatgttcactaagcccaccttgtaagaatgctccagacccttttattttgatgacggctttactgagatataatttacataccacacagttcacttctttaaagtgtacagttcagtggggagggagtgttcttgggttttgggggttttttttctttttttgttcttgaagtcagtggtttttagtatattcatagacttgtaaaactatcaccacaaatcaattctagaacattattcatcccctccaaaagaaactatagctatcacctcccaattctcttcttcctccagcccttggcaactactgtgctactttctggcactataagattgggctattctagatatttcatataaatatgacttttgtcttttgggactgattctttcacatagtacaatgttttcaaggtctccagctattttttttagggagaaaggaaagcgtattactttgtatattatgcctctgcaacaattccaaggtccttgagaaaatacactaggattttgctttttacaagagagcttgaaatcaagggacatttgagagtagtaaactgggcctgggcatggtggctcctgcctggaatcccagcactttgggaggccaaggcaggtggatcacgtgagcccacaagttcaagaccaggctgggaaacatggcaaaaccctgtcctgtctctaccaaaaaaaaaaaaaaatacataaattagccaggtgtggtggcgcgtgcctgtagtcccagctacttgggagactgaggtaggagaatcacctgagcccgggaagttgaggctgcagtgagccatgatcacaccactgcactccagcctgggcaatgggagtgagaccctgtcccaaaaacaaagtagtaaactattccaccagtatgctttgataactcctgtatgttttctaagccccagtgatcttaaaatatattcacctgtgtacc

SEQ ID NO: 136348 - DNA, 1086 bp, Homo sapiens
gcaacaggctttgagtgaagtatagggattgcacatcagtttatgtgtagatttttttaactatacatttcaccttttaattctaaggcaataaacagttaatgaagggattttgagttaatgtttattattgacaataattcctcattctgcaacttcaattatgaacaactctaacttatttccagaaagtaaacatcccgtccttacaccaaatataaacagtagccagatgtggtgaggctgaggcgagaggatcgcttttgagcccaggagttcaaggctgtagtgcacagtgatcgtgcctgtgaatgaatagctactgactgcagcctgggaaacatagcgaggccatgtctctaaggaaaaaaaaaacctaattgattgtagtatagaaataagttgtttttgtgagtgtgtttatgttttaagattactttctgggctgatactggtttagcagatgttcgtgctacaagaatttcactgatgaaagcgttatattctttattcttacagtaaaattggggaagaacaatcagcagaagatgcagaagatgggcctccagaactcctggtacgcattggcttatagaagatgaaatgtcatatgcagattggattgtcattgatctctttatttcgagaatgggtcagaacttcgaattctagctcttgcagatggtttcaaaatggaggccctgaaggttattgcaactgggctttgacatttatcaaaaatagtaaatggagcccagtaggtttttatgaatgtttcactgagaatggtttgaggtcctggaaaatagtatatagtaatttctcactgatttcaactctggtatttgtgatggtttggggatggggagtgagtataattgctattcagttggcagtacttaacatttcctaacagtatagaaaaaattttaaatgctttttaagtttcctgcccagaaaaggagtgctttctcaatcttgatgttagcagagcccactatctccctcccatgcctgattgaagcatcacgcatctccttggccctttgaaagcttatgtggtggtatctgcccatcctcattctt

SEQ ID NO: 136349 - DNA, 2883 bp, Homo sapiens
gtgtccttttcctctgcacctcacatggaggctgcagccacatactcttctgtttgcttatattttctctcttgtgtttacctcaaacttatatagttgaatagttttgtttgtaatgaaattattttaaataagatgttagcatttaaattcaatctcttgaccgggcacagtggctcacacctgtagtcccagcactttgggaggccaaggcaggcggatcacttgaggccaggagttcaagaccagcctggccaatatggtgagacccccgtctctactaaaaatacaaaaaaaatgagccaggcatggtggcttgcacctgtaatcccagctcaggaggctgaggcaggagaatcgcttgagccctggaggcggaggctgcagtgagccgagatcgcaccagcctgggtgacagactgagacactgtctcgagggaaaaaaaaaaaaatcagtctcttatagcccttgttcttttttttttctctccttctctcttagactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatgtaaggtggaaaattcagtgggatcttgttaaatgggtgacctgaatgaccatcagtgattgctgcaggctgtagtttgattttttttttttaagttatggctttaaaaaacagctttaggtagcttactcctgtaatctcaataccttgggaagctgaggcaggaggattgcttgagaccaggagtgtgagactctacacaaaatttaaaaacaaaaaattagttgggtatggtggtgtgcacctgtagtcctagctactcaggaggctgaagtgggaggatcacttattatttagaaaaaaagaaaactaggtatggacatgtgaaggaacatacttggtgtggtggtaaatatcaaaattgagatccagagtgatgccagttggaggtcgaggaggaaaatgatttcatcaaggtgtggccacagggcttcattcacttataatcttataaagaaatacctgaggcaaatgtgacaaaatactgggcatttgtcaaaactagttttaggtatcagattgtgacattattctctacatagtctgtattttgtgtacacttgaaatagttggtaattaaaataggaatctaatttaaaaaacaggactaacagccctagcttgttctctgtaggtttcgaatgtatcatttagtggtcgaggtctgaatcaccagctgtgtggttggtttcttcatgaaggggagcacatagtggagctagttgtggagtgcagtgacagtgatgtgaggccgaatgtgagtgtgtcatccctgggtgccgtgtgcctttacctttgtgttttagatgggacaccaggtccaataccacctccaagccgagtcacttggtggatgcgcacactgccgaagtcaactgcctctcattcaatccctacagcgaatttattctagccaccggctctgcggataaggtttcgaagtttttgcattatttggtgtttataaaacccagttctcttgtgccttaatcagatatttgaaaattcttaggtaaagcatagaaatcattttcacttgttatttttctttagaccgtagctttatgggatctgcgtaacttaaaattaaaactccataccttcgaatctcataaagatgaaattttccaggtatgtgacagttttctggtgtctgtatgtcaggaaatgaaatccagggattcatcagttaagctataccagactcgtgggtccactattgaaaaaaatgtcttgtacgtggtgttacatggagatgctcatagggtaaggtacaccttgttgaagaattaaaaagcttctgggatggttatggggtcgaataaatttattgagatcccaggctgagttcctcagtgctggggagtgcagccttcctgaggacaggatggagctgagcccttgcagagcacttgaaagtcggggacaagagagtgaggccatcaggccaaggataagataatagagtgcaagatgggaaaatatcagattagaacaacagccacaaacctagcagcggatgattctttaaatacattttcaaaattatctattactaggtccactggtctccacataatgaaactattctggcttcaagtggtactgaccgccgcctgaatgtgtgggatttaaggtaacttacagtcctgtgacaagatactgcataaatgtgcctatctggcaagttacatagtcattcataaactagaaaagcaatttggtaatccccccttcaagaaacctaatattaaagaaacttctaagcatcttcctaaagagcctttgttctgtaaaatagaagtgaagcagcaaatggaccataaaataaatttctctagtgtgagttttgtctcttaatattcaggcatgaaggtgtatgtgtctgtttttgtttttgcattcaaatgactgtatttaaaacacacttgatatagagaaatcaagatgttagctgttttatgtctcattggatctcagtacgtgtaggcaggactgttttttctgggtttttgtaccatttactttgctttcagtgattcattctgcagatgtgcactcctgctgtgggttgtgtaactgctggggagacctttgtgaaggggacaaggacagcccaagctgtcagagagcttatgttctctggggcctcattgtataaagagtttctgccaatttttaaagttcctttagttcagacttgctgttctaagaatttta

SEQ ID NO: 136350 - DNA, 2218 bp, Homo sapiens
gtcttattcacacaccagatgggcggagaggttaaccttggcactgcactagcagttaaaccaagtatgctggcagggccaatgtatgtgtgtttagggacaggtaggggttagcgtgggtttctgattgatttgaggatgcttctgacttcagactcaaagggtgttcatactgtggagggttaaaacctttcctgttttgatgaatcctaaaataagatgctaattcagtgcagtacttacagtgagttgtatttgaactaaaaagctattggtctgcttattatatggttacttgaaatttcagtgaataactatatcatcttcataactgaaagaggacagttgttttagatccaaggtggaactgaattaagttgcataaggcagctaccaatattttccagtgcaaatgggctttaagaataaattgatgtggcaaatgaacccacatttttgggttttctctatgcatgtttctgtctttgtcttgtcagtttgtgttgtattctgccaggtcaaaatctgttaggttgattgaactaagtgatttgtgaattttaatcctgagtgtgtgtgtgtgtgtttctttctcctcacattagaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccaggtatgtaataatagagttaggtcattacttgagcagttttcttgattcaaactggtaatgtttttaaggtcaaagtagcatactttataatatttaaaggtttaaaaattgctttgggggtcccataaccatcctcaagttcagggatttgccagaactacctaaaagcagcttatactaacagctaaagtttattacagcaaagaatccagagcaagagtaggaagaaaaagatacacatcaggggaagtccagaggggttagctacaggcgtctgagtccttcccatccagggccacgtgggacatgttttgtctctagcagcaaaccataggaacatgtgctaaatgtctctacccagggcagcccatttgagtttcagaatctgggatttttgtggaggtctgttggcgtgggcacatcctgttctatgaccagccatggtaacaaaattgaggaccccaatagtgaagccaaatacattgtgaatcttgctaaacaatcctacaagtcttgacaggtccctatggcataccccactgctctgggcttacaaaactttatcagtcagtgacgtgaagaactttctgagggtcacattcccaggggttggccaagggtcatttatggttgcaggctaccctagaggcatgcaaggactgagcaaccagacctgttgtgttagaaatatttctaaaaaattggggggttgcggggatacggtcaccactgcccaaatttgtaggatagctatagtttttaatatttttgtgttggggatagtattaggttttccaaagaaaccaatcatctaatggtcatgaggctcaatttgcattgggtattaaagaccagatctcgttcgtgtgcagttgctgtaatggttcactcaatgaaggagtgagaatttattctcaccagttctgataaacagagaataacttaatgtttttcatcttttcttagacccaagtggagaatgtaatcctgatctcagattaagaggtcaccagaaggaaggctatggtctctcctggaattcaaatttgagtggacatctcctaagtgcatctgatgaccatgtgagaaacgtattctttgtaatttgttcatatagtgagagctgacgtgtcacagctgtgctgaaggagtactatatagatgaaaggttttctaagataatactgctgattattgtggtaacattcccccaggactttagagagatggttttcatactgccctgtatgagtcttcggattccacagagctcttttgaagtagccttagaatggagggagcataggcaaaaggcctcccattatttaaaagaggaccctccaggcccttaaaatggaaactgtagagtgtttgtgggacctgattaatataaagtattttttaagtgtacagttcagtgggttttagtatattcacaa

SEQ ID NO: 136351 - DNA, 3326 bp, Homo sapiens
tcctacttcctttccccagtcattgttttcaatttcctaacccatccttgccagcgtgtagaagtgcatacctgtatcttcattttttatggtagcaagttcttcacttgagtttgtcagtaagagtatgtattggagattttcctgtcagcatgcttggatatgcttgttcttttcaagagtgccatagaattttgtttatggatacactgtgtaatgtatgataccagttccttgctgatggatacttagttattttcagtctttttccttctataaacaatactgctgagaataatcttgcaataggccagatttatgtgatgcttggctaaatttcctagtggtagttactggggtcaaaggattctgcactgaaaatgaataggctttcttaaccattagtccttctgcagcctttaggtacatccagtattggaggaaaatagtgtcatattgattagtttaggaaaacaggctgtgttttaatgatggaggtgaagggatttctagtaaaaagaaaagtcctcatatgatgatcaagttggggaaaactggaataattaaatttgagtccagagggatttttaagctcctccagtccgtcttgggacagtgttccttagaaagggcctgtgataaactgacctacctgttattttttacttgttggtcttagttttcctgctcaactccacaaaaaacaagtgacttttttcctttgatgacagtaccagcattgctctgtggtgccttctttctctcaagcattattatttctctttttaaatatttatttaaatttttgttttttgtttttgtgttttttgttttttgtggagatgggattttgccacgttgcccaggctggtctcgaagtcctgggttcaagcaatccgcttgccttggcttcccaaagtgctgggattagaggcgtgagccaccacatccggccaaatatttattctttttttttttttttttttttttttttgagacagggtcttgctatgttgcccaggctggacatgaactcctaggctcaagcagtcttccgtagtagccctagtagctggtactacgggtgcacagcactgcacctggcttaccctttcattttaagccactattccctgtaaaggtttgatttttatccaagtcctcataaagtatgttgcttagagcctaattttaatggttttactggttaaaaataagtgggcaagccagatatggtggcacacatctgtagtcccagctgctgaagaggttgatgtaggaggatcaacttgagtccaggagttggaggccagcctgggcaacatagtgagaccttgtctcttaaaaaaagaaaaggtcgggggtggggggcacatgtgctcatgtgcattgccccctacatacatataaagaccacctaagatggaattaattaattttttgatagccacatcatattcttggcccactgtgcatgtatcaaccaagacccatgttttctttctttttctttttttttttttttttttttggagacggagtttcactcgttgcccaggctggagtgcaatggtgtgatcttgagatcttgactcaccacaacctccacctcccaggttcaagtgattctcctgcctccgcctcctgagtagctgggattacaggcatgcgccaccatgcccggctaattttgtatttttaatagagatggggtttctccacgttggctaggctggtctcgaactcctgacctcaggtgatccgcctgccttggcctcctaaagtgctgggattacaggcgtgagccacggcgcccatttgtctttttttcaaacacgttgctattgcttagtcacggctgccttactctgttttggggggagtgtgtctgtgtgtgtgtgtgtctcttctccatgtgcacacacttttttaccgtaagccaaattttggtaaaattgcatcttgtattttcttattactaaattacttgcctagaagtaatcttcaatctttttagaaaaaaaaaaaaaattgaatcctttgtgcagctgaaatttagaaacagataaatggcctaacttgtcttgtgttagggcctagacccctacttctcagtcctcttcattgaagtgggaccatggagcacagttgaaaattgtattctagataatacaaatgggaaagcctttttaatagatactgatgcaaaaatcactgctcggaccaaggtgccaagaggtttgggcaagttcttcagcctcaaggtgtttccacagaacaaggtaacaaagatacctcggtaaaattgagaatgttcgtttcataaacttaggtatcataaacgtcagtgagtttcacatcatgccatttgcacttatagcctattttattcagtgaagaaactgaggccccagggaggttgtgttttaagcaactgcattttagtttgatccaggatttaagctaagtttttttgattcaacactttctgtccatactaccttgtagaatttcttattgggaaataagaaacatctagtgtataagatatttttaggtgggaagaagatttctttaggtgggaagttgtgatttatgagtgtggggattgttggtggattcctgtgtagatgtttgtctgtgtttactgagttgggcctaccttccccggagtgctgctctataaaaggtagtgttcacgctgataattgaggcacaggaggatggctctttgggaaagaagcaagccctctgcatgttgtagctagaatattttcttatatttgcatatgtggggattgtaaagttggtaaccagagggggagaagatacacagttgatgctaagtatatatttgctaaagaaatatgaatgtattttgagggaactagactgaatttgttagcaattggagatttcttgtaggattagtgtgacttattttctttcttaaacagacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtggtaggtatatcatatattccaatattggtgtcaaagggaaaatgtctctttcaaagcatatgctattaaaactatactattagcttttggcccagtaatttaacttctaggactttattctacagaacttcccacccacatgtgcacaaggattttagtcgtaattgcagaattgaaaaattaggatcaaccttgtaacccagatgttggttcatagaaagtt

SEQ ID NO: 136352 - DNA, 2868 bp, Homo sapiens
cacccccaccaccgctgccgctacaagcaaccacgccccgcgggccccaaggctcgccgccccggggctcgcggcccccactcagccggccagccgcgcctccatcagccccgccctcgcgcgcccccatccgccccgccccctcgggccctcatccgccccgcccccgcgcgccccatccgcctccgcggccggccctgggagcgccgggcgagccctcgcgcctgcgcatcgccaacttcctgccgcggcacgctccgcccacccccagaagcccgcctccgaacgccgcgtgaaacccgcccgccgcgcgtcattggtctcggcgccggagccgttggctcccagacccgcctctccgcctcctctcacttttcccagggcggatgcgcctgcgctcagctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagagtaagaggccctgcggggcggcgcgcgccggggccgcggggggcggcgggcgcgcgaggccgcggcacgcgccggcgaaaggcgcgaattggcgtgcggagcagggggcggggccgggcgcgagactgggcgcgcgcctcgaggggcctgcgcgggacgggaccgccgcgccgagggctccgagcacttccggagccgggcgcggggccgagggctgggcccccctcttcccttccctcctccagcggctgcgctccctccggcgccctcggccccggggcggaggcggcccccgccgctgggaagcgagcgccgcggctctttctacgcgcgcgcgcgcgttgaccgcctcggggtcgcggcccttgtccgggggttgctggggtcctcaggcctatggctgccgaggcgggcgtcgtgggagctggggcctcccctgatggggattggagagaccaggcctgtgggcttctgctacacgtgcatttgtcttcccgactgggtcgcgcagcccctgtacgtacaggtcgtcatcttagaacaggtgcgaacagctgtaacagggtaaacaatttccatgtccgtgtaattgactacccaacatggtgtacgcagggggtattgatctcaatggaaaaaataggcttcctgattgttagtattttctccaccttctggaagagcagttagttgtccgtgtccaaattagaggtaaaaggaaagagtacatgaggtgtggccatcttgaggtgacctccaatttctgactttgatctatctcagccacttaatcgtgtgggctttctccaaatttcagtgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaagtaagggtttctggcaacttttattttgtttaaatttaactgtcgttctgaatttcctagttttggcgttttatgcatagaacataagtatgtaatcagcccttgcatgaggtggcaggtggtttttattttcaaaacttacgtgatttgtgggatgatttctggtgtatagtgtggtggtaaaaggggagaaagaagctgttgtgagattaatcgtgtttggaggaagcactgaatatatttgacatttcctgggcttgaatgtagagcagcatctttctgggcccaaactaatgcgtttctttaaaactttactgaaaaatagaatatttacggaaaagttcacacatcttaagtgttgtatggcttgataaatttttacaaagtgaacacacgtaacagtcatccaagataaatacattttaattggtaaagggaaaaagaccttgtcaacaattgaccaaagaaaagatgttatcggcttatggaatacactttgagattgctgttagtcttcataagagtattcttttctgttacatctgcagtttctctggtaataattgctggcatttattgagcactcagaacagggcctggcacatctgaagaatctacgtcctgttgtttgttgtaatcctcataatagtactatgctgtaggtacttttcatcatccttgttttactgataaggaaactgggagtgagagtttaagtgccatcccaagatcacacagctggtccctgcattagactgcctttctcattcacttgcaccttttctagtaggaacttgaccatgtacttttaaagtgtattaaatatggggtcaggcacagtggtttatactcctgtaatcctagtgctttggaaggttagcttgagctcaggagttcaaggctgcagtgagccatgattgcgccactgcattctagcttagccaacagagtgagaccgtgtctctcaaagaaacaaaaaacaagcatcttaaatttgggtgttgcggacatataatttaaagaggattaaatgaaactctaacctaaaaagaggattttgcaacaagttataaaaataataagctaattttggctgggtgcggtggctcacgcctgtaatcgtagcacttcgggaggccgaggcaggcggattgcctgagctcaggagttcaaaaccagcccaggcaacaaggtgaaatcccatctctact

SEQ ID NO: 136353 - DNA, 1029 bp, Homo sapiens
attggaggggtggagatgaacgccaaatcagaggtgttggagaaagaataggagaggtggagaggaaatagcaactacagagagctttttttttttttttcactctatcacccagactgggtacagtgacttgatcatgactcactgcagccttgaccgccccaggctcccatctcggccccccaagtagctaggactacaggtgtgcaccactacgctaggctaattttgttttttttcatagagacagggtttcgccatgttacccggggtggtctcgaactcttgcgctgaagcagtcctcacgcctcccaaagtgctgggattacaggcgtgagccaccgcacccagctctacagacaactcttgtaaggcgtttcactctgaaggggagtggagaaatggagcagtggctggaagggaatacagtatcaaggaaaaatgtcttaaaaggtattgatattttaggcatgttcagattccaagagaagggtgaattgatgatcctgggggagagaactgaataattatggatatcattgagaagccgagaggggatgagatgagagcaccatttcatccatggccgctggagggaagctgaaggatacgagcagggaggcaggtgggctggtgaactgctggtggtgggatggggtattcttctataaggggatctattttctctgtaaagtatggggtgaggtcatcagctgagagtgttggcaatgtgaggagagaagggagggtgttaataagttgtctcagggagggaacgtgaaggcattaaggaagtatattgggatgatcttactgtgttgagagccttctgagactgatggtcatcaatttgaagagtccaacttttcagtcactgaaacctgagactttggaaatacttcatgggctttgactccaggatgttcatctttagacattttaatgttgctggcattttggttgccgttgatttatttagttactgagttttaaaataaattttatattaaagtttaacattcccacaga

SEQ ID NO: 136354 - DNA, 1071 bp, Homo sapiens
cttactcacaatatctatcatcacgagcaactgttaagtggtttgctgaaatcaagataccatatgtctgtagcattcttttgatctcccggtgtaattaccctactcaaaagggaaatgaggttaatctggctcaaactggactcaattccagcaatcagaggggccattttaattttcttatatataatgggtaaggagtttatttgggggaaatctgctttggcatgttggtcacagaataactgtaacgttggactacaaggggactctatgggtcttagagttcatttctctgactctagagtgtcagaatgcttttcccttcctttcttttaaggtacatggatgtccttgttctctgttccttaaggaaaggttgaaattcatgaccttttggcatttgctgaggctcagtttgagtaacattggcaagtgtctggtttaactaattgttgagaagcaagagaatatgtggttaagagagtagactctgaagctggactacatgggttcaaatcccagctccactccttcaaagctgtatgactctggacaatttattgaattttcttttcttcatctgctatggagtggagataaaagcagtactgattgcatcaggttgttgacaaaactaagaaagtcaaggtgtgcaggcactgagaactgtgctttgcacatggttagcctctgataattattggctattattggctattttattgatactataattggatcagagtaggaggtatgtgttaatttctttcaagtaggtgaaaacctgtgcctgaatctgtgaagtgctgggtcagggtaaagtatacagctgaccaagcaatgctgtgtgtctctgcatggtcaaagatgtctattaaggttcttttgttgttgttgttgttgttgtggcttctttttgttatgcagaaaagtagagaaaaaattgaccaataatcttattatccagattcattcatttattacacagcagtcactattctaggcccttgagtttcatcagtaaacaaaaagttaccaggaccttatgtttcaatggagagagacaaa

SEQ ID NO: 136355 - DNA, 1058 bp, Homo sapiens
gctaggcatgcaactcatacagaagggtacaacattgaaaagaacaagaaagccctcctctccgctctcactctgccagacttgctccagacttttgcaaaaccattgaatgttgaggaagtaggcacttctcctacggtcttgttgattaatctgctgtcttggaaaaatttaaaaagtgtcctaactaatactctttttaaaaaatcaagatataatttacatgcagtgaaatgtacagatcttgatgagttttaacagctgtatccacctgcataacatacaaccctattaagatagagaacattctcctcacaccaggcaggtaatactactttcaggtaggaaagcagtatttgaactctgatagcctagcactatcccctaccaaggttgttgtgtgaacatgggcacagaagaagataattccatggggggcttctgggctttcgaccaagactaagaattagtgattccatttataagatatccaagacaaattgaaatagtggagtttcctcacttttggtctgatggtgttgggctgtttatgacatcatcgtgctggattttagggagaatcaggtttttgacaaggataaaaatctagcctcagaggtgccaggggtaacttagaagtaggagccttttattttcttatttatttatttatttatttatttattttttgagacagagtctcgccctgtcatccaggctggagtacagtggtgcaatctcagctcactgcaacctctgcccaccgggttcaagcaattctcctgtgtcagcctcccaagtagctgaaattatgggtgcctgccaccacgcccagctcatttttgtagttttagtagagatggggttttgccatgttggccaggctggtctcgaactcctgacctcaagtgatctgcccgcctcggcctcccaaagtgctgggattacaggcgtgagccaccgcacctggccagtaggagccttttctacgataaagctaaaataacatttttaaaaaaaatgaaaaaaaaaaaagaccttgatactctctggtacat

SEQ ID NO: 136356 - DNA, 1051 bp, Homo sapiens
agttcactttgggcttgaggtgtgtgatgcctttacagttaagtctgaaaaaatggtcgtgaaaagcccctgggggacctggctgctgagtgacacacagctgggcctttgaaagtgggcttttatgataaatttgaacatggttttagaccttactataagtgcttcaatttttttcccctaactacagaataagtgagctgatttttccatgagggaattgctttggaacattaaccaagattttcttcaaatatagaggtgactatgtaatttgcttgtgccttttaaaaactgatggaggcctagtgaggcatctctgtgaagtcagaagttagacaagggatgcttttcttcacttgccaggtgtggaatgcaaatgagcttcatgcagaataagaggcctttaaaaatccaggttgcctttgaggacctggtaactcttgtttcgatccactgcttctcccaggttgcctatcttttctgtaggtgacagctaagaccatggcctacactttgttttccttcaaccccctaacttcttcctatggccaaccccacccccagtttttggaagatcgctgattttttgtcttagatgactgagtgttatcaacaggattctaaatgtgttgaggcagatacgaaacaaattcacacataccaccccgacatttcgtgtgtgactgccttctgctagtacaatgtcacgttatttcacaagcccctcaaaattctgtgatggaaatattataatattcttttgatagatgaggaaatgaaggctccactagtggctttaagaccacagtgttaaaaaattgtctggtcttggattcaaatgtggttcttgcatcttcagtttgggcacctcctctgctctaccctgcttctctctgtcagcctactactcttcctcccatcaccaccaccttatggccactgaggtgacattctccctcccagtttatgatggagaaacagaggcaaagaaaaaaaaaaaagacatgaggacaatatccaggtgcaactttgaatactcaaaagggct

SEQ ID NO: 136357 - DNA, 2444 bp, Homo sapiens
cagaactcagtcacatggccacacctaactgcaggagagattggcacatacagtctacttatgtgtccaggaggaaaagataaacaggtttgctgaacagctagccagcttctgctacaagggctgaccaaggacaaagaacgattgcaggctccaagcccagcttgaggtggcatgttttcgtggctgagagcagggctggatcattttctcccactgttcttggtggaacattcataggttgaaagtactactatggggcacattcctgctggtaaatgtagcccagtctccaccagtaatatctggtgatggaataaacactagagcaaccttgaacactttggcatctcacccacagaatgagaaatgtagccatgctgtccacactgtcattcaaaggggagcaggagatgaatgtgggaaataaactgctatttctttgcacttggacaagggttgaataaaaataagactctgtccccttttaaggttgtgctttaaatagaaatctgccccaggcccttcttgatcttttttttcctggctccctctctcttagtgtccttcactcctggccacatctgctcctttgtggctgaggggcctgagttctccttgggaaccagattgcctggtggatccctcagattgaagccccctccccacttaccttttcataagtttctagtgctacccggacaggtgcagctattttagttatatttctatagtggttgtgcctgcccttctagacagctgccacttgtctttctgacagactgtttgcttgtgtgtggctgctaatgctgtagtaaaaatcacctcgctgtcctgtccttgttttcagaggcacttgtctcttggtgtaatgctggatgtttaatgggcattgtttataaggagtataagacggaatagtatagcctcttgctttgtgtcgtaattccctctgggcttactgaaaaggatgctgggagttaggccaggctggcaggaagagggatataaattagaaagggagggagcaccagggccagagagaagtgattctgttaagagtgggccctcagaaaaggtggccaaaggtctaaataacaatgaccaaagtgtgcagtaaggagggtgggatccgggttggtgtcaatgtctaagagtctgaagcactatattggtttctggaagagattttcaactggtgagtatgtttgccttgccttattctcccctaatccattctctacactcctgcagagtgaaatcttgcaaggtacaattcctagttcacattcttccatggcttcttataataatatctaaatgaactggttttcaagaccatatgagcctggtcccagcctctctccagcctaatctctccttctgcctccctagattcattgccatggccccagttctaagattcttctgtttccttcttatacgccaagctctctagcacctcatacagctccctctggtcccaactttgataccacttttttcctggtagctttcctgactaaccctccccattgagttagttgcccgtaacactctgtctctctctctctctctctctctctctccgtggcaattatctcactctattgcaattacctgctcatttttgtgctcttccactaaactggaaacttcataggatcagggaccatgacttagtccactttgtactcccaattctatagtcagaataggctaatttctgtaataaagaaccccaaaagtctcagtatctgaagacaacagaagttttatgtcttacccacatggaattcaatgtgggtgttcagtagataaccttctacactgttattcggcaattaggcccctttcattttgtagttttcttatctcctagggctgtcctctctttccaagcctgcatctgacagacagatggaagaagagggaatggagaattgtataggaaggtttttaatgggctctgcctggaagttgggtactaaacccccactcatattccattggctggaactcagccatatgactgcatatacctgcaggagctgctggaaaatgtcatctagccatgagcaggcttggtgagcaagtagtgggtctctgcatgccaccagttagtgcctgcctggaatgtggtaggagctgagtgaatatttgttgaatgagtgaactttggattctaggtttcatcttgattcttaggtgattcagtttaatcatcaggagggacatgtgatgactaatcacagtggatttcagggctctgggcaccttggaagggttacggataatgatagagagaagagtagtgctgcctaagagtccagctcccagtgaggtgctttccttcaaatccaacagggaaagagatttttaaaaattaatcttgaattttcattttttggagaggacaaaggaggaggtaacagagaagagga

SEQ ID NO: 136358 - DNA, 1287 bp, Homo sapiens
accaaatttttagcatcaaaatcctaacagcagaaagaaagtttccctgtggaagaaggactgggccatgtcaattcccaaaccttccatccttccttcctcccaacggctcaggtatacctgagaaacctacatctgctggcatcatctcccatgcattgtttttgcagaagcagagcatgaccgacatctaataatatctatgttggtatctgtctcagcaaatcctttctgtattaaaagattaatgtagtaaatccagagttacagggagattgtggtgtttcctcttctggtgtcagagtgttgtttttttaatactatattttgttttcctttttcaccctcccttctcatccctataaaccatattttgaagcccttctccaattgcttgattttcctaatagtaataaaaagcctagacagtttggatggcatctgtaccacctcttttagggattataacccaatttttctccaacagtgaacttatgggtcttttatgatctggctttaggtctcttgaatgaggctgacatgaggatgtaaggcttgaatcataagattttaggaaaggctctgaaaagcaagctctttctgaggagtgttgattttttttgggggaagattattttgccagtgttcaggtaagaattcacatttgcttctgttactagtcatgatagctgaatggtgtgcttcattcagatactgtgtagtgatcacttactttgaattgcatattaagacatgtgaccatataaccttttatttgaaccaagcaatttacatggtggagctgaagattggttgttactggttcatttttagtgagcactgactgtttctaagactctatcttggtcagactctctcttgaggtctcccagggtaagtcagccagactgagagtgacccaagaagatggggcaacattctgaagaaaatagaaaatagtgctgtcatgtggtgaagaggccagggagcatttgtttccccatgcccctacccaccccgttatttattgattctgctcataacgtaacagtatatgtatttttgttgttgttgttgttgttggagacagggtctcactgtcacccaggctggagtacagtgatgtgatctcctctcactgcaacctccacctcctggactcagtcctcctacctcagcctctctagtagctgggaatacaggcatgtgccaccatacctggctaatttttgtattttttgtagagatggggttttgccatgttgcccaggctggacttgaactcct

SEQ ID NO: 136359 - DNA, 1457 bp, Homo sapiens
agggagcatacaggctccctggtgtctcttctgataaagatgctaattcacctggatcagagctccaccctcatgaacttgtttaaccttaatcacttccttagagcccccgtctccaaatacagccccactgggggttagggcttcagcatatgaaatttgggtacaaacaatcagttcataacacaaggtacttgttgcccactgtaacatctgctgtttcccgaacaagacaaaggtgatgataattaaacatggtactagactattcatgttaaaaagcatagtactgtgtgtgaagcatcttaaatgagtcaggcaggagcacttaatgaaaatctatggtcaattgaacataggtttactgtgcccttgtcttttccttccattatgttttttttttttttttaaattactattccatggggattctcctaagcttgtcaattacagacaggtgctcttgttttggagccagagcagcagttgtaaaaaggtgaaactggaaggtcaggataagctgggttatgccatgacaataaacatctcccaaatctcaatggctcatataacaaatgtttctttctcccctacgctacatgtctaaggggtgtcaccaggggtgctctgttagttgtaattgttcttggatctggactgatggaggcttcattctgacacgtgtcacaaaggagaatatagtaaattgtatactggctccaaagttttcacctagaagtgccacataccacttttgctcatccttcattggctaaagcaagtcacatggccacatccaacctcaaagaagtaggtgaaacaatcttactaagaaggaggagagctaaagctttcctttggcaaatggcactgattaatactataatggggtaataatgaggcctaggtaaacagggtaggacttgagcaaaacttgtggcacaaatgagaaattttatgtacttaatgcttttttagaaaaatgctgcttccaaaacagctctaacatccaggatttcttgcctagccagtatttctgtgcctagagtgagattcagagaatgaaacccttttttactgagatcctgagagttgcctttcaagtgtccatagagtataaataacaatagcctcaaagaaacaattaaaggctctccgggtggcttatctcagatccactgagaaatgaaaacccccaaacatgccagaacactaaaaaaatggctgtgtctgagggtggtctccttgtcatgataaagctttctcctcatccttctgaaaatgataccaccctcatgttagcaacagtatcgctgtctggaaaggggctggctgaatctggtgggattactttgagttgcataaacacagattgaattaagcatggcgagttgatgatggggagtgtagaaagagtcaggaccttgcgttgggataataactagttcattatctgc

SEQ ID NO: 136360 - DNA, 1026 bp, Homo sapiens
tactgacatttggggctggatcattctttgctgtggagctgtctgtgcactgtaggatgtttagccacacccctgttctccactcactgggtaccagtggtatctactcctcttttgtccagttatgacaccaaaaatgttttcagatattgccaatatccctggtgaggcaaaattaccctcagttgagagtcactgtcataaacctactgccactgctttctacattttatttcacaaacttttttgggtactttctgataagaagaacctatgagacactttggacgagtagggaaggtgggctccaagttctttatttgttatgtacttggttgagtgaagcacacagttttcatttctaggggtgggtaatattatgaaaaaaaggtagaaattggtaagatttgatgatagctactgacagggtaactgggtcaaacttcaaagtggcaattctgaaaatgcactagcagtctgaatctccaagtgatttttagacgttttgaaaaatccaagaaattctaagaccaccacagtttggaaccatgccttgagtaataggcctgggatagacatgaaattcctacactgcatttaattaggaggttttgatcagggttccaactggcatttgcagctgatgtttgattaagagaaagtcctgtctcaaaatatgagaaaacttgaataataaaagcactgtgccaatggcttttcatgtatttgtttagaacctgccttggttccaggaaggatttaatgtggatttctatcattgcatgtgctgtcttcatcaatggtttaaaatatcaaccagggtgaagatataagagaggaatatcgaatcattgcttagaagaagacttgagcaggcatctcctcctcctccatctaagcttcaaaagaggcctcccctaaccagacagtccagtgagataatgaattaattagagacttggaagggttagcatgagagccttgtctgtcttgcctctggccctctgtctgctcggctagatcctg

SEQ ID NO: 136361 - DNA, 1206 bp, Homo sapiens
tttgggaggcatgcatatggaagcagaaaatatggaaactgaatctcttaaagctatccatatacctacatactgccagaaagtctctggggaccccagtggtaggtgagcccaagtttaagaaagttgagttggagaatcaattaatgcccttttggaacttcctggtttccagcctttttatctccttgaatgcacatgtctctctctctctctctttctctctctgtgtgtgtgtgtttataaataagagtcattaagccccaattcaccacaaccaaagcttttgcctgttccctcatctcctcttgaattccaactgcaattaaatttatcaaatatttatttaatccaactgcgcatcaggcactacaccaggcattggtgatgttgagatgaccaatggagacaacaatagtcattgttgataacgaagacgcacacacttgtggaattctatagagattttcagaagaagggatggcaagcaacttccaatgttatccttggaaatcaactccttattaggggggaagttcctaaagaaaggataatgaagtctgctaaagaaaagatgcatctgcctgtgtgtactgggggatgtgtgtgtgtgtgtgtgtgtgtgtgtgtgtgtgcacacgtgcgcgcgcgctatacagatcaaaccattgcagacctgcaatgttttccaagtgctttaatgtttaattctctttgatttgatccacggcgtcatcaagtattcctgcgggcaattccaaggtgtctgaggacccttgctgggtatcaaaatccagtaagacctttggagaaattgaagaaggggaactttattggtttttaggccagtcttataatttaattctgttttttgtctgaaacacacatgcacggaatcttttatcgtctgttaggcatgtgtcctaccaatcacaagacttaagatgagaaaaataagcaaatgtttgatggagagaaaacagccgttggaatcctgtggctgttcccacactggggggatcaggcaaacccaggatccatgcattagaaaagaatggtgcagagagagctattgtcccctttgagctgtggcccatagtaaattgttgactctgatcctagggtcaggttattgctgagttgctgttagcattaataattatataatggccttcccatttttctaccccatgtggatcattttgg

SEQ ID NO: 136362 - DNA, 1089 bp, Homo sapiens
gcctattctggacatttcatataaatgcagtcacacaatatgtgatccttggtgtctgacttctttcccttagcatgatgttttcaaggttcatttatgttgtagcatgtatcagtatttcattcctttttatggattaaatacattccattctatggatatactacattttatttgtccatttattcattgatggacatttgagctgttcccacctttttgctattatgaatagtgatgctatgaatatttgtgtgcaagtctttgtgtggacatatgttctcatttcttctcttatatacctaaggagtggaatttctgggtcatatgataactccatgtttaacccttggaggaatagattatgcatttttgacttgttattgtcccatgaggtctgaagttaggaaaggtagggagaataacttcttatggggtagacatcaatggatctcagcagtgcccaggctggcagtgccatttttatgagtgtaacaagtttatcttcttcagccctttgaggcctcattttccagagactactggccctcctgggtctgtgaccctggccagaactaggattttttatttttaacctctcataagggattcctacgaaatatgacccactagagtgcttggtggactgtcaactctgtatctgtggggaacaaaatccagctgttcagcttggttagctgctgtctcatctggaactgcctttcctaggtttatttccccaaacaatggcccaagttgtaggcttgtggttgccagccccctttaatttggtccttagttgcatagtctgttatttgtgctgtgactggctgtgattgaaggggtatgctttttcctaaactcaacagtgtagtaagatgcttggtggactccaataattcatctatcccatggagaatgtgaggagtgtgtgtagtgatggtgaggggcatggcacactgaggggaaagtacctttaaaacagaatactgaatttaatatcagatcaggctgatgttaaacctctgctttccatatgagaacactttcccaggggatttaattgtaaaatgacaaaagggtcttagt

SEQ ID NO: 136363 - DNA, 1224 bp, Homo sapiens
tgaatggcgcagagatcagaaaaggaggagctgggtgagccttgcaggaagtcttatggatttcaccagtgaatttctactcacttaagccagtggttcttaaacttgaatgagcgtcggaatcacctggaggacttgtttaaacaagatgtttgggctcaccacccctgtccccaagtttctgatttagtaggtctggagggaggcctgagaatttgcattagtaataagcttctgctgctgctatttcaggaacaacacttggaaaatcactgacataaacaataagtaagattttgtaagtggcaagataaaggaaatgagtgtgatctgtgtattagtcaggataggttaactgtcataacaaataaatgctaaagtctttgtggtgtagcacagtaatatttgatctcttgctcatgttacagtccagtgtgggttgatagaagagtgctctgctccatgcagtcattctaaggaccaaactccttctaccattgactctgccacaccccagtgccaaagagccctgaattgagccagcagatgacagaggaaaatatggcagatttggcaggtttttatgggtcagacctaaaggagaaacacatcacttctgcccacttgccgttggctggaactcagttacacacctctacttaactgcaagaaagtctgggaaatgtgtcccagccacgaggttccacatggaacttggtttgactagagaggagcattcaacattcacgttgagagaataaatggatgtttcatgttcttccaaggaaatttgcatcagacaattcgggtcattatttagcataattatagcatagattagagtagggggcaaatcaccagatttaggcccagatgctctttattcgaaagcaaaatagctgactgtaaagttacataacttctcagtacctgtttatttatttctctataaaaactgggataagatatatgtgaaaatcactagcctggtgctaagcacataaaaacagagtagttattcccgtgttttctgcattcagatggacagacagtgacaagctattgtggccctgagagccccttcatgtggacagctgtgggattcacagtttaaaggacatgggcacaacctgatctcagcagttgcatggctattctaaagactgctacactgatgtctcagatgtaccataggaaatcaggccatgccagcaaggcccaagg

SEQ ID NO: 136364 - DNA, 1023 bp, Homo sapiens
aaagaagtataactatttttgcttagaaagacctttccttatttcatacgatatgttactggccatcctgggatttcagagtcttttagctccatcgctgttccattcccaagtcccctccttgttgaactgatctgtaagattgggttttgagttgcttccttctgacccttttatgtatagcagtatattttcatcccatggtaacctcctgggtgaaatgttggagacagatatattacaggatatttgtaattatactagaagatgttttagtgggaaagttccttacttatgatcacagcatctctgaaaactttcactgctgtctagaaaaaaaatctttagagttgtcaaatatattccctttagagccaaggacatcttgatactacctaatgccacttccctatttctctctagcttggagatctgggacatttcatagatgtcatggaattctaaaagtcaacagaatttgtaagatgatactctgggatgatttgattttgtacctagtatttgctctaatgagaattcgagtaatccaactgcctttctcctttcatgaatgcccactgtggctgggggcccatgaatcaggtctcccatcaggaattatggccatttggtgacttccagctcacatagtgccatctcagaatgagtgaacccggtgtgcactcagggagggagacatttgagttctccagacctacttaaggcaaatatgttccttatgaatgaggttcctctccttgttttacacttcctttactttgatctcttgcctctggtttttaatgagcaggagctttgtaggaaggtgaggagaatttttgtcatctatagcctgagcagaggggagttgaaggtgaatatgtgtgggcatatacacacacatgtatgtaagtatatgtgcatatatatgtgtgcatctgtgagcatgtggttgtatgtgcacactgcacgtttgctggtctaggcattaagggtattgtctagatgataataataataata

SEQ ID NO: 136365 - DNA, 1034 bp, Homo sapiens
tactgtatgtaagtgatatctcaattaaaaagtacataaaaatggaggcatttaaattgacttgtgccactattgtagaagcagtgtgagggatgccaggggagaggaatagatatatttgatgcagatttaaaggaaaaatcagtcaggtgtttagagatgtagatagctcttaatctgtaagaaccagaagtgatttccaggaagacataattgcttatatccggaagacaataattttattgctcttaatttcatctttattttttttatttgtattttggcttctaatccccctgagcatttgtgtgtttgccctgccttcatttgattctggctctgccttttaaaacagttgctgctgccacctctcccaagttctgaaagatttacaaatgtttgaacagagaaacaaagacagaaaatgggagacatgctctggtttgctgcaaatggcttttcctgccaagctgcggggaatggtatttgggccagctttgccttcctaattggaaccatagctccttggattgccttcagattgaaaacttgagggtctgccactctgcaaggaccatttcatgctgggacactacgtaccaggattctcactttcattggcctttaagagagaacagcagagttccctaatcagtttggctaacacttgaaaggggagtagcaaacttctaattttttgtaggttttatacttctctgctactctcttcatgcccctctcccccagagctgtaataataataccagctaacgtttattgatagcttactctgtgcctgatgtcactctaagcattttgcatgtgttaattcatttaatcctcaccaactctggaagctggtattgctgttgctcaatatagatgaagaaattaggcacagagagatgaagtcagtggtccaagatcacacagctggttaagtgacagagccagcatttgaacacagtctcgttccagagtctgagctcttattcactgtctaaataaaattgattccctgggccgggcgtggt

SEQ ID NO: 136366 - DNA, 1024 bp, Homo sapiens
ctatgtctatgagtgtgctccacagagtgcatatcttcttgtctgattgttaatcagccccacatgtttgtattgttattgaatgatatgagtccttaagttgatgcttccctttcctggattagaaggaagtagagcaggcaaattttgtataggagcccaactctgagtctttggagccctgttgatttataggctatttgatagcattgaagctcattggttaaccagtcctttcccactagaaagccaagtaaaggaagatgctgggtagatgggatgaaggaataaactcagggcagaagagaccacagaaaacatgggctacagcaagtcaagaactcctcatggacaccatctggtcagtggtcctagtcactggcaatcccaggtggacattcacataggctacttctgaggttctcccggtacctgactcagagctactgactccctttctattctagtcacaagcaatccattcgctcattctgctagtggagatttacaagctcagttcagcagctgaatgttggctagaaggccacttggtgaaaagaactcaagtttggaataaggaaaccgaagttctaacttttactgttctagtgacagctctgtgatcttgcgggagtcatattgtctctgtccacttcagtttattcatctgttaaatgagttcagtattaagttgccttctagaattcctgtgagcatcaaagggtatgaaaacacttgaagaagaacaaaattttatgagtgcacaagggaatatcgtaaggcatctacggactccatcataagagcttcatgtcaatttcttcttgctgtctttccatttggtgttcattgaagagaagggcctgagggactgagtttgtttctgtgcctagaataccgctaatggtcatctgtcaaattgcaataagagagtttaattttatgttcaatcagagcagggttcctgttggtttctacctcttagaggttgagctccaagcttaagcatgaggaatatgtgcag

SEQ ID NO: 136367 - DNA, 1085 bp, Homo sapiens
ctttttagccatcagttcctatgggaactaatagagtaagaactcactcctgggcaccaaagcatgcatgagggatccactctcacaacccaaacatctcccaccgggccccacctccaacattggagattaaatttcaacatgagctttggaggaaacaaatatccaaaccatagcagaggttaagtaacttaccccaaaatccatagccagcagaccaggatttagagctggagactgcgatattcaaggcagatctcagaaaaggacccagtgggcttaagatttaaagtatggagagcatcatatacagtgaagcctcagactctcagctttatgagggtagaaaccatgtatattatgttcattgtgggatccagcacagaatgtattccaggcctgacacagtccttgtgctctttcagtgcttgttgactcattgatttttgataaggcagagaaatgcacaaccaagacatgaaactttggtacataaatttaatgaacaaatgcctatatttatatttgttcttttatttaataaatattctattgagcctctactatgtgccaggtgttagaagtagaaaaatgaatacaatgtggtttttttgcccatgaagaactcatgtatggagatatatgcatacagcccaaccttttctctcaatttctctcacttgctgtctgggtctctcctaaggctcatcatgtgttacctggtgttaaagttttgtttttcatgtgtttgtgtgtgcatgcattctttttctttgtttgtttgtttgtttgtttcttgacagtgtcttgctctgtgtcccaggctggagtgcagtggcgagatctcggctcactgcagcctccgccccctggggttcaagtgattctcatgcctcagcctgctgagtagctgagaccacaggcgcacactaccacacctggctaatttttttatttttagtagagatgggatttcaccatgttggctaggctggtcttgaactcctgacctcaagtcatctacctgcctcggcctcccaaagtgctgggattacaggcgcgagagggagtctcactctgttgcc

SEQ ID NO: 136368 - DNA, 1048 bp, Homo sapiens
agaagcattagcatcacttgggagcttgttagaactgctgactctggactctacccccagacctactgcactagtagctctgggggtgggacccaggaatttgtgttttagcatttctccgggaggtccccatgcatgctccagtttgagaagcactgctaaggatagggaagccaggttctgtcatgtgtgattgctcaataaataatttttgcttgattgcatacataaattactgtatgaacagggaaagtgggttggtcttactaggtctgggcatgactccaagcatccattttgccaagtctgcggagactgtgaggaggtggagtcgtatttccttccctctcagaaaatttggatggatgtgtttaaatggctgggaagatagactccatcagcatcaatgtgggaaatggtgagcaactgagcatgaaacctgatgggaaccaagtgaatgggccagttcgtaatgaaggccagaagataaaacagggtggagtgatgatttcacagaagggctgagaactctgtgcagatggtttggggcaagatgctaaagccacaagtttacaagaattgtatgcttgggactcttttctgttccagggacttattacaaattaagccctccctattcctgcatatgtggcagagccttgctgtaaatctatttcaaactgttttttctttctcatcttattctccttttctctttctttaactcttccttccctctctatctcctttttcctttctgaccaagaggctattgttgtccgtgttttgatcagggctaaagctaccctgtggcataacatttgttaaggacaaggatgtgtgggtttttgtgagtaatcagcagctgcttttggagtcatggttttaaggaatctcccttcctcaatagtgtgatcattccctcctcccaacacccccttccaaaagagaaaacttgcataagagcagttggctcaatataataaaatatagcttggcatcatgagctttataaacaagaggcatttaatacactgcatagagtttt

SEQ ID NO: 136369 - DNA, 1033 bp, Homo sapiens
atttgggtaaggaagattcaaattttccaatgatttgcagacagtgaaaagtttgaacataaacacacatgatttatttaccacagaatatcaagactgtcgagccaagtcaggaagcaagcgtgtgccaataaaatcttgacagataccagaagaaaaatgagaacccaacttagtaagtggtgggaaagaataagtggtggtagatggaattctttttaaagagcccatatagaaatgagtgagtgtagtgttcttgaacagtggcccatttatactggaagctatttctttgacatatatgaaccagccagatcactgagagggaggatgcttcttcccacaagaagagtaatctgattgtttttcctcaaataaataaccaatttattatccacccagatatgcaattgttaaagacactaaggttgtgctgttcaatatggcagcctctagctgcagagctgtaagcacttgaaatgtagttagtgcgattgaggagctgaatcttgaatttcatttaattttaatgagtttaaattttaaaatgggtgtttgattcagttattggaaaagtttttgttctttgcaacaattctggtatgtgaatctactttttcaaccatttcatgaaatctaaatatagatcaagtaattctgatgaaaatttaccatccaaattgagctgtgctttaactgtaaaaacacatgggatttcaaagacttaatataaaagaagagaatgtaaaatatctcgttagtaatttttttacattgatcacatgttgaaatgataatattttagacataatggattaaataaaacacattattaaacttaatttcacctcctttaaaaatttttttatgtggttattacatatgtggcctgcattcttgcattatatttcacatgaacaatgctttatatttatttatttatttatttatttttaacttttattttaggttcgggggtacacgtgaaggtttgttatataggtagacttgtgtcataggggtttgcggtaca

SEQ ID NO: 136370 - DNA, 1092 bp, Homo sapiens
gtgagctccatttcctctgcaatgcttcagcctaaccagcaaaattgtttacttcctaaacatttttccaacctccaaaacagctcacaggtgcagacactctggcctcgaggaatcttctagtgctgaaggtgccatgtctaggttttctgaatcatagatcatggcagaatattcgtgattggtacttgttgaggacatccacttgccatgtttccaggactccagacataactgtggccagttcctgtaggagtcaaagcatgaaagtaactcaggaaacacccagtcagtggggatggagttgggaattgcatccggtgctgtcatggattggagagccttgtctggggccaggtaagccatagttaggatttctggtgggtaagagagaacaccaggcagtaagcaccatcctcctattcagcggatttctcttttaaatttttttaaagttttattttatttttaattgacaaataatacttgtatgtacaactcatagaattagagagtagaatggtatttactagaggctatggggaggggatggggaatggagacattttgatcagtggctttcttgatgttctgacacctcgtggggacacggagctgagacttttccagggggcatctgctccactgctatcacccaagtaagtctgttaatgccccagaagctgtgagaataataataacgataataataaagtagctaccatttttagtatcactccagggattcttgttgtttgtttgaaatatggcaatctagtgaaacctatggatcccttctcagaataatgtttcttaatgcgtaaagtataatacataggattgcaaaggaagccaagtatattgaaatacagttatcaaagtatttaaaaaattccaatattataatagatatatgctcctttattactacattaaataacaagagttagtggtgagtctaacacacattataatttgaagtagtggtggtgtaaataatatttcagtacagcaactttaatgtgatatgaaaatatctgtaattcctattggtaagaaactcacaagtactgctaataccaccgtggtttg

SEQ ID NO: 136371 - DNA, 1055 bp, Homo sapiens
atcccagggccaagtaccagacaactaaggacatctatgccttagttgtctggtacttggccctgggatgattagggcaggtggatggtgacctggagtgtgagagctgcataaaggaagtggttgggatgtggactctggattggttggttcgcatatgaaaggagctctcccaggtgagttgtttgctatctctaggaattacctagccctgggaggtgcagctcctctagggtgaacaaggccccaagatgtcaaagcatcaaaaatacagaattaatgcaaaagccaacactgtcctcagagtggatggcagcagcattagattggagtgatttcccaataagtggtgtgagaggctcccctcttcatttagctccaatggcgagaatgttttacattgcacatattggcagctccgttgtcctcataaaaagaagcatgatagaaagtaaaagctgagacttaatggccaatttaagcttgagataactctgctatggtagatctaaagaggctcccaggttacctacgtagcaccagtctcaaccttatgtgcactaattcaaacttcaggggacacacattttgcatttctacaaactaagcgagtattaggaaaaataaacactcaccagttctttttatgctatcacattctatgttgcacataagaaaaaaatatgctttctagagagttgtaaacattctgcacacaacatccattatgttatagctggcaatggggtccaaatggaataatctgcagactaaaccctttctttatccccagagctgaggctgaggtcagtaggacagtgtgggtgaaacagcttctgaggtgccctccgactctgaaatgtgctgacctggagttttgccagttggcccaggttggataatagactgttagatggcctacatctaagggatgataaaatagcagcccagaccttgatccctgctcctgccaggttctaaagcatcagctctgggtggtgggggtggggttccggatggactgcttttcaattttcccaagccccagaaaagca

SEQ ID NO: 136372 - DNA, 1051 bp, Homo sapiens
cactgcactctagcctgggtgacagagcaagaccctatctcaagaaaaaaaaaaagtggggggattaggatatttagaaggacttacttccttgagaccatagccaaggtggaaataagagaaggtcaaggtgtgtgggtggggcccgcacagtggctcacacctgtagtcccaacactttgggaggcagaggcaggaggattgcttgagcccaggagtttgagaccagcctgagcaacatgggggaaaccccatctctataaaaattagccaggcatagtggtgggcgcctatattctcaactattcaggaggctgaaatgggaggaatgcttgagtctgggaggtcaaggctgcagtgagccatgattacaccaactgcactccagcctgggcaacagagcgagaccctgtctcaaaaacaaacaaacaaacaaaaagatgtgtgggctgggtaacaacaagtcttgaatgttccaggacggtgatgatttcagatattccctttcagcgagaaaccaagtatatagatttggggttcatagaaaacatgatcactatccttgtgagaaaatgcagctctaggccaacttgcttgggaatattaagagtctttggcacatcttcaaagaaaagtttccccatggggttacttctgacgtttatgcttccagtttcaattgtttggtggagagtccattgaactcagttaattctttttatttacctcaatgttcgatatgacaggccaacattttaagtgctattctaaattgtagcttgtgtacactcgggaaaaaagggcctatttgtctcctcgggtctcctccatttttttcttcctgcattggttaatgttcccttctccttgttgaatatttggaagtttccttccaaagcttgggaggggctagtttcacaggaaggtcacatgaacacgatctcatgggcagttcattgactctgcccagctttaatctctgcggttggagcaggagagtgaagggcagtggacagacactgccctctccctctccatttattctcctcct

SEQ ID NO: 136373 - DNA, 1047 bp, Homo sapiens
ctcactgcaacctccacctcccaggctcaagtgattctcctgcctcagcctcccgagtagctgggattacaggcatgtgccactactgcccggctaatatttgtgtttttagtagacggggtttcaccatgttggccaggctagacttgaactcctgacctcaaattatccgcctgcctcagcctcccaaagtgctgggattacaagagtgagccactgtgcccggctcatttttgtttatctattcatctgttgatgtacttttgggctccttctaccttttggctattgtgaatagtgccatgtgaacatttgtgtgtgtatttgcttgagtactagttttcatttcttttgggcatatacaaggaaagtcagcatgtggaagtgtgggtacagagaaggtaaggggttggagataggattcaaacccagagccttcatgtaaccaccatgtggtgctgcttcctataatacagcactgtccctggaatccctcttagggaactagcttataacaaagtctctttagcatttggtaatgaaagtcctgcaggcatgatggggttcaggtagaatccctttaaagtatcagctgctctccagcaaatggtggtgttgggaggcattcttctttattcttgaacttcaggtaatagttacaagtaatttatttatttatttatttatttatttatttatttatgagacagagtcttactctgttgcccaggctggagtgcagtggtgtgatcttggcccactgcaacctccgcctcccaggttcaagtgattctcgtgtctcagcctccagagtagctgggactacaggcacccgccatgatgcccagctattttttgtacttttagtaaagacgaggtttctccatgttggccaggctggtctcaaactccttacctcaggtgatccacctgccttggtcccccaaagtgctgggattacaggcgtgagccaccacgcctggcccagtagttagaagtagttttaatctctatggcatgttactcttaaaaaatatttttacctag

SEQ ID NO: 136374 - DNA, 1079 bp, Homo sapiens
gttttacaggtcttgagaatcttggctgcctatttacagtttcttggaacgggcttaaacctaaaatcaaatgtcagattattacgagctgaagcagaattctgtaaatgctcggtttcttcattaggggaaaaaattaacgtggaaccttggtagatatattactcacctgcattcagtgcttcccaggaggtaaaattacagtatgagctcagtgcattcttaatttcccatggtaggttacaaatgggctcttttctattctacaacttctttaatctcaataccttatttctcccacgtgtagctctacacaatcaagcaacttatacaccacatggctcatttgtctaactggttctgctttggtttcaagttcatgctttctataaccttgattttgacctgggtgtgcatgcaggctgcaagttcaatgtttttcagaatgtggacttcagatcaaccacatcagaatctcccccagagagcttgttgcaagcacagcttcttgggctccaccctagacctcctgaatcaaactattttgagagtggggctcagggatctacattgttttctacaagctattgggtgatgcttatgtgcactcaaggttgagactcactggtttcgaccagtgggtctcaactggggccagttgtgcaccacaaggggacatttgacaatgtctggaaatgtatttggttgtcacatctggagggaggtgctactgcctaagtaagtagaggccaggtgtgatggttaatattgaatgtcaacttgattgaaggatgcaaaatattcttcctggatgtgtgtattagtctgttttctgctgctgataaagatatacccaaggccgggcaatttacaaaagaaagaggtttaatggatttatagttccacgtggctggggaggcctcacaatcatggcagaaggcaaggaggagcaagtcatgtcttacatcagtggtgacaggcaaagagagagcttgtgcagggaacctcccctttataaagccatcagatctcatgagactttttcactatcacgagaacaccatgggaaagacctgcct

SEQ ID NO: 136375 - DNA, 1043 bp, Homo sapiens
caaactacaattggaactcaggcagtctgggttcttaacaagagtattattctgcctcaattacttcaaatgtagtcaataatttgtcacatctgacttgaatcaagtgaaataatcattaagatgattttcctggtccagcgtagaaatgggatgcaagccacatgtataatttcaagttttctaggagacaaactgttaaaagatgtaaaaaaaaaaaaaaaggtgaacttaatcttaatagtatattttattaaccaacatatctgaagtactataatttgaacatgtgatcactataaaacattattagcattttacatttttcttttgtagtatgcctttgaagttctgtatatattttacacttacagcatatctcaattcagactagccaagtttcaaataccccaaagccatatgtgacaactggccaccatattggacagtgcatccttagctgatacttggtgagaagcattaggcttggagaactgagtttgaatgattttttgaaaggcaggaagattgttttccaatcctgcttatttagctcaagtcagagagaggccttaaatgtttttccatattttgacagacttcagtggctacttctttccagggtctggcttctgcaaatggacccaagcatttataccctcatgtgcacacatgcccctcctctgccaataaatattcttgaaaggggatttaacttacaacacacacacacgcgcacacacacacacacacacacacacacacacacacgaagaaaacactgaccatctttgttaccaatgtgttattttcattagattgaggagtgtacaggaggggagagatgtttcatttgtgcctgtgtgatatcttcctatgtctgcttgacctttcaacctccacatactgccaacttggccccagtgtaattcaaatggcacacacacacacacacacgtgcacatacacattttaacccaggaatgggaatatatggatctacagccttaaaagcaaaagcttgttgcatggctagcccagaa

SEQ ID NO: 136376 - DNA, 1001 bp, Homo sapiens
tcataactcttcctttgtcttcagtggccttgacatttttgaagaataccagccagttgttttatagaatgttccttaattttggtttctctgatgtttcttcacatttacatttggatttaggcatttttcagttggaatgctatataggcatgtaagtgatttgttctctggggaccatatcaggaggcacagatgtccatttggcccttgttggtgaggtcacatttgattagttaagctggtgtctgtgtagctgttctttttccttttgtaatgaacaaatataatttgttggaagatattttgacattatgtaaatatcccattcctcatcaaactctctccacctagctttagcattcattgaggattcttgcctggataatgatttactctaatggtttcatccatcatcccttctatatttgttagtccaaaatagtctttgattgggtgggaaggcatactaagcctgccgatcttagtagctgagctcacagggaggaagggccttgatttcctccttggactctgactgacagctcttttgaagcagtcctgttctgttgggtgtatgttttgacacatgtagtaactcattttggaaatacttattttttactagataactttcaaataagtttttaaatactttacaaaaaaatggtaggatgttggttgcatatgttatcatttatttttgtggcatctgctggaaaattgcacctggttcttttacacagtgttgatcaacagaaacctgatcatgatgatagcaataataatatcttctcaccatctgaaccctgctccagagaaagggatgaaattagagagattgtttgaattctgagaaggatggttggactaaaaaggaaaaccagctattggaagcagatgaattaagtaaaacatgaatttccaggaatgtttcaaaatacttgtgtgggagttctttttggaatgttaaagcagtgaatggcattgcttggaatttt

SEQ ID NO: 136377 - DNA, 1051 bp, Homo sapiens
ctgggagtgctggctaactcaccccttcttcaaacacgctgtgtggcttcaggatatggctgctggctttaaaaaagaaggaaaaataaattaagacacccacactgcaagacaacccctgtgagtatatgttatactgggaatgccccatttctcaaatatttataaatatatggtctcttggagtgttctaggtctgtcatttgggaaggttagacagccctgggccactatcctttttcgtaagcacagggcactttcacaaataccagattgacagctgggtgatgccaagggaatggtgatgtgttgccctgtgtatatctgggatgtgttagacatccctcccttccttctttttctttgttttccctccctccttcccttcttcccttccttctttcttttttcttcctccctccttcccttcttcccctcctttctttccaagcacatcagtgagaatgtagcacagcttggttttctgaagtccgtcaactactgtgtactgcttgtcaagaagggtgctatataagctgaaatgctgctctaaatttcacattatcccttcctgctgctcattgagttatttaattagaagctgccatattttctagggaaaacactttgaacagaaggcctgatttcactgagaatggatgcctttattatgtgtcaaggagctaaaaattgctagtaagatgtcagtgtgtatatgtatatgaaatacagaaaagtgcatgtacatatatgaagagcaatcaaaagagaaatgcgaaggggttggaaaatgaagaggtgtcagatccagtcgatgatttggttcctgctcaggagtgtgtaagcttcagttggctccagtttggctaacactgcaatgcctttagtgtcactgaagccgacaaagaaagctgacgcgttgtttttctagggggaaaaaaaatgctctccttccacattcccagtgcagacaacagcagaaaacagaaatgagaccgtactgcccagagtccacacagactccaactcaaagtctttgaattatgtattc

SEQ ID NO: 136378 - DNA, 1051 bp, Homo sapiens
ctattctaaccaatagaattaagtactagtggtgttgctatgggaaagtcatttcactctgagcccatactttctcattcgttaataatctttgtaccatagggcagatgttcaacatggtatgttgaacacactcatactttaacttatgacttccacagtaaccctagggaggagttgctgaggactccatctctcttacagatgcaatatctcagccaggtagacatagcattatgcctttacattcagaaaaggaagcaaattctgtgacatgggactatcagggggtttcttggtgcatttgggccttgacctgggttctttagaatggcaaattttgccaccaggaaaaggcagaagagattgtgagtgataaaagctaaagcagtctgggccagaagagctacatatgagttctgtgtctatacagcatgtgactttgttatttgagaaagtagaatgtcaggttgagggagagaaaaacagatcaggccaaaactactaggcatctgatttgggtggtggagagagggtgggcagaagagaacagaaatgatgaaatctggatcctagttcttgataaaccgtcaaccctctgaagaacttgggaaaattaatttcacttatctgaactctggttagggcaaaacacaagtcatttcccaagagtctttaaataatgagcatcatcacaattgtaagggctcacactgattgaatgtttattgtgtgggctgggcacggtggcttatgcctgtaatccctgcactttgggaggccaagacgggtggatcacttgagcctaggagttcaagaccagcctgggcaacatggcgagactccgtctctacaaaaaattagctgggcatggtggtgtgtgcctgtagtctcagctacttgggaggctgaggcgggaggattgcttgaatctgagaggcagaggtttcaatgagccaagattgcaccaatgtactccaacctgggtgatggagtcagatcctgtctaaaaagtaaattaaaaaaaaaatttattatgtactccttgcct

SEQ ID NO: 136379 - DNA, 1035 bp, Homo sapiens
aggttaagagacttgcctggagttaagtagcagagttgagagtcaaactcagatagtctgacttcagagccaggtttgaatgtgactggttcctgcacaaggcttttctatgagatgcgtaaaatgctttagtggacaaatctttccatttttccctctggagggggtttaagtggtatttgtcttccttctacctcacagggtgattgtgaaggtgaacagcttagtaacatactgggagtgggagtggtgatacagcccactctgcaatgcagggtgtgtggttaaacctgtaaattgaatgttgataatgataatgatttttactttacagataacatttatcacatgttaataaaatataaagtaagatgcacgtaagtaaagaatgtagttactctgtccagaccctctggaattttttaagggtctttcccccacttcagctttgatgggctttcagcggccagccctgcagctcatctttggactattggacctgcattgatcccaggatgaaagagcccaaggtatctgagtttgcgaacacacacacacacacacacacacacacacacacacacacacacacactttagccaaagactgatgggtacaagagcccagctgccttacctcaaattgagacaactttgaggtgtaaactcacactctagagttccctgtgcgacctcagtggaactttgctggagaccttcgccttgcttagctcttgcccttctctcttgggagcatctcttatccaatagcttgtaatcccaatttccttgggaaacaatgagaagagaaaacattgaaaaacaaaccagtagggacatctaaagcttcaaaagaggcatggcaaggagggcttgatcttcttggtttgacaagtcattgtttgctgattgcttgacatccattacagagccaggcctgccacaagccatctctgccctacctccctgccaacattgtcctgcaagacggccagggccttttgaagcagcctgtggagagcctgccagggttctg

SEQ ID NO: 136380 - DNA, 1025 bp, Homo sapiens
attcattcattcaacaaacttgtttgtgtgagtgcctgttaggtgttactgtgctagccatgaaactagcaccattcttgtcctagaaataatataaaatatgtttgttaaatatgtagtaagcatttcataaatgctcttgaagggtgtacacaatagaggctataacagcttctctgaacaatcctgtggttaatgatgttctttaattatgccaacatccaatacctcatgttaaagacttttagcattttccagatgttggaaatgatcagaaaattgtatattctcagtaactatgaagaataatctgagttcttagttgtgggtgctgaggcccaagaggtatatccttcatcaaggttacatgtgggtagaggtagatgcctcctgcatcccagcattgggttagttagctaagaaagtaggctcgaggcccaactgccggggttccaattctgtctctgccacctataggttaagtgatcttgaggaagtcatttaacttctctgtgttttagtttccttctctgtgaagtggggctggaatagtaactggctgcatagggtgtatggattcagtgagttcctatatatcgaaatactcaagagtgtaaacagtatagtttcatgtgtaataacagccattagcaacaagaagtaaggctggactgttttctcacatatggcagaaattcaattggtgttataaaataatcaaaactggtaaatagccagttcttagatctatctgtccaagatatttcatgagcagattgtatttccacaaacaaagaaaaacctgtttacaactgtacctggcatatagtaagtgctcaataagtgttcgctagtatcttgcggcactgctctcatctcctgcagtgttggagagggtgtttgaagcgctttattggagtcaaaggataatgctcccaccccctgactctgtgcgcatgtgtgtgagtgtgtgtgtatgtgtgtgagtgtgtaccagtgtacaaaaaggtgtgttgtagtggaaa

SEQ ID NO: 136381 - DNA, 1036 bp, Homo sapiens
tctagggggcatatcattttctgggctgggcagctagtactaagacactaatttagttctgattttaataatgtaaaggtatatggataaaaaggccgcctgtcaataccagagttctaaggaggatgactcttgagttaggtttcccaagaccttgaataaaaaagtttgcgctggaaaagttaaatgatgctgccaaccccagggggcaaggcagctgagacagagagagacagagagagagagagagagagagagagagtgagttggggattgtggctctttggcatctcaaaaggagcttgaatgtcagacagggtgtggaggacagcaagaagagatcagtgtgtaaaatattccaatggaaaattccaaaaaagcgtcagccacagctaaatgggacaagaaacaatatacgttaatttaagacgacgccgtcaatttagtggcatgtttattgaaatagccctttgcattctaaaaacagcactagggtatggacctctgaatccttgcaggaaactgtacaaattcctaggagggaacagcagccccaaatctgactttaataacaaaaggcaattatttttagtattttccagtagatctcagctgtctggtattgtcaggctctattcatggagaggtggaatttggagagagttagttcagtgaatggtgagtgggggagggaggaaaggaaggaggaaaataaggcagggaaaaaacacagaaaggttgggtgggggagcgagaaggaaggagagaaggagagagaaaggagagaatgagaatatgagtgggagcttgtgagcttttccactctggtactattatctggcatgatggccctcaaggcaaggtgccagtcatataataataaatgccaagatcaaacctctaggaacaaatataaagggactctaaaacaagcaatttgtcagactggtttcagggtacggagaaacataaagaacttgggagaaagtaagtcaccgataaattctcatggaaacaacaggaaagccattatagg

SEQ ID NO: 136382 - DNA, 1001 bp, Homo sapiens
cataactaatacagcaactgtgcaccatcttgaatacatttggattggggaagccaagcctttctttagcattcacactaaaggcaccagagtcatcaagagatgaaccaaagttcaatctgagtgctagaactattagggacctcagtgatcatctaatgctgtctctcttttcctgaatggtcttgctcttaggaccattttaatgttctttctcttttctgggtaaaatacagttaatacagttttgtttttactaggatcctcatgcaatcttaggtgaagtgttagctagttctagaactgtagaaaaccccatggtttctcctcctctcccatgcccaaatcctcttctacctgctggctgatgcctctagttttaccattccaggttggtcctctcagcaataggcttgatttccattaaaatgcaaaaaccctaggacaggcttaagccattatcaggtgtttttcactttgttgtgaaggaagggtcaaagtaatatgttgtggaatgaaagttttatttctgtaaggccagagggttagagaaaggaagaggaagtgccagcctggagggcaaaaggttctaaactgggaacttgggggcccacatggcagctccacagactctcactccttctcccaaaatgtctttatttgtatgtatttgtctttggactccctgtggtgatcaggtacttggtaattgttcttgctacaactggagctctgccaagtggaaggttcccaattgagaggcagctcaaatccgggatgagggtccccagccttgtcagaagggtgtgttagtgcttttttttttaatcccagtttgtggaagcagcagtggggatctgtgcaaagagggaaggttagagtgttgttttcaacttcatttgatatgggaactctttatccaggctcaaaggagagcattgcataagggggcatatgtagcctctcatgcatgcatatgcatgcttacacccatggactca

SEQ ID NO: 136383 - DNA, 1057 bp, Homo sapiens
atttctaggaccctgcaagacaaaataaaaccaaaaaattcaaggacacgcaggagttgtatgtgtccttcaactcctgcctcaccaccaaaacaaacaaatacactaaaatatttgaacttcaacaaactgacagaagatggtgccattaaactagggatcttgtgaaacacaccaaagccacacaaatgagtaagagatagattagcagatccacatagagtgattgcaaaaggtcaatgaaagaatatatgaagcaagggttttatgtccaaccatgctgttcatcaagtatagaaaagcaattttcaacatacaggaacttagagaattttgcacccatgagtcctttatgaggcatctaccacaggacaagcttcatccaaccaagggataattggggaaatgtcagcaaaaggatgggtagcatacattttaatacatgtaaatgtagatctaaaactaaaagtacagtggagatgaagatagaaaactaaggtgcaattttaaatgttgtgacaacagagaatgatacaactaaaaatgagagaagggagaggtaaagaagaaaatagaataagctaattgatcactgtctaggcaataagtggctgttaaaggataccaataagaactagttaaccagatagtaaaggcttgaataataaaacagaggactaaggacattaaaatggtataagaaaaaagaagactactagcaaaaaaaaaaaaaatacaaatcttcctaaataccaaaaaattgttttatataaacagagaagacaacacatcttacagaggaagaaacataacaaatataacaaaatacacataattataacatttatcagagtttagtcatatcaatgaatatgagtgagcttaatttgcctatttaaaaacttttcaatttggctcacaaagcaaatccaactatatgctctatacattaaacacacacaagatttttatttattaattaggtcctgattatttgaaaaaacatgaccaagaaaaagagagagaaaacacaaataaaataagcaatgacaggaaa

SEQ ID NO: 136384 - DNA, 1024 bp, Homo sapiens
atgcccaagtgatttcttcttgcattattcccatcaatgttactggtatcgttctggttttttcttaggggcagtcgggtcagaatattctgtgtattaaatatgttcaaaatctgtgctgctaagaataccattttgtaaacaagtaatgcctttttgtcatcaaaatacaaacccagaggatgttcgatatgcttttgtcaggttttgaacatcaatttacatgttttccgcgggccacttgttatgtaaattatggacagtttctttttgaaaaaaatcaccaaatagctctttggccatagctgactgaaataatggagaaagcggcagtgattaatcatatgataatgatgtgtggcactgcaagaaagaaaacagcaaacccaggcttctcaaactgcaagtaatggtcctgtaggccaactagaaaatctgttttcatgcttccttggatgaaggtaggctttttaaaaaagactgttaagacttctgtattgatttgggggatttttgacctaaaaatatatggatacagagatgaaggctgaattctattttaaaaccagcaaggctgtcttcctttcactctctttttttctcctcctgtgtactgagagtgtgaatattagtctagatagaatggaagcatagccagacctttctgaaaaatttattggcagcagttataaattccacaattggatctagtaatcttagtcgtaagtaaaataatgttataaaatattctaactttcaaagacataaatggtctatccattgggctttcttacatctctaatagttacattttaacttatttgtatattgaaaatttcaaaacagccatgttatgactgattttcatattggtaccatgtgactaaagattgcatgtcacttgagatgcatgttgcacacagctatcattaaccccactcagatttctctcaaataaagtggggaagcaaatggaccagatatctgggacagatattatttttttcctgagaaaaaaggagtc

SEQ ID NO: 136385 - DNA, 1053 bp, Homo sapiens
tttgaaaaatccatggtgcagacaagagtttgagttcctcacctcccctctcatcattctagttgtgatgggactgcatgtaatgttgataatgtgattatggagagagaaactaacaagcaccatggtttgccctctgtgtttacaaaaacaaacctatgggataaagactggcaattccagctttacagttggtatagaaggtggatccatttaagtgcagaactggggactgccttgtatgtttattttatattgaaaagacatctcatgctaaaccagaaagcattcagtttagtaaatagaagaaagtagacagagttgggtgatgatttaaaaaaacaaatccttagactgttgagtttcctcacagcaaaagaggtgtgtgtgtgtgtgtgtgtgtgtgtgtgtgtgtgtgtgtgtgtgcgcgcgcgtgcgcgcatggggaatgcaagaaggtttggaccataagagatggagggaacaaaacctcacaaagacggcttttaatgaagaaatgggtcaggatatgttagctgagctaattcaggttatcatcctggctgctgatttactatgcaaaggtatcagcttcagagagcccagaaatagatcagtaaatagtagtaactaaaggttataaatccttaaggagccatttctatgtgagagggattttttggatgtctttttctcttctctttcttttgatttttcttctttgcttgtttttgttggcagtgcaaactgttgtggagagctgcatttagaagtaaagcttaatgtactgcagcataatttaaataagagctgaataacagctcccttatatttgttcacaggcttaacccaaactctttccttacttcccgtcaaaaatatcactgtgttccaagtaaatgaaaatttgtttgccatttctaaagctaatgagacctatttgtgggttgcaggagttggctttgacagagaggctagtatacgctgctctctggttcattcacaatcggtactacagcggagacgaaaattgaggaggaggaaaaccatctc

SEQ ID NO: 136386 - DNA, 1033 bp, Homo sapiens
gtgattgtgcacacaaacccagacccctccaacactgtcaataggatatccggaaccagggactctgagtgccaaaccgaggatattctgattgctgccccatccagaaggagaatcagagctcaaaggggtcaaagcattgcagcttccctttctcattctgctggcaacatttctgccctagcagacaaaggtgacaccatgtttactcctgcagtgagcagccgcacaagatctcggagccttccccgggaaggtaatagaggtggggatgctgagcccaaagttggcgctaaaccctcagcatatgaagagggagagtcttttgtgggtgaccatgaaagaacccctaatgatttcagtgaggctccaagcagcccgagtgcccaggaccaccagcctactttgggcctggcctgctctcaacatcttcacagcccccagcacaaattaagtgagaggggaaggtcacgtctgtcccgaatggctgctgactctggcagctgtgacatctcctccaactcagacacgtttgggagccccatccactgcatctccacggctggcgtcctccttagcagccacatggaccagaaagatgaccaccagtcatccagtggcaactggagtgggagcagctccacgtgcccctcgcagacctcagaaaccatccctcctgcagcttctcctccactcactggctcttcacactgtgactcggagttgtcactaaacacagcccctcatgccaatgaggatgccagtgttttcgtgacagagcaatacaatgaccacttggataaagtgagaggccatcgggcaaactcctttacctccactgttgcagacctgctggatgatcccaacaacagcaacacaagtgacagtgagtggaattacctacaccaccaccatgatgcctcctgccgccaggattttagtcctgagcgtcccaaggcagacagcctgggctgcccaagcttcacaagcatggccacttatgacagctttctggaaaagtctccatcagaca

SEQ ID NO: 136387 - DNA, 1321 bp, Homo sapiens
gcagggaagaccaagcatctctttcaggaaaccaaaggcaaagccgaccccacctaaacgtagctcatcattgaggaagtctgatggaaacgcagatatttctgagaagaaagaaccaaagataagcagtggtcagcacctgcctcacagttccagggaaatgaagctgcctcttgatttcgccaacacgccttctcgaatggaaaacgccaatcttcccaccaagcaggaaccttcttggataaaccagagtgaacaaggcattaaggaacctcagttagatgcttcggatattccaccattcaaagatgaagttgccgaatccacacactatgcagacctctggctcctaaatgacttgaaaacaaatgatccttatagatctctatctaattcaagcaccgctacgggtaccacagtcattgaatgcatcaaatctccagagagctctgaatcccaaacatcacaatcagaatcaagagccaccaccccatctcttccttctgttgacaatgagtttaaactggcttcaccagaaaagctggctggcttggcatctccatcaagtggctattcaagccagtctgaaacgccaacatcctctttccctacagctttcttttcaggtccattgtctcccggaggtagcaaaagaaaacctaaagtcccagaaagaaaatcctcactacagcaaccctctttaaaagatggaactatatcactgagtaaagaccttgaacttccaattatacctcctacccatcttgatctaagtgctcttcataatgtcttgaacaaaccattccaccaccgtcatccactgcatgtttttactcataataagcagaacacagtaggagaaacactgaggtcgaatcctccaccgtcccttgcaattacaccaacgatcctgaaatctgttaaccttaggtccatcaacaagtctgaagaagttaagcaaaaagaagaaaacaatacagatctcccttatttagaggaaagcacactcacaacggctgccttgtctccaagtaagattaggccgcatacagcaaataaatcagtatctcgtcaatactccactgaagacaccatactgtcctttttagactcttctgcagttgagatgggaccagataaactacatttagaaaaaaactctacttttgatgtgaagaatcgctgcgatccagaaaccataacatcagctggtagcagtcttctagattcaaatgtcacaaaagaccaagtgcgtacagagactgagcctattccagaaaacacgccaaccaaaaactgtgcttttcccacagaaggattt

SEQ ID NO: 136388 - DNA, 1452 bp, Homo sapiens
gggacatgtctgttcgaagcaaatcgagagctcccctcagcagtagcagcagcagcgccagttccatcacttcacccagcagtaatgtgacaacccccaacagccagaggtctcctggtctcatataccgaaatgccaaaaagtccaacacatccaatgaagagtttaagctgttactgctcaagaaaggcagtcgctcagattctagttaccgcatgtctgccactgagatcctgaagagccccatactgcccaaacctcctggggagctcacagcagagtcccctcagagcaccgatgatgcccatcaggggtcacaaggggctgaggcattgtccccactctctccatgctccccacgagttaatgcagaaggcttttcctcgaagagctttgccacctcagcatcagcaagggttggacgttctcgggcccctcctgcagccagcagcagccgctacagtgtccgctgccggctgtacaatacgcccatgcaggcaatctccgagggagagacggaaaattctgacgggagcccacatgacgaccgttcctcccagagttcaacatagactgcctgtaccaggctgcctggcaaaggccaaaacccttactcacatgaggatggaggaacagaacagaggacttgggaaaagtctcaacttgatggggtagcatcactgctaagcaatgaatgaatttctaaatacagtatgtgctgggtaaacagaaagtggtttagacattcttgattagtttccatattttaagtagctgcagtctttcatgtttttctttagcatagtttgatttacgcaatctccttccttgtgaaaatagaggatacaaaattgtctaattttcatgacacctagaaaacgttttcccagagctgcctattcagaaactaaagccctcactgtcattattctttaagaagatgaaattactctggatgtttggtatttttttacattaaaacaaactaaagcaaaatttagaagaaagaactacacatatgtaaataccatatttttgataaaaatgtgtaaatagatttatcaatgatgagtggacatgtggtcaattatctactgcacaccaactgtttatagaatacacaaaaataaaatgtaataactgtattctgtgaataccattttcatatcaaatgccatatttaaatgtccaccaatatgatttctgagtggtaaacctcaaatatgaattttaaactggtgaactaaaggaaatcttgaggtcatatactgaaatatgaataaattaaaataatgaattcagatctaatcatttttatgacaaattgcagcaccaaacaaactaatagcaacccatggctgtgatttgttgtgtggtaatttggacagaatgaaaagcatgcttttgattttttttttaatcagtgagagaagtcatcattctcaacacaaa

SEQ ID NO: 136389 - DNA, 2412 bp, Homo sapiens
aatgagttttcagtgaagctttctctctgtgctgatgagattcatgctacctaaaaattaacagaaatgacactgtgaacaatgtagttggaaaataggtatgtgtatatgcattatttatactcattgttaaactgggaatggggaacagctctggttcacaatactacatacaactgagtttttgtctggttttactatagtgtctgcttgatggcaaaaggggagggtggagggtgggagaggaaatgtcagggcatgtgctctgataaaataaaggcagggaaacaagctgaattacttgaaattacttgaattttcttgtcttaaaactgaaaaaaaaatgtagttacacgttaaaatctgcaaatggtttttacacctctgattttaacatgaacttatactaatgtttggaatcttatgtcagaaatataagcagctatgtacttagaataggttttgaatgggagaggtagaacagagagagaattaagaagggatctgacttataaaagactagaatgtgattagagtgatagaacataccaatgttaccaagaaattgacaagctgctggctttaagcttatgcaagtggtagttgggaaagtaggaggtgtggaagagggtttgcattttggattaattcatgcaaaatgaaggaggaagcctggtctaagaagatactgtctttcaatagaaatgatttctaaactgctacagattaagaatagataatctgattgctgttgttttgtttgtttggaaagaaaaaaaatgtctggcttcttctactatttgttttcactaccaaactgtgttactaaatttcttgtcatccttgtatgtaaaatgggtgctgggggtggaggggtataagaggagggagagtcagagagagtgtgtatgggtgtgtgtgagtgtgagtgtgtgtgtacgcacacacactggggatagataagctacctggtaaagggtttgaacatttacaaaatgtcacactttttcttaaaagaaaaatattttggggtttgaataaaatggaccaccatttctcattggaacccattaattaagaaaaccagcatggtttgacaccacatgggaacatgaataaatctgtctcatgatttgaaaagtacaccttgcaaagttttaaaaataaagtttttaggcaaatgcgataagaaaccgtcatttccagtcacagtaggcgatctttcgtaatttcataaaagcagttcgtttgcagtatggcttttgtgtagttaggggttttttaagtgtgaagaaaggtatgtgggctttaaaagtgattctaaatcttgaatagaaaacacatgaattggctttaataaaaatgtcacctttttattattgacattaagtaatggtaccatatattttttaaaatacatattgacttgaattgtgaggcaataagataccttctatatgtaatgatcacagaactaacccttataatatagttttacttattttgtttactctaaaaatctatagcagagtttctctattttatatttcatagatttaaaaaacccaaataaagatggatttaaaattcactgtggaaaagagtattgagttacaaactgagaagaaaaagcaggaagttccctaataatctggaatattctacatggcttgattacatagcaaacaagaccaagatttagggctgtcttaaacatcactgccgtcttgaagcagggtacacacgttaggtattgtgaagaacatcaatccgaacttttcttctgttgtttgcactgatgcgattttttgttcttttatgtttatacaacgtatctatgttgtgtaggggaaattttttcattttttaaaaattctactttggttttgttgttgttttgatttgtttttggctaagtagaggacatggactagttgtagcaaacagaacatgctgtttgctcttgccaaaggtcagtgagtgagtgcatttgctgcagtggtggcacgtagagaactagatggtaataaagatttaaaactatgaagaaggttacagtgtaactattttggtactagaaccagttcatgctggccgaaacgacaatggtttatggacttgcatccattttgtatttttgtaatatttgtaaatatgaactttttaaattgctgcaaagatggtttcttttgtaagatgttttcaacgtttacattcaatccaagcctttgtatattttagagctgtgcaacactttaagtcttgtatttatttttagtaaaaatggtgacagtttcattgtgaacccctctcaaaaaaaatgtatcagaaaagtttgattacctagaaagtgtgtatagaaactgcaaataaacgtgactgcaattaaacaaccggtttctctcttcactg

SEQ ID NO: 136390 - DNA, 1038 bp, Homo sapiens
catgtgtcagtagtcccagctacttgggaggcaaggtgggaggatcacttgagcctgggaggtcagcgctgcagtgagccatgattgtgccactgcactccagcctgggtaacagagcgagaccctgtctcaaaaaaaccaaaacaacaacaacaacaacaaaacaaaacaaaaactaactgtaaatttggggaatttccatcggatttagctagtaaaatatacctagtctagacagatagagagagattgaaattccttgaaagacttaaagtaagagagaagtcataggttagattagattaacctaattttacccgagtaacagatcttttgctgtatttgtctgtggccaaagaggcttggattgcttagtctgttttgtgatctttgaagctttaaggtaacgtctgaacctgcttttgttgtttgggggaggtcagatgggatgctcttatgtagccatcctcacatcatttttgtataagctttcacagttggagtcttgagaccttgttggggaacttaacaaaaggttccaggaatgagaccattattccctacctaacatctcttctttcaggataatgatcaggtcaagtatgatttgtcttttttcccccccattgaagctccaagttatatagctgtacctgatcccagtgtcctgaaacaaggcttctctaaggacccttcaacctggtctgtggatgaagtgatacagtttatgaaacatacagatcctcagatatcaggccccctcgccgacctcttcaggcaacatgtaatgtatcttttgatccggttttcctgccgtaatgcctttgaatgacctctgtgcaggcccttcatttggatgctgtgtggatggtgggggaaccctatcaactgatttttccatatgtgagagaggttatttttcccaagattagttccttaaatggtagattaatggtctgttctttaagtgagtatccaggtgcctaaaatacaaactgcttcaacttctcaagatacgatgattcagcattgcaactc

SEQ ID NO: 136391 - DNA, 1051 bp, Homo sapiens
tagtagtatttgaattgtaagtctattgaagatagcctcctttgtctttttccctgtaggagaaccattgtttgctgggggaagtgccattcccaaagaggagaatctttcagaagattctaagagctcatcactaaattcaggaaattatttgaatcctgcctgtagaaatcctatgtatattcatacttcagtctcccaggatttttctcgaagtgtgccaggcaccacaagttcaccactagttggggacatatcccccaagagcagtccccatgaagttaaattccaaatgcagaggaaaagtgaaggtatgttcaaaaatagtgactctcaatgtgtttgtcttttgccttgagattttcatacctaacagcatcccctgagagtatcacattggagaaagtgctaaaatttgggaggctgagtcctctctttcacatcactgtcaggtcagaccattatggatcctccaatcctcttgacagcacagaactgtctctagggatctggatcaccaaccatgtctctgatagagacttctcagattagtagtgcttgaacagttgtaatttatcatttccttgggtaccgtctggactcacaaacctctcatgactctgaggcctggaaagacagtccctctcctttctgttgtacacttttcttcgtctctcttgagacattcctggcctcagcctgtgttgactcctggattcgggctggcatcttgttaccacagccacaccatttcctcactctccacatccttcctcagacccaccaggaagtcatgacatgtataagtagggcaatatcctgttgccatttagaaagagccagaacaggccaggcgcggggtggctcacacctgtaatcctagcactttgggaggccgaggcaggcagatcacccgaagtcgggagtttgagaccagcctgaccaacgtggagaaaccctgtctctactaaaaatacaaaattagctgagcatggtgatgcatgcctgtaatcccagctacttgggagcccgaggcaggagaatcacttga

SEQ ID NO: 136392 - DNA, 1020 bp, Homo sapiens
aagttctcaggtgttattgccgcatggttttctggccagctgctgctgattctggaaatacagagtaccatcacagactatctttttaagtccagggattctaattcacgtgccactcaagtgtgaagcgtgggtaccacgtctctagctactacttttttttctggtcctcctggttaccctcacccttcttcataaagcttgtctcctctacttcagtgacatctctcatatccatccccttttttccatttccttgttactaccctgcttcagactgtactaaccccttctctggtttagtaaagcaggcttctaactggagtcctctttccagtttctcccctctggtgtagctgtccagtgagtccctttgaaataaaggtatgatactgtgacatgcttgcaaaaagtatacatggagaagcagtggcatggagagcacaggtgttggagtttgtcagacctgggttccaatcctggccttgtaatctctgctgaaagagtataaagtctgaccggcctacattttaattcagttcctgctgttaactagctatgtgcccatagacaaagtactgagcctctctagttctcagtttccttatctgcaaagtggatacctctttggttgtgaaattgaaagaaagtatatgtaaattcttagcctgcattatgcctggcatgaagtaggagcaataaaaggtagctgttagaactagggggaagaggaagagtgaggtttcatgttttcatgtgatattatcctttttttttccttcttcaggagaggtaggaggtcatccaaaatggtaggaaatttggaagatggctaggaagggaagggccacctgtgtgggaagaggggtgtctgtgtattgataggttttctgtttctaagagtaatttggggaaaaatacgagttggagatgttgagagtacaatttcctgatttctttttttttggacacagagtctcagtctgtcacccaggttggagtgtagtgacaccatctcgg

SEQ ID NO: 136393 - DNA, 1049 bp, Homo sapiens
tttgaaaggaaattcttgtactgtgtatacaattaaaagatgaaaatattcatctgtctttgtgccattttatataatgtgggaatgtatgaagaattgtttttgtgatgtgcctaaaatgtctgtagattttatatcatcagtttggacaagattctaaaaaattgaataaacattttgattgtttctttgtgggttcagtgtctttgcatcaatgtaaaaatatatttacatatttttaggtagcagaaatgatcattgatattaactatatttaggttttctgtgagtgaagtggatagtgggatatagtaattgattatgtagtgttttcacaaaatttcttttaatcagtctcattgttatgtatgcatacgcattttttctcaagtctgtgtctatgtaaacaaacatggaaactttggccctcatctggatcccaagagaatccagcagctgcctgaccacttcggcccgggcccggtgaatgtggtgcttcgccggattgtgcaggcctgtgtggattgtgcccttgaaactaaaactgtttttggatacctgaagccagataatcgtggaggagaagtgataactggtatacttatctaatacattgtctaattcagtcccttcccccttcccttcccccttcccttcccccttcccttcccccttccctttcctctccccttcccctttcccctccccttccccctcccccgccctttcttctttcttccttcatctttttagaacagggtctcactctgtcacccaggctggagtgcagtggtgtgatcttggctcactgcagcctccacctcccaggttcaagcgattctcccaccttagcctcctgagtagctgggattataggcatgcgccatcatgcctggctaacttttgtatttttagtagagacagggttttgccatgttgcccaggctagtcgtgaactcctggcctcatgtgatctgcccaccttggcctcgcagaatgctgggattacaggtgtgagccaccgcacctagcctgtaatatttattata

SEQ ID NO: 136394 - DNA, 1189 bp, Homo sapiens
acaccaatttacatatttgttaggtttgtttgactgcctgttgtaaaatttcttgttgattgcttttccctgtccgcaaccactactatcaccagcattagaatgtaagctccaccagagcagggatgtttgatatatttgttcatcaatgaatcttaaattcctggtacatagtagataatacatatttcttgaatgaatgaacccggctggttttgtttctttccaggttcttgactctgctccagagaaaatatgagatgttggagagcagagtttcagatctgtgagaactgttgtcttcctgtattaattgataattaaacatggagcttaatttttggttgctaagggttgtgagagaatacgcaacttttcacttcgagcacatgagtcttaatacatcttaacaatgaaatcttttttttttttaatgttttgataggaaccaccaaagcccccactaaataattttaaagtggggatgaaactggaagctattgacaaaaagaacccgtatctcatctgtcctgcgaccattggagatgttaaaggggatgaagttcatatcacatttgatggctggagtggagcttttgattactggtgcaagtatgattctcgagatattttcccagctgggtggtgtcgcctgacaggagatgtattacaacccccaggaactagtggtaagataataattaactactttttcttctactttattgaagttagatgtaactgtcattggtggcattgtgattagcgttggtggtaccaggtggtacatgccccaactggtggcagacagaacaaagcgctgtccaggctagagaactggaggtaaaggaaagctatgattagaattcttgaggtcactgcagcatcatagtctgagttccagtccacactggagattatggacaaagctaaaagtcatatttggaccattgaggtcttgttgctataagcaaggggggtggtatgtactcagctccttttatagttgatattcaattaaaaattatacatggtattccattgttcatatctcaaagatattttttaaaagactgggcttaacaactgttataaacatgtcttacatgatttttgtcctgtttttaagttaaattgacactttgatagccttaagttaaatctacagtgaaaatttttgactctgtgg

SEQ ID NO: 136395 - DNA, 1054 bp, Homo sapiens
gttggctaatttcaaggggaatggtctaatcagattcttactttagaaagccactcggtatattttagaggctgtatttgggttgcctggaagtgggcagatgagtgagaacagcagcgggtagtgtttttatgctgcatgtcaagccaaggagagaattttgaagatcttttccttgactcttacagctctgacctcactcatcatccactgtgactgttatttaaaatgttcctcaggtattctggtgacatagctgtccatgtgtcttctcttatagttgatgcattttaaccaaattttatttatatatatagtctcagattccacctgtgaatgatttcaaagttggtatgaaattggaagcccgtgaccctcgcaatgccacttcagtatgtattgctacggttattggaattactggggccaggttacggttacgactggatggtagtgacaacagaaatgatttttggaggcttgtcgattccccagacatacaacctgttgggacatgtgaaaaggaaggagacttacttcaacctccactaggtaagaagaaagttttaaaaatagcgtattctttctaatgtgatattcaatagaaatggctttaagtggccttttaaaatttattttcttgggcattcttgcaaatagatggtcaggtggttgctgtggagaatgtatgatgagagaggaaatcagcaccatctgttgtggagttttgcttaagtacatatttggcatatgtgtgtagaagttttctccactccagggcaagactcatgctaggtcttcaaacttgaaatgtcaaaaccagctctactagattacatatgcagattcagaactccttctggggaagaactttgtagcgtttgatacaaggcacatgctctctcaatattgtccactgagccattcagcaattttggtatggggataagcctaggggaagggtatgattccacattcaggttccagtttcaaactcaagaatttcatttcacctacagtgggaagaaatcagagcgagagggacaggaattag

SEQ ID NO: 136396 - DNA, 1047 bp, Homo sapiens
atttgtttttatttccttcaagtgttttaaaatgttttgttcacaaaatgtgaagaggctatatttacttgttcctgtatgttagtgttgaaggtgatagtatgatcttatgattaacaatccaattagggtccattaataatagatttttaaaaaaggcgtgctgcttttcgagaatatgataggttgagtacctagcaagacttctaatttctttttattaaaagtactattttaggattgagaatttttggcgttgacactgaaaccaggaataaggaagcctgcagcagtcttagcagtttgacaccaccagtaggtgtttctgttgacaaatgcagagaagagaacatttgggaaggaaatctttttttcggggcgggggttgggggggaggtgagggtggttgaggggggaaggagccagaagagagaagctaatgctgccagcactgtatgctgagcatttcacaagtacaaggaaacctaattagggaaaaattccgtttggctctattaaataatagaactacaaaagaggcatactaaataaagttaaccattccaagagtgttagatattatctgccatttcagagtagttgggggttcctcaattggagagggtatcaaatctctttgaattgtcttgcctttttaacatagtcaatgcagcgattaatttgctagatgtatatatatcaaacagttgagtattccagttttgttgtttagcatatttcctaagcctaaattttttaaaatcaaaatccgatatattttttttaaatttgaaatagaattctttgtccagagagtaattccttttttcctggctcagtcttaaaatttattcatgatttaggggtttgtgattggtatttttttacccctttttctcaggtttttgatttttacttatgcaagttccctaagtctgcctttgtttatattgtaattttcttggaattatttaaatcagagtgtggcatctattgtgtcccctggggttttaaaaggaaaggctcccattgaaagaaattgcaggg

SEQ ID NO: 136397 - DNA, 1045 bp, Homo sapiens
agagaaataaagtactttgctcagattacccagctagtcatcagaaacagcaaaattgccatccaaactggtctgacttgaagccgtgctcttcaaaaccatgctttctgcttctctttaggaaactgatttcccaagcatatttatttttgacaccgggtctcactctgttgcccaggctgaagtgcagtggtgtgatcacagcttgctgcacccttaacttggcagactcagtggatcctcccatctcagcctcctagtagctggagactacaggcacgtgctcccataccaggccaatttttctttatttttaatagaggcggggtctcatgatgttgctcaggctggtcttgaactcctggcgtcaagcgatcctcctgctttggcctcccaaagtgcttggactacaggcatgagccaccgccaggcccaccccaagggtattttgagttcctactgtatattatgcctcgggtgtactgaaggtatatgtatgcttcttggagttcatgggctacattggcaaggctgctggacctttagtcacatgggggactgaactcagatccatcaggactgctagataggacaattggaagtgcagacttttctaaccagagggtcagacttttctaacagaggttctgtttcttcataaatgaaggctgtacataatcatgccaaaaatgaggtagttgtttctaattagctacttggtatttcatgtttctggatattgcattataacttttgatggactttgattacatttgctacactaataaaggcttcgaagatactccttgaattcaattttgtggcttagatatacccttgaagtaaaatggcagccattataatttgcagatgggcacctcttgtgtaattatgaccagtgaaataaaatctggaggtaaagtctatagagatatattattgtgtgtgcgtgtttttttgagatggagtctcgctctgttgcctaggctggagtgcaatggcgtgatctcggctcactgcaacctccgtctcctgggttcaaacg

SEQ ID NO: 136398 - DNA, 1030 bp, Homo sapiens
tgggcatggtggctcacacctgtaatcccagcactttgggaggctgaggcaggcagatcacttgagcccaggagtttgagaccagcctgggcaacatggcaaaaccccatttctacaaaaatgcaaaattagccaagtgtggtggtatgtgcctgtagtcccagctactcccagagagtaagctgggaggattgcttgagcccaggagctggaggctgcagtgagccgtgattatgccactgcactccagcctgggtgacagcgagactcttgactcaaaaaaaaaaaaaaaaaaaaaaaaagaactgaaagaaatctaaaacgaccagaaaatagagaaacaggcattgaagcacaagttggcagcaggggccaggtcttgaaaaggtttagtaggccattttgctgggtttttgaacttgtcctaaatctcctgggaaacggttgaagattttaaggaggggtgtgacatgaaatgaaatgctacaaaacccaagaattttagttcaatggaaccttggtaatttaccagaaaggtcataatctctgcaaagtaaaatattcttcccttgtttcattaaaatttttgtaactcctttcttgattgattgtcgtctgcggtactcctttcattgtttttgtagaaattccctttaattttctaaaggtaccttttcttttatccctcactgttctgttaaccttatataggaatgtcatttctatttataactgaattagaatattttttctaacagctttagctctcttccatatttaaacttaaaattctttgctgtttttttccctccagacacctttaatctgctcgaagtatttaatgttttaacgaaatgtttcattaagtttgctttattcttttgttcttccaaatacagtgtcttagatctagtttaatatttctcagcatttatgctatttcatgttttatgaaatcacatgtgagcacccagaatgtttttagaaaattttgttactattgtataggagcactactcttcatcaggag

SEQ ID NO: 136399 - DNA, 1032 bp, Homo sapiens
ctttcttggtgtaaagttgttagctcatgcctgtaaagaatacttttgcccactgttcctctccacatatacgaagaataactgcagcatcacctctttcaaatagttccttggaaatctacatagtgattcaggcttgaattgagttcgcttttgccatgagttattttctttcttttctttttttttgagacggagtcttgttctcttgcccatgctggagtgcagtggcgcaatctcggctcactgcaacctccgcctcccgagttcaagcgattctcctgcctcagcctcccgagtagctgggattacaggcatgtgcccccacgcccggctaagttttgtatttttagtaaagacggggtttcaccatgttggccaggctggtctcaaactcctgacctcatgatctgcctgccttggcctcccacagtgctgggattgcaggcttgagccaccatgcctggcctgaagaggtacactcaacaggcacttaaggggactgggaaaggaaatgactcttgagtgcttgtgaagagtcttaaaggaagtccagaatgtcaggtgcaggtaaagggtttacaggcagagggtgcattaaaagacaaggatctggctggccgcggtggctcatgcctgtaattccagcactttgggaggccgaggcaggtggatcacgaggtcaggagttcaagaccagcctggccaacatggtgaaacccccgtctctactaaaaatacaaaaattagccgggcgtggtggtgtgtgtctgtagtcccagctactcaggaggctgaggcagtagaatctcttgaaccctggaggcggaggttgcagtgagccaagattgcaccactgccctccagcctgggcgacagagcgaacctccgtctcaaaaaaaaaaaaaaaaaaaagacaaggatctaaggatgggcatataaagctgggagaattgcaagaagtaatgtttatttatgtattacatgctttgctttgatgcttgtaccctagctatatcccaggatcttttc

SEQ ID NO: 136400 - DNA, 1032 bp, Homo sapiens
gctggtcttgaactcctgacctcatgacccacccgccttggcctcccaaagtgctgggattacaggcgtgagccactgcgcccggcctgagagcctgttttctttgggttttgccatctattttaacttgcttcagtgctccttggaattcctcactgatctatgtgctgagagcatctcctagattctcagggctgctctggattaattttttatttctttcgcttatttcactgagttttggtgtgggaggaaaggtaaatgtgtgtttggtcagccattttaaagtagagcttcagtgccctgtcttcgtgggtttcccccttttctctattgcagacatcatggccgagaatgtcttttaaagtgaatcattgtgtacacctttgatcattttattaagatactggccttatatcctgcccttcccccctgccgccccccagaatcactgggtggtgatggtagatgattcacatgggaatgtgctacacttgtgaaagatgtagaggaaatactgctgattctcctgaaggaaaagtctgttaatttttctctgttggccattctggccgcatggtttctccttattgtttttttgttggattttaaaaattactagtaagattgaacatttataagattcatttgttgcccatttatattttttcctgcattttcttttcatgttaataaaagttttttccccttaatacgattcccttaattctttttttttttttttggagacggaggctcactctgtctccaggctggagtgcagtggcgcaatcttggctcactgcaacctccacctcccatgttcaagcgattcccctgcctcggccttccgagtagctgggactaccggcgcatgccaccacgcgcagctaatttttgtatttttagtagagtcggggtttcaccatgttggccaggatggtctcgatctcttgacctcgtgatctgcccgcctcggcctcccaaagtgctgggattacaggcatgagccactgtgcccggtccccttaa

SEQ ID NO: 136401 - DNA, 1343 bp, Homo sapiens
tcaaaagaccttaaaagaatataaaaactaagcatcttatctctccctctattgtcaatcttgatttactttcaagacacacggtctttgaagaaacttgttcatgcctttgtaaatggattgtgttgagtactgcttcctgttgcttactgttatgggaatgagtgtactttgcctgtcagtgatattactagctactatttgagggcttgcagtgtgtaacagaataaaggacaatgcccttttgaaattctagttcagcataagtcagcaagtttcaaactgagttcttgatatttgcaaggttctgtgctaggcatctccatgtccaaagaccaatgagaatgaatctcctaacctcttgaccttgtctaatggggataggaggcacataccatgatacaagaccaactataattgtcactagaattggaaataaagtgctgccgggcttccatatcacagcatatcacattttatttgggttgcagagaggggaaggtatccttgtaaagtaagcttatccaacccgcggtctgtgggctgcatgtggcccaggatggctttgaatgtggcccagcacaaattcgtaaactttcttaagacatgagattttttttgcggtttttttttttttttcttttttagcttattggttatcgttagtgttagaatatttcctgtgtggcccaagacaattcttccaatgtggcccagggaagccaaaagattcgacacccctgctgtaaagcttcatggaagggttgtggtctaagaggtccaccttgaaaggatttcagtcgcagctgcaatatatgccaggtgaagggaattgcttgatggaatcatgtagcaggaacatatagtctataccaagtggttctcagagtgtggtccccagaccagcagcatcagcatcatctggaaacttgttagaaatgcaaactcttgggctccactccagacctactgattcagaaactcagaaatcccagaaacctgggttttaactagttctctaggtgattgtgatgtgttaaagtttgaaaaccattggtctagacttaattggtcagagaatagttgaagtaaggtttgagaagggaagttatgagaacaagaaggcaggggccttactgcagagaccttgattgagtactagggtgtgagtatatggggctggggaaccgttagggtgaaggaaaggacatccttggagtttactttaggaagagtgagccaacaaactttttttgtaagatgaattaaaactaaaagatactggaggccgggcgtggtggctcacgcctataatctcagcattttgggaggcctaggtgggc

SEQ ID NO: 136402 - DNA, 1029 bp, Homo sapiens
accccgtctctactaaaaatacaaaaattaaccaggcatggtggtgtgcgcctgtaatcccagctactcaggaggctgaggcaggagaatcgcttgaacccaggaggcggaggttgcagtgagccaagattgcgccactgcactccagcctgggtgacggagcaagactctgtctcaaaaataaaaaataaatgaaaaaaataaaagataccggaagctgggagtagcagccttggaaagtgaaaggagcaacacagctgggatgagtgagccttgacagctggctggtcaagtgtcaggaaagaggccacagcctcagaagcagctatggttctgaacctgggtgttgagaggatggtggtgcctttagaagcagtgcaggcagaagacgcaaaggccacatggtgcaggaaaatgggacaagggggaagaggatgttttctacaaataattgcttcttcccctgaatgtacaagtttagtgtaagaaattcaggtacttgaggggacagtgaagaagaatgcagaatcgcctcaaatcccactttacagagattagcaaaacattattctctttaaatattttgagtatacatttgtttctttaaactcagttttgtatgcatggaattatacaattccgtaacaaattttctcagacaaattgaatttgaatacgttagtgttccacacatgaatgatcagtgtgcgtttggaaattggtggattttatatttgggaaacagaatgtttatacaagcagctaattggtaaagattgcaatttcattatccatggtcataaaaacatcctgtccacattagttgttacagaggaaatctggggcaaaacagtttaagatgcttggtgtgctgttagtctggggagaagaactgcaactaagaagaaaaaagatgaaacatttgtggcttttattagaatagcaagtttattacggtgtcttacaagaactaattaatattgggcataaaatagtctcattacataggtcaataccaagttccaaagt

SEQ ID NO: 136403 - DNA, 1096 bp, Homo sapiens
gcagcacaaacaattgaggaagtgcaaagattttcgcttgatttttcttcagtttcttctatattttaaataggacacaaatatctctgtaaataaaaataacttccaatacatttggaaaacatcccagacttcctgtccatgcctcgcaaagttgctgctgtctagtcattattactatgttttttccctttgacataagtgaccctcacaggaatagcttcatcaccagctgtttggccagtggtattccacttactttgtttttcctgtttctctgaaatatgctgaaagataatcactccgtgccttcccttgtttagaatgaatttactcaattgctctggaagcttaccttggtaaatgatttggaaccgtaatgaaaaaagagggtaggctttatatattttatattggtgccttaggaattgacatttatttattgaggatttttgtgctcattttcaatttgaaagggtcctagtgtttagaattaaattgtgggacttgaaagctaaaaaggaacttggagatcgtccaactgaggagccttattttttaaatgaggaaacaaaagttgtcaagatcaaccataaatctgatagtttggcttggtgaaagaaacctaggtttcagaaaatctctcatgtagtttgcagtttatagccacaaggaccaggagtctgaagacttgataagagggtctgtttttcaaaatattaacaaagtttagcctggaagctccctttgtgaattttccatgtcattgacagtgtttgaaatctcgtcatgtcttcaggatcaataacctctaccatgtacttttatactttttaattagcggattttcaaacttttaaaaacagtaactcctttttttcaatataatcttatattgaaccacaggatacaaaaaagatacgtgatatttaattaaaatagttttaagcacaattttaatttgttggataataaattaatgatgacatagctaaaatttatgaaatgctgattagagtactgtacatacatatttcacttctctctctagcttaaaatatttgaatgggtgtactgtaattcatttaactaggcc

SEQ ID NO: 136404 - DNA, 1113 bp, Homo sapiens
aacataagtatatactctaatgaacaattataagtgaatgtctatttaaccatcactcaagacatagaaatagtgccccaggaacccctcctgtgttgtgttgtgttgtgttgtcttgtctagcctttccctttccctttctctttccctttcttccttcctttctttcctttctttctctgtcaccccggcagtgcacagtgcacagtgcacaatcacggctcaccgcagctgtgatcacctaggctcaaggaatcctcccacttcagcctcccaagtagctgggactagaggtgttcgccaccaacgcccagctaattaaaaaaaaaaaaaaaaagttgttgtagagacaaggtctcattatgttgcccaggctggtctcaaactcctgggtttaagtgatccttccgcctcagccttccaaagtgccgcctcagccttccaaaatgccgggctgccatatgtcttttctcaatctcagtccctccttagaggtaattaatatcctgatttttttacaataaacacttccttgatcacttttttatacagttaccacttacatgtacatacttaatatagtttatagttcagctttgcctgtttttaaactgtatataaaagaaacaatgctgttgtatcagttttctgttgcataataacttaccacatgcttagccatgttaagacaccatatattattagctcacagttctgtaggttcccagcctgatctttttattacttgtgttttctgtttcatgaatttttgctcttactcatttctttcttcacattttcattgggctcattttgtgtttcttttgtttagcctcttgagtttgatgcttagttcatgtttccagtttttagtattttctgatatatgcatataagattctcaatttcctccttaagcattgttttctttctatagatttgtatttttgttattgttaagtgtattatgttttcttccttgattgacatatggattattttgggagtgtatttatttccaaacataagaattattttctaactacttcttttgtgattgatcaactttagttgtggaaagagaccatccttttacttcagtccttgtaattt

SEQ ID NO: 136405 - DNA, 1043 bp, Homo sapiens
aaaaaagttcacctatgtgaacagcaaagctgttattaagttttaaagttggcaaatcctttcaaatacatagaaacaattaaaataaagagtttaatcattggatgcttgtttcaaggtctgaaattcaaaccatacaaaacaaataggtctttgttccttcactagtcaactcctcttccatttcttcatcgatgttatgtaaaaatttcattttcagtgtcttgcttaccatctgttctggaatagcctattttatttttcaaaagtattagaattagagaccaatgcaataaagctgctgactggagaaggctagcacatacggtgtaacaaggttagaatgctccagattctgggcctaagtttttctggatcataactagtttttctcattatagccataggtgatcatcttctttgggattggctcaaaattaccagactgttatatatatatatatatatcagaatatgttactttgttatcagaactaccattgctgtatgtttctttctttggaaagcacctcacatgtatttttggctaggatatacatataaagtatataacaatctgtcaccaggaacggtgactcatgcctataatcccagcactttgggaggctgaggtggtggatcacaaggtcaagagatccagaccatcttggccaacatggtgaaaccctgtctctactaaaaatacaaaaattagctgggtgtggtggcgggcgcctgtagtcccagctactcaggaggctgaggcaggagaatcgcttgaacctaggaggtggaggttgcagtgagtgagcttgtgccactgcactccagcctgatgagagagcgagactgtctcaaaacacacacacacacacacacacacacacacacacacaggttgcagtgagtgagcttgtgccactgcactccagcctgatgagagagcgagactgtctcaaaacacgcacacacacacacacacacacacacacacacacacacacacacacacacccctgtcaagcaaactctgcattcttgta

SEQ ID NO: 136406 - DNA, 1004 bp, Homo sapiens
gcaggcagatcacctgaggtccaagagttcaagaccagcctggccaacatggtgaaaccccatctctactaaaaatacaaaaaaatttgctgggcatggtggcggacacctgtaatcccagctactcaggaggccgaggcagaattgcttgaacccgggaggcggaggttgcagtgagcggagattgggccactgcactccagcctgcgcgacagagcaagactccgtctcagaaaacaacagagtagtacgtcgtgatctatttctacataaaaagtaatccaacactgatttactgtgtaattagaagctgtagttcatattttacaatttaaaggtgtatttcatatattaaagcattttaatttaaaaaaaatcaacttttttttttgtttttaaagttacttcctatacttaaaacactgtgttctaggcatgacatcataaagtaaaattcaaccagacatctaaggaaaatctgttgaatgcctatcaaatatcaggcacttagctaggcactgactacaaaaaaaaataagatgtaatttttacttttaaggaatttaacatggataaattaacaaatataaagtcatgttttcttttcttttcttatttttttttttttttttttttttttttttttttttgtgacagagtctcgctctgtcgccaggctggagtgcagtgggacaatctcagctcactgcaacctctgcctcccgggttcaagtgattctcctgcctcagcctcccgagtagctgggactacaggtgcccgctaccatgcctggctaattttttttatttttagtagagatggcgttttaccatgttggccaggatgatctcgatctcttgacctcatgatccaccctcggcctcccagagtgctgggattataggcgtgagccatcgccccagccctaaagtcatgttttctgttgtcaggaagtttaacatatagtttgggaggtgaatttgagataagatggtagttgaca

SEQ ID NO: 136407 - DNA, 1049 bp, Homo sapiens
ctattagagcccttaacatattaatcacagttattttaaattccctatctgataatccccaagtctgtgccatatctgagtctggttctgatgcttactttgtctctttagactatgctttttcttgctttttggcctgccttgtaatttttttaaagctggatatgatatattaggcaataggaactgaataaataggcctttagtgtaaggttatatgttaatctgtctagaagctaggtcatgtttaatgatgtaggtatagatgccagaggcttcagtttcctctagtgtctttgttattttatttttcctagtctgttgtctgtgggttctcctaagaactcctttataaatagtgagtctgtgtcttgcaactctttcagttgtaattctctgttaatgtactggagctctgttgacatgatgggaagagtatggcgaagggaagaaagtgttctataatctcattcttctgtaagacctgagtctttggctacaaccttcagaagtgtttccagccaccccttcccctccttttcttctgttagatgaaacaagaaggctagagggactgtctttggctgatttcctttctccctggacaccaaggctctggtaaattttctcttggactgttgacctttgttatgaaaaacattctggccttatttcaaaatggttactttcttcctctccctacctaaaagaagaggagatttttattagatcttacccctgggtgtatttcaaattaattttccttgtgtcttacacaaaaggggaggagttttttcttgggtcttcatagtcagaacctggtgagatttcctggaggtaaaactgcaagaacttagagggcctcctaagatttagtccccaggagttctcattcacaagctagtctcagttagcctttgtcaaaattatcatttaagttttcttactagtgtatgattccagtgccttctgctccaggtactgctgatcttggatgtgattctttgtatttgcctgtttctctagatttcaggcgattggttcaccct

SEQ ID NO: 136408 - DNA, 1564 bp, Homo sapiens
ttttttaactcatgtgtgttctaagcattttacttgtatcttctcatttaatcctaatagcaacctcaggaataagtgatattattatatctgattttctccggaggaaattgaggcacagagaagttaaggaacttccctaaggccactcaggtagtaggtggtagagccaggattcaaatgcaggcagtctagctcagagctgaagttcttcttacccttctttcagcgacgtgacaacctttgagttttactttgcttttctattatttgcttgaaattaagattgatgtatctaaaataagtgttctaggcttctaaaaagtgtcacacaattaaatgttactaaagtacgtttctaattagaaaagtttttgttttctttcttattaaaccacatagatttggcaagaagagtataaaaaataaccagtaataggttacatttacaactgtttggagtatagtcctttaataatcagatttttttgttcgtttttgtaagtaggaaacaatgattttgttagaaatctctgcttttggccaagtgcagtggctcacacctgtaatcccagcactgtgggaggccaaggcgggaggattgcttgagcctatgagttagagaccagcctggtcaacatagggagaccctgtctctacaaacagtacaaaaattagccttgtgtggtggcacacagatagtagcctgtagtcccagctactcagaggataaggtgggaggatcacctgagcctggggatgtcgaggctgcagtgagccatgatcgagccactgcactcccgcctgggtgacagagtgcaactctgtctcaaataataataataataaagaaaaataaaaggaaatctctgcttttttgtttggttgcttagggctcaataaaaaatttaaccagattatttctgattatgtatatctattatatatcacattttgttatacatttgtgatcatttctattgtttttacatgtctttgtgtttaaatacaggtagtagaataactagaaggatgtgactcacacgtcattatgtaaatattatccatgccagtacatttaaattctatagggacttaattgtaaagcagttataatatagccgtgttcctctgttgagaaaagattcatactgccctttaccttgctttttcagtgaaaatgtttaagttttttcgttcatttgaaatgtagaatcaaagtttcatttacatgcatattctatgtacttggtactataatcttagagtttgttctattctttgtaaacacagaatgtgaatataaattttctgccatgttttgttaggaataatgtatctctccattaatttgcatgttttcataccattgactcttaaatttccatgaacactagcccacaatgtgatttatctgaggcagattttttttcaaattcatattgatttatcttccatgccacttgaatacattttgttgatataataagattctttgctagttctagctcaagagaaaccacaggagtgaactttagaacttccgattagttcattaaataga

SEQ ID NO: 136409 - DNA, 1023 bp, Homo sapiens
tgccacattttcttaatccagtctatcattgttggacatttgggttggttccaagtctttgctattgtgaatagtgctgcaataaacatacgtgtgcatgtgtctttatagcagcatgatttatagtcctttgggtatatgcccagtaatggatggctgggtcaaatggtatttctagttctagatccctaaggaatcgccacactaacttccacaatggttgaactagtttacagtcccaccaacagtgtaaaagtgttcctatttctccacatcctctccagcacctgttgtttcctgactttttaacaattgccaaaaatgaccttttctaacaaaccaataaagttaaggcatctgcttagtctcccaaaagaaagccaggaagatatgacctctacagagagtgaataagctaaaacaaggcaaaaaatgcagaagttggctgagataaggacaagtgaaagaagcctaaaatggataaaacaaaattgtttagcactttcgaactgattaatgttcgtttactaaatgtttattgaacacctactatgtgcctgctattctaggtgctgatgatgcaattgtgaactttgcatactaagtacaaaaacttagtacaagactaagcaattatgaaagatccaacctagaagttgtaaggtttgtggtggaaaataatagaaaaataggagtaggaacaacgtttaaggttgctataagaagactttcctaatttcattgatttccaggtattattgattcaaaaaatacacacacacacacacacacacactcctctaaatatattccaaataatttaaaatttttatttcaaagaaaaggaaaagtcctaacagtatttaggcagaaaaaaagaagtgatctatattggaacaaaatccaaataggcctcatacttcttttctactacaaataccagagactgtcaggtcattgttccccatttgatgccttatgtgatagtattataatttctttatgttagaaaatggcagccct

SEQ ID NO: 136410 - DNA, 1535 bp, Homo sapiens
ctttggaccagcaagaattcaaaatattgtctgtccagcctttactttaggaaaacctattgtctagaatttatttttgacatacatttggaccttctttttgcttctttagacttttccatctttccttaaatgtaaggtgatggagtgaggggagagcctctctgcttgtcactgggcctctgtgcatggcaaggaggctgactccagggagctatacactagtctacatttaagatgaaacttaggttgtgtctctgcttttatataaaataaaattacttgcatttcgtattctgctgaatgttttctatagagaactattttcctcttggaatggacatattcttcttaattattagaaaacatttaattgatcatctgttctgtcttctaatttattttattcttctgtttacccagacactggaaagctctatactgatctctggatcaggagtactctggtctcttattttatataatggtacaaaaccagagttcgtaatctggagtccttaaattcaagagcctgatttctgtgtgaaagaggccttgaaacaaaaagtccaacccttgattaaacaaataatttgattaactgagcttgagcattctggctagtcatgattttaccacacttccttttcatgttcaacatggacctccttcagacttcagggattcttctaggatttggtgatcattttgcatcttctgtgatttaataaatttctactgtgcttttacctgttcttcatctctaaagattggagggtcctcatctttcttggtgtatgtaacagtagcactagcattcaaactccctcagccacattgtctgtctattgatgtcccttcttcaataagagcaaccagactcaaatatggtacccccgtggttttgatcaaggatgggttgatttttctttatcagtttatctgtgtaaaggtccatttggggtggggggctctttggctatacaaaaatgtcaggtttgtgatttcacaaagtaggttacagctattcctggatttcctttctaagcccacagttctttaaaaatagagttacaatagagtttctgctcatctttagatttttctcttttcatcagttatctttgaatctcctttgctcctgtgatctttcttcttaagaattgttctctttagcaaatcgctcttgatttttaggtgtgttaacttgccttactggtaagtttagaagtaggacagtttttgggttgtttttacttaacatcctttttccaccctgccattttgtcctcactcagtggggtttctatatatctgcacataactttgtcagagttgatcctgcattcagctaaaccccctcagtggtaactgatgacaagatgggtcagcatgcacataagcagttatcacatagaagtatggactcgggaagagtccttctgaataatccagtataactcagccccagtatacagatgatggacctcaggctcaaagttgcatagcgtgtatgtgaataattgcaactaaaa

SEQ ID NO: 136411 - DNA, 1030 bp, Homo sapiens
aggcatgccagtatcttttttatctcctgctttttgtctgtctttcacatctgtctgagttacctcaggcaagtttgttgtttctccttttatttttgcttttgtaagccagaaatttgccagctatgaccagtaattggggtgccaacagcatatgtggttcagcaggttagctcaacatttttgaacatttgtcatactaggtgttggaaatatgacaataaataggacttgtccccagtctagaagaaagaaaaatctattatactcagaaataaagttagtcataattaatgaattgcattttcactgaaaatcaatctaaactccttgccgtagcctatgagaccttgcctgacctcatctcgtacctatctccattccccccattctccagattctcagcacacttgccttttttgttctttggcttccataaacattccagggtttttccagtttcatcaacttgggacccatggctgcttctcctggcaaggtgcttccctcgtgtggtcccttctcattctgtcaatctcaaagagtgcctctttctctggccacccaacgtaccaccctcacctccatcctagtctttctctcccacagcatcctttttctatcatagaacttaccacagtatggaattattttgtctgtttctttacttgttaattgttaactatctagtcctctcacactggaatatgtttctcaagggcagaaatcaactgttttatcacatcacagatgtgtttccagcatttaacacagtatctaccatatccagtgagtattcactacatatctgagaagtgattaaccagtctgtggcatcagcattgaaactcaactgtatttcttttctctccatctctcatgcttcttttacccttttacctttacctaacctttgaccaccacccccaaatagatcccccgatctttctcttttcactttagccttctcacatttctcaaaccacacaattctcttttttgtttagaaacctctacaaggttactgata

SEQ ID NO: 136412 - DNA, 1129 bp, Homo sapiens
acatagacaacaaaagtaatatacaagtatgaatttgactgggattggcatttttgcttatctgctcccttctgcaacactcacaagcacgtgcacacacatgtccttccccaaatgttaacattccctttgtgtatgtctcacagtttccagctgttaaccatcctcagtccttggaaagaagataccttggaattttgaatagtgttctacttgacctaatgaaggtaaggccaattgatattatctctataaaatgtcttttggtttgtggattcttttgtgtctacatgtgaccatagcctgcttttatgaatgaaattttaggagatgtggaatggcaaataatggggaactatgtcatattaaaaggcatgtaacttatttaaaattacaatgggatctggtattgtcacagtccatctagacagaatcatgagacccctaaatgacattcttaaaatggacagaataataaaaatctgttagcatgcaagagctgttcaagcataaggttttaaaacaaatcttaaaatcaatgttgaaagaagaaattcaacaattttttctgacatggtatttgaagcctcccatcgcctacacagatttgatcagtgaatctaatttttctctttttctaacttggtctcttctctcccagactctttctggctctactttagacgtatcaggatcattgctaatgctgtggcctgagtgttcttccttatgctaccctccctgtccagaagtcttcctgctctatactctaaaagcattctcaaatttctttattcaagtttatttttttttctccagtagacagtcggctccttgagtgggaactgtttttcatatttctccagctttcactgcagccagaagtgcataagcaagtgttggttgtttgatagtagaccttcaaagaacacttattaatggatcaattttattttatgcccagtcagtcaactgtcaaaatcagtagaggttacactgtgcatagagcctttaaaaggcatacttagcacagtcggaaatttctgagtggcattctcagaactttgccgtgctttaaactatgttaatctgtgttccagggaacatagtgtacataggtgtgggggtg

SEQ ID NO: 136413 - DNA, 1618 bp, Homo sapiens
actgaacttaaaagtttatgaaacttttaaaaaaatgtaaaagaagaaactttaaaaccaaaaaattagagttgaggctctttgctgctacagaatgatttttttttttttttttttttttttgagacagagtttcactcttgtgcagactggagtgcaatggtgtgatctcagctcactgcaacctccacctcccaggttcaggcaattctcctacctcagcctcctgagtagctgggattacgggcatgagccaccacgcccagctaattttgtatttttagtagagacgggttttcaccgtgctggtcaggctggtctcgaactcctgacgtcagatgatcctcctgcctcggcctcccaaagtgctgggattacaggcgtgagccaccacacctggccccgaattatttcttaggatcttatgtcaagtgggaagaaagctaaattcaggcaattatgtgtatactactatgtgggtaaaataaaaggaacaggtagagatatgtatagggaatatctatggaaggatgcctaagaaactggtaacctaggctgcctccagaaaagggaactgggtatctgggggataagagaaagattaagaatgtatattctttcaagtgaatatctacttaattaaaagtgtactttaaattttttaattatattgtaaaagtgattttgattaatgataagtgcaggatacaaaactgtgtatattttgtaaaagaaaatatgtatataggatattcaaaaaagggctgggatcatatatacaaagaggaaaatgatgatgagattataggtgatttagatagtctttttttttttatttcctgaactgtgtttacttgatattctgcaatgactgtgtatttcttttataaggaaaaaaataaggtttttattagaacttaaatttgactttgtaatgttcttaacgatcctaaattttatttcctaagaatttactgaagttggacccagctgacagatacttgacagaacagtgtttgaatcaccctacatttcaaacccagagacttctggatcgttctccttcaaggtcagcaaaaagaaaaccttaccatgtggaaagcagcacattgtctaataggtaaatattcccttttaaggaaatacagatgcagtgttggtcttacaagtaggtggaggaggtggctgcttaaatgatgcaattagagaaaagaaggaaagccctctttattcaaaaatatcttccttatgcttattgcatgattcagaaccacaattaaggagttgtgtgggtcttaaagactttcttatctttaactagtatatgatggaaacctatgcattccctgggaaaggtagcattgggttagcaactaagggggtttacagcctcaagagctagaatattctgtgtgaatgaaacccatcagtgatacccggaggaagaaagctgggtgaaggcaaggggattcctggagagagaagaggatgccaaacacagatggtggatggaaatgtacctagtgtaatctttgtgactggaccaaataggtctggctctacagagaggtcttgtgtttttgttgctcttgtcttctaatcattgagttgagaaatt

SEQ ID NO: 136414 - DNA, 1041 bp, Homo sapiens
catagtaacctttaagtctaaatgttgtcttctgacattcaagcagacaaaagagttataaagagtttatagctcagctctcttcttagcagtcattctatcacaaacactcatatgagtaccaatataatgagagtatgttttaccagattatcatttagaaactgttttgacagcaagttagctgagcatttagcagtgccagaataatttcatcaaggccagtgctttgttacagagtgagttggtctaagaaacttaattgctgttgataggttacttgttattcgaaggcacatgcttgagagaattaatgtttttagtcttccaggtgttttgagtatttgttctttctttttaacaatactttttgtgtgtcagctattgagggaaactgatatacttcttttgtttttaacatagaaaccaagccggcaaaagtactgctttgcagtctcaccacagatctaacagcaaggacatccagaacctgagtgtaggcctgccccgggctgacgaaggtctccctgccaatgaaagcttcctaaatggaaaccttgctggagctagtcttagtccactgcacaccaaaacctaccaagcaagcagccagcctgggtctaccagcaaagatctcaccaacaacaacataccacaccttcttagcccaaaagaagccaagtcaaaaacagagtttgattttaatattgacccaaagccttcagaaggcccagggacaaagtacctcaagtcaaacagcagatctcagcagaaccgccactcattcatggaaagctctcaaagcaaagctgggacactgcagcccaatgaaaagcagagtcggcatagctatattgacacaattccccagtcctctaggagtccctcctacaggaccaaggccaaaagccatggggcactgagtgactccaagtctgtgagcaacctttctgaagccagggcccaaattgcggagcccagtaccagtaggtacttcccatctagctgcttagacttgaattctcccaccagcccaacccc

SEQ ID NO: 136415 - DNA, 1877 bp, Homo sapiens
tggttggcatgtgtcctctgtgaccaggagtgccacagagggcccttcctactctgaacagctgggtgccaaaagtgggccaaatgggcacccctataacagaacaaatcgctcacgaatgccaaatctgaatgatttaaaagagacagccttgtaatttgtgctggtaggggggaggggtggacagacaagccagtggggaggggtgggaaagggtgggctgggcttggggcatgggccgggccaagtggtgagccaatattttcagctttatgaaggtgtgtgcaatattgcatgtgttggggccgttgagctcctcgcggccacaaatgctagtcagggatcttagagccacaggagttccttagggatcgccactccccacaggtcttgtgtgagaatagatagagtgtgccattgaggaagaagaaattcttgccagtttctcccctttacattccagctttagtgcaatctctgttgaacttgggaatgccaggatgtgtcctggcactgcaagggataggaaagtcgtgttgaccgatgcccttactacatatttttttctgcctagagtaaatgtggggtttattgtaatccaagagtatccctttgaagggttagcagatgaactgtatgtcttaaattgttttctaaacttccatatttgataggatttgtaacatttatttataattaatattgtactgttaaaatcatatcttttatgttataatgtaaagttattttgagctgtttgaaacattgtgaagcagtgggacagctacagtagtttctataaaaactaaacagtaacatttatatattgcatcaggagtattttattctatatataatatatatatatggtaaatatctgttttataaatatattcatttaaagaaagtatcgttatgacactatctgccatatttttatacatttgtgatatgaagtgagtattatacttctactaaagggagttgaattgtggctacacgtgactgtaacagtatgaaccttgctcaactttgaggccccagcagtagcctctagacatgatccttggtagcagacgagatgcagcatctctttccaaacctgcaggggaagaaagtcagataggccagtgagaattccagcaggcctggtttccgtcctcacacacttggctcctgtttgtgtccagggacgttacttgcacacaggggagaatagattgaggcgttactcgtgggtctttgtagagagaatgtgctcttccacttagcattagtgtagagcgtagaccaaagatttgccagtgaacattccttgttgtgagatcataagaggtacctgtctgcagatcttgcaaaccatctctatgctcctgaatattgtccactgtcccggagactcttggctgatggggtgtgagatatatgtgtggcatttctatttctgaatgccttttttgctattgctctctccaataccatatttaaaaggctcctggagcaattccagatagataaaaaattactctatccatttttttcttcctggggctgtccacttatgacaagattttcatgcacacctgttacgcacacaacccccatcagaacaggacctatcttcccctcatctgatctctttcagctcccaagttactcccaagtatcatcaaaccctttggccatcaagtgttatcctcccatgcctctgggtcatccttgagggaagtcacctcagcaccatcatctatcagtagtagtagatttttggaattagtctctgagcaataatacttttaaaggtccctcccacccctcaaagagataacttctcagtatttattacttgtcctcaaattctgagtgtcagcccctgc

SEQ ID NO: 136416 - DNA, 1047 bp, Homo sapiens
acagccccccaaacaaacagtggtccagccccaagcactactagtgctgaggttgagaaaccctgccctacaccatcccaagcccaccagtctgcagagcttggctctggccttgttctgtccaggctacagtactgcaggtgtgatttcttcaacatcacattctcttaagagtcttcaaccactatgcctgaatccttggaatcctattgttcgtttccattgtcttgggcctgctaaaaggtgcatactttggaaggagaccagagttactttataggtgttggagaacttaaattctaggttagcatccttagaaaatctttcatagagccatgaggcttatatttagaagcaagcaacagcctggcagattggcatgatttttaccaactgctcaaaggcatccgtggctttcagctgtgtctcccgaaagaaaatgtctttgttttttattcaagtcatttaatagctctttacaaatattagcatatggcagaccaattagaagcaaaaaagtccgtattggtggttgtgatgtggctgttatagaagtatttgtgctgtatgctttggttaaatctgttttaaaacatgctttaagattcaccttacgcagttgtactttaattctaagctcagagctatgctgtcagtctctagtcacgccatgtattataaagtatgttgtggttgtagagttagccagtttagcatgttcctaatctgagaattagtggactatactaggaaatgctatcccattttccctttccagcccctcttagttaagatcatagtatcctcacttcttaaactagtctttagagtaaataaggaaaaaagccatttattttcttctagccatgtattattgagaatgactcatagtacaactttttttcaaaggccagaggattactttgcaagtgtgtagaaagatctgtctatttctgttcacctgggacctggtggtgactgaactctttcagcaagggcaatggctcaatgtgattcggtgctggagctcagctgggactcagtaaa

SEQ ID NO: 136417 - DNA, 1954 bp, Homo sapiens
attttgccagaaaaaaattgtaatagtcggcacgctggatttgtagggccagcaaaattgcggcagtgaaactagtttcacttctaaagcccttcatttcccacaaggttaagctctcgaaaccccatttgatccttggttcctatttcgatcctcctttggaatctgaaaatcggtctccatgttgtatgcagattagaagttgccttgtttgttactcttccaacacagggtatcagggagaaagaggccttatctgttcctccatcccccctgttttgacagactgctaagaattcctcaggacttcctttggttggggattttactttcccaaaagtctgatctgatttctttcaggggtagacaagcttgtcctagtgctctgcttcaggtcttatcagaagaaacccaggaatagaaaaggtagatgccttgacttttgtccctgttgtggggactaaagtgttttttgccagaattgtcaaaagctccggttcaaactctgtagagtttcatggaaaaacaaaacaaaacaaaaaagatgcttatcgtcccggagaatgtgtaagtaagttctccagcacggcttaggttttccaaaatggaaagcaaagcttgcagacaacctgttttctctagagacacacaatgattctggccctcagtctgtttccctccccttgtttactctttggtcaccgatcgagtcaggctagaggggtaatacggtgattaaaagaagtaaattctcactgtaaacttggattgattaacagaaacaattaaaccaaacaaaatcattgccccaaatttctatctccaagaattgctttgtgccattttgaattcaggtagttattctgtatatacttagctaactattcagagcttcttcaatctctagtaagcttgaaggtggtgtctgggaagacacagggcagggtgacatttagactctgttcattcttaaaaatagggataagccagaatgatgtgacatctagtatgtggtagatgaagaatcagtggaaattcttaattgcacagactttataatccattatataaagtgtaattccatactttttactgtggcaagggtgtgatgtgattgttaatctttttaatttttgaatccaaactgaatttaaagtgttgaatacttaaatcctcacaagtgaattatgaaccatttgtaaagtgtttctataactctttgtatcatgtgttggtacatcttatcaagttttttctggcatgtaattccattctaaacttatgtaaaatttctattgttgctgtaaatattacacaaatatctattccgtgataaccttcattatcagcatgaaatggttaatttttactgagcacaatgtatttttgaatggatcttcccaaatgtctttaataaaatgcagattttgcactgactgatgtgactgccaggccgtcccaatcttgagcactgtggtccttcgtgtttgaactgcgaacagctccattttagttccttcttgggaagaaagaatgcattcgaattcaaatgagggatgatgggcctttgaggttgtaatcagtttgagacagaaattaatgtaaaactaggcaaatcctgtaacttaatgatgttgatctttgttttcctatttataaagcttttttccccttacggcattttgaaaactttggtttgttttatacttgagtgttgtcacctttgcacgtcgctagacactcacgtggtagtttgaggaggatgggaagagaggccaatcttgtgctaagtgctatggagaaagcaaagatgcacagcttaataagggttttttgattctagaggagaggtgggcaagcttttcctgtaaagggccagatggtaaatattgggggctctgtggcccatcagttccctgtcaacattactcagctctgcctttgtattgcagag

SEQ ID NO: 136418 - DNA, 1081 bp, Homo sapiens
actgcaaccacgtgcttggagccgggagcaggtttctccctttaggagatttgcagggtggggtctgtagcactggtaggcagtgggagactgacactttgagccacacccggggctgtgtagtcagggtccccacaaccagagcgccagcaccctcatcactcagtgcacacgttcaggatgcagcaagttccaatgttgtcacctcatttggaacctcaccacaatctttggaggccagctgggggcaggggggcgggggttgtggacgaggtgcccctgctgcggatcctctgagagctttgtaatgaagagtgatttcacccactcagacccaacatgtaagtggccccggggatccccaacgtttttcctgcagggatctttttatcaccccactttccctgctttgaacgagtttttctccaaagctgcaagtgataagtaaattaatttgttctcctataatttattaattggcaatgaacataatggccaaatgaagtttctgttcagcatgggagaaagggtgctcccaagccaaggagctgggattcctgccaagagcaaagaaatgtgacattttccttggcccgagatatcttattaggagctccaagtacattctccggaaggctttctaaaatgacaacaccagataggctcctgttaggatggctgtcctccccacaggcccagggaccccaggaagggagtcatcaggggctgcgatcccgctatggcagtccagcccctctaggtcaatgactgggtaagggcctgtattagtctgttctcacactgctaataaagaactagctaagactgggtaatttataaaggaaagaggtttaatggactcacagttccacgtggctggggaggcctcacaatcatggcagaagatgaaggaagagcagaggcatattacacggtggcaggcaagagtgcgtgtgcaggagaacgccccctttatcaaaccaccagatctcgtgagacttattcactatcacgagaacagcacaggaaagactagcccccatgattcaattacctccccctgggtccctcccacaacaca

SEQ ID NO: 136419 - DNA, 1764 bp, Homo sapiens
aagcccctaggctcccgtggtgagtgttccctgcgctggcctagcagggtgttggtgtcttgagcccgaatcctgtgcagcattggcccaacccttgcaggtggccgccacccctttcccctgcagctggcatagccaaggtgccaggctctgcaaagggtaagctgcatctgaattgggcacgaggggatggttgtgccttccacatctccttttgtgaaagatcttcccagatgcaaacccaggatggacttgccaaagagaaatcccagtaactggctctaatctctgtgccaccagctgccattgtctcgaagttcatttgcaaacaacagaaaccaactgtggctgggttaagtgggaagtttattaaacaatattggataggtcacatggtcaccaggctaagcggctccctagccaggaccaagatcccatgtcattctccagtactcccaggttcataccccaggacttacaccacagacacccccaatgctgggcactgtcactgggaccactgcctctgctcttttggaaactaaatgtagaggcttctacttgtcaccaaaagggattttaaacagccactagctgccacttcaaggtctcaggcaagcatactgcctcggctgagggagaggttagaaaaaacagcatccagccaggcgtagtggcttgtgcctgtaatcctggcgctttgggaggcctaggcaggaggtctcgagcccaggagctagagaccagcctaggcaacaatgtgaaaccctccctacaaaaaataaaatcagcaaggcacagtggtatacacctgttttcccagctactcaagaggctgaggtgggaggatcacttaagcctgggaagtcaaggctgcagtgaaccgtgattgcaccactgcactccagcctgggtgacagaacaagaccctgtctcaaagaaaagaaaaaagccgcatcttgagaattctgccttccaaagtggaggtccccacttcataacatggggatcccctgaacacaggaaggaggttcaaatgccaaacatctgaaactcagtgtccgctccagctggaatgcttgcttttctttcctctgcccataaaagaaggacctgtgccctcgccagggtctgccctggagagctgacgcaagaggcacatttgcccctgaggaaggctgtgtgtcaggagtgaagaggggcgtgcaggcaacccctcctcaccccaggtgcatggaagccatcctggtacccacctctgggatggaggtaggacaattaattacatgttctgtctttgggtagaaatgctactgagccataggggctggatcaccactgctgcccagtatggcccaccagaccaccttccaccatcctgcaaagccctgcagaattgccagtgcgccctgcagtttttgtgaccaccagcccagtcccattcgattttcatagcccttgagtgacagcccatctgggacaagactcaaatgattgtcacatcttttcttctaactctttagccagctgggggatttaaaaataatgaattggaaccgttcgtggtataagcctctctcttgacagtgtgaataatttcctccagctgtcaccagggatcgtttgagttcctgtaagtactggagtctctcctgggctcaagagaggcacagccatctaggccaggcggccctctctgcctctccccaacctcccctccttctggaagtgcaggcaacagctccctgctcccctttccctcat

SEQ ID NO: 136420 - DNA, 1045 bp, Homo sapiens
aagccacaggaatctgccacttcttttatgacagcgctccgagtggggcttatgggacgatgacctacctaacaagagcagtggcttcttatttgcaggaattgttgcccaattcgggctgccagatgcaatagggtctcacctggaaacatgatcacactctcaatctgtcacgtgccccctagccttactgggaaccttctgtcccccaagatcccctgtgctatcaggaaagcatgtcccatcagaaacactctcggggggcaatggtagcactcaccctgaaactgatgtatgttaaagccacagagatagagctgaggagtcctgtgttcccccgcaaggagcaccccgggatcattttctaggttcatttctctggaacatttgctgtagcatctggtctcacggactctgaggaggaattggaaattggtctcttttgagtgcagagggaactgagacgccagcttaaattggctcttgcagagagttacagaaatagtttcgatgagctagtgacacatcctaaagatgcaaagatcctcctggcggcagtagccttgacaagggccacctcttcacaggatgcagtctgtctgtgcaccaaactcttcaccaaatagaacacttgtgtctctctgtggaatgggggttttcttgtgccttgcttgctttcatagccttccattttattggcatggctgccttgatgtaacataattctctgtccccaagatttagaaaattcctcttcgttcaccttggctcatggtcttccagggtttttatcctggctgtctatgaactagggttttctcctgccttaggaaaaatactgcatcttctggaatctagaaaaaaaaaaaaaaaaagacaaggctcctcttatagccaggcaagcagttgtttagggctagacctgttgtccccgctcgcgtggggtgaacgccccgcagtggatactgtcctcctgtgctctgggcgaggcgtcatagggtgagcacaagtcagcagtgccatggaagtgaacaggcatgtcccc

SEQ ID NO: 136421 - DNA, 2287 bp, Homo sapiens
cttgctcaaggttctttctgtaacaggggcccctgtgcttcatgggccccaaggtattcctcacggccaccgcagagggatgtgaggaggtcggagcaggccctgcccgagcagctggactcctgggacccaggcaggatcctgcaggggctcatggtgcttgctccacttcccgcctctcttaagggggtgggagtgtccactgctgttctgccctcagcccactggggacgctccaggccggggtgctgggatttagaaggtggccagttagactagaacaagctgttcctagaaaatttccccactcttcctggggcatcacatgcttccgctcggactcactggcgcaataccaagatatttctattatgaaaaagcattttgtgttgagctggcactcgatatttatatacatgggtgtgcatgtgcatgtctgtgcatgtgctggaggcttttgtgattggtgcttattatagaaatctcaaaaatagatgcctgcaaaggcacagaagcatcccttccccagcaggagccatgaaaatccccctttattatggcaccaaaggggcctcgcagccgcccgggcccagttgccaagtacaatgcggagcctcccgggaggactcggcagccccctagggcattgttcgggggagatctgaaagatgcctgctgggttccctagaattgttccatcgaaaacacagcctgtgggcagtgagaacaagctctctaaaaataactctgacagtctggcgtgtcccagccctcatatgggtttccagggcagagggtgctgtgtgtgcatgcacgcctgtgtgtgcatgcatgtgcttatcccattctggaatctgactgaaatgcgctctattctgcctccagtgccacggtctctccatcgatggttatgtcctcccatcctcgacgacccgagaggtacgatgagaaaaacgcagaggcgggcccctctgtgggttcacaataagggcttcattgcatggactctgacctcttgtgctccttttgggctcattctaattgacaggccatttgtagctctgagctgtctagccccttcaccctcatatttggcaaaaatgtctttccagcatttattggcatcagcctttttcttcacctgagactcagcatttctgggctagcaagctctttgcatttgccagacaccccttagaaccctggtgaaagaaaggagccaatctccatgccaccctggcctgccccatgggcagccttctcggcccttttctccaactaaaaacagtaatcgtccctaggtgatttgtcattctttttaacatggatttttttttagttttaccccacccaaagcaccatgcttcatgctggaaggaataatgaagaggaaagagaaaccagaaatggtccctgctccctggaagctgtagtcgatggggggaagggtagataaatcaggcgaggacaggctggctcctggaggcatactccagcctcctgctctgagggccactgccagcaggatccagggagtggccagaaaaggggcagcagtggcgctgagccccgagcccaggcactgctacggtcacccttggttactcggtgattgattgatagggctgcatctgtcctctcactggtggttgcctgcctgtccctttggtagatgaccccgcatgagatcaagtttgctgtccatgtcgaatcggtgctgaaccgcgtgccgcagcccgagtaccggcagctgctggtggaagccatcatggtgctgacgctgctctcggacacggagatgaccagcatcgggggcatcatccacgtggaccagatcgtgcagatggccagtcagctgttcttgcaggaccaggtgggggtgccagggagctgggttggctggcatttatctctgttgaggctggagattctgtgtccaataggaaagaatatactcgaaccaagaaaatgtcatcacagatgatggggaaaaaatgtcaaccacttgcttagaaaatggtacagtggccacttgggaaatctcaagacctttggggatggataggcctgtctcaatgcaggttttcgtccaaacaccaccacttgcaacacatgtgaccatgggtgaaccccttaccctgtacacaaagtcaagttcaacagagtagtcctcattatagtcaggagctacaaactagggtgcgtgataacagagtgcagtgcccagagaggtagggcattccccctggcagcgctggcttcgtgccctcatgccctcagaattgga

SEQ ID NO: 136422 - DNA, 1034 bp, Homo sapiens
gagcggcagggccagtggctgcgcaggagaaggctggatggggccatcaacagggtccccgtgggattctaccagagggtgtggaagatcctccagaaggtaagccgagacgcgagctcctggggaagtgaaccgtccccttactgtcctggcaaggcatggtggcacctccaggcgagcaaacacacagccctgaggatggcttctctgcctcagcgctgttggcacctggggccgaggcattctctgctagggggcctgtgcgtggtaggatgtctacagcatccctggcctctacccgccagatgccagcagccatctcttctccccaccccacccccgtgtgacaactaaaagtgtctccaggcattatcaaacatcccgtgggaggcagatcaacccagttgagaaccacagcaagtaagacaaggtggcagtctaggttgtggttgtgtgggaccaacttggacgtattttaggaacatagaagaacagggaaaggctgggaggcttcagatgaaaaccctgtaaaaccacccagagcagcacctacaggcctggaacctggaatgacagttcaggaggggcctggagtaggccagccccccagcctcccgcacatccaggcaggagtagtgtccctgctgttcagcgatgtgactgagccccaccctcccagggtacctgccgtgttcagtcccaaggtgtacagaggtggagagcttccagtttagccccaggtcctgtgtgccctgaaggcacaatctccctcacaccctggggccccactcccctcagccagccggctgttgcgcttcccatctgcctggggccgttcacgtctccccagctgttgtccctgggaactgtggtgcctgtacctgagcacaggagcacctccctgagcgcctgttgtcaaggaggggggcagcattctctgtacccccccagtgtctcccttctgcatcagcccgagagagtttatgcagctccctgggctgcaccaggccctccctgtcttttcccttgaatgg

SEQ ID NO: 136423 - DNA, 1105 bp, Homo sapiens
ttctcaccaattcccagagcttctggaaacttcggggcattagttccatgcctctttatggagccaggatggtgagcccttgcccacatgtgccaactagcactctgcacctgccatgccccagatctcgtgcagggctcggattgagctcaccgcagagcagaggctgaatcttcctcctgaaactggagggcccggatcagctgagtcattgaggagtgcagctgtaattacttttatttgtgtctaattgttgccttaagtggcagtaatgagcccaatggaataacccagccgaactgccttttcaaaataagatctgttgaaatccaactgctgcagaaaggagagctccacctcctgccctgctagcacacttcaggatttcactttaaccctttacatttgactgtgcacatttgatgtgtggcactatcgagaaacaaaagtgccagatagtcccaggcaaagagatgtgtgagagtgaaggttatcccttctcgacctggaggtctcgaagctagaagccccgcagggcaagacagaaggctgggagctttgccgcagggaggggatgcgcccccactcacagaggcccgccccgccagcggtggggagcctctcagacagtgtccccctctggagcctgaatcagtccagccaatgttgaggtgggaaggagatggcgccctcttccctcacttcagcaaagtcagccccagttcagaggcagccattgccccaaattaagataaagcccagtgccaagaatagggaaagccggaaatgggattgcaaagggtgggtggatggaccctgatctgcgaggtcctcgccactaaacgcgggcttcactgtttgtcttcccccgtgtcatgtattgccttctctgtggttcctgtcctgtggaaacgtgtctgtcacttctctgtggcactgcagcaatgaagtgggcactatggagtttgtctccctgagccatggatgcctgctccgagggcccgttgtcaccctcaaagctctcccactgcagtggcacaggcgccacgtgcgggtgacagctgcccctcatgggcacttagcgcacactaggtatgcctcaggg

SEQ ID NO: 136424 - DNA, 1316 bp, Homo sapiens
gcaaaatccagagctgctttctaagacactcgagttcagtgtcatgatggtaagatgatggcatttattagatgtgaataatggggaaacgggtaacttaggaattgaatatggttattaactcttaccatcggtatcttcggactcatccctgtctcactcaatagcagggagtccaatgtgtttgctagtggatgggcattaaacgcccactgacgggcccttcggagccaggcttggggccacacattggagacagagaccacagacacccatccctgtctgggttgcttagtctggggtctaggtatgaatttttcagatcaagggcaacatgggtcactaagtttgtaaaggtaaatgtacgatctgattggcagtgtctcctccccactgcctgtctgtcgtctttgccagtatctctctcgcgctctgcctctcacccttccccttaactgcgcaggcctgcacagacctgctttcgcaccagaagcagctcaccgtgggcctgccgcccgagccccgggagaagatcatctctgcgtaagtcctcagccttggggacctcaggtttgcgggggagccatggggaaaacagcgcttcccagtgttcggaggaggggctttttaaagacactctgtcacatggatgcgtctagcacagaaaataagggtgttccatggagggcgaggaggcactgtctcaagacacctcatcacattcgtgacacaatgctcctttctaggccccttcccccagaggagctcacaaaactcatctacgaggccagtgggcaggacatcagcattgccgtcctcacgcaggtctggggctggtgtgggaggggtcgggccacagccttcctcagagtggaggggacccttcagccactcaccctgtctctgaaaccctatctccgtgtgtgtctgcctcaggagattgtggtttacctggccatgtatgtcagggcgcagcccagcctctttgtggagatgctgagactccggattggactgatcattcaggtgatggccacggagctggcacggagcctgaactgctcaggtgagatgcccgcagctcctgcagctcccgccgcaccccaccccaaccacccggccacggcctccactctcaggggaagaactgcttaggttatctcgaacccagcatccaagcctgtggcaagctcaggccttaccagcttctctcatttagatggaactcccatccatgcggcatagagctgaagttcataagtcagggagaatggggctctggtgatgtttaccattatagcctcaaaggcgatgtg

SEQ ID NO: 136425 - DNA, 1782 bp, Homo sapiens
ccaatgttttcaactcaaaattgtcaatataccaatctggcatatttggggatagcacatccttcacaccttcagctcaatgaatgatcaccaagccagtatacctggatcaatgaccaccttctgtgcccccctcccatctctttctccttttctggtccagagataactgctgtcatgattcctaacaccagaggttagttctactggtctgtgaaccttccataaataaaactcacatatattttaacctattcagtccagtctcttgcaaatgttgaccagcacagtgattcactgatcaaaaatagtaaaagcctataaataaagaggtacaaaaagtcattgaaaactggagcacagcacagcaatagagttccaagaccagattggtgtttcacttcttgatcttccgaaagttccatgcctagcccatctccctgctttctggctcttgtatgaacaggttcctgaaagtgactttcagtggcccagagatgaccatggtgacgtggactgtgagaagctggttgagcagctaaaagattgttcgaacctacaggaccaagcagacattctgtacattctttatgtcataaagtaagtgtctgagtccattcgggcagttataacaaaataccatgaacagattggcttaggaacaacagaaatgaatttctcacagttccggaggctgggaagttgaaactcaaggccgatttgatgtctgggaaggcctgttttctcatagatggcatcttctcattgcatcctgacatggtggaaggggcgagtgagctctctggcattgtttttataagggcactcatttccttcaggagggctctgccctctgacctgatgacctcccaaagtccccacctcctaatgtcatcattgtgggggttaagatttcaacataggaattgggggaaaacagacattcaagccgtagcagtaagtttatggtctttactaggctaagctttctcagttctccttaattttttccgtagtattcttggccttctagccagcccaggtcatgattatattcaccccagttacccaggatcaccaggaatgagacttccatccccttctctgcctactgatgctggtcccccagcatgagaaggctatgtgaggccaggaggccaccacgtcctgatgttaggcttctgtttcaaaggacatagggaagctttggtcgggcgtaaccctctcagtgagactcaggggcactgggagagcccaagtgctgtgcaaaatgcacagtgatccattcctctcccagtctaaactttctggaccatatttctgggtttttctacctcttggcaggggtcccagctgggacacaaatctctctggacagcacggggtcaccgttcaaaaccttcttggtgagctctatgggaaagccggcttgaaccaggagtggggtctgattcgctacatctcaggccttctcaggaagaaagtggaggtcctggctgaggtcagtgcgactgtgcaggctgcccatgtgtgctcactagctcgtgcccccttcctcttccacttccaatctcccagttatacctcttacttgtgaaggagccccattctttaacccacaggtggagcgggcccttctctcctgcctgcctgctgctccaggaaggcgagcagagggaaggaaatgcaagtggattggttttgttctttcttggctacggaaaaagtctcgccaggaaatcaaatgaaagtgctctgtggcctggcagcctcttagagctc

SEQ ID NO: 136426 - DNA, 1071 bp, Homo sapiens
tacagtggcgcgatctcggctcactgcaacctccacctcccaggttcaagcagttctgtctcagcctctcaagtacctgggattacagatgcctgccaccacaccctgctaatttttgtatttttagtagagaggggtttcaccatgttggccagggtggtctcaaactcctgagctcaggtgatccacctgccttggcctcccaaagtgctgggattgcaagcataaaccatggtgcccagcctatttctgagggttttttaaaagctgaactcaccctacatacccactggatccacttggggggggtgctcaattaaagaaaggcttttctttccctcgggctgtcattctggttatagcccttttgaggctgaagctctggcacctctgatactattgcattacatatgcctcaattgactctttaaacgtttctcagccttttcaactaaatcccaatctggtgctgataactctgagggagggatccattgctttctgctcccccggtgtaaccttttaagaatgttttcttctgtatgtgcaaatcgctcccagcgtgtggggttggacctgcagaacctcaggccccaggctgccaaacccagcgtccaggtttcagtggaactgtgcccagcctaaggtgatagggccactcagggcttctgctccagtctggggatggcttccccattgaattccttctagagggaacctgacctcttccatcatagcacccctgtccctgtgtgacagtgtttcgtggtagggactcataaataatggaacgagtgtgcccagagaatcactgcttctgggccagtcgttttgggggaaaaaacaaaacaaaaacatgggttggttctgtttaaaagtagtttgcgcaatatattttgtcaaactgttggttggttcagtaaaatagagtcgtatttgtgttgggttgggagtaagaagtcagtgtgattcatttggcttttaatatgctgtgcgcgttcacttcatacttgctattgaatttttgtttgaatgtcttggctgaccgcttatatggggcaatctgcagag

SEQ ID NO: 136427 - DNA, 1384 bp, Homo sapiens
accagttaaaccaagtagaaaatcaaaggaaggagtttccgtgagaagtagaatgtgccattgccggaagcattcagttttttgcatttatatcagcccatcttgttcactgggccccttgaggtggctgcttgctccaggtgggctcaccaagccccaccagcctggacccttagccctgagctccggaatgttgatggcccctcatcccaacatgaaccgacagcccacatcatccaagctctctcaggactgattttgttccagggttaagggccagactttggagaggaactagtcttccctcactctgcagatcagtctacggagcctgctagggctgtgttccttctaagtgtcctcagcctagatcccctgcaaataaatgtattccttttagtacgcgtgctgcggtatgtgggttggggcagggctggcagtgggggctgggttaccttccagcagctacatgttcatatcccgcttcaggtcgctcctttcccagtactgaggcattcgggaaaaccgaattggtaatgagaggtaatttggaacctggaagcagagcaagggaaaataagtgccttcaggggtattttacttattctatggtagagaagagccgtccagttctactagagggcacgttttactgactatagtaaatgccaggtgttaagagctacgcttttctttctttctgatgaacagtgctgactacacattgtaaaaaattactctgtgactttctgtcttctaaactccacactgacctttgggtttctgcttgtcattacaatgtcctcagcatgtttacactggtgtgctaggcactgattttgcacactctttgacactgattgcattttgtgttggctccttccagatgacagctgggaaggtttatcagtcacatcaataacatgtagagaccaccaggaaggatttctgcacacagggccaccacaggcccatgtggcacctgtgtgcaaattagataaaaggcctcatcagggtagccgcagccctgggccagggtggcatgcagcttggatgtgagccccactcatttcctcagccagatgtgcttgtgcagggcaccataaggccctctgtggacagctggagaccaatgaaagtgtccccgcaaacatggattgagcagccactccgtgccaggcaccaggctagctactggggcacaagggtggctacagcgccagctctgtccctgtgagcttgcaggttagcaggggccagacgagctggtccatgagatggagggcagtggcagcagcaaaagcatagcacctttgaggacctgtgggcagttcagaaggaccggtgtgcagagaggcagagggggatgcctccatgcggggca

SEQ ID NO: 136428 - DNA, 1040 bp, Homo sapiens
tactacagcctgggtgacagagtgagaccctgtctcaaaaaaataaaaatttctttaaaattttaaaaataaataaaaccagcttgtagacaaggagaactggttctgtggctcacacatttttcttaaagaccgactgtggcctcctcctcgggtttctttgccacactgactaatataatgatataaatcagatcctctgccaaacttggtggtagacatattgctatttctttgttagagttataggaagctttagtataataaactaccaaggagtcttgtgtatgtttctgacttactttctgaaatattaccatggcaaactgccaaaaacagcatctcattatagtaaaatcctactcatgccaacttcaaagctgtaaaaatcagtcaagcatgggaaaccccatgaggcacaatggtattatgtatgtattctgacatcaccttttaaaagtttgacttatttgattctaggaccctaatcgactgcattatgaccctgctgaactcaagctcttcgaaaacattgaatgtgagtggcctgtgttttggacatattttataatagatggagtcttcagtggtgatgctgttcaggtgagaaaatgctgggtgttacgttgataattattttcattccactggtatactgattattattagaacatagggttatgcaagaatttaggtcactgtttcggttatctgttcccacttagcaaactttcccaaaactgagtgaattaaagcaacacctattttatttatttgctcatgattctgcaatttgggcagagcccagcagggacaggttgtctctgctttacctgctgtcagctgggatggttccatggaagtggagaatctatttccaagatggcctcactcacatggccaattgatgctggctagcagctgatgctgggaactcagctgtgctattggtgggggccttggttctcctccacatggctagcttgggcttctcacaatattgtagtctctgggccattaattttacatgttggttgttt

SEQ ID NO: 136429 - DNA, 1111 bp, Homo sapiens
actttacacacaatttcaatggacttgccaatcccaaagttaccttcaggttaaaataatccctgttttgaggtgaaatgcagtaaccgtgatacactaaactgagaatattaaatactccagccagttgaaactatcggtaaaattatcaaagaatgtaagtttccctaagctgaaatctgcagattgattgtcctacttaggttccatgaaaaatgcttttgtcccttggagtccctatgtctccaatcatattcccaaaagaaagcagctgtctcagtcagggttcagtgggaaaaagggaacccctttaggtagttgaagtaggaagggaatgaatacagagaatgaagtgtttacaagaagagcgggttctaggctcagcctcctgggatgactcccaggacagtgcggtgctggtcgctagggctagggacgtggttgcctccatgaccctcgcgagagccacatctgctgtagcagcctccacatacttacggaactggagaatggacacccaaagctgtgatctatggattaagggcgtcagattaagagagtgctgcccctgccctcctttcgtagcatccaggaagctggggcagaaccctggagcctgcagcccaaaaccagcagcgacagtcctaagcacaggaagctgccccctccctttctgctaatctttgtggaggtgcatctgaccttagagcctcctctgcagccaaagcctaacttccaggagcctggggaatgtccttgcagctttccaatcttgcaagtaggagcaaaccaatccaagtatctgccttggtggcttttctaaatagtgagggtccttttaggtctctgtgtaatacagtaaatcagaatgaaggcatggtcgttcactgaactcttggtaataactcttgcagccctgatactctgatggaatgttttggcgttcccttccaagtaccgatcaaacctgaattgattttgcttattacttaaatatattaataactatactgacagcaaagaacacttggtataaaattcattactaaaagattcatgggaaagagggtgcagggctgacttgaattaaaaaggcaaaaaaatttctctg

SEQ ID NO: 136430 - DNA, 1046 bp, Homo sapiens
ttgtttaaaacagcatcccatatgtggattttttaatgaaaatatgaattatacattaggtacacatgtatcaagtcctctgggtgccagcattgtgagccaatccctagtaatcggtttgtaaataccacgtaggttcagtgttctgtgtctcagttgtgactttggctccagttacttgctgagcattttttccccaagaggtaatgctaaaaataagtactaaattattttaaatgcttttgctggctttgactagttatgacccatgtgctaaagtttctgtcttccattttacaacataatataagttcaaaggcattgactagagaggcagcattttattcaatcttaagaagataaaatattttgttctccatacatccagagtttcttacaaatgaataccttctagaaataagaaataagaaatttgagagtgttgtggcatgcacttttgtcccacttgaatattttcttctaaaattctgcacagaggtcgcatgaactgaaattgaggaagagcacagtatgagtctacaaagcctccgagaagatccacttatgtttcagtgtggctgcaggaacataaaggaagcatttttcccatagcacttcttatatacctctttctcccctctgattcccacctttttctcccccaggattatggaatgtgggagcgtggagataagactaatcagggcatcccggaattgaatgcaagctccgtaggaatggccaaggtgacagttgtcctgtttgttcttccttctgcatgtttttactgctttgatttggttcccttcatcaggagtttgtatttaatctgattagcatatttgtcaaaagtcagcatcaaggatgtgaaattcaagtggcacagttaccccagccacctgaaattctaggtaaagaaggtaggtttccaatgctgaaatctgcccatggcagaaagtaagagtgctccgtcctggttagctgctgccatcacccatgggtctaagctcttgctgttgtttaagaagctgcacgtgtgatgtcca

SEQ ID NO: 136431 - DNA, 1110 bp, Homo sapiens
attccttccttcttttattttgctactataactaatgttgcaataccaactttgaccccatcttcatttacttccttctgagagttagatatcactcaaaggcaactcatatatattgccaaattgttttcagtttctagttaaacttagttctgattgaaattctaatctggcttactagttaagctgccctcattgatgtaagagtccatttcctatcatatccatagcagcttccagaattcatactttaaaaatacctgtatttgttataactgactatatttttctgcagggtggaaggccagctcctggagctggggactccctgtctcccactgggaaaagtattcacccttctctttggctctctcaaagatagagacagtgtctctggttcttctggactaaaatccttgctctgttggaaccttccccgcatcaatccaacctgtaccagaggtcccaaatctctctcatccctttctactcataggcacacacaggaaagtggagcccttcctttccttctccttattttccttccttccctccttccttccctcttttcggagattagacactcactgttatgccttacttaagacttcatttttgatgcctttggaagaaaaatgaaaatgagggtaaaagggtttatttcctagtgtgatatttgtaatttgtgactggcagctctctgcaacatggcttcataacctcattgtttttctttgctaggcttacgtatcattttcactctcgatgaggtggccttcatacagaatcttgtcttttacatagaagctgcatataaagtcgctgtaagtatcaaccctggtagtcttttcagatgttccagtcaacaaaaagaataaaaatcatacagtgttttgagggccaggctgtttggggctcaccaaaaggttagcgagactagcgctatgagattgtgtcacctccacacacaaactgcatatttttgtcctggaatagagttgggggtttcaggtttttggaatgtactctgtgctctgtctgaatccattatgcttgttatatttttttatttattttgtttatttatttatttttaaacagagtctcgct

SEQ ID NO: 136432 - DNA, 1035 bp, Homo sapiens
ggccgtgatctctgccagccatgaacccccataactatgcagagcgggcttgccttctccctcaggtggccaaagtggagaagttcaaacacactcagagcaccaaggacagcctgcacgccaagtacaacaccgccacctgtggcacggtggtgggcgacgaccagtggggccacctccaggtggatgccacctctctcttcctcctgttcctggcccagatgaccgcctcaggtgagctggggttgctggagcccattgtataaggagtgacaatccggaaaaggggtgggaggaggacaggtagcggccagtgtgtcaggccatgtgctgcttcactgctttaataaaatacctcagacaaggccatttatacagaaccgaaatgctttttctcgcagttctggaggctgggaagtccatgaccaaggcactaccaggctcagttgtccagtaagggctccatcctccaaagaggaggactgctgtgccctcccatgggggagaccagaagggcaagagagccagaggctccacgaagtgtgttttgtaagagccttcatcccatgtaggatatgtaggatgggaggagtcctcagggcctaatcgcctcttatggccccacctcttaataccatcacattggccacacctcaattttggaggggacacattcaaaccgtagcaatcagtattataaatcagcagtttacacaaaagaaaagcatgcttctccatattctgtgcatttgtttctgcaatagggcagggagtgcagggaccctgcctgtaacctgcagagaggacagtcaccctccacctgggcaccagcagggtaaaggccgttgagctggctctcttagcttccctctgttgaacacagaacccctttactgtcactctctcctagttcctggagccacctaggtctggtctaactttgacacttagctgtctgcagaccatctcacccctgctcttagacttttctcctccaggatcagcagccctgtcctttcagctctcccactcact

SEQ ID NO: 136433 - DNA, 1043 bp, Homo sapiens
gagggaaagtggcttccctgggcacacacagctagagagcggagtggggccctgcctccaggtttcttgctcacaggttcaatgctttacctattagtgcggacacatgaagactgaagaagacctaaggtctgcaatatgcagctttgtgaaagccttgcagtcttttcctgtttgctgtttcttctgttttaccacttacaacagtgtggtctcgtctgaaagcaaaagaacataagagctggaatgtttctgagagattttctagtcacatatcctcattatacaagtgaggaaactaaggtgctgagaaggcatgtgatgtctcacccaagatcacactgttaggggcagagcaaggactggaactttggtctccctgctccaggtcccggtcctcatctaccctgttaggacaagcatctgttacccagggactgcatgaaggatggcactgagccattttgtgtctcttctctaatagaatcccgtcacggggctgctgtcagccagccatgagcagaaggatgcctgggtgcgggataacatctacagtatcctggccgtgtggggcctgggcatggcctaccgtaagaatgcagaccgcgatgaggacaaggccaaggcctacgagctggagcaggtaatagtgactgacagctgtatctcggctgctcagccaccttctccttgaactgaaaaacccacagagaagtagctgtgtgtgcagaactgtttgggtgtaggcctctcctctatttctgctatagaatattttggggaggtacttagattatctcaacctcacattggtctttctgtttgagtttggagattcccacataaaacaatgacaacatccaaaatcacaccaaatagaaaatgaaagcaaccacatttcttttttttttgagatggagtctcactctgtcacccaggctggggtgcagtggcgcgatctcagctcactgcaacctccgcctcccggtttcaagtgattgtcctgcctcagcctcccgagtagctgggattacaggcgactg

SEQ ID NO: 136434 - DNA, 1418 bp, Homo sapiens
ccctgcttgcttggagaatcatcatctttgtattgccaccagtcaagaagattgtttaagtgttgtttctcaagctgatgtgatgaagactttagttttttgtttttcattttacaatacaaaattataatgttgaatctgtgtttttaaattacacacacaccaccctagggagtcatgtatcctgtattctctggtcagcttccaccactgcaccctgactcccactgaaattcactaccctaacttctgcctccttaaacttcacctccgtcctgtgacattactgttctctatttgacccatctcagctctgagttgagcaatgagccatttcctgtacttgaagcagctccccggttttgtccacttttctacttttaaagcaaaaatgaggctttagcttctgcttgagtcattctcaaggttcatgttgtgtatatctgatttatttcttttgagtttcctaaagaaaggctgaacagaaggacatgcataataataaaatgagctttttttttttttttttttttgagatggagtcttgcgctgttacccgggctggagtgcagtgtggcaccgtctcagctcactgcaacctccgcctcccgggttcaagtgattatcctgcctcagcctcctgagtagctgggattacaggcacgcaccaccatgcctggctaatttttgcatttttagtagagacagggtttcaccatgttggtcaggctgttcgcaaactcctgacctcatgatccacccgcctcggcctcccaaagtgctgggattataggcgtgagccactgcacccagccaaaatgagcattcttaagtggtaaatttacttgtattagctatgtataatacaaatatatatagacagagaatgtctatacttttaaatacctttgaaaagatatttcagactgtaaatcagtaaaaatatagtgatttattatatattcatttatttatttattaggtacctaactaggccaggaccttgcgctagagtggtaaacaaaaaagataggctttgcctttaggaatcttgtagtatgaaaaccatgtttcagattgtgccagaaagacatcccatgtccatggatcagaagactcaatatggttgagatggtagtattcttcaaactggtctacagctgtggaattgagattgaggttctttttcttgcatgtgtatgtccacttgtcccaacactgttaaaaagactgtcctttcttggattgtctttagatctttgtcaaaaatcagtttgccctattcatgtggatctatttctagactctgttctgttctgtccatctatgtgtttattcctttacctcttgttaggttcatacacgtctaagattgttttatcttcatgatgaactgaccctcatggttcgctgtgtct

SEQ ID NO: 136435 - DNA, 1013 bp, Homo sapiens
atattccactaaacttagttctgccatattgttccttgtcgcttatatttgaatatcactgttaactagtgaaataaataccacacctgtctcacaatgggtagggagaacataattaatgttcataaaatacatctagagaagtggttcttgatcaaatgggttacagatccatttgagaatttgatagaggctgaatatccaatgctctccttagaaaaaacgctcgcacaaaaatttcaggagtctcgtagccttccgtgtccctgtccacaatgtgcaccccccacacacaccccagaaaggcgattcatggactcgtagcggatcctctggaggccccaggttaagagccctattgtagagtgacatgtggtgtcttcatgctccaaacccaaaccccgacctgaaacatttggaataaaagtcacgcttataattgaaaatatcaaataatgacatctgtaatacccctgttcagctgaaagttgactagcgcagcacccagtaatccaccagtacttaatatttcaggtatcggcaagagggaactgacagcccccctgagctgaatgtgttctgtatgtttccacaacaccaggctcaggacttacatctcagtaatcctccctccttactacacgaattagtgagagaggcaaagaattaaagtctcctaggagagtggtaaagtcgtttacacgtttgattgtagctaaagagcccagagcggtttgtgtgagtttcgaaagttttaagatgagcgtggggatctggaacgaagctgcaccaagtggatgcctgcaatgcttggcttctaacccagtttatttccctataggccatcattcatcatgtcagatggtgcaaatacctcggaccaggacagcttgcagcttgtgcattgtttgtaaacccagaggggagaatcgaataagcagcaatttagacaaaaatacattatttgaaagtgagaattgcacacctgtgatccctttaagtaaagcatgagg

SEQ ID NO: 136436 - DNA, 1069 bp, Homo sapiens
agcaaggagcagagacaaagacaaactagtccttaaaatgctgttatggagacaaaatgacaccaaacaagtccactctgtgaattggttatgctgtaaattaatctttgtctaaatggcctttgacaaaccgactgactcctagctgacctccttagacatacccagtatcccaagtgaagctgtttcatcgttttttgtttgtttgttttaaagacaggaggtctttctgtgttgcccaggatggactccaatttcctggctcaagcgatcctcctgcctccgcctcccaagtagctgggactacaggtgcttgcctggcttgcttcaccattttcagtaagaacgatcatgatgctgctcactgaagtcagcagacttcctttgtggggttaatgactgcagtgtgttttgaggaaaaacaaaacaaaacaaaaaaaaactactccaatattttgaggaaatacttctttaaatactggcctctgccctgacactccttgcctcctaatattggcaccacctctgtttccttacaatagagtctcagaacatgggatcaatcttagacccaaaggaggatgcttctcagaaacactctctgtcctgccgtacgtctgtctaaagtaagaaaaatagatgagagaattctgcttaaggaccacagcacagacacagtaggaaaaataagggggtgggacctaaaggatactggacattgtgcatccttttatgtatattttggttatataatctgttttgggggattgatttctgaggtctcacccctctcccaatctagaggatctcacatcttcctttgaatttagtactcggcatctttgtgggagctgaggaccttgaagaagagattgctcagagacctcttaccagggtgaggccagcttcccgtatttggggatcccacatgctaaccagcaatgcagaaatcccaaatcctgttctcacttttcagtagtcctacctgtttgacactgaggaagcagatacttggatgagatctgaattgggtcttgtacattgcctacaggccaaaggcaatgtgttg

SEQ ID NO: 136437 - DNA, 1022 bp, Homo sapiens
cttggctcaggtgatcctcccacctcagcctcctgagtagctgggactgcaggcttgtgccatcaagcacggctaatttttgtattttttgtagagacaggatttcgccacgttgcccaggctggtctcaaactcctgggctcaagtgatctgcctgcctcggcctcccagagtgctaggattacaggcctgagccactgcacctggccaaattctttttaaatcaaagaaaatgtgtacttttaagtttctgatacaagactacacacacaagacatgcttgacaaaggcttgatttcaagtagcggttggcaaactatcaccaatgggccaaatcgggctcactgcctgtttttgtgaataaagttttattggaacactaccatgcccctttgcttacatattctctatagctatttttctgctgcgtaaaacacgagtggttgcaacagagaccatatgacccacaaagcttaaatatttactatctgaccctttagaaagttttctcactcatgatttaaggaatgacctgtggccatgtacatagaggagattacagatgagaatgctagcagtaggaaaaacaaaattctcagtatgaatgaacagcaagaagacacgcatcactggaaacggagctgcagctaaaatttagaaaaagatgagatgatcgaatgaaaagtttagtaagtaatacagcaatggtttaaaggacatttacagcataactacccattataaaatctataaattctatatttgcataatatatatgttatagtgagttctatctataagcaagtatatttgcttatagacagaagaagaaatgaaatatttctcttttggtgtgggtaacactgctttggaacaatataaaaatctacagatctggtaatttggggtacctaaatttaatttgctcacaaaatcaaaactcatagctataggtgtcttcgctaaagcatgatgcctgtacatcaataaatcacactagcagaaagcatatcacatgcact

SEQ ID NO: 136438 - DNA, 1014 bp, Homo sapiens
ccctctagggccaggtgtggtggctcacgcctgtaatcccagtactttgggaggcttacttggaggatcagttgagcccaggagttccagaccagcctgggcaacatagtaagaccccgtctctacaaagaaaattaaaaaattagccaggcatggtggtatgtgccagtggccccagctacttgggaggctgaggtattaggatcacttgaacccaggagatcgaggttgcaatgaaccattatcggaccactgcactccagcctgggtgacagagcaagaccctgtctgaaaataataataataataataataattccctttagatttagcatccagtgatgatttttgtatgatctattctttaatatggttgaaaataataattttcgactctagtattccctccacatttggtccagagcccttccttctcccctatttattgattgattcatctatttatttttggtatcaaataattcatattttcaaaataggtctgcaattcattactatacttaattattttagtgcacaaattgtaaaggacttaattatgcattgtttccttctctcttttctgcctaatgaactcctctctccctgttctagatcattcccatcagcttacaatcctgctctaatgtctaatatcttcatcaattccatattctcctccactcattccccacccccatttctagtcactccttctcagaagatcttcttaaaaggatgctcatattttatcacaccacattgtcagtcctcagtatatccacattggcaaatacagccatcacttctttacttaccatgttttacttggcggcagcatttgacagtcattccctccttctttgaccactttcttgttgtggcctccagtatcctacgctctcttggttttcctatctttctggtagctcattctaagtctcctcatcctctcttctacctatgaaggttgatgtccctccaaggcactgggaactgttcttctctttctac

SEQ ID NO: 136439 - DNA, 1049 bp, Homo sapiens
gcagtggcggcagcggcgactcctcacaacccaggaggcacgacgcgggtgcccccaagtctccttcaggtgccccagcagacgccacgcctcagtcgcaccgcggcgtgacagagtcgtaataacgtcatgcgctgcgccgggccgcgggccaaccagaacggcgtccagggggtgccccgcccccgctaaaggcctgaggctgcccattgggtatcagcgccagagagggaggggctgagggctctttccgacgccacgccgcgggcgggtgaggaggcggggcttgatagcgcctgcgtgggaaggtggggcccccgcctccagggcgccgcgggaaaggagccttcctagattccgctctgctgactaccggggaggttgtgcaggccccgtcctaccgagcgcctactcctgccggtgctgcagctctgcagccctcgttcagtacatctcgttcagtacactagatgatgaagattagcagcatgctcagagccaaaagacagaacatctggtttctgtaaatggtctgccactaactttgtctttaaaagatcacgtagcagttggacagttctgccctgtctacttgaacgcggatcaaaaaatttgtttcccaatatatgtcgagaggacaatgggaaaaatcttttttctctagttattggttcacaggctcactgcgagttaacagcgtggctcagccgatgataaaagcacacacagagacaaaacaccaaagcaacaaggggctctattcagaggatcaaagggctcaggaacccattgtgttgtgtcctagtgggattgcacctggggttccgggttcagatttgggctccacattttaagggggataatgagtaaactgagtggaatccaggggacagtggtcagaacggtgaggggctgcgattgtgacttatgaagaacgattaaagaagttaggaagaaaacaggctaactagaattggctgggttatgatgtaacaactgacctccaaatttcagtgatttcaagaatttgaagtgacgcgagccatcgt

SEQ ID NO: 136440 - DNA, 1897 bp, Homo sapiens
tgtactgaacgagatgtactgaacgagggctgcagagctgcagcaccggcaggagtaggcgctcggtaggacggggcctgcacaacctccccggtagtcagcagagcggaatctaggaaggctcctttcccgcggcgccctggaggcgggggccccaccttcccacgcaggcgctatcaagccccgcctcctcacccgcccgcggcgtggcgtcggaaagagccctcagcccctccctctctggcgctgatacccaatgggcagcctcaggcctttagcgggggcggggcaccccctggacgccgttctggttggcccgcggcccggcgcagcgcatgacgttattacgactctgtcacgccgcggtgcgactgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccggtgagacctcccgggcgggccgggatggggcgcgagtggggctgaggcggggccggagggcagggcgggccaggccgggccacccagagcggggtggaaggcgccaggggagccggggagcctttacttcgcctccgcgccctgcattccgttcctggcctcgggagaagcggcacggaccgggatcacgccaaggtccgtgtgaacttcccccttctcgacacccacctcccgcccccgggcccagctgtgcgccaggcgaagtcggtgtgctcaagaggtgcctgttgggttacaggacacggaaagggtggcctcggcctccttcgagtctccaattgaccccactcatttcggatcttctaacttaatttctcttgaccgagaggctttgtaatagcgtagaatctggagacagggtggcttcgttcaaacagcaccctcaccattgactagccctgtgaccttgagcaagtttttaaacgtcccggggacccggtttcctaaaatgtttgctcgaagtggagttaatctctaaatggagataagagttatctctgaaatgttatcagttaactctaaaatggagataataagagtccccacctcttggggttgtcttgaggattcaacgagtgacacgtgtggaaacgattccaaatagcacctggcacataatcgataacatgtgtgttgaatagtgttatttattgagtctccagttcggtatacatttcttgaacacctgtgctcagttctgaggcgggttcacagaaggtcagcctcttcagaaacaaacttcctcctcttccctctccctcaacatctgagcttttcttggcagtgagttcaggagcgccgaagcagaactcagaggacgctgccctcccctccccttacctacacattcttagggtacaagtagctaaagcaaagagcaacgatgcttgaggggtggggggtagagtttagcactatttcatggcctcagcatttagaggtgcctaacacctgagctagcattctgacccccctaggcacagtgaggtcgtgttaattggtgtaactgcaggcctcgggattctggtatttcccccaggacttgataccgctctacttagtacaggcagagattgtcaaaaggtaagaggtatgcccctctaggaatcctgttgcctaaaataatgacaaaactgccgggtgcggtggctcaggcctgtaatcccagcattttgggaggctgaggcaggtggatcacctgaggtcagaagttcgagatcagcctggccaacatggtgaaaccccgtctctactaaaaatacaaaattagccggtcgtggtggcgggctcctgtaatcccagcta

SEQ ID NO: 136441 - DNA, 1019 bp, Homo sapiens
cacacttctgataggacttttagcttctttaactttgttcctttcactcatatcagtggttcttatttttgagatacacagtaatgaagccatgggagaaagtatctaagtagctttctggcagtcctaatctttgcaggcgcaagattacaggcgcatgccacagcactgggccccttcttgctctttattgtatagcattatcctgcctcattgtttcaactctaggattgagaaagaagttaccttttctctgttactgtcgcctggctggtttggactcctgccttccaaaaactgcagtttctgtagttgtatttggaaatttatttcacaatacaataaatttctggccccacaaaatatttattaactgccaagaataacacatctgtttgattgctaaatataaccattgatttgctgtttcaccttctctcagctttacttcttcccaaattcctaaatttccttcactttttctgagatacattagtggactgtctctgcctgtaagttaactgaaacactgattcctagtatttcagttgttttcctccagcactgtcattgtctgtgtttgttggctttgtccaataatggtctattgaggggtgaagatatacgtaattagctttctgcctattggcttgtacactccagggtatacttggcagatcagtcttaactcttctcaccaagatcagtccagtgctggattaggtaaggtatgaacacatcagatgtgctttttatggagaaatcatgttggtttacacgtcagtgtgtgagaatgtggcagaagggagctaaaatagtatgataatactactggataaattttgtggtctaacctaaaccttagccattacatagaatacttttgctgtgagcaggtttgctcagttgtaaaactggaaaggaatcatttctcaccccccgcctccaagctttttacctccaaacagtgacagccacccaaacatcaagagaacagtgtttcagagaacatttctact

SEQ ID NO: 136442 - DNA, 1011 bp, Homo sapiens
tgggcacctgtaatcccagctactcgggagactgagacaggagaaatcacttgaacccgggaagcggaggttgcagtgagccgagatcgcaccactgcactccagcctgggtgataaaagcaaaactccgtctcaaaacaaacaaacaaaagaatggcataaacagacacagctcacagatgatctagtctctttagccactaatttcattatattctcactataatttctttgaaaacaaaggatgggtttgttttttgcccctctttgcgctgcttgccttcagatgcgggataatcctgtttcattggccaaagcatggattcattttggaggccaaggaagatgcaaacacagtgcacagggtggaagagaagcctatgaatatgttggggcttattaaatttccataacttcattctgataactgattattatactttccaaaatagctgacaattaaaaagtactgatttgtttgtatatttttgtcttttaaggcaagcagagtgctggtagcatcccgtaattttgcaaatgatgctacatttgaaattaaggtaagaggtgttttactttgttaataattttttcacaggtacactctgatatacagttttacctttagaatagaacattttgatgttcatgcttagtcatcattttcttctaaatgttccaggatcagaagttcagagaagcttcacgaaaactagaatttattattagcagcttgctgttgttctgtggggggaagggggaggagctagaaaatgaaaataaaaataaaagcttattcaaaagtttggaatgtaattcagtgaaatatttgaataagaagagtcttagttgtttctttgaaggttctttcaacctataactcagttggcttctaggggctttcagtgaaaatcatcttagaaagatttccttcccccaagccccatctcattgcacagtgaggtttatggatttaaggaacagaggcgatatgaagcattactgatgtgc

SEQ ID NO: 136443 - DNA, 1031 bp, Homo sapiens
agtagaacctgtcattaataaccagagaaagtagctattttccaccaaaatacagagtggaaggcccaaaccagaagcaataaactggcaacccacacatgtgccacttccttcctttctcctgtatgatgacctaaaagaaaagcctacatcagatgtcaacattaaaacactggggaatttcacatgaaaatccagacttccgccttctcttagacatggaaaacaggaaacattacccctgatttccacatggcaccaactggctggaaccaagtcatggcattcctctgggtagggcatgctggtgccagttcagcatgagtccctgtcaccattttctgttttgtatacctagccttcttcactcatttattctacctggctggcccttgtaggtatttgactctaacccttgacctaagcccacaaaacaaaaaacaaactaatcctttctctccaaattatatacagtacaggcgatcatagtgccagaaagttttaaaatagtaaaactctaagaacaggtacagaaaactggcaatgttatgtgtgaatgaattctttagcctaagcttcatagcaggttttggcattctactttttaattctaaaatactggcttcagccaggcacagtggctcacgcctgtaatcctagcaccttgggaggccaaggtgggcggaccacttgagcccagaagtttgagactagcctgggcaacatagtgaaaccccgtatctccaaaaaatacaaaaattagctgggtgtgttggtgtgcacctgtggtcccacatactcgggaggctgaggtgggaggattgcttgagcccagtggacagaggctgcagtgagccaagatcacactgtactctaaccagaggctgcagtgagccaagatcaccactgtactctaacctgggcgacagagagagactgtctcaaaaaaataaataaataaaagaaaattacattaccagcctcaaactcttctgatacatatggcagggtaaagcccaataagtacaagc

SEQ ID NO: 136444 - DNA, 1062 bp, Homo sapiens
ctggattttcatgtgaaattccccagtgttttaatgttgacatctgatgtaggcttttcttttaggtcatcatacaggagaaaggaaggaagtggcacatgtgtgggttgccagtttattgcttctggtttgggccttccactctgtattttggtggaaaatagctactttctctggttattaatgacaggttctactagcccacatatttcactgtggtctaggaaacgtttttatttagaaacatgtatcatattgcctcatagtttctccttcctctaacacaggaagcttgctgtgtgggcctggaggccggcatcaaccccacagaccatctcatcacagcctaccgggctcacggctttactttcacccggggcctttccgtccgagaaattctcgcagagcttacaggtttgctgttgatttacagaaaggggaaatgagtggattaagtttttaaatatctgtcattaagatgctattatgagttaatatttgttaaaaattttaagtttctttttttaaccctctctcctttggtgctctggtacttctgttgtgctcttgagttaactgaccatttgtgaagttctctggcccctcaggtaaaagtttaaaacaggttggtgctataaaatcacagtaggtttggttatcattcaagcatgccagaagaagtctagcagtcatagaaagtaagttcggttgaagcactccatggtatgcaatgtaaattctagaaatcttcttaatattccccttttctttgtcccccgtgactatttgtttgttttggtggtttttttttttttttttttttgagactgtgtctcactccgttgtccaggctggtgtgcagtggtgtgatcacggctcactgcaacctccacctcccgggttcaagtgattctcatgcctccacctcctgagtagctgggactacaggcatgcaccaccacacctggctaatttttgtatttttagtagagatggggtttcaacatgttggccaggctggtctccaactcctgacctcaggtgatccacctgccttggcct

SEQ ID NO: 136445 - DNA, 1054 bp, Homo sapiens
tgaactatggttgtccctctatatatccaggggattggttctaggaccctcgagtatacaaaaatcctcaaatactcaagtcccaaagtcagccttccatatcttcgggtttgcatcctgagaatattctattttcaatacatgtgtggctgaaaaaaaatctgtgtataagtgtacctgtgcagttcaaaccctgttcaaggattgaatatatttagtgtactagtataggagaggtcctaagatgtttgtaactggccagaaaacccagaaaagtccagggtatcatctggatggaacatctgaaggaaactaagtgactagagagtaggaaaagctggaaaggttgaagcacatggaactagtgaaaggacaaggagaaacatgtgtttgcctggagggacaggtacttagacgactgaactggcctctgtgttctaatggttgagcctcagagtacatatttggggtgcggtttggtttgctttgtagagttggtttgttctgcacatgtgtatgttctgccatttccaggacgaaaaggaggttgtgctaaagggaaaggaggatcgatgcacatgtatgccaagaacttctacgggggcaatggcatcgtgggagcgcaggtagtcaaggacgaggattgtgtgctgctttagatttggccctggactttgtcttcaaaaactttcacagccccagacaacttttcctgaagtagtacagccatgtgctgcacagtgacgctttggtcaatgtcgcatatatgatgttggacccataagattataatggagctgaaaaattcctgtcgcctagtgatgttgtagtggcacaacacattaccttttctacgtttaggtacacaaatattttgcctacaggattcagtagagtcacatgctgtgcagggttgtagcctaggagcagtaggctctactatacagcctaggtgtgcagtgggctgtaccatctaggttcgtgcattacagtatggtgttcacatgacaaaatcgcctagtgatgcaattctgagaatatatccctgttgtta

SEQ ID NO: 136446 - DNA, 2545 bp, Homo sapiens
ctcagctcactgcaacctccacccccgggttcaagcaattctcctgcctcagcctcccgagtagctgggaatatagttacgtgccaccatgcccaaccattttttgtatttttagtagagacggggtttcaccatcttgtccaggatggtctcgatctgtggacctcgtgatctgcccaaagtgctgggattacaggcgtgagccaccacgcccggccaggttttattttttaactcttgaatgcagaaatgttagtgcttactggttaaaatagaacatagtatttatatattactttagtgctttattgaaaatatcggaggtgggataaacagagagatagggttggaaggagagtttgtagcagcagtgtaatttctgtgtcagattctggccaggagtgaaaatgcagggcattaattagtatctcccctcatggatttctgtggttcctttctcggttgtccttaatgttaggtgcccctgggcgctgggattgctctagcctgtaagtataatggaaaagatgaggtctgcctgactttatatggcgatggtgctgctaaccaggtaattatgtctcttaacttcccaaaaacagtcttattttcaaagtctttaatatttacagttgaatttctaaagaagtagcatattgcttattaggtgaaatagcaagtcctatggctagctcaaatttggttgacttatggccagattagagattgacctcttagcgttgtttcacaagagacttacgggggcacattcctgtgaaggagctcacctttgctctacatcagtgcttggcaaaggccctgtggtaaaggacctccccacaacctattgcaaaacaatacagacccattctcttggatgtccgggctggcagtgtcaaattcggataatagcgtctgagtcctaactcagtttctatgcttctcttgttaccgagtaatccccagtctgtggccagcactctgtgaagccctgttctagaggctgattcttaggtgctggttcactctggctatccagtgggcctgatagatttcatattgatcttttttccagtgtgttccttactgctagcatggccccaaagaaacaagtagtagttggtttgtcaccttccttagttgcaagagtatgatgcctgctacttctcctccaccacccaccccgctttccctcaccacccaaagctcggttttagaagaggaggctttctgtgctttatgaaagctttctgtgccaggcagagcagcagctgttagagatgatgaagcctggagaaagaagccaaatgaaaccccttttcgtaactacttccagggccagatattcgaagcttacaacatggcagctttgtggaaattaccttgtattttcatctgtgagaataatcgctatggaatgggaacgtctgttgagagagcggcagccagcactgattactacaagagaggcgatttcattcctgggctgagagtaaggacacctgtggtggggccggggccaaggccaaggccaagggtatgtccttgtgcagacccttgacgatcttagaaacattggagagtttcattctcatacaggagcaggtcatgtgaaagtaaaatggtttggggcagttggattcatgcttcgcccctcccctgtttattaccaggtggatggaatggatatcctgtgcgtccgagaggcaacaaggtttgctgctgcctattgtagatctgggaaggtaaggctctaaagccctctgggctagtgacatttatctctggaagttcaaagactgcctcccatgtgcctgctgaagctgttagtgggtacctgctaattgaggtgcatgagatggaagcagagtgaagggagcagggctcctttgggtagcttggtcttggtagctcacctgctgggaagcctacgtttctctcatttgggggaagtccgttctggtgcttcctctgctttggcctgtcttcatgacaactgatttgccttttccttaggttaattctgtccctcctccccaccccccattaatcatgagtcccttgaaggaacagattggggatccccacagtgtccagcatagaatgtcatgtatacaataggcatttaatatgtgtgtcttatacaaattaaacagtatggtagaagctcgtaatcttagtcttgctcagtcctaaggatctttcccttttcagtgtatggcagtgagggagatggtaagagggagactggcctaaagaggtttcacttcctttggcactagtataggcttaggaggtttgggtgttctccctaaatcagtgttctacagcccagaaacaaggtttctgaagttggcacttcagcgccataccatgtacgtttaggcagtgatgtgaatcagatgtggccagcaatgatggaaatgtcacaaagtggagagacagggaagtgagggtgggaatgtagtaacattaaataagagctaatgagtagaatgaactagagcaggaccaagactacagcttgggtacaatgggctgagca

SEQ ID NO: 136447 - DNA, 1508 bp, Homo sapiens
ttatcaccacacacaccatctctgctgtccccacccatgtagtatacaggagcccaaatgggtgggacaagtgacacttctttagaaccttacatctaaatcaaagcagcaagcaaaaacttggcccctgttgtcggaatgccagggaagccatgtgactcaccagtgtacggttttctagaaaagacagaagcagttattacagaatgttaggctgcgttctggtattttgaaagtataacaacaactctgccacgcctatagtgacataagcattggtatgcccctttgtttcagaaacacacttctgtatttcacctcattgggacaatccaaccccatatcatgtttcatcacgccgtccttgctctactggaactgctcttactgatcgattactacttttccctccccatagttaccgtacacgagaagaaattcaggaagtaagaagtaagagtgaccctattatgcttctcaaggacaggatggtgaacagcaatcttgccagtgtggaagaactaaaggtacagtcacttgttcatggtggtttgaaggttggctttaaaagttgccacccctgggtggccacagagtttgtgtgggttcctccaagcccagaaagtgatgtcctgggacataaatagttccatagttccaaagtcccttggggtgggggcttttcctttagtttcctctattcaaaattgtattactcttcagatttcagattttggtggactgtgaaccaccatcacagtggcaaagcccccacagtagtatggttcttttttcctaaaagtatactgtggatttttaattcataaaatagatacaccctagaaatctgtattccaaaatcttctgaattagcaactgttcgtacttgtagttaaagagttacaccagcaacaggtcctcagcagaactctagttggtacctaagctgctgttcattctaaaaccttttacactgttacctaatttttaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgcttaaagattatttttgacttaaaatagtatactttgaacaaatactctaattatgaaaaggaagaacaattccttgtatgcctgtttcccctgcccccagccacctttttgggaggagaccattatggcggggcccctcacagcattctaccaaccatag

SEQ ID NO: 136448 - DNA, 1124 bp, Homo sapiens
accatttctctacaagatacaatatttattatcaggcaagaggacagttccattttaaaataagacttttgtaatcattccaattttgtaatcatttcaaaggccacataacttagttttctctacttacacattcagtataaatatgaagctattttctgttcatatcaaacattaactacaaggcacattcgtatcagttttgtgtttctcaaattgaagtaccataccagttctgaggcagtgtcccagcttccatgtttgttaaataccccttgtttgtttcaccattccagcaagtgctgaagggtgtactttttttgagacagggtcgggctctgttgcccaggctggagtgcagtggtgtgatcatggctcactgcagcctccacacctcctgggctcaagcaatcctcccacctcagcctcctgcatagctgggactacaagtgaatttcctaatattccgggaggtcaaaaccaaggctcactgttttcacaatacacacagttctatgtttataaataacaggtttcaaaagaaactcaggacagtatttaaaacaagttcttaaactattaattgaacaatggcatttttaaatatgtaaacacagcggaattcgtgtatacactaacagaagctttaacaaaacatgtagcgtggtgggacactctgccacagcttagctgattggtatcaagccttgtctttggtttctgaggcctcctgagcccttctgtactgggagaccgcactccagagtctgcagaggagaccacccctgggaaacaaacacagctgtcttcagagtcagtgcttcaagccaacagagcttaaaactgcagtccctaatttaaaaacctaatgaaaataaaaacattctcctcacatatggaggtgacgctcgtgtcccagcagtagtaggacatggccttagaggtacgtacctgcagagagctggctatttcaaatgactcgggaacaagaaggcaggctgcagtttaaagaagggggtgggtccagcgtgcaggcacgcttgccatgtgcctccacccactcccagccaggcattaatggcaggagattggccagctcttctctgtcacattcctatttctga

SEQ ID NO: 136449 - DNA, 1086 bp, Homo sapiens
caacatggctgcattgtaaatgcagtatgctaagtgaaagagctagattcacagccagcaccgtagctcgtgcctgtaatcccagcactctgggaggctgaggctagcagatcaattgaacccaggagttcaggaccagcctggtcaacatggcaaaaccccatccgtacaaaaaatagaaaaaaaccagctgggcttggtggatgcatgcctgtagtcctagctacttaggaggctgacatgggaggatcacctgagcccaggaggttgaggctgcagtgagccgaggtcatgccactgcactctggcctgagtgacagtgaaaccctgtctcaaaaaaaaaaaaaaaaaaaaagattcaaaaggccacataccatgattccttttcctccagaaaaggcaaaactacagggacagaatcagaatggggaggtgacgggactgattgtaaagggcacatgaggacttttgggagtgacagtcatttctgtatctgtgctgccaccttcatagcacattggacacctaaaaagggtagtttactgcataagtaaataaatatgcctccatcaacctgacattcgttttgggccacttagaaacgagctccagagctacctcttggaatgtggactagataagctctgacctcaacactaaaacctatttccttgtaggatttccagtgcagttagggatgtgattcctaaggaaaggcatttgaaagatgtggggataagcatttaaagtggtagacctaacatgtcaaattccaaactaactgaaggtatcctagatgaggaggctttctagaaagtgaatctcagaattatgaattgtgtaatacgtattagcgtggttcagtgatacagggttaattcatctctttttcacatcacatttacattctggaatcatttattaatccaactggttacttttgaagagttttatggttagactaatatataacaaattgccaatcgttacaggtattacagagaacccagcaggcccctacgggcagagaacagataaagagcttatagactggttgcggctgcaaggagctgatgcaaagacaat

SEQ ID NO: 136450 - DNA, 3243 bp, Homo sapiens
aaaaaaaaaaaaaagccattatccagagagcattcaacaccattcaatttaactcaagcatctgttgtgcatacattagagatggaaaaaaaatggaaaatgggacaagtctaagagtcagcctagagagggaagcacatgtgtttcttcaggttctgtgactcagacttcagtctgcagaggggaaccttccttgtgttttcctccccttgacaacaaaggccagtgctcacagcttggatatatttttgcaatggactcaatgtgtgcccctcacccggcccaagttcatatgttgaaatcctaacccacaaggtgatggtgttaggagacggagctttgagaggtgaggtgagaggagtgtccttgtgaaaggagaccccagaggctccctcatcccttccaccatgtgaggacacaccgcgagaagatggccatctgtgaatggggaagcaggccctcactggccacggaatctgctggcacctcgatcttggacttcgagtctccagaactgtgagaaacacatttctgttgtttataagctgcctggtctctggttattttgttacagtagcctgaacgcactcaggcagttttgtctcaaaaacgtatcgtgaaccaaaagatgccgatgttaatcagaactcagccagaaggacgatgtgattatttaaacctggctccctaagtcagataaggcagctgaaactagaatagaatggtaagtttctttcctcctcacacagggactaaacgaaggggacagaagcccctgcttcttattttgtttttgtttttttttttttggagacagagtctcactctgtggcccaggctggagtgcagtggcacaatctcggctcactgcaacctccgcctcctgggttcaggcaattctcctgcctcagcctcccgagtatctgggactacaggcatgcgccaccatgcatgggtaatttttgtatttttagtagagacagggttacaccatattggccaggctggtctcgaactcctgacctcaagtgatccacctgcctcggcctcccaaagtgctgggattacaggtgtgagccaccgcacccagctggaagcccctgcttgtaatggggcagagcagggacagtgagtgagacatgctgctctgccggtggggaggatggctcctgccaacatccaccaagcacttcctacccagaatccaggactgtgccaaacactgcatgaattcagtcactgaagccctgcggcacttctaggaagcactggttgttctaaacccctgttttgaagctgaggtaactgaggcagaggagttaagtaacgcccagagtccacaggctgggctcttcccaagggaccgcctcctgaaacccagtcttgctcatgggctctctgggatcagatatgacttggcacaactgtgcctcaaacttcccccacatgccagctcaggcatagcatgccttgggggaaagggctgacagattggaaccacgtctagcttttgttggggctcagaaaacagtgcccccaaatggcctcagcagcagcctcagaagaaaaagttttcctctgaccttctcctgcctccctctctcagtccattctcctggaggcaccatagaatccctcttccccaaagcggggcacagaaaccagaactcctccccaaagccagccacaaaacctaaaaatacgactctaactttccctccgcctttctgtgtaaaaattggttataaagaaattcttggccgggtgcggcagctcaagcctgtaatcccagcactttgggaggctgaggtaggcagatcacctgaggtcagaagtttgagaccagcctaacatggagaagcctctctactaaaaatacaaaattagccaggcgtggtggcacatgcctgtaatccgagttacttgggaggctgaggcaggagaatcgctttaacctgggaggcagaggttgcggtgagccaagatggcaccattgtactccagcctgggcaacaagagcgaaactctgtctcaaaaaaaaaaaaaaaaaaaaattctttgggctgggcgcagtggctcaagcctataatcccagcactttgggaggtcaaggcgggaggatcacctgaggtcaggagttcaagaccagcctggccaatatggtgaaaccccgtctctactaaaaatacaaaaatcagccagttgtggtggcgtgcgcctgtaatcccagctactcgggaggggagactgaggcagaagaatagttcgaacccaggaggcagaggttgcagtgagcagagattgcaccactgcactctagcctgggcaacagagtcaaactccatctcaaaaaaaaaaaaaaaaagttcttcgacctactttgtttgactgtagttcataagacccccgattccagagggtcctgccccacacccaggagaaaggaatgctactcagagaggccaagaaggatctagacagacaggccttgctgggtttccccactcagtctatcagcattcgatcaggccctttttatccctgtttctccacagctctccatactttgttaagcctaagcataaaaatggacaatttcccctggatctttgggtcttcatgctgaagttaaatacatgttaaatacatttgcatgccttttctctcattaatcagcctcatgcaggtgattttcagcaaacctccaggggccaagggccttggcccccacacttttattgtttgcttacatacctagtacatgggatttgtttcttaactgtgtgttcctttaattcatttatatgatccatgctggtgaacttgggaatacagaactaagctttattgaaattactgaaggctgctgggggtggtggctcacacctgtcatcccagaactttgggaggccaaggcaggtggatcacctgaggtcaggagtttgagaccggcctggccaatatggtgaaaccccatctctactaaaaatacaaaaattagctgggtgtggtggtgtgcacctgtggtcccaggtactcgggaggctgaggcaggagaatcgcttgaacccgggaggtgaaggttgcagtgagccaagaatgtgccactgcactccagcctggatgatagagcgagcctccatctcaaaaaaaaaaaaaaaaaaaaaaaaagactgaaggtaattattgaagttgccatgagaagtcactgcaacagtagagagatgagaacacaggaactcc

SEQ ID NO: 136451 - DNA, 1880 bp, Homo sapiens
atggattacttttaaaaaccaaatcacgcagctgataatgtgacttcccagagcaaacaggaataattttattcatttcacaaatatttcttcccctttttttctttttttcagatggagtttctctcattgcccaggctagagtgcaatggcacgatctcagctcactgcaacccccacctcccggattcaatcgattctcctgcctcagcttcccaagcagctaagattacaggcgtgcgccaccatacctggctaattttgtagttttagaagagatggggtttcaccatgttggccaggctgtctcaaactcttgaccttaagtgatccactcacctcggcctctcaaagtgttgggattacaggcgtgagccaccacgcccatccacttcacaaatattaagcacctactatgtgccaggaagtgaacaaaacagaccagtgcattggaggaatatgatggtgatgccagggttccctggttgggaagctagtccactaatgcccgtctagggatcatgacaaatcacatggaagaaatgacaacaggacaaacttcctcggggtcgggattatgggatgtacatccactgatgaagtgctaaccaacccccaaaccctgctacttctgcaggggcaggctgctgagcctgcgagacccacacaccatgccaggggccccgtcttggtgaaaagagagaaagaattcacagatgctgctgcctttagtatgagtaatttctgtgtggtctggggcaaggtactatatatacctctctgattctgagtttttttttttttttttttaaaggaaggcattcctctagtccctcaattgaggctgagaatatgcgcccttgcctagttcgtggatgatgaagctgctttttcctaagacctgggtgagatggtcaacaataaagccaattaatcagcatcttggtggctcaggccactgtcccagcgcctgctcccagaggagggcccagaagctcctcacctgttggtctcctgtctgagctcacccagctggaggctcaggtgctgctggtggggctgggcctcctggccaggtccggtggctgggggatagccctcttccgcttcatccatgtccttatctaccccttcagtctcacaggtaggctcaaagtgggctcggagctctgcaaatcacacaagacatgacaatggtgagcaaaccaggccagtggggcctggggtcgcagacacccaggtcagcaaaccgggctgttcagaagctggcccagcccgtgccatgctccattaggggactgctgactttacaaatggagaagagactgttccatttggttctctgcagcgtaaagttgatcacgccagtttccacaggaagaaattgaggcttaaggatatgaagtgaaccaaggccagcgttcaaaaggtacaaccaggccaggagcaatggcttacacctgtaatccaagcactttgggaggctgaggcaggcagatcacttgaggtcaggagtttgaaaccagcccggccaacatggtgaaaccccatctctactaaaaaatatatacaaaaattagccaggtccaggcgcagtggctcacgcctgtaatcccatcactttgggaggctgaggcgggcagatcacaaggtcaagagatcaagaccatcctggccaacatggtgaaaccccgtctctactaaaaaaaattagctgggtgtggtggcgcgcacctgtagccccagctactccggaggctgaggcaggagaattgcttgaacctgggagatggaggttgcagtgaggcgagatcgcatcattgcactccagcctgggtgacagagcaagactctgtctcagaaaaaaaaaaaaagaaaag

SEQ ID NO: 136452 - DNA, 1083 bp, Homo sapiens
atcctgggtgcctgggcggttcacctgggcttgaggggctgccagggactcagctccaccccgtccctctctgagtctccccattcggtgtctggctgtccccctacagaaggtccccgcggtgtcgtcctggccctgcccacacagggagagcccatggccaccagcagcagcgagcacggctctgtctccccagactccgacgcccagcctgacgcactctttgagaggacccgggcgcccaggcaccaccttggccacctcctcaggtacacccgtattctgtctgtctgccgcgggcccgaaagggtgctggtagtcctccgccacagggcacctccctggtcccaaccagatggccactgaggggttttacttcccttctgcagggcagtagggcagctgagccgccccatcccggcaaggagggtgcttcgttcacttgctgtcccttcccctccctccctgtcctttcattccccacatgtgccctcccccacctctcctcttcccttctctctcccctctccttcgacacttcccctctctcctcttccccctctctctccccctcacccttgccccctctgtccctgcatcttccggccccctcctcctcctggcccctcctcctcccttcctccttttccttcctctctcttcctccttcccctgtccccctcaccttccctccctcacctctccttctgtgcttgcccccttccctccctccctccctcctccctgtctcctgggaggctcctttaccccgcctccccctccttctgctctccctcctgctgtgggggttgacagaacactgcatgtctgtccttcctccggcaatttcatcttcttgagcacagggactgcatcgcagttacctctcagcccttctccagggcgtcctaacatgacacactcccagggacagtgccccggcacgcacagagattgtcacacgtgtttgtccacagtgttccagacgagagctcagccttggaagaccggggcttggcctcgtccccggaggacagggaccagggcctcttcctgctacgcaaggacagtgagcgccgtgcc

SEQ ID NO: 136453 - DNA, 1150 bp, Homo sapiens
tgctatatacccacaaaagttaaaaataaatttgcagatttttaaaaatatggagccatggtgaacagcactctttctaaaggcaaggatttaataatgacattcatattagttatttactgctgtttaagaaatgatcccccaaatctatcaactcaaacaacaaatagttaggtcttacagcgtttctaagggttgaaatccagcagcaactaactagctgggtggacctggctcagggtctcccaggaagttgcagtccagatgtcagctggggctacagtcatctgaaggctggactggggctggaggatcagtttccaagctcactaaggatagagctagtggggggcttcagtttttcattacatgggatcctccataggactggtttgagacatggcttccctcagagagactgatccgagagaaagaggaatggcacactgccttttatgacctagtgtccaggtcacacaccatcactcccacttcttcctattcatcagaagcaagttgctaagtccagtccacattcaacgggagggaactacgcaagggtgtgactatcaggaggtagggatcattgggggtcattttggaggctgcctgccacaaatctgactcctggtgagcacttgatggcttaccaattgtctccacatagccttgtccatctgactcaaacgactctggaaggttaggcagaggaagcactatctaccattattcctactttacacaggaggcaactgaggttcagagaggctaaaggattcgcttaggctagaacccatatcttctaccttcaagttcagaactacacaccatgacatcactcatccatacactacatcaagaagaagcgctgctggaaaaaaaaagctgcctgaataagagtagcacgtgtaaggatttccaaagccatattggagcatctttccatgtaactggaaggtacagggcactaatggaaaactgggtgctccattttattcactactgtattcacaaggtaaccatccactctcagaacagctaacagagagagataaatgcacacaactatttcagatactcaagggaacactccctggcaggatgcatgttgggtgtgtacatcagctaacccaaaggctggattctgtca

SEQ ID NO: 136454 - DNA, 1651 bp, Homo sapiens
ctcagggaagctaattatgagataaattgttgggggttttatgtcttcaaataactccttgtcatatcagagcccctcttgctatgtattgccaagctaattggtggcttccaaagaggaggatacaagtcattttcaattagggtagtaaaatgctaaaagaaaatgaagtgctagtcatacacacatattcatatacacacattgacagatgtatacgtatatttataccagaaacaatgaatgaaaattcaatgcactctttctttgggagattctgatagtgtccctggtatagtattttcccattttcaggcacatgtacctccccttgtgttacaagtgagaagtcattttgtgatgtattaaaattctctttagatggtgaatgtgtctccactgtgggtgtccagtggctgacacgcgacaactctctcattgacaaaaagtctttcaaagctgacacattatttaccaaaaataagacccaagctgtccaccctacagctttggtgactgcagagatagagaacagtcacctgtcttttatagcttatttcagagctatattattttaagagctaattttttcttttttttttttttttttttttgagacagagtctcactctgccacccaggctggagtgcagtggcacaatcacagctcactgcagcctcaacctcctgggctcaagcgatcctcccacctcagcctcactagtagctgggaccataggcgcacaccaccacacccagctaataattactatataatatatgttatatacatatattatatataatcattatgtattatattatatataacatataatatataaatataatatgtaataataataattatttattttttgtagagatggggttctccctatgttgcgcaggctggtcttgaactcctgagctcaagtgagatcctcctgcctcaatctcccaaagtgcccagcctatgaaagctgtttttttttttttcttttaagaaatggggtctcactatgttgaccacgctggtcttgcactgctggcctcaagtgatcctcccatcttggccttttaaagtgctgggattacaggtgtcagccactataccaggccccagctgtttcataattccatcaagcaagatctttgtgatctttacgttactccttgggggactataaacctttacttattcaaaaatcagtacttctttccaaggatcaaagttcttgttattagtcaggtttaagcaggaatttccaatagccacaagtagcttttgaccatcattctacttattgatcttacaactgtgaaactagctggtaattgtataccaccctttgaacccagtccctctcaatgctcaagttattccattactgacacatggacaagaaaatccaattcctcaaaatcacttagaataccatattccccaggaagaattagcctctcttggaaacacaatcatatcaaaacacaaggtaccagaattcactacagtaacaggctatttttatgacagaccaataaaatgtcttaatcagttgtctgaggaatactgttattcagcattacccacgatttcagataatgtgctattaactttaaagagatgtgctgccatcttgctgattgg

SEQ ID NO: 136455 - DNA, 1032 bp, Homo sapiens
gtcgagtgctgaagaataatgtgtaaacacccatgtatctgggtgattgctgatatattggggatgagttttaagggatttctgccagctgtaagacccttcattcatccattcatgtatttgttgattttcagtgggatagcatgttatgatacgtgaattatgagacaggacctgaaatgaactatttccatttcttcatttcaccaataagaaaatcaagactgaggaagattaaatgactttcccaaggatgcttagaaacaagactaggatccgagtctcttgagttcctcatccagcatccagtctcttttctcatgatggataaggtgttgcagttgtatctatttggggaaatttctggcatgtcccatctccttcatttggtagcaatagctgttctagctttttgttgctgatcagtagttcctgggattttaagagctagaagggacctttagagactgttttgttcaactccctaaatttataggctgaacttatgatgataggtactttctctgtgtcagactctgggctggcactggggaccgaaaggtgattaggatagtgtccttttcccagggttctgctggttcggtggcaaatgcagatgctttgcctctgagtgaaagtgccaagtgccatgatagaggagtacacagagtgtttttagaacgcagaagaggaatgaattactctccttagtgagttgtggcaagtttgaaaaaatagatcaactttgagctgcactttgagggatgagtaagaatttgtttagcggaaaaggaggcctatgctgatggaaaaacagagctgttaaaacacaaagtatattcagagaacaacagattgtctgatatgacttgaatgtaggatgcagggcagtgagatgctcttgaaatgaggccaaaaaaaaattttttaaggcttagcctgaactgatctttgaaagtccttgtatgtgacattaaatagcatggtctctatgtggaatttatgtggggaagggatgtggtgaagtgtgtg

SEQ ID NO: 136456 - DNA, 7917 bp, Homo sapiens
tgaagctccgttagaattgtggtaacaaacctgcatgttgcacacatttaccctagaacttaaagcataaaaaaatatatatatatatgtatatatatgtgtgtatatatatgtgtatatatatgtgtgtatatatgtgtgtatatatatgtgtatatatatgtatatatatgtgtgtacatatatgtgtgtatatatgtgtgtgtgtgtgtgtatatatacatgatttgctggaaggactcacagaactcagaaaagctgttacactcttagttatggtttattacaatgaaaggatacagattaaaatcagcaaaggcagaaaggtacatagggtagagtccaggagagaccacgtgcaagcttccagttgtcctttcccagtggagtcatgtgaatagtgcttaattctcccagcaaaaatgtgtgacaacatgcatgaaatcttgccaaccagtaaagctcattgagccttaatgtccagggtttttattggggatgggtcatgtgggcatggagtcttcatgcagctgatattaatacctcagctccaacctctctagaggtcgaactgatacagtgtggcccagggccccgaagatgaatcatatcgttagcatagactatctgggatggcccaaggtcccagataaacagagatgctcttagctggcagtatatcccaagggcttagaggtgatctcccaatagccagtccagggccagatctttcttttgaatgtgtggagttgggacaacacaggcctgctgagtgcccaagcaagtcggttggagtctagctggcctatcttcccaggatagctccagcttttatccttaaagagcaaaataatactatgatgctttcagttgaaccattccgtttagtaccaaagaggttgtgaccaccactgcctggcaactatattccaaaaagttcagtttgcctgaaaagagcaaaggtgtggtcagagtcaagatgtcataacatcaaaatctacctagtcagattctaatatttcaaaaaataaaagacagtgagtttgactagtgattgccagaagtaagggagggggtgggatgggagggaggtaggcgtgatggtgggaaggcaacacaaggggtccctgtggggatggaaatttctctaacttgccttgtatcagtgacaacatcccggttgtgatacagtactatagttctttttttttcttttttttctttttttcttattatactttaagttttagggtacatgtgcacaacgtgcaggttacttacatatctatacatgtgccatgttggtgtgctgcacccattaactcatcatttaacattagatatatctcctaatgctaaccctcccccgcccccaccccataacaggccccggtgtgtggtgttccccttcctgtgtccatgtgttctcattgttcaattcccacctatgagtgagaacatgtggtgtttggttttttgtccttgtgatagtttgctgagaatgatggtttccagcttcatccatgtccctacaaaggacatgaactcgtccttttttatggctgtatagtattccatggtgtatatgtgccacattttcttaattcagtctatcgttgttggacatttggcttggttccaagtgtttgctattgtgaatagtgccactataaacatacctgtgcatgagtctttatagcagcatgatttataatcctttgggtatatacccagtaatgggatggctgggtcaaatggtattactagttctagatgtctgaggaattgccacactgacttctacaatggttgaattagtttacagtcccaccaacagtgtaaaagtgttcctatttctccacatcctctccagcacctgttgtttcctgactttttaatgatcgccattctaactggtgtgagatggtatctcattgtagttttggtttgcatttttctgatggccagtgatgatcattttttcatgtgtcttttggctgcataaatgtctttttttgagaagtgtctgttcatattctttgcccactttttgatgggattgtttgtttttttcttgtaaatttgttggagtttattgtagattctggatattagccatttgtcagatgagtagattgcaaaaattttctcccattctgtaggttgcatgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgcataaggtgtaaggaagggatccagtttcagctttctccatatggctagccagttttcccagcaccatttattaaatagggactcctttccccattgcttgtttttgtcaggtttgtcacagatcagatagttgtagctatgcggcattatttctgagggctctgttctgttccattggtctatatctctgttttggtaccagtagcatgctgttttggttaccgtagccttgtagtatagtttgaagtcaggtagtgtgatgcctccagctttgttcttttggcttaggattgtcttggcaatgcaggctcttttttggttccatatgaactttaaagtagttttttccaattccatgaagaaagtcattggtagcttgatggggatggcattgaatctataaattaccttgggcagtatggccattttcacgatattgattcttcctacccaggagcatggaaagttcttccgtttccttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttagtggtgtataagaatgcttgtgatttttgcacattgattttgtatcctgagactttgctgaagttgcttatcagcttgagattttgggcgagacgatggggttttctagatatccaatcatgtcatctgcaaacagggacaatttgacttcctcttttcctaattgaataccctttatttccttctcctgcctgattaccctggccagaacttccaacactatgttgaataggagcggtgagagagggcatccctgtcttgtgccagttttcaaagggaatgcttccagtttttgcccattcagtatgatattggctgtgggtttgtcatagatacctcttattattttgagatacgtcccatcaatacctaatgtattgagagtttttagcatgaagcgttgttgaattttgtcaaaggccttttctgcatctattgagataatcatgtggtttttctctttggttctgtttatatgctggattacatttattgatttgcatgtgttgaaccagccttgcatcccagggatgaagcccacttgatcatggtggataagcttttgatatgctgctggattccgtttgccagtactttattgaggatttttgcattgatgttcatcaaggatattggtctaaaattctcttttttggttgtgtctctgccaggctttggtatcaggatgatgctggcctcataaaatgagttagggaggattccctctttttctattgattggaatagtttcagaaggaatggtaccagctcctcattgtacctctggtagaattcggctgtgaattcatctggtcctggactttttttggttggtaagctattattgcctcaatttcagagcctgttattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggatcagtggtgatatcccctttatcattttttattgcatctgtttgattcttctctcttttctttattagtcttgctagcagtctatcaattttgttgatcttttcaaaaaaccagctcctggattcattgatttttttgaagggttttttgtgtctctatttccttcagttctgctctgatcttagttatttcttgccttctgctagcttttgaatgtgtttgctcttgcttctctagttcttgtaattgtgatgttagggtgtcaattttggatcttcctgctttctcttgtgggcatttagtgctataaatttccctctacacactactttgaatgtgtcccagagattctggtatgttgtgtcttttttctcattggtttcaaagaacatctttatttctgccttcatttcgttatgtacccagtagtcattcaggagtaggttgttcagtttccatgtagttgagcggttttgagtgagtttcttaatcatgagtactagtttgattgcactgtggtctgagagagagtttgttataatttctgttctttcacatttgctaaggagtgctttacttccaactatgtggtcaattttgaaataagtgcagtgtggtgctgagaagaatgtatattctgttgatttggggtggagagttctgtagatgtctattaggtctgcttggtgcagagctgagttcaattcctggatatccttgttaactttctgtctcgtggatctgtctaatgttgacagtggggtgttaaagtctcccattattattgtgtgggagtctaagtctctttgtaggtctctaaggacttgctttatgaatgtgggtgttcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccgtttattttgagcctatgtgtgtctctgcacgtgagatgggtttcctgaatacagcacactgatgggtcttgactctttatccaatttgccagtctgtgtcttttaattggggcatttagcccatttatatttaaggttaaaattgttatgtgtgaatttgattctgtcattatgatgttagctggttattttgctcattagttgatgcagtttcttcctagccttgatggtctttacaatttggcatgtttttgcagtggctggtactggttgttcctttccatgtttagtgcttccttcaggagctcttttagggcaggcctggtggtgagaaaatgtctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgcagagagatcagctgttagtctgatgggcttccctttgtgggtaacctgacctctctctctggcttcccttaacattttttccttcatttcaactttggtgaatctgacaattatgtgtcttggagttgctcttctcgaggagtatctttgtggtgttctctgtatttcctgaatttgaatgttggcctgccttgctagtttggggaagttctcctagatactgtcctgcagagtgttttccagcttggttccattctctctgtcactttcaggtacaccaatcagatgtagatttggtcttttcacatagtcccatatttcttggtggctttgttcgtttatttttattctttttttctctaaacttctcacttcatttcattcatttgatcttccatcactgataccctttcttccagttgatcgaatcggctaccgaggcttgtgcattcatcacatagttcttgtgccttggttttcagctccatcaggtcctttaaggacttctctgcattggttattctagttagccgtttgtctaattttttttcaaggtttttaacttctttgccatgggttcgaacttcctcctttagctcggagtagtttgattgtctgaagtcttcttctcttaactcgtcaaagtcattctccgtccagctttgttccattgctggtgaggagctgcgttcctttggaggaggagaggtgctctgatttttagagtttccagtttttctgctctgtttcttccccatctttgtggttttatctacctttggtctttgatgaaggtgacgtacagatggggttttggtgtggatgtcctttctgtttgttagttttccttctaacactcaggaccctcagctgcaggtctgttggagtttgctggaggtccactccagaccctgtttgcctgggtatcagcagcagaggctgcagaacagcggatattggtgaacagcagatgttgttgcctgatcattcctctggaagttttgtctcagaggagtacccagccgtgtgaggtgtcagtctgcccctactggggggtgcctcccagttaggctacttgggggtcagggacccacttgaggaggcagtctgtccattctcagatctcgagctgcgtgctgggagaaccactactctcttcaaagctgtcagaccgggacatttaagtctgcagaggattctgatgccttttgtctggctgtgccctgcccccagaggtggagtctagagaggcaggcaggcctccttgagctgaggtgggctccacccagttcgagcttcccggaggctttgtttacctactcaagcctcggcagtggtgggcgcccctcccccagcctcactgccgccttgcagtttgatctcagactgctgtgctagcaatgagtgaggctctgggcgtaggaccctctgagccaggcgcgggatataatctcctggtgtgccatttgctaagaccattggaaaagcgcagtattagggtgggagcgacccgattttccaggtgccgtctgtcaccccttgctttgactaggaaagggaattccctgaccccttgtgcttcccgggtgaggcagtgcctcgccctgctttagctcacgcttggtgcgctgcaccccctgtcctgcacccactttccaacactccccagtgagatgtacctggtacctcagttggaaatgcagaaatcacccgtcttctgcatcgctcatgctgggggctgtcgactggagttgttcgtattcagccatcttggctctaccaaaaactgtactatagttttgtaagatgctaccattggagtaaacctggtcaaagatatatgggttctctctgtattggttcttagcacttcatgtaaatctaaaattacctcaaaataacatgtttaattaaaaagaaaatgagtttgaaattttgtcattttgtaattgctttgaactttgaactacagctgacccttgaacaatgtgggagttaggggctcagttgaaaattcaccaaaaacttaactacgaatagcctactgttgactggaagccttaccaataacataaacaatattttgtattttatattttgcaaaaagtgcaggattttcgcaaccactgacaactgcagtgacggcttcatgaatttccttttctgtttctcctacgatttttaggctggcttcatttatcttgaaatggcagcagccgtaactgcagaactcaatctgcaatacatatcaagcaattcaactttttctggtaatgtcatgacttttctcggcttcttgggagcatttccagtatcactagtggcactctctatgggtcccatggtgttatt

SEQ ID NO: 136457 - DNA, 1035 bp, Homo sapiens
gtgatcttttgggagtaggattagaattgattttaaatttcttttgtgtacttcatgatgatttccctattttatatagtccctgaggcttttataataaaaatcctatgagcaaaaaaaaattaaaactccctagtgtaagttactgtgttgctattatgactttttttttttttttttttttttttggagacagattctcgctctgtcacccaggctggagtgcagtggcacgatcttggctcactgcaggttccacctcccgggttcaagctaattctcctgcctcagcctcccgagtagctgggattacaggcacacaccaccacacccagctaatttttgtagtttttttgcagagatggggtttcaccgttttggccaggctggccttaaactcctggcctcaagtggtccacgtgcctcggcctcccaaagtgctgggattacaggcatgagccacggtgcctggcctattaagacatttttaaagttactagagagctgcatgtggctgttggtaaaggtggtggtgggaggcgaggggaatgggcaacaacaaatttagagaaagaaaacttttcatgagaaagttggtttataccattatttaaacattttttgttgtaatataataatactttggtggttctgtaattataggtatcgcaaagggtttgaactccagtcatccctctattcgggaattaatcttgcagttttgctgattgttgctggacaacaatttgaaacttccttggaactaaggaaaataggtaaagctgcttattattgcagatgttgttgctttgattatacaagtttggcattaaaagttatgttgaaataactagcattatatcattatatttctattctttttttgagacagagtcttgctcggttgcccaggctggagtgtagtggtgtgatcttggctcactgcaacctccgcctcccgagttcaagcaattctcctgcctcagcctcctgagtagctgggattacaggtgcccaccaccacgcccagctaat

SEQ ID NO: 136458 - DNA, 1062 bp, Homo sapiens
tctgggaattttcagattccctttttgagagaaaaccatgagaaacagggttttctactggtcacactcttcccacaggtacacttgtttatgggccaagaaggaggcccagcacactccttccgagctcccacttccagagccttgtccaccaccaccagggcatcatcttcccagtgatctgttcattcattcacttattcattcatttatttaacaatgttcagtgatggcttactgtgtgccagaaacttttctaggtggtggggatacagacacaacggacgtgaatcctgcccttgggggccttgcattgctggtgagggaagttaaagaaagtgacacattaggatgtcatctgagggctatggggaaaggttaagcagggaaggggataaaggagggctcggaggggtggtctgcaattttaaatagggtagtcagtgaaggtgcctaaagatagaaaagtgataagggagtgaacttcacagataactggagaaagtgttcttggtggaggaaacagcaagggcagagactctgaggatgaagcatggcaggcacactccaggatggtcagcactaagcaaggggtgagtggagagcaacatgaaacaggaagagggtaagaccttcttgctctgagtgagaaggaacatcaaatggagggtttgagcagaggagtgacaagattggacatgcattttaacaagagtactcactgttatgcaaagaatatattttagggagtgtatcagctatcacttgctgcgtaacaaccccaaaacttagcagcttcgaacagcaatgattatgatttttcatgattctgtggctttgccaggcacttcttctgctggcttcacctgggctggcttctaaaactgaagtcagctgtagggtcaggtgtggctggaagatccaaatgaccccgtacacatttggcagctggtgttggctactgatactgtaccttagctctccaccatgtggttctaatcctggtagaccagctttcttacctggtatgcagaactctaagagagtgaacaagggagcagc

SEQ ID NO: 136459 - DNA, 2912 bp, Homo sapiens
ctggaatgcagtggcacaatcttggctcactgcaacctccgcctctcaggttcaatcaattctcctgcctcagcctctcgagtagctgggattccaggcgcccgccaccatgcccagctatattttgtatttttagtagagacagggtttcaccatgttggccaggctagtctcgaactcctgacttcaagtgatccacccacctccgcctctcaaagtgctgagattacaggtgtgagccaccacgcccagcctctgctgatgttgttaactctcctacactcagctgtttcctggctgctggcctcatttacttttgttgcctttggatgcttcatgccctttgatagcagggattccttctctgttcttctctctctcatccatcttattttctggtctttttccctcctattaaaggctacaagtaacttcactaaatgccctttgtaaggaagggcctgtctttaagtgcggaggctgtctcctgtttataacaattcagaaaaatcagtgaagagctgtgtttcctctcttgctcactttgggacctcttgccaacaggactatgatgcgatggtgaagctggtggaaacactggagatgctgcctacgtgtgatttggccgatcagcataacattaaattccactatgcgtttgcactgaataggtaagaacgataatgtacgtacaggttttgaaacatgccacccattgaattgtgcttccttctttcattcaacatcgggtatgagccaggtcacgtgctaaatgccaaggttatgaagatggacaaggtccagtctttgtcctcagggactttgtatttggcatacacattctagctgtgagattgaacacatcaatccatcctaatagcttatgacggcatcaaaacaggcacccccggcttcacatatcttgtaacacatacgaggtcacatctcttttttaaatcggtaaaatttgcagtcagtgaaatgcacagatcttaagtatatgatttgtgtttgataattggctatacacatggaaacaacactcccatcaaaaaagaaaacatttccatcaccccagaagttcccttgtgctcctttgcaggcaatccttaacccctccataggtgaccactgttacagcctctgtctccatagatgagtttggcttgtccttgacttcacataaacggaatcacacagtgtgtactcttttgtgtcattcatcgtcgtgttcgcgagattcatctatgcggttgtgtgtattagtggtttgttcgttctcattgccgtcgcgtagtccttggtataggtatgccacaatcatctgttttactgctgatgggcctctaggttgtttgcggtttggggatactgagaacagcgctgctatggacattgctgtacatgctttttctacacatatggatacatttctcgggtatatagcatgtgcttgtagtagacatcggcaaacagtggtaggattctgattcctttttgggagaaagcttcatggtctctgtggaaatgcacctgctctctccccagcagcctttaaacccagcatcccaaggatgcattgttgtgaatgacggccagtcttcattaagcctgataaagtcttgtaactttgttcccccgacatagtaagctccattcttatttatatttacctgtgcttgattaataaccattaaatgagccatcacgcctgaggttcttgggagagtgcctggcacactgtaagtgctgtaaaaaattggtttgttaaataaaaactataagggccttttaagttactcatcactaagtctttttcccagacatagtagaggtaaccgttgtcagacagagaatgaaataatagattgccattttctcaaaataacaaaagagtaaaacaagatttgaaatggaaaattggggccggccgcagtggctcatgcttgtaatcccagcactttgggaggccgaggcgggcagatcacttgagctcaggagttcaagaccagcctgggcaacatggcaaaaccccgtctctacaaaaaaaaaaaaaaaaaaaaaaaaaaattagccaggcatgatggcttgtgcttgtagtctctcagctactcaggaggctaaggtaggcggcttgcttgatcctgggaagttgatgctgtagtgagccatgattgcaccattgcactccagcctgggtggcagaatggagaccctgtttcaaaaaaaaaaaaaagaaaaaagaaaaaaagacatagaaaattggtatttaggagaaacaggtatagcaggatgaggtgatcctgagatgaatacgtttcccgtttggaagcagaatggctgggattgcacaccagatagccacctttctctttgatgggtcttttccttctagtctgattatctcctgttagacagtggctctgtttaatagggccagacggggtctccaacactgagaacctcattttctccaacaaactaaggattttctatgggattgcaatacttgcttcatttacacatgtaatctgatcctgaatttcacatttttgctttaggcttaagttggccagccgtcaacatagtaggagtttgcattacacattgagcatctctaatctgaaaatctgaattgaaaagtgctcctaaatccaaaactttttgagcgccaacatgatgctcaaaggaaatgctcattggagcattttgtatttcaaattagggatgcttaactcgtaagtataatgtaaacattccaaaatctgaaatactgcaaatccaaagcacttctggtcccgagcattttggataagagatacctaactggtatatatagttttgagcgagtttatggcattactttgtatctgtaaaggggaaaatagtgatggacaagaaatgagttttcc

SEQ ID NO: 136460 - DNA, 1050 bp, Homo sapiens
actactaatgagagacacctgatagagaaattcattttcaagtcattctcatgtatgtttcatgggttttggagctccgtttggctttgttactagtggcgaaaataaatacacaaggaaggtaacttctcaccctctatatgtttgaaaatgccggagacagtgggtttggttggctgcaagttctgtgtgttgtccaagtacagatgggagtcacctttgaaagtatcttcaaggttgaatgaactgatttttacttgtcattcattggtctataaaatgtgaataagtagaaagcatcttctgtttgctggtgcagggaggctcaggtctgggccgaggtccctatgtgttagcctaagtcaggtcaatgagaaccattttgggcgcaagacagtcctgggtgcgtgcagatgtgactggaggattttgtgtttttctttctatagtgtttattacaaagaaaccttgttaaatgacatccggaaagccagagagaaataccaaggtgaggaactggcgaaggagctagctcggatcaagctccgcatggataatactgaggttctgacctcagacatcatcattaacttactcctgtcctaccgtgatatccaggtatgaaatccacctagccgaggctcacgtatgctacgttcttccttggcttgaggaacgtcttgtgaagtatttgtatactcagtatgtggtgaagtggctgggttttgttcttcttttttgttttcttttttgagatggagttttgctcttgttgcccaggctggagtgcaatggtgcgatctcggctcactgcaacctcagcctcccgggttcaagctgttctcctgcctcagcctcctgagtagctgtgattacaggcatgcgccaccatgcccagataactttatatttttagtagagacagggttttcaccatgttggtcaggctggtcttaaactcctgacctcaggtgatccacccgcctcggcctcccaaagtgctgggattgcaggcatgagccactgtgcccggccagaggtggccgtttt

SEQ ID NO: 136461 - DNA, 2217 bp, Homo sapiens
taggaagttgtcagtgatttttttttttttaacgatctctttcagctctgagatcctgtgtttcaagatgatttctgagcatggctttacactcgcgtggctgttggggctcttcatatatctcagcaaggtcattctgaccttacgctctcgtgctttaaaagccttcgtgcgttgagtggagctgcagctatcctcaggatgtactgtgctgtgttctctttagatttaggttaggtgaggtgaaatatgcagaagtgaataggtttagattggaatcttggcttagatgattcctacctgtgtagcactgaaatagtcagctcacctattggagcctcagtgctcaagaaaccataccttcagatgttattattgtgaaagtaaaagaaaaattattcttcttaaccaaaggatccagttattttgcttgcagccaatttaaaggatttattcctgtaagttgtgtcacaaggagaaggatttgtccttccaaaacaaatgaaaatcccaaacactggcagagctgacctgaaatgaaatgtagaggacctcctgtcacactgtggctcaaatagtggcaccctgaactgcggagtgttctattgtagtgttggtacaagggagacacttattaatggtctccttttctatcccgtcacctcttccctggatacagaccttcttctacagactttaatggaaaaggagattagaaacctaaacatgtgtgaccacatgccaacacagagagcaaatgggggacattttgtggcacattcctggaaaacctcatgcagtcatgccttgctaactgttgtctgattgcaaaacaaacacttgagtgaagttttatagaaagctctcccaataccatattttcaagtctgacaaggaggtagactggctagatctgccagatgatttaggtctttgcaagacatggattcaagtttgtttctcactcagtgtgtgtatgtatcagtaggcaaacaactcttgtgatttcatttagtttcaaagggcttgaaatacctattggtggattccaccctctgaactggcagtgtctgacaacagttagtaggaggggaagtggtgcttatagtttaaaacatctataacacagatggaaaggaagttttgagctcaagcgccagctctgatagatttataaagtctattttgagtcctgtgctggaatggcttggaagccatttccaagtgctcattgatcagcaacatcttccttggttacaggggcagaaatggctgcatgcttattacatatctgatgtccccaagccatactcaaaccagtgtttaatttacctaaaaggtactgttcttcttaggtttcttagtttattaaaattatttttcagaattacccttgaaaaataaggctgaagtataactttttacttatcgggctaacctaataacactttaatagcttcagtgcctttatagtccaccaaatgtgcaatggctggcatccaacttaatgactcattcaattagtgacagaattttaaacactggcagaatctgctaattttgttcattattgggatgatggcaattaacaaaaaaggaaatagaaaactaaagcaatgcattgatatttttctatcagaacccctgctgtgtgcgtcacttcattctttaaatgttaatggaggtcctcttgtgagcattggaccaggttatgtactgtatgtacacatatttggcattgttttgtaattattgaaagtaggcaccatttgttcttatcgtatctcatgttgtttttctctctttgaagactattattaaatttagcttactctctttttaatgaacagcctaattttacactctgcagttagtccatttcagctttgttttgtgtgtgtgtgtgtgtgtgtgtgtgtgtgtgtgtgtgtgtgtgtgttttagaccaagtctcactctgtcgcccaggctggagtgcagtcgtgcgatctcagttcactgcaacctctgcctcccgggttcgagcgattctcctgcctcgacctccgaagtagctgggattacaggcacccaccaccaagcccagttagtttttgtatttttagtagagacggggtttcaccacgttggccaggctggtcttgaactcctaagctcgggtgatcctcttgccttggcctccaaaagtgctgagattataggcctgagccactatgc

SEQ ID NO: 136462 - DNA, 1031 bp, Homo sapiens
ggtaggaagaatcaatatcgtgaaaatggccatactgcccaaggtaatttatagattcaatgccatccccatcaagctaccaatgactttcttcacagaattggaaaaaactactttaaagttcatatgatgtcacttcttaaagggcacactcttgggcatgcgcacagttattctgactcttgtatcctcacccaggaatgacagtagttgcagctaggctctctttgactgtctgtttccctgatctccctgttaagtttctgactaatcttctgtattggtcttacacaactggtactacactgagttgttagtctccctccttagctgattgttctattgcttttgacaataccttgaggcataattgttccacagtttgatacaattaaagttttgcaggaatagtccttaaaactaatccctaaggcttggtctgacctcaggaaggttcctcctagctgtctctttcccatttctctctgttaaacttctagctggtctaccctttacatattcctatcacagagctaccagccttctcttaattgccagccaccaaaatctccataatgttttgtacagcactcatgagcttaaacttccccatggcacattctgcatgaagtcactctccttgtgaagagctgcagttcttacagcctgcctttctcctggtcagagctctgtaccactgctgtggagatggcagtggaaacagcagtctgtttctcttggggtgacactctgctctgtgagtggggtgctggctgggggcaacagcctctagtcttctcagcttgcctctcttggcatagaaccttcattctgtgagggagctggggcagggacaatcaagtttcagcattcttggcctgttttttgtttgtttctttgtttttgttttgttttgagacggagtcttgctctgttgcccatgttggagtgcagtggtacgatctcggttcactgcaacctctgccttccgggtttaagcaattctcctgcctcaacctcccacgtaggtt

SEQ ID NO: 136463 - DNA, 1065 bp, Homo sapiens
cgctgcctcctgtcagatcagcagcggcattagattctcataggagcataaaccctattgtgaactatgcatgtgagggatctagtttgtgtgctccttatgagaaactcatgcctgatgatctctcactgtgtcccatcattcccagatgggaccgtctagttgtaggaaaacaatctcaggggtcctgttgattctacatcacagtgagttgtataattatttcattatatattataatgtaataataatagaaataaagtgcacaataaatgtaatgcacttgaatcatcctgaaaccatcctccctgcccctgcccacctggtccgtggaaaaatttttttccatgaaaccagtccctggtgccaaaaaggttggggaccactgttttaaagtgtttaaatacaaagaattacaaaggagacccttcatatcaaaatacagttatcaaaatattttaaagttatatataattatgtgcttctttactaatgtcttaaataatgagatcaaacagcagatcttaaaaactgtcataatatttggagtagtgatgggcataaaagttattctgagatctccgcaggaactgtaatgtgatatgaaaaagtctgtgactcctgttaccaacaaagtctcaagtctcaagtctactactagggtatgttacctacattccctaagtgagggaaatgttatgtttcagttgagggcaaatgatggcaatgatgtaatttttttctctttcaagttcacagacccccccccccaacctccaagaatgactggatctcaggtttagaactcctagtcccttctagaactattgcacatagagaatatttgtgcaaaaaaaaatggccatgattaagcctctatcatctaatgaggctgacactattatcatctccctcttaaagatgagaaaactgaggtttagatagatgagtacatttttcagggtcatccatttaggatgggatggagctggaattcaatccttggccctctgaattctttactacattgctatgcttgagttgagatgatactttgtttctata

SEQ ID NO: 136464 - DNA, 1057 bp, Homo sapiens
atggctgctggggaaggggagtaaatgaagcgggactggccagagggagacatgcagctgagatgcaggctcaatgacagctttggctgaccacattgggagggaggtctggagctgaaatggcctttctgagttgtcttgggttgggatgaaatggccaggcctctatgttcctccatttgtccttcatcactaggaatgtagcttggatgagatactctctggaactgacacagttcagaagggactaacagtaaggggctgcttcctaacgagctcccagaaactggggcaacacatccttccttgaggttgggttggggggttctgggtagtatacctgcatatccaccacattataattatttcatttgagaaatgtgtgtatgtatgtgtgtcatatataccccaagactaagaaatacatttccaaggcttagaggtactgctataatttttttccactgaattggtgggtaaattacctgaaagctgtgcatagccttgctagagaggcaccatggagacaagcaccttctctgtcccccaggagaattactgggagaaaacaaggtgttctacccaacacttgcagaaggaattgttaaaagtacattggactttattttcatttgtcatgtcctaaagccagagttcacagttgtttttttaaaaagcagagttaaatttccaagctaagatcacattattaaaaaaaaaaaaaaccttattaaaaaacacgttattaaaaaactaatctggttcttgacctctggtttaggtgattttttttttctggaaagccagtgagatttaagagaaactcattgttgccattaaaatggttatctttataatccaaataaattagaaattctttgaaaaacagacactggcaatattggagacagtgtcttcaatactcgaagtctctcctctggcttaggaacatgtgtaggtctcggtcagggtaacaatttctcctgtttttttcctcttgccattctcaggccttcagtttcctatggcttaggactcaaaatgatcaaagatgata

SEQ ID NO: 136465 - DNA, 1033 bp, Homo sapiens
gtgttttattacaattaacaatttataaatcagatgctaaattcgtgttttaggaattctgaaaataagccagttgcatactattttggtataaatcctcaaagtgaacttagtctactggcctgagtgacaaatgtcaggcaaaaattccaactttagattcgaggcagttttcctattgaacatgaattgctcagaattttttttttttttttttttgagtagcagtattaatatgtcctgttttcattgacagtgaaaagtctctcccaatccttggtaggccggtgggtcccagcacagaatgttgagaaggcaaagaagggaggacttcatgtcacttgatcaaaatggaatcttggcaacaagttcctctgccacgttcaaggttgcctgtgaaaatgggctgtgtgacttcgggactactgtccctatcctcccttctgccccgttccgctattcccctttgtctgtttctatttgcttccttgcctttattaactaattataacagtcaccatggccttggaattaatatctatgttgctactttttcataacatcactatgaaacatgtaattttaaaaaaaatcttttgagacagagtttcgctcttgtcatccaggctggggtacagtggtgcaaccttggctcactgcaaccgcctcctcccaggttcaagtgattctcctgcctcagcctcccgagtagctgggattacaggcgcccaccccacacccagctaattttttgtatttttagtagagacgggatttcaccacgttgggtaggctggtctcaaactactgacctgaggtgatccacccacctccgcctcccaaagtgctgggattacaggcgtgagccaccgcgcccggcctgaaacatataatttttaatgtagataagtaagagtccaggaagcaatcctataggcagaatgtctaatttactcagctgcagtggcgcattatcttgactctaagcaaatgtctttggggagtggaattacccatttgagagaaattgatg

SEQ ID NO: 136466 - DNA, 1989 bp, Homo sapiens
aactccatcgtgcccaacatgaattatccccgtatgtctgcagagagtttgttgtccaagtatcacaaaagcaaagggcctctcgtccttatgaaactaacttcttaaaaataccccagcatttgccagttcaatagttttggactgacttatgggcattaaaacctttttctcttaagaggaaaaattcccagccaggccgagaaagctcatatcaagtttcagcttgattcatttcaaaaccaccatgaaaactgggacattttctccacaccacaatgggttagtcatggaaattctgccttaatcgcagctaccatggccacagccatgaagcatgcgctctgtgcctctgaaaagtgatgtgacagtattggagaatttctccccttcactgtcagaaagcagaaatgcattacagttcatggtctatggaaaaatgccagggtaacctgaggttcccttttcagcaagcaatctcatatttgatacattttttttctgtatggcagtttggtttggtagctgtttccaaaaagtgctctttccaaactaaaactatggaaagttaaacttagcagaaatgtgcattaagctgggtgtagtggctcacgcctgtaatcccagcactttgggaggccgaggtgggtggatcacctgaggtcaggagttcgagaccagcccggccaacatggtgaaaccccgtctctactaaaaatacaaaaattagccaggtgtggtggcgcgtgcctgtaatccaagctcctcgggaggctgaggcaggagaattgcttgaacccgggaggcagaggttgcagtgagccgcgattgtaccactgcactgcagactgagggacagagcaagactctgtctcaaaaaaatatataatatatatcatattttaatatgatatatattatattttaatatgatatataatatattaatatgatatataatattatattttaatatgatgtatattttaatatgatatataatatattttaatatgatatatattttaatatatataatatattttaatatatataatatattttaatatgatatataatattatattttaatatgatatataatattatattttaatatgatatatattatattttaatatgatatataatatattttaatatgatatataatattatattttaatatgatatataatattatattttaatatatataatgtattttaatatatataatatattttaatatatattatatattatattttaatatatattatatattatattttaatatatattatatattatattttaatatatattatatattatattttaatatatattatatattatatattttaatattatatataatattttatatatataatatataatatatattatatattaacatatattttaatatatataatatatatatatgcattaagaggttaagagtggcttcccctgaggtattcggaccttcctcttactcatgagtgacagaaatagagcagtcttctctgccatatgtcctggagactcttgctaagcgtggccaggcttcactgtgcataggtcttcttagtgcaaacctcaaccagtaaaacagaatgggccattctgccttctctgcatccatagcagagaatgcttcttcagcctcgaagctactcacatcccgctaggagccacttctataagctacattcctggtttttttcttgagatagtttgttcatttgttcgcttgttcctttattgacagaggaaccagcatgttttccctaggaacattctagactttgagaacacaaggatgagttcctgccctcctggggctcacagcctaagtgcgggagacagacatcacacttctgggttgttttaaaagtataactcattacagactgccacctcacacattctgaaatcctaaactgccaggtggacttaattcagtgggcccaggag

SEQ ID NO: 136467 - DNA, 1034 bp, Homo sapiens
cttagctctagtaattgcatgcagtggaaggcagcaagcaagaaacctgaggggcagggcaggtgtgtaccctcaaaaggaaataattctgatagggcaagagatagaagcagcctgaccagtccaaagcaggcttgttaatcctcccaaactcagacatcccaaggcataaggattagtcattttcttcccaaagaatagagaagctagagcaggaccttcactgtgagttggggagctttgcctgtctcccgctgtagcacatgctctctgagtggccaggggcaggtgtcagggagccttgagttagagatgtggggagaaggtctgggatgaaggagaggaagtgaggccagcaaggatggagtgggagcagggcaaagttgatggctggaaggaagcacaggagatggtgatcagaaaggggaggttggtgcttacaaccttggaggtgggtttgtttggaagatgaaaacattcgcaatggttgtggccacaaatgtgggtgactgaagatgaatgaatgaaggtcatagaactgaagataccgaggaaggaggggccggagttggggatggatcacccacgcggccaccataggctcaggaagatggcaagagctggagtcagggaggccagtgttctacaagccagtgtcctcccatgggtgctggtgtgttctgggagttgatgatagtgacaagagggtttgacagtgtggtagcaggtggtgtgagcctgctggctctatcctctgtcgggcagagcagaattaacagcttttgctttggccggtggctgagaatgtcaggatggaagcggaccattcaatgagaagggtccagatatgggggagttggttgctatgaatcagacatcccagaggtcactgtccattgactttacatgtggaaacatgtgcccaggaattgctttcgaagataggcagttggatgatggacaccaggatgtgggtaggaggcccagtgactttccagacctatgccacttggagatgacctattgctttaaat

SEQ ID NO: 136468 - DNA, 1012 bp, Homo sapiens
actctctgttctcctgttttctaggactgcatcgacgtaggctggtgggaaggagagctgaacggcagacgaggcgtgttccccgataacttcgtgaagttacttccaccggactttgaaaaggaagggaatgtaagtctccttcactttgatttcagcggagttgtggctcccatgttgggacttgggatgggggaagtttggtgtaatgttgaagagcactggcatttgaacattcaacagacccagattctgagccctcggctgccatatactctgtaacaagtttcatcataggatgcatctgttagctggcaacagtgatctctactctgcggttgttgcatacataaacaagatagtgtgtgtaaagcactcggtgcagcactggcacatttcagcacccaaataaactgtgagaaccttgggtgctctttttggtaagtggactgccagcatcccacatagcatggtccttgggggtgggaaagtagccagtgttgtggaagtggttgaaaagcacattgtaaggctgaggatgcagggcgaggcctgttaatctttctacactatatgcttacatgtgtgagtacacccgcacatatccgtatattagtatatacacatctctcatccacggtttctcttttgttgtgggagcccatttgaccatgccactgtttaaatcagccactccatctgtgtttgcctcactccaggtgtattctttccctgctgacgatgtaataagaaatattgggaagttagaagcactttccagtataagggaggagcaatcccatatttaggttctttgcccaggcttttgcgtggcctctgcccacctttcccagcctcaacccacttcatgtccatggggactctgttactggacggtgctgagccagatcttgccatggcacgattccagtagggctgaggtgtgggaaggatagctacagtgctggtggcttcgttgccaaggatactaaagtagcatttaatggaattt

SEQ ID NO: 136469 - DNA, 1059 bp, Homo sapiens
gagtttgaaagagtaaaaatgatatgtcagaaatatgatttctttccatattcttgctaagggtttaggtctactttcccctgagttcatgccaatagagcttatgtctaaacagcagctttctggaagcgtcatctacatgctgctccttttctcatttctacctcccacctcattcagagttcatcccctcacctgcctacaatgctctttctcatttgtattagagtctaaaactccatgaaggtgactgtcgtctggagttatgcctggggtcctggtgtaatttattaatagcgccccagatttggaaacaaattgtagtacttgggccacgttacctctctcctcagtggtcagctactgcctcaccatcctgccttcactcaacttctaccgtcttccttggggacatccacttccgccctgatggcagtcgggcctcacaagcggttgatcacctgcccctcctttctgcccctgtcactcagtgggtgctgtcttgcctcacacctcatatcactgttcagtagatgttggaggggcagggtttgttccaagctctaattcctgtatattctcttccatgagcacagctttcctctctccctcttctcttcctttacgctcagcaagtctgcccttgaccattctcattgcctcagttcttgtccttgttctctgcttccaggctgcccagcttgtcttggtcccacttgtttgtaaatccattctagcacttctgccagtgtttctgtgccattctgattcactgtgtctgcctctcccactagactctgagcttgggagccccacaaggacatgatggttttcttttctcccctggattcatctcctgtcctgcacattttagaagtctagcccagccattggcatttttttttaaaattcccaggtgattctaagtgtgcagccaggtttgagagccattttaggttctcagtaaataaactgaggccaggcgctgtggctcacgcctgtaattccagcactttgggaggccgaggcaggcagatcacctgagttcaggagttcaag

SEQ ID NO: 136470 - DNA, 1074 bp, Homo sapiens
gcacctgttgacccatcctctaagttccctcccctcatcccccaccccccaacaggccctggtatgtgttgttcccctctctgtgtccatgtattctcaatgttcaactcccacttatgagtgagaacatgcggtgcttggttttctgtccctgtgtcagtctgctgaggatgatggcttccagcttcatccatgtccctgcaaaggacatgatctcattcctttttatggctgcatagtattccatggtgtatatgtaccacattttctttatccagaaatatttttattttctaatactactgaattcaggctcaaatgcctcatcaataaaaatacattcctgttttaaaatatgtcataataaattaaagtgtgtgaagctaatggttgccgggtttggtcaggagttctgggtgatagtgcctgtgactagagtcatgaaaagtcacagctcaaagtcagagctcccaggaactcaggtctagcccagtgtgccccttggagccctcagagcttcactgacatgtctttggggacctgggtgggagatgggacagccctactccccaaccagaacagctctttttcagttcctttatatttgagctctggaataccttgaaatttgctaagtgtcctgctgaagttaaccagactctcctctctcccctccttagctggtccctgattttacacctgaggacactgaggtcatccagagttgtagtgtgattgtctcaggtcatgtgcttgcgaaagcccagctgggaacccaacctagtcccaagtatcctgccttctggcccaccgtcctctcctcctcctccttgtggcccctccaagtgttcctccactttataggggtcacttggagatcatcaagaaacattgagtgggagctctgtgtccggttttggggggtgcaaagagggctgagatatgctgcagcaagccctggcaccaggatctcctctttttctctaacagtggtgctttccagataattctgtgtctaatgccttacacataaaacagcatagctgcacagtcgaagtgttctaaagctggatt

SEQ ID NO: 136471 - DNA, 1032 bp, Homo sapiens
agggttgttgtgaggattaagtaacatgtaatggttagagaagtgcctggcacatagtaatcacttgattaacgttagttattattattgttgtccttattgttattagagtagaaagagtacctataaatgacagtacattttccagggttatttctatttatttatttatttatttatttatttatttgaggcagggtcttgctctgtcacccaggctggagtgcagtggcatgatcttggctcactgcaacctctgcctcccgggttcaagcaattcttctgcctcagcctcccgagtagctgggattataggtgtgggccaccacgcccggctgatttttgtatttttagtagagacggggtttcaccatgttggccaggctggtcttgaactcctgacctccggtgatccacctccctcagccttccaaagtgctgggattacaggcatgagccaccatgcctggcctctttaattttttattatggcaaatttcaaactgcaagaagtacaattgaattttgctatatctgtgttagctgtttgtttcatatcaccaagtcttaaatgtcagccactagaaagtaagtgccataatttgggaccttgtctgtgttagtcaccatttacagtttatgaaaatagttgtcaaatgatagttggccctcagtaaatatttgtggactggatgaatgaagatactgttttgtgctaatccaattctggttgggatctgcttgtggtctagctaagattcactcttccatttgttcattaattcactcattcattcattcactgaagctttattgaatgccttttatggatcagcagtgtgaagctttattgaatgccttttatggattagcagtggtatctctgggatttgtatgtaaatgaacaaaggggtggcaatccatttggaaagggattggctaaatggcatgtctagatgttgtatttgcatagtaagtgcggtttttttttaacctgacaggttatttatttggggtggagcagatctggtg

SEQ ID NO: 136472 - DNA, 1043 bp, Homo sapiens
attcggtcctgtgtttttgctcacaaatgctggttttcagttaattaaaatgtacactggggaccttcctcctcccccacccttttggcttaaaaataccattttatggaaaatgacaacaacaacaaacaaaaccattgttttaaggatttgattctgaaacgtgttagcagtttataatgacctttctatattttgtctgttttcatttaacagtttcttcctgcactgagacttccttatttgaatgacttccacattttatgagattttatgtgagcaagtatttggtgtatcattcttatggactaggaggccaccttacctgtaggaagataatgcacaattggctaatagagaacaacatttgatggcgtactttcatttcaagggcatggttatgatcaggagttatgtagtaaatgttcaggagctattctacacatctagaggctttcagagacaggttaatgacagagtttagtattccataaaatattctttgaatcctgccctttgatggcataattgatatactgaccatcaaaggaagaatacacccagaaattaactagacacaaataggctcttccttttaggaacatgattgtgggcagagccttgggaaaaaagaatctggggaggtaagtgtccatgttgtcttgctaataactattttatgacttccaaacacatgccacagaagatcaaaggaagagtgtcatgtccccagtgttcttctttggaaagggattcagctttgggaaaacactggtgtttaaaggagagaagaagggctgtaggtttgggggattctggcctctgggaggacggcttcctttccctctttaacaaacatgatcgtcttgctagtgaaaccgtcttaatgtcaagtttggtttaatgctttcctagagaaacatgtctgcatgcatttattccttgtgaagccatccaaaaagattgaattctttggcagttataattttgtgtggtttctttaattgctcatttgtttaaatggcttttagctttacagtttc

SEQ ID NO: 136473 - DNA, 1036 bp, Homo sapiens
atgttgaaagggcttccaggtttaaactgggcataatgtacatgccagtcatttgcagaggcaagccccaatttctgggtgcttatgccatactggttgcatggggactttgggctcattctgtaacattcttaaatcctgcctaatggtctctacttaattttgtggatgaagctcttgcagcagattcattgaaggcaagttcagttaaagactcttcctcttccttcttttgccatcatttgctccctcctcccccctctcttgtttttctctccccttctcttctctcattcactgtcaggaaagactacctttgaagggacaattctgtaccgagctgcaccgggaaagacggagggccacagacgctattacagtgagtgaccttaacagcagaaggcaattgtaaagataagatctgggtacttgtgttttttgatgcagctgccctttcctgagctgctcatgcttatgccaagtgtctgtgtgaatttctgatccaaggacatggacttatttgtctaagtaagtgccatctccttggtgtgtgctaagaagcattcccagcaccagcccctggcgcttttgtttgctttctgcctctatcatgtatgtgatatgcgtgcatgagccatacgtgcaaacaaaggagcagtagcatttgtcgtggcatatgtatttgtaccagtttctctgggcttctggggtggtgtaagatggcttcctgcagagatgtcaacctctcatggttattgctttctctgagtgggtcactggaaaccaataaaccattttgtcattgtgtggttcaaagaagtaagaatttggcatgaaagtccatgccagaaatggcattttgctttgctcactcagccaatcaccacatggcagactttttttggcaggaccaatgtgtagccttttgtgttgtgaaataaggctgccaaaagttgaggggaaggagatgaatgagatgcccttagaacagttcttgccacacagtgagctccatccatgtgagtgttaaattaaa

SEQ ID NO: 136474 - DNA, 1046 bp, Homo sapiens
gccagctgagttcatacctggggccattggaaagcattgtctctaacacagcttactaaatacctccgaatttccaacgcagtgccaccaagtttctcttctacttgaattgagcatagactctgggcatccagagtgacccagatccatctttagagcatggatttagtattcattgtgggggacgctgtggatttagagggcaaaaaaaggagtgacatttcttagaagacctagtatgtggcagatgtgacaagattctttaagcattagcccatttcctcagcccacacggtttattgtgcgggatgaggaaggaggatcaagagaccctagaagacgcagggctgatggccaagcctggtccctgtgactggagaccctcactcttcctgctgtaccacattctcttattcctgctagtgaaatgtccctccagattccctcaggcctaggggatcctgggtttcaggcttagaaccttatcattcattctgattcaacagttgtatctatatctagaaacacagttttccatttgcttattgcttgctgataccctctgaccttacagaaacccacaattcatagaaaaggaagctagaagttgaggatgactttaagggagctgtcatgtgagtggaagtggcaggggtgatgctagaagccagatttcctagctctcatacataacctaatgtgaacatgtgtcagagttttatttaactcattaatgaagggatctgtaagatggtaaggctggcctgaagagaattgtgaaagagcaaagataatgactgaaaaaatttaagattgctaagttacatgcaaaactacatagtgccctacagtgcaataaaactgtaacctttgaggttatcttttctaggggacaaatcctttgcatttctgctcgtcaaaatttatttttgttactacctggcaagaatcatttgcagtgctctcagttttcaccagttgacatccacagtaacagagttgtaaactagcctcataaatagtacatagtgtgccaagcagagata

SEQ ID NO: 136475 - DNA, 1011 bp, Homo sapiens
ataagaacccacatcatttggtggtttcttcaggctttgtaactgttgtagtgcagaaaatgtggtggaggggggcggtcttgtgactcagggagagctgtgacctcagtgagttttaatcgcctgactgagttgatcgtggtgattatgcataatggaatcttattttcttaatggcaagattatcgaatcttagcttggaaagggactttaagatcatgtgttttaacccttagctttctaccagatcaaaatctaaaccatctgagatatcaccgtgatcattactggatatttaaacttgttaagcttggggctcccacagcgactccatgtcagtgtgtctctaacctggtcctgctccaggtgcactacgtcatcagaattttgttttgggggcaggagtagggatagaagccttagaatcttttaaaaagttcaggtgattctgctgcttgatctaaagcttgggcattcattttgcacaatggtaccgatagggcagtaccatgtttttaattctagtttcttttctcaagaacatgaattggtagctggtgacttcaattagaaaatattttcatcttatttctaaagtagctttatggataaagtattaatagctatattagtgaatatgtaagtaaacacaatcatgctggaaattattgtaaaagtttactacaaatacacaaagaacatagtgctatgtaaacagtgcttgatttaagtccattagaattaatacattctggctgggtgtggtggctaacacctgtaatcccaggactttgggaggccaaggcgggcgaatcacttgaggtcagaagttcgagaccagactggccaacatgatgaaacctgtctctactaaaaatacaaaaagtagccaggcgtggtggtccatgcctgtagtcccagctactcagaggctgaggcacaaaaatcgcttgaacctgggaggcagaggttgcagtgagccgagattgtggcactgcactccagcctggg

SEQ ID NO: 136476 - DNA, 1039 bp, Homo sapiens
ccataaaaatgggcaaccagcagctccaggcagctctcggggctgctctgcctgtggagtagccattcttttattcctttactttcttcttcttcttttttttttttttttgagacggagtgcagtggggagatctcggctcactacgacctctgcctcccgggttcaagggattctcttgcttcagcctcccgagtagctgggactacaggtgcgtgccaccatgcccagctaatttttgtatttttagtagagacagggtttcacatgttggccaggacgatctcaatctcttgaccttgtgatccgcctgcctcggcctcccaaattgctgggattacaggcatgagccactgcgcccagcccctttactttcttaataaatttgctttcattaaagaaaaaaaaaaaaagaacagacagttccaccaagccttttcccaatgattcctctccccctaggaaattgatcatcatacattagttttgcctgtactagaattttgtataaatggagtcatacaatatatgttcttttatatatgactggtgcacaacaaaatgtttttgcgtacatcggtactttgttcttgctgtgtagtatcccattatgatgaatatcccataatttgtttaatattttgttgatggatatttgggttgtttccagtttgaggattttattgatagaggctctgaacattcttgtatgttgtcttatggacattagcactaattgctcttgcatatgcacacatgtaagagtggaattgctgctgtcactgactttcaacctgtagatttttctctgtgtaaagttgtggcttccattgggtgaggggaggaggtgccatacctgtgcctgaagcctcatttgcgccacactagtcaatttagctaatcagcctgaatcttgtcataatgtagccacctatgaatataactggtgaggcgtcctgatgcacagaacccaatctcccagtgatgatttgattattgggccccaggaactgacaaagactgatttttaatttatttt

SEQ ID NO: 136477 - DNA, 1150 bp, Homo sapiens
acctcaggtgatccgtctgcctcggcctcccaaagtgctgggattacaggtgtgagccaccacacccggtcaggaatcccatttttatacccacatgcctttctgtccatgttaccactgtcagagagcctaccttaagcattttcttttctttttttttttttttttgagatgggttgcactctgttgcccaggctggagtgcagtggcatgttcacagcttactgtagtgtcgatctaggctcaagtgatcctcccacctcagcctcctgactagctgggactataggtgcacaccaccacacatggctaatttttgtatttttagtggagatggggttttgctatattgcccaggctggtcttgaacttctggcctcaagtgatcctcccgcctcggcctcccagaatactgggattacaggcgtgagccaccatgccctgccaaacattttcttgattcatttagcagatccttattcagtatcccatttgagcgtggtcctccagagtgttgggattcgtatccaccttcatctcagtgctgtctcagtctctcaagagaaaaataccagccattcccctggtatactgagtagcaggccatcccattgttaagaagatacctgtgctttgtcagctcttgggctatttttcattatgcagaaatgtacccagctaggccacatgcctttttaggtttgtctctcttttatttagtttgtccttatttatttattgtaaatatggaagaagaatcttttaaaatctcccttctctttcttttctttctctctctccccacccatgtctttttttgagacagggtctcattctgtcacgtaggctggagtgcagtggcgtgatcacggcttactgtagcctcaaactcctgggctcaagcaattctcccacctcagcctcctgagtagttgagaccacaggtgtgagccaccacacctggctaattaaaaaaaaaaaaattatgtagagacagggtctcactatgttgcctaggctggtcttgaactcctgggctcaagcagtcctctcactttggcctcctaaagtgttgggattataggcatgagccactatgcctggcccccacccacttattttggaatacatttttctttatccctcccct

SEQ ID NO: 136478 - DNA, 1076 bp, Homo sapiens
tttaggtacccagccctatgcagttggtgagacatcataatgtttccacatgccaccatctcccctactccctgaccaccccctccaagcctgtatcctgctgtcttggcatctgttaggcactgagcttccccactttccctagatcagtcctgccacaggccactgagctcacctcaaaatcctttctctcctacctggacacagccctggggcacctgggccctgcttgtctctggccctgcagtggtcctcattgtcacccattaatgcttccatttacttctctctcactcttttttcttttgtaaattaaaacacacacacacacgtgcacacgcacatacacacacatacacagagacagagataaaagaaaattctgtagtgcattttgcagtgagtttattccagactttctctcctcaagctcctcaaattctcttctcacctgaccctaaccaagagatgaccttgattcctgtttaagagaaggcgtcaactcgcttgtgtactctcatcttcatggctttatatcactgttgtaatgttgatccacttttatccaatgccagagaaagatacccttccttcttttttttattgttctctgacttctctccgatcatgcattcctgactcatctgcctgttgtccagcatggtgaccctgtccccgcagaccgtcagtaagtacttactggatcaaagagccattctgtctgagaaaatgtcagctaagaatgtagaagggcagcaggcctaatttggcctggtttcatatttgaacctactgcctatattcatgtgtgcaattgggtatgttcgtggatttttttttttttttttttttctgtgcagctacagtatctggaacatatgtctcagaaaatctttattgattgaaaaaaatatgagcaggaacaggggcaagaagacggactttgagtccagactggctggcggctggaatattatctgatctctctgggagttggattctttcctaaaccaggaacaataataggcaccttgtagagcgtattccagttcctgttgctgtgtgacaaattactc

SEQ ID NO: 136479 - DNA, 1214 bp, Homo sapiens
ggcagaagcaagaaaagtaaagctggatgagaaactcttattgtctttattacccagcaaattcagtaaccaccaggcacaaattcaccaggaacaaccaagcaaggaaggaagaagaagctgatgcaacaaggtgtggtatgacttcatccctcgcccatccccagaagtagcactgagtaaaacaatggagatgacaaaaatattggtaacagtgggccccagtatggacaaaggcactgacgaggtgaccaggccacgtggaggagagtcaaggaaaactcttgggacaacgaagtctttgcttccatctcaggacctcagcagaaggggtaagattcaccaggactaggcatttcccaggtctcagagcagcctgggaaagccaaatcctgcagaagtcagagacacctttgactgtgtctagtgagttctggttctggacatttaatgggaacctagaagagaggggataccaggttccccaacaaagttccgtcaaataggatgattatgagctctgagtccattaaaatacagaatgaacatttaagaactgaggaatcatagatgtagaatagtatgtaaatgttataaatcttgacaaagaaaaattaatgtacattgacaaattcagacatggaggaggtaaagtgggataaagacttaagaactaaccgtctcatcattcatggccaggtgtcatgtcacgtcatgtcttaaaattataatatggggaaaaacgctagtgaccaaccttaagtttttccacaatcttttttttccttgaccttaatacagtggttctcaaagtgtggtcccagaccagcaacatcagcatcacctgagaacttgttaaaaatgcagattcttggccccaccccagacctcctgaatcagaaaccctgggggtggggccaagcaatctgtgatttaacaagtcctccaggggattctggcacatacttgagtttgagaataactggcttatttatcccttttaggaaccaatgaagaaacatttatctgaagttcagcagccccttcaatttaatgcctaattttttttctattgcattcaaataaagttaaatctaaaacttgtttgctggccgggcacagtgagtcacgcctgtaatcccagcactttgggaggccgaggcgagtggatcacttgaggtcaggagtttgagaccagcctggccaatatggtg

SEQ ID NO: 136480 - DNA, 3573 bp, Homo sapiens
ggctatgtagttagcagtgggtggggaggttctggggagaagaaatgaggtgcaggaagaccaacaagggaacgtgtggtgacccagatgacatgttatgaaaacctagataagaagtgctcatatatctagttcagcattctgcttaaaatgggcttttatggccaggtgcagtggctcacacctgtaatcccagcattttgggaggctgtggtgggtggatcacttgaggccaggattcaagaccagcctgggcaacatggtaaaaccttgtctctacaaaaaatacaaaaatcagctgagcgtggtagcatgtgcctgtagtcccagctactcagaaggctgaggcaggagaattgcttgaacccaggaggcagaggttgcagtgagccaagatcgcaccactgcactccagcctgggcaacggagactccatctcaaaaaaaaaaaaaaaaaaaaaaaaaaaaggccgggttgggggggcttttaaatcattggaagggtggagggatcaagtggagataggttatgaaagaagctatgtcaagggtgaatgtaactcaaaataatcacacatttaacaagatacttcaactgaatcttattttagaattattgtagttagaatttccttttaaagttgtaagtaggtaacattttatttgaagataaatttatatgatttttatattgtataatgagtaaagaactaggatacaatgaagtctacctctatttaaaggaatgatgttgacaaatatatacgtgcatgtattttgaagatttcattaaccaaaatagaagaataagaattttctatcagcactgtttttgtttggaattaaacatttccatactaatataaatgccaaaaaataaatcaacttttacatttctttcagttttaatagtgtaagatcctagtgaaaggtaaggatatgtatattaataaatttttattttttaatgtccctaaaaaatgtgccattttaccatgtttgctccgttattacttgcatggtcttatgtccagtttgtggttagtaattgaatattgtgcatagtatcacagtatagaatccacgttcattattctctaatcatagtctcattgttcttgtaaattcttcttcctgtatttattgaagccttacacctttttatactgtagtcaaccatccaaaagtaagaaggcatttccccctctaataactttctctgcagttatcagtcagttaaaagagcccatgtagttttagaattagagatatagggtggaaaagataaaatactaatttgaggtgtgcgtgtgtagtgtcaggctccgtacttgagagccaaaggtttaagagtcttgattttatgccagggatgccttcactgaaactcacccaaatagcagaagactgttttcatcaatttactaatatcaatgttatctagcaccacatgttttctttgtcctattgatttatcatgcgatattgctttgatgtgttctgttgttactttgcgcctttggggttccacatgccttcgtgggaatctcggggtgcaagtaacactgtataaacgaaaatactttgaaaattgcagtgtaaacaaaactagctcagatgtttgacactttgtttgaagtctttatttctcttgttttctctcaataggaatatacagatgttgccacaggaatctaatctgaaatcgtacaaatggaaatgacgctacaggaggatgtttgggagcatctctctctttttgtcaggagttagaagtgacactaaggcactaatactgtaacttcttgataaaataactttattttttagtagtggaatgctgcaacttttttacacctaacaattgcttttaaattacagtattcaatttaaaagttgtattaactacagtttcctttgcaaaaagtctcaaaagaatcacttgaagggcattatttgttgatgcatttttctctgagcatggtttcatagagagaacttcaccaagtaatattcagacgtttatatgttgaaagttttgcttacataataaaaacaaaaacaagtgtctgaattgtatagtgtctttacatgaaagaactttaaacagtggccttatggtagaaaattttataccagatttttctttttctgatgacattttggcttataactcgaagttttcttaagtttctgaagatcaaggcctatataattcatacatttcatattataagaaggcaagagacaaggtgcttcaaatattccatcaggtagttgtgagtgcactgaatttttagtaatatgttcattcagtttttttccacaactatttgctcttttccaatttcaaaatgctattgtggaaaatatgtaaagattttgtaatctatagtccatcttatttttccctcagggcaagcttgtgcatatcatatttttaaaggctttttaaaaatctgacaaacaaaatctcatatttgaaaattgtactttactactacagcattacacattttgcaagcacatcttatagagtgtttacttttagttcagttgatatgtattgcatacctactatgtgtaagagcaaatggatgggatttttaaatgaaatttttaggccccaataccttatttctttatgttttctgtgttctgcttaacagtacatatacattcccaattacatttttgtgaaatgtttatttgtaataaaataaaatgttgttgctctttctgcttaaataagttacttgccagtttgtgagagcattattttaattttgtttgagacttatagccttggatagcacctctgtttaaacagtgtttaaagcactgttctgtgcttacaaagacagagctttcaaaattaaaatgtgaaggttgataagaacttggtttttcatgactggatgtgaaaaatcttagtacattcagttttcttgtccatatctttaaaagagagggcagccttttccttaagtgagttcatgataaggggggcaagtgcacttgattcattgctaagcaggtaataaatttgggtagatggcctgtcttgtactgtgtacaatctctataggtcaggttttccaaacatatttagcattccacttatggtaagaaagaaatgcatgcacacaggtagtatggcaactttatattgtgttaggtacttataaaatctgtcttaaattttaaaataattgatttcatttactcccatattctaggggacagtaatgagctttgaatatttaatcatttgattgacaactatgtattgcacagatactgtactaaaattacagcaatgaacaagaagacaagacacatggaccctgcctttatggtacgaagagtctaataggaaaaatggacattaaacagaaatataacttggtaaatcgcctttatagctcgctttttatttattgtaacacataaaggtaagatggctgatttactattattcattccacaactgattccctatttggatattcttttggcactgtctcaatatgcaaagcgtgttatctgcaaaatacctgtgcagaaaacattg

SEQ ID NO: 136481 - DNA, 2487 bp, Homo sapiens
tatatatcttggatcttgctccatttttttattcttttgtttgcctcagtttgcccaattcctgctgaccaccctattcttccagactacattgctcaccagccccgcttcacagcaaatagaaatcagaaatcaggccttcatcataggacataagaagtatatcctagaagaagctacagcctgctacgggtctccaatctttaggcctaggctttttgcatcatctaaagtgtagcagttatagttaggtttcagtgctggtcaccacctcaccttcctgttgcccttcactgccatctggctgcattagcagtgtctcaacacactggatttttttttaaattagtgtctactattcttgcagtgtctactacctgtttttcttaggcccacccttctggatgctgcttcatatatctttctattgcagccactttgacatggagttttccaatctggctactgtcagtgcctgcaagcaagccagagccacaatttttatagatttgtgtttgaacaaagcccagctctacaagtacagcatcaactcaggtaccttactactagcaccctactgaacagctgggctccactctcctaacctttagagaaaggaatgaggcattgaagctgttctgtttgtgccagggtctgaagtaagatacctgagactaacttggcctttcagctgtcccagtcataacaaatcccattccatgtgtataaactgatggcttagacctattagtccattttatctcaggccttcgtgccttcaaaaaaagagtgaaggcctggagactctggtttcttccagtgttgctttccgtttcccttaaatgagggacatttttgctcaagtagggttcctgggtgaggtaccatttatatgactcttcatcccaagctttagcatcagagggaactttgaaggttcttccttagagagaaatcttagtctgaacagcatccctgcactgctttggctttttgccctcctggagaattcgttcttttggcagttattagaccaccacctagactcattaaggatgcatcattaatctaaatgccctggaaccttcttgagcctgaaattgaatatgaacctatttattcccatatgccttaaagtccaccaagaatatttagacagatcttatctggactcctcactcccctgccatattgaaatgctggagtgatcactcatggctgggaggtcttgcatttcctcatctgtagtacagtctggtgattatgctatcctatgccatgcacttcctgcctccaacaaaaaacagctttggggagtggtggcggtggtggggatcctagatgtgctcctaatacatcctctgcttccacttaccagaatgatagtggcttccctaaaactgcattggctctccagctgcctacaaagtagtcagattcccaagcagtagtagaaaagtacagaacggaaattcttcctcattcatcatgtacttgtcatattccattgtggcaccctaagtcccttttactgtgtttattttctcttggattctgtgcttgggctggaagataaaggggtgggaggaatgtctgttactacctggaataaggcttgtctttaatccactagcattcagaagtacccccaggaagcatcctctgctcaccatagaaagttttcagaaactcctgagagtctgattatatactagattggaacaaagaagctagtaagaattaatgaagtcacctctgggaacattgcctctgaaaaactgtaagtaattgcgcatttggccaggaaggcaaggaattccaaggcagcggagatctgaggagcattctccagcagtcctcaggtgctgtggtgcttaccagagctctgtccagggataggaaaggaagagagaagagggcataatgacagtgcagaaaggaagttagagactgggattcgtggttttgggggttgaaagaaaccttgaaagtcatggagtacgaaaatagaacaggaaccaagattagctgaatcaacagaaatctagtatacacttgccaggtcccttgagctgaagtgtgccagggtgcaaaggaagtgttgcataagggcatcatcactttcaagcacttaggatctggaggctccagtttcactacctacctctctgccttctctgtcttatttggttttctcttcctccatgcattcttttaaaatgtaagcatttcctagtgtgatgtgatattattctcttttttcagtcctccttcttgtcttgattgcccttacctcctcccaagatttcagccatcacctctgttgatgtcttcaaccctgactactctccagacctccagattgtcagctgcctcccagatgccctcacatggatgtcctaaaagcacctcaaatttagcatgtttaaaatcaaacttgcagctgggtgcggtggctcacgcctgtaatcccagcgctttgggagg

SEQ ID NO: 136482 - DNA, 2345 bp, Homo sapiens
cttccagtaagttggcaagtagctaagtttttaagatttatcagggcagagatagactccatctatgaacctttgcaccactgctcccatctgttttagattattctaggaggatgcttggaaatgcaggcagacacaagcagtgtgtgatatgggggagtgagggagggagacttggagaattgtttgggaagatttggagaggattggttcacgactgacaaaactgaggactgttttcctcttccacctccagcagtagattaacaagggaccatttctcttatcaaccacatgggaaacacacaaatattcgttgtcctcttatgtctaatgtaatgctggacagtatatgcagcctaggaagtgttctttttaagtaatggatcttttgtggtaaagaaagatttgtttgaaggtattaacaggaataaagttaaaagagtttttgattcttaaatagatattgatacttaatatctttccccctcattggggtttgatacatttcactatgaatcagaagaataattttagttcattagaggttctgaacattttattttgttagcatgatgaatttcaataattaatttcaaattcttttctttttttattttttgtagagacagggtctcactctgttgcccaggctggtcttgaactcctggcctcaagcagtcctcccacctcagtctcccaaagtgctgggatttaggtgtgagccactgtgcccgccctcaaattcttttaacttaacagttttaaaaatttggtttgatgtagttttgttttgtttttttgagacagggtctcgctctgtcacccagactggagtgtggtgtcacaatcacagcttactgcagcctctacctccaagactcaagctatctcccacctcagcctcctgagtagctgggactacaggcatgagccaccatgcccagctaagaataaaaattaaaaatatatatattgatatataaaatgagctaggaagccagcttgagagaaacctactttctcaccatcattgactctttctgttttaacatctataaggcctagaatccaggacagctccaagtaccagacagtttttcatctgtttttttgttttgttttgtttgagacagggtctcactctgtcacccaggctggagcgcagtggcactcttttgtacttttcaagcatagagaacagtgactcgctgcaacgtccgcctcccaggttcaagcaattctcctgccttagcctcctgagtagctgggattacaggcgcctgccaccacgcctggctaatttttgtatttttagtagagacggggtttcaccatgttggccaggctggtctcgaactcctgacctcaagcgatcagcttgaggagttctgcctcagtctcccaaagtgctgggattacaggcgtgagctactgcacccaaccacccactcatctgtttactaataaagtagacttggaaggtgtagttttagcatttaattccttttttttccttcacagagcaactttagaggtggcagatgccagcccaattataaatcaggcctggtacagaagagcttgtacattcaggctaagtatcagcgtttacggttcactggcccaaggggatttatcactcataagttcagagaaagattaatgagaaaaaagaaggttagttgaattaaaatgatttaaaaatgtttagtgacttttaaactcctagattatctatgttcattagataaattggtttctcatttaattttaagaaacaacctgggtttttaaatgttcttgttgcatgatagttgaataagatcttcagggagtaatggtaatacagttgtgaggctgtgtaaccttaaaatgcttttaggcattatgccttgaatactttgcatatgttagctgtttgaacttttgactttagaatttctgttgtatggttaatctttgaaatggaaactcaggtaaaggcttttaattgatgtattttaatcttatacaaagtgaattatctgaatgccaaaaatatattgaatatatacaaagggtgcataattgcaaaatacactaactcttttccccattcatatatttttttgttgtggtaaaatatgtataatataaaatttgccattttaaccatttttaagtagcatcaagtacatacagttcagcgacactaatttcattcacagtgctatgcaatcatcaccattatatgttcttttgcaatttatgtttttaattgacaagtaaaaattatatatatttatggtgttcaacatgatgttttgatgtatgtatacattgtggaatggctaaatcaagct

SEQ ID NO: 136483 - DNA, 4420 bp, Homo sapiens
aatgtgcacatgtaccctaaaacttaaagtataataaaaaaaaaaaaataaataaataaataaaaaataaagacttcttgaaatttacacatgataacttggccaaaatttagtcccatggccatgcctagctgcagggcagctgggaaatagattctttaatctgagcattcatttgcctggtcaaaaatcaaatatcaaaggatttaatttttgtattgtggcaaaatatacatatcctaaatttaccattttaaccatttttaagtgtaaaattcattgacattgagtatattcacagtgttgtacaatcaccaccactatctacttccagaactttttcatcttcacaaacagaaagtctgtttccattgaacagtaactcctcatgctctcctctctgcagcccctggtaacctctattctttctgtctatatgaatttgcctattgtgggtatctgatataagtagaatcagacaatatttgtcgttttgtctctggcttatttcacttagcatagtgttttcagggtcaattcatgttgtatcatgtgtcagaatttcattccttttttaaaaaattcattctcttttaaggctgaataatattccattgtatggctgtactacattttgtttatctgtttttctgtggacatttgtattgctttcaccctttggctattgtaaatagtgatgttatgcatattggtattgtcatctttttggttatagccatcctagttagtgtaaagtggtgtctcattgtggttttgatttgcatttctctaatgactaatgatgttgagcatctttctatgtgcttattggccattggtatgtctttggagaaatttctattcaaatcctttgcccattttaaaatcaaagtatttttgttgttgaggtgtaggagttctttatatattctggatacagctccctcatcagatatatgctttgcaaagagaattttaaaaaatccattgctttgtttgtagaagtagtcatacacactaatggtaatcatttggaaaaatataataaagtataaaatcaaaaatataaggcattcctaattttaccagtcagagatgaccactgttaatatttagtacatttcttgtcatttattttttctgggcacatatgtgtatattttaaataattgaaattatcctcaatatacaactttgcactttactcttttgatctactgtcgtgagcattttgacaaagcataggcctttttaacatttaaaaaaccccgagtgtctatttcatgtcagattctgggatcagagctggggccacaaaacgaatcatccacattgcttcctctgaaggaatagcaacttgttccgttaaacagacaggtacaccagtagttacaaatacggaatgataggtgttaagacctaaaaatgctacatgggcacatagcagggagtacctagttcacctcagaagggtttaggaaactcttccttgaagaggtacaaatggatctaaatctttaagttaatctaagtagaaggaaatggtcacagaaggaactgcacatgcaaaggtgtagaagcaggagagattgctttgtgccaggaaccacatgtacttcaatattcctggctgggcacggtggctcacgcctataatcccagcactttgggaggccaaggtggatggattacttgaggtcaggagttcaagaccaggctggccaacatggtgaaaccccgtgtctactaaaaatagaaaaaattagcggggtgtgatggcgtgcacctgtaatcccagctactcggaaggctgaggcaggagaatcagttgaactcaggaggtgcaggttgcaatgagccgagattgtgccactgcactccagcctgggcaacacagcaagactctgtctcaaaaacaagcaaacaaaaaatcctgaagctcagtgtgcctgttggggagattggagcgaggtagcaagggccagagcagaaagggctttggggggtcacgatgaggagtgtggaagttatcttgttgccagtggggaatccatgggaaagagtgaaggtgggcctgcagaagacacaggaaggggctgagaagcattgtagagagatgcaggatgtgacacggagaggaatccccaagggctgtggaaatgaggctttggagatcagaggaagatcccagggaaggacctccctcccagatagggctgcctgagaagagccctttgtggcctcagtacctcatgatgacgggagagaggaggctgtccttcgctgctgtggtcctacagtatcagaggcctcagctctgccagtgaggggaccctgagccagtcatacaccttgcctctgttgaatgggctgggtcatgagccattggtgcttccaccagtaagagctgtcagcaagaaggggaggggggcagtgctgccaaaggttctagagcagtaattatctttcctcaaaacacacatttcacatatggtttcagggggttacagcccccagaaagcctgtccttagaccccagattgagaacctggttcaaggagtgtttttccgcattgctaacctccaacttagataaataacatttgttggaaaatgaggggtttagccctaatgactatcatttgtaattttagtagtgatagatcattgagatttcacttgtgtgctactttaattgtttctgaaggggctttttaaaattattcttgtttatttcttggaaaaaaaggtatactaataaaatattcttattttctctgtttccttattagggatgatcagaattccagtttttcaaaggtaaagaatgttcatactgatggattccaaaaacccacacattttataaaatcaaattttagaaaatgtattgaaaaaccttacatggtaagattgcagttccaaaatttgcatttttataatttcttcttctccaatacatcaaaatgtgcagggatcaccaatatttttcacgtttgtaattgttcattaagtatatgttataagattccgttgatgcttaaagttattatgacagaagaaatggtcatttcttacttgatttagtaggattttattggattcattaaataaagctaataaatctagctttcttaagattttttggggggccaggtgcagtggctcatgcttgtaatcctagcactttgggaggccaaggcaggaggattgcttgagcccaggagttcaagacctgcctgggcaacgtggctagacctcatctctacaaaaaaatataataataataaaagaaaaaaattcaaaaaagattttttgggaacaacacttaagatctcttggaacatatttattaaggcataattcacataccataaaattcacccattttaggtgtacaatttaatgatttttagtaaattaaccaaagtgtgcaaccatcaccacagtccagttttagaatattttcattacccaatatgaaccctcatgcctgtttcgttactcccctttgccacccccaaccaacactaatctactttctgtcttaaagatttgcctttttatagggcagctcacaaaatggcagctagttccataagaacaggcaagtaatggcgagaaagatggaagccagagtcggtaacctaatttcacaagtaaaatctcatcctttaccatattctttttgcaagaagcaagttcctaggccctgccgacactcgaagggaggaataattggtcggatcactgggagccatgtcagcagttgcctagtacagtcctccctctggccagactctgcagaaagtggaaataatagaaggtgataagactgttgattttagaaaaaggaaaccatcttgagaatgggccccatcttttctgtctccaccagaggatttaggttcttcatagttacagacttactaatgtagttctttcttttatttctggtacttttctagccatggcaagagcatcacctcagatcagttacctgagtcaggaaaacctgcctcctgcaatgttgaggatttgtattcttcttaggcagtaggaacccttcagcaactcctgatagtaatgggtttatttctctcctagctgcctgaataaatgctagatgtatcatccattttctcagattcacccattatgttatacacgagtatgttttatacttgttacaggcgtaaatgatcctggctcctcacaaactagcatggatcatgttagtcaaagtcgagggtcaagttagcatgggtcaaggaggagatgtgtatgtgctctacagctaagctccctgctccctgctttgtgttcttaatcctgtacatttaaaatgtgttttctaatggtaaaacaagcttttaaagtaaactttaaagtctgttaacccacactactactttttttc

SEQ ID NO: 136484 - DNA, 5558 bp, Homo sapiens
ggtgcgatctcagctcactgcaacctccacctcccaggttcaagccattctcctgcctcagcctcccaagtagctgggattacaggcgcccatcaccatgcccggctaatttttgtatttttggtggagatggggttttactatgttggccaggctggtcttgaactcctgttcaaatgatctgcccaccttggcctcccaaagtgctggtattacaggcatgagccactgcgcccggcctaattaacttttttcaataagcacttttctatgttgacttccacatagtctttattaccataaattaaatgattgtacattattcttttgacttaagtttaccatgatttatttactcattcttcccttcctcttaattttttttttttacatttaagttgcttctattttttgttattttaaatataatgttttgaatctatttaggtagataaccttttatttgggttagagtcccacaagtgggaatcctggttcaatattaggaacttttctgactgtttattgtcaattgtgtctcaaaatatttgtattagtttacaataccattagcaggatgagtacaaggtaacttatctaggacttgtaattaacgttcttgttagatatggtctttgtgcaactaaaagtaatgtgaatggtttgtcttctgtcaaaattcctcagactctgatcaaaataatagatccaaatgacctacgacatgacattgaaagaaggcgaaaagaacggttacagaatgaagatgagcacatttttcacatagctagtgctgcagagaggtaatcagtagatgacaaacatcctgttatcagggagctttgggttttaccatatttttacattttttgtgtgatgataattttcattttaatatagggatttgctccttcaaatccatcttatatgtttaagtgaaatctattaaaatgtttccaggttattcagtgattctcatatgcggtttgatttaaacaacaaaaactatggggtaggtgaatatttgaggtcttcgtaattctgatgaggagtgttaccacttttagaatattagcaggaggcaggaccagcaagtttacagactatttagcttgagctgattgaaactctgatacattctgccctttagattctgggttagtctttgaatagtagaaaatttcctgaagtcagtacagttatcttttgcgactctttgtggatgtctatactggataattgtggatcactgtactgacaaaaagtgaaaaaaatccacatttttggatgtcgtccatgaaattgaggcaggtgtagtagaaaatgcagaggagacctaagtttgaatctcatctctctcagtttacaagctgaccgatcttggacaaatttgcttagtctctggagcctcttcatctgtaaaatgatgataaaatcaatttatgctatggggcagttatgagtattaaacgagttggcacatgtgaagtacttatgtcatatatggcaaatagatcctcagtagatttttctttcttaacctcatacttctgtttaggggctcttagtagtctagatcaaccccagtttatctctagttctgaacaccatgtggatggaactcacggcaactctggggccccatatgattatgaggtataattgaacaggacaacatttccagttcacttgagttcttatactacttggatctcccaaaaagtgagactgtatgaatacaaagagacagtgctaattgtttttccataatcttttctatcaaattgctaagataatgtatttgacaagacttttaagtcaagtctgtagctaactaggtcagaatatatggacttgatgctgacaataaattcagaactaattaaaacatagtgaaacgatgtgttgaggtatataaaacaattgaaaatgaaagagtaaaaatgttgtcccttgctgggtgaaagtctccagtctcctaatatgatatggttaatgcatgacatgactgtgctccttaatgacacaagctctctatcatgcttttcttgactcaacaagtgtaagaaacccagtaccaagaaacaggattttaaaaacagatttaagacaatcagcatattttaaagatcataagatgctttaggatgtatctttaccccttgacgtgattaagaacttgagcactggagttggacctgagttcagtggctggctcttggattcctagctatgtgactgactttgggaaaattattttgtctctgtttcctcatctgtaaaatagggataagagttgtacttacctcacagtggtggttaagattaagtaaagtgatgagtgtaaggtagagtagctggtcagcattaagtattatgaatgctagctttgaggacagtgtggtagtgtgcaaggatgtgttcctacaagctgtcttttgctgggtctgttggattattttatttgtattggataggtggtgaggcatagtggagccatgaggagtttttaaaaatgagacattacttaacattcatcctgcaaaaataaacaattcagtagtttttagtatattaacaaacttatgcaaccatcattactatctaattccgaaacatttcatcaccccagaagtaaaccctctacccattagctgccactccctgccccatttctccttcccccttagtccctggcaactactgttctattttctgtatctatggatttgtctaatcctgacatttcatataatcatttttcttttctttttttttttttgagacaggatctctctctgtcacccaggatggagtacagaggcacaatcacagctcactgcagcctcaaccttccgtgaggctcaggtgattctcccacctcggcctcccgagcagctgggaccacaggctcctgccaccacacccggctaatttttcgtattttttttttgtagagacggggtttcaccatgttgcccaggctggtctcaaactcttgtgctcaagggatctacccgactcagtctcccaaagtgctgggagtacaggcatgagccaccacaactggcctgacatttcatataaattcaataatataatatgtggcctctcgtaactgacttctttcctatagcataatgcttttaacgctcatccatgttgtagcatgagaattcttatgtatggctgaataatattccattgtatggctatatcgtattctctttatccattcaccagttgatggacatttgggttgtttccactttttgtctgtttgtgaataactgtgctgtgaacatttgtgtgcaagtttttgtgcagatacctgttttcgtttctcttcagtatatagctaggagtggaattgatgagtttgatggttactctatgattaactttttgaggaactgccagactgttttccaaagcggctgtgctattttacatttccaccagcagcatctgaagggtccagttgctccacatcgttgccaactcttcttattaatctctcactttatcctaattcagtttccttatttaaataagaaaaatatattatccttttatcttagaaattcagtttataaaaattgacctcattatatgtttttatataaacttttaaaatcaagtcagggtagtttccacagaaatacgaaagaaatgaaacatgatgcaatcataagtcataggatgtagtgatttctcacctgtgtggctttccttcaaaaagttgtatgcagcctttctgtctgtgtttgctcactgttgtatccccactgccctgagctcagttcatatttgttgaatgaatgaagagttcccaaaggagtagacaagacagaggatacctaacttgtaatacatttagatttgggttactattccctgatgccttaggatctttcacaagcacacctaacacttgggggttctgtctagcctctaggacccatctgttctctacaggtgctccttaacttatgatagggcaacatcccaataacccattgtaaagtaaaaaaaaaaaactgtaagttaaaccattgtaagttggggacggtctggatttacttccacttcttacccgtttcttactctgatgtctccatgttttctcctgacacactatttctgccttttctaactggagttactaagtttcctacaatgtaaatgagttgttttgttatagaggtatggagtgtgtttgataaagtagcttaaaaatagtatcagtggacttgaagaggacatcaaactgccaagaatttcttttattttttatttttattttttaacaaggagttggaacgacagactgtcgttttagctgggcaggttacgggaaaacatcagtttttgttcttgctattgcagtagtcataatctatactgaagtagagtgaactttataaagatatattcatatagtcaacagatatttatgtattgatttctttgttctagttactgttctaaggactggggatatagtgaaaaactatatacaaacctttgtcttcgtgttacttataatttaatagcagaagaaagaaaataaatacatgtcagtggagtgataggtgaaaataaggcagaagaggaaatttaatagcaaagagtgacatgtgtgatatggttttatttagggtgatcatggagtacacttatgacttttaaaaaatgtagctgggttgtgaattaagtgagggtgttagccatagggttatctgaggggatagtatttcaagagagggaacagcaaaagcaaagaccttcagcatgcctgcttttgtttaaggaatagaaagggggacagtggggttgtgacagggtggtaaagggagagagtagatgaggccaatcacgaagggctttgaagaactgaaggacgtgaagactttgtattttattctggatgaagttagaaaacattttgggttctaaccagagaagagacataatctcacttaaattttaaaaggatcactgtggttgctgggtggagagtggactgtaagagctagagaaaaaaagtatttccttctcaagtgaaaaaaaaagattagaggtaggaaatctacatgatagggtcaacacggtagagtggacacatcagggaaccaggctgcttagatcttcttcctcccatatcctctgtatgtagcatctgtctcatgatccaagatgggtatttgtgccctagccatcatgtcctcatactagcctttcctttaaagacttcttgaggagccaagatggccgaatgggaacagccccggtctacagctcccagcgtgagcgacgcagaagacgggtgatttctgcatttccatctgaggtaccgggttcatctcactagggagtgccagacagtgggcgcaggccagtgggtgcgcgcaccgggcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcag

SEQ ID NO: 136485 - DNA, 3290 bp, Homo sapiens
gttttgtttttgcttctggcgagtttccattaattggaaaattcagtgatatagaacaactttccccagtgatgctacacaaataaggcagttgtaggtattacaaactggaggccttcaagaatttaaaattttttattttgtgcttcctactagacaattgcattaatctttcttaccttcataaaatatgttttgaaaatgagtttttttcctctgtgtccctcaaactaaggcatgtatttactttaaagcacatagtttgtctgaaacagttcatcctctcagctccagtccctgtcacccaaaggaaatgtgattcttggcagaaatggagctgatttgcagaaaaatccaggagattgtcccagaacagaaacagtaaattagggaagaggattgcttaagtagcattctgatggaccaagtgtattctctttctctgtatcctattaaaagtgtgtagcatagctgatttctaaatgttttcatgaactttaatgtgaattaaagtaaagtggcattagaaggccttctgtgatatgcaaacataacatttagtatttgtttgaaattgttttgatgtttcaggcttgtttttgaagttactttttattttcattcaactgtgaagctctatgccatctttactttccagatatagtaagtcttaccttggagaagaaaggtccttgctttgagagagccattgtcttttcccctggacaagtaagcaggcgtgtcagatagaaagaaaattcttcgattaataaatcaggtgtttttactcttgtttgggcttgggaaggcacgtgagcgctacaaattagtctgtgaaataagtttgggtcccacatatttttaagagaaaacaggttgaattttaaaaaataatcccttctttctgtgcttatatgtaatcttttaagtgaaatcagcttaacattgagataaaactcttcatttcctttttcagcaaattattttccatcacctggcattactttacatgagcgtttctcaacaatgcaagatatacacaaggcagatgtaaatgaaattccattgaattcagatccagaaatacacaggtaatgattgattaccatattatacccatttaactaatggggatatacctcagaaaagatttgggaaggggctgctttccgaacctgctcacttgggcttgctgtagactgtaggattgcatttcctgcacaaaaataataggataatccaagcattatctggccactgcactttgatggaatgaataggatgcgctgaaaacattgactagcgttgtttaaatgtgtaggactttgaagatgcttacatacctaacttcacttctgctgtcaatagtaattgcttcctgaggtcctcagtagaagaatgaaagacagttttcaagccatcgaaatcatatgttgcttcgtgtggtcacaaataggtgttctgagggcagccagatgaaaccacgtgtcttctgctggcacttgttggagcaggtggtgtaccctgtcttgtgagctgatttgaatacatgtgagaatgcagtatatcaccagagcaaagtttgagattacacagactactgatttgagaaccactaaagcttccctatagtgtgttccacaggatatgtatatcctgggagactgccatataggtgaaaaactatctggtagcaagtttcttttgctagctccaaaacatactagctttatttcaaattctgttctgtaatagtagaatcagggtatcagtgtataacataattatttagttgtactatgcctttattattttaggagaatagatatgtctttggccgagcttcagagtaaacaagctgtgatctatgaatcggaacaggttagtgaatacaatttttgatgagaaattatcttattgtttgtatattaacggcaaggggcttggtggttgggagagaaaagggagttaaagtacatgaagaaggaggattgaaacccaggaatctgaaattaaaaaagtcttcaggtgattctgactatcagccaggttggagtgagaatactgacaaaagacaaaaatattccctaagagggacaatccctaaggataacagctttgtaaaattgacacgcaattacagcatttgatattcatccccaaaatccgcactgtaaagcttatggaaagtatgttaggtacctatttttttcaaagcaatcacgtggaatatatttttaaattgtacgtggaatgaatgcacaggaacgaaaaatttcatttgatattgcccttctgtttactgcagaatgtacgaaacattctgtggaatatgaactagcaaaataagggaaataagggactaaatttctttattcatgtgtgtcgttcccacccgacacctcccctcccaccccccatttctttgctaattagaaagactgtcttgactagccaggagggaagaaaactggctcttgttttagaagaattatatcaagttctaaaagaactgctaatttattcattgaggataaagagtctttgtagaggagatattttaatacatttctgatagaatatataaataattttttcacttgtgaaatgattataatttttgctgaacttatggagataggttaatttgttgaacaaatgatattttcagacaatttctaatcatcaaagtcctatactcaacttacaggaaatctgtggttttttaaaaaatcacctataatttagtcatttagcacaaactattatttaatcgtcttttctggcagtcttatagcttgcattttaacgtagtcactatcatagtatatgtagttttgtatgcttttttcttttcacgtgatccataataacattccttttatgtaaaatctctgaattcgctatgaccttttatgactgaggctttttaagttttgttttgagacagagtcctggtctcacccaggctggagtacagtggtgcaattatggctcactgcagcctcgacctcctgggctcaagtgatcctcccacctcagcctcctgagtagctaggactatagacatgcactaccatgcccggctaatttttgtattttttgtggagacagggtttttccatgttgcccaggctggtcttgaacttctggactcaagggatccacccacctcggcctcccaaagtgctgggattataggcatgagccactgcacctggcccttgttaagttttaattaacttttttgtttgtttctttttttttttttttgcgacagagtctcactc

SEQ ID NO: 136486 - DNA, 1014 bp, Homo sapiens
agtgtggtagtatttcaagataaaataattttgctggactaacaatgttttggccatttggaagtagaaaataatctaatcgattactttttgcatagtaagtgtctttaataccttgtatttttcaagtaaaaattgtttcacttagaatttgaaggattttattattaaagtggcaaatatttaatgacctctgatttgaaagaactcagagccatgtatctgtagttattttctcctacttgttattgtacatgttttatggcatggaatttagtgccttaattataagaaaagatatacatctttctagttttgtagctatcttaatttttgataaattcttttctccacaaaatagtttcaaatttagttaaacatttgcaaattattctagggttgcttctagctattccacagagagacagatgtcacatgatttggttgctgttggcaggaaaagtgagaactttcatccagtgtttgaacatcttgactcaactcagaatactgaaaacaaacctacaggagaatttgctcaggaaatcataacaataatccatcaagttaaaggttggtatattttgcacatacgttagggataacacaaaagtaatatactattcacgagatacaggtaaacacctgcagtatagtttaatagtaattaatatttcattgtaagctagactgtgaattaggaaatcttttgaagagagtatcaggcattcattcgagcctagttgttctttatatctagttccaataaccttgtgcttcaactgttagtagattggaactttcaagttagaaagggagaggctggctgctgcgaaagaaaaggcatactgagagcagtaagaaacaataactggtaacctaacagggaggaaaaagcaacaaaaaacagataggaaactcaagaaatcaggaagcctaggtcattttatgattcttaaagccccctgagggcattactaggactttgtatcttaaggatgatgctgagtgatc

SEQ ID NO: 136487 - DNA, 2746 bp, Homo sapiens
aagcctcaatgttggcaatgctgaggtatggagaaggtagttccataaaggatgtgctgtccctggagagcattgtagctgctttaaagtataacttcaccgaagttacaagctctgttcgaacagcacatctttccatagatatgcaaaggaacagatctgggaaagaaaagcaacttacctatgttagaggtatttctggaggaactaagcatgagattcaagtcttaagagcctcttgttcccccttttcccccggttaagtacatatgttttgttccttgatacagccttagtagagaaagtagacaatcagctggagaaactctgggcctggcttgggtctgagtttgaattgtagcatcattaaatcttagactctaatttattgtcagaggtaatgttcagtttgctggagaccctcctacacattgatttgtgtgagtcttgccttcctgcttgtttcttacctggcctttgaactggatgtaagcttttgttgactggccctttgaagtcactgcatcttcttttgccagaactttgctgtcagcagtcttccaaaatggatcctgctgtgcacctaagctggccctcctccaatgggacaggtgtgctcagctcatttggataagcacgtggaataccttagttcagatggaaagagtatgcttgttggttgggcagtaccataatcagacccccagatgtacaatttagaatgcagatgtagcaaattgatgaatttagtttgagtggaagaagccgagggatcctaggaaaagcaactgtttttggtaggtcatattgagacacgcttagttgattaaatggtttacacttttctgtgtttgtttacataggtctttatcaccagtacctagaaatgctgaacactacaagcaaagacattcacacgggcattatggctgtgaatataggaaggatccaaaaagacccgtcgcgtggagaatggacagtgagaaacatggacagagtaaaccaaggattccctctcgtggaaatatatattaccagtcttatgaacatagatcaccttcccctaacataagaaactctttagaaaatgtttatatgtataagcctcacagaggatattcgcctggaagaggggacagtaacaggagagctcagtatatgcccaaatactcagagggtataccctacaaagagcatgaaaggaattcttatccccagaaagtgcaaggagggcatagtcctgatgaccacagagttagaggaagtggaaaaggagggaaaccacctcagaggtcaatagcagattcttttagatttgaaggaaagtggcatgaagatgagttgaggcaccagaggatacaagaagaaaaatactcccagtcaactagaagaggctctgaagactttgagacaaggagctcatttcagaagaggtataggaaaacattaaacctgggtaatttggtataaagcctcaagtgaaaagatctgtttactttatggttgaagataaccaccttgaaaagcttttgtctaaaaagacaaaaagcattgtaatttaattatggggtactggtagtagtgaagtatttctttttagagtaaatcatgttgatggctagaatacttttaaaagatggtattttcctctttaactgccttgtgcctatagaattggcttaaagggttatagattaacttgccactgcattctgcatttaaagccatgctgcccgacattctacacatataaattctccctttcttctctctattgcaagtgtaaactgctttatgtcaacacaggtatcctgaggatcgtgatttcagaaaatatggacacacatcaaaaagacctaaagacgtggagaggtatgaaagcagagagcctgccaggaacccaaagtggaagcctgagcattccctcccaccttaccaagaggacacagaccagtggaaccttgggccccaaacttatcgacatgctgagagggaacacccagagaccagttcagcaaccaaagtatcctatgactatcgtcacaaacgtcctaagctcttggatggggaccaggacttttctgatgggagaactcagaagtactgtaaggaagaagatagaaaatatagttttcaaaaaggccctctaaatagagagttagattgttttaatactggaagagggagagagactcaagatggacaagtcaaagaaccttttaaaccgtctaagaaagacagcattgcctgtacttattcaaataaaaatgatgttgatttgcgatctagtaatgacaaatggaaggaaaaaataaagaaagaaggggattgtagaaaagagagcaattcttccagtaaccaacttgataaaagtcaaaaacttcctgatgtgaaaccctcgcctatcaatcttaggaagaaatcacttacagttaaagtagatgtgaagaaaacagtagatacattcaggtattatctttgttttttctttatgatatttaataatgtttctacaatctttatttgcagcttcaaaaatggaattaatagtgtgtttagagtccatcaagtgggagggattgccaagaattttcccccccaaaaaaaaagccctgtagtgaggctgtttcctgtgattagttacatgggagcaatttcatgtctccttgtttccacatcctatctccagatgcttcttggatgcggggcattctgtggagttgttcctcttcatgaattcacgtgt

SEQ ID NO: 136488 - DNA, 1001 bp, Homo sapiens
ttttatttttttaatttgaccaacatagtgcctttaacctagtatattcaaaatatttcaacatgtagttaatattagaaatacatcaataaaatattttacattttttatatgaactctttgaaatctgatgtggattttacacttacgacacatctcaatgttgtcacatttttacatttttaaagagttgctttaaaaaaaagaagaaacagatgtgacagagaccttacatggcctgcaaagcctaaaatagttaccacttggcactttgcagacagtttactgacccctgatttaattcattttatcctgacaacattccaataagaaggggtgctattattatcatttccatgttagagatgaggaagctgaggcacaaagggtttaagtcaattggcagcattcgctatgttttagatcaaattgtagggtctttctacaaacctgctaatcctgtgtttctttgcagtgtaaaaagtggatagtggctcacgtgtcaaaggatggcacggtcacgatctagatcccccaggtggaaacacaggtgagcagttcttagcagagtaagcttggatttgggatgtgctgtgactttcaatttcaccagtactagtaaacacttaagctcatgggacctggttattcacagtaggtactttatcatagtggaggttgtatttctacattctagtagctgacagctttgtttaatcatagcaggtggctagagttaaataatgaaaagcagtgcagtggccacagcaagagagagtgagaaatatctttgagagtattacattttttgaattagtgagcagtttagaactcctcagtatggatttcattttattttttcataattaatatgtttaaagaaatttcgagttagaaaatagggagtttcctctttcttcttcatggcagaataatagagttttgaatagttcgattatagtccatttctccttccttcttggtagtatcaaaattatgta

SEQ ID NO: 136489 - DNA, 1776 bp, Homo sapiens
ttcaagcgattctcctgcctcaacctcccgagtagctgggactacagccacgcgccaccatgcctggctaatttttttgtatttttagtagagatggggtttcaccattttagccaggatggtctcgatctcctgacctcgtgatccacccacctcagcctcccaaagtgctgggattacaggggtgaatgagctgccgtgcctggcccatttgaattttaataaaactaattttaatattgggtgaaggaaagtgttcttaataatacttcttttatcacatgcaataaatgtcgcttgtaaatattttctcccaagtgatgtccacttttcctttaaaactagtggttctgtagcccctggaccagcagcatccacatcacctgggaacctgctagagtggggcccaccccaggggtagggcccagcaatctgtattttaaccagccctccaggcgattctaatgcacactaaagtttgagaactactccagtgtatattcctgcatggaattgctgggctgtgggatatgggcatgttcgactttattgggtatttccaaactacaggtgacacttgaacaacatgggtttgaactgtgtgggtccacttatatgtgaagtttttcccaatgaaacgggtatagaaaatacggcatttgagatatgtgaaagctgcctatacagagggacttggatatgcacggattttggcgtatgtggggattctggaaccaatcccctgagtgtaccaaggggcaatggtattttcaaactggttatactgtaccatgtacagttcacctagcagtaactgagagttcccattttcacacatctttgccaacactttggaatatgcaacttaaacatttttggcctatctgatgggtgatcatagccctttggcatatcaaatggctatgatcttaatttgtattttcccaattgctaattaagttgaacatctcatacgttcataggtcatttgagttttgtgttctgtgataatggagtcttttgcctattgaaataaatacagttatgtaaataaatacgatgtgttgaaataattgcaaaataaacccagaattcccaaggagaaagaagcccagagggaaaaaacagaaagtccaggaaagagtcctaggggatgtgatagttacacaatcgggaaagaatagggatttgtcaagctgaccgagggaaggccatccatgtgctggacgagcatggcctgatcagggaaagcaagtagtgtggtgtaggggactagtagggtgtgtgggggaaaagacacacataaggctgggagaaaggtaggaagcaactagatgtatctatcttacatttgtttaatcttttttgttgagcatttgggttattagttttcttgagctttttttctttcctattataaataaaactgatacaaacatcttagtgtacacagctgatttttttcttttgaattattttttaaaacaagtttaaactgaaattactagattaaaggaaaggaggtatgattagtttcatagtttcttgtaagaaacatgtatgtttcaagattactctccattagtcattagggaaatgcaaatcaaaaacacaatgagataccacttcatacccactaggatggctatagtcaaaaatatagtaagtgttggtgaggatgtagaaaaattagaaccctcatacactgctggtgggaatgtaaaatggtgcagctactttggaaaagtttggcagatcctcaaaaagttaaacata

SEQ ID NO: 136490 - DNA, 1049 bp, Homo sapiens
tgcagtccagcctgggcaacagagcctccgtctcaaaaaaaaaaaaaaaaaagaaaaaaaaaaggaatcactttggtttagatatgtcttttgtattgtaaaagttgttgaggtttcttctgttagtcaaattgaaaatttttattgtaataggtggattaagcccacccacatttattgttaggactgaaaaatttgacctcaaatccatcataatattttataattatgtgtatttgttatctttgccatttctctatgcgaggtagatattttgctcttttattacaaaaattagggtgtgtgtgggggtgtatttaggaaggtttgcatttttgttctaatcgtttacctttgtacttacaccttttaaaataccctcactcctttgtttgcttatttttctgtgcatgtgtgtgtgtgtgcgtgtgtgtgtgtgtgtgtgtgtgtgtgtgtgtgtgaaattgcatctatgtaatcaaagtaggataatgatagacaactgtggaattctgtatctacttcgtgctcctccttactgaagaactggcaataacagataacagctacccaccgtggccaagataataatccatgatggtctcttcaggtctaccttccccttctcactattctactgattgtgctctttttctgtgggctctgacttggtgcgtttctgtgatgggagtgtggcttttttgtttgtttgtttgtttgttgttgttgttggagagagggggtttcactgtgttgcccaggctggtctctaacttctgggctcaaaggatctgcctgcctctgccttccaaagtgttgggattacaggcatgagccaccacgcccagcctgaggcttctttgttgcaaaggctttcctggggaatttttattctttgcatttgtaaatgctgaattcacatttagtgtggaatctctgtcagttgattttttttctgtaacagctttgttgagatagaattaacataacacaatttacccatttaaagtgtacaattcagtgttttttagtatattcatagagttgtg

SEQ ID NO: 136491 - DNA, 1037 bp, Homo sapiens
gataagttatagttatatgggaggcttagatatgtgaaaaaatggggttctgcagtcatctgtggtttataggcctgcccattttgtagatgaaaagagaagcacagaactaatgaggcctctaaaagaggaaaaggttgggtggcgctctgttttgagttaggagatgatgtgtatgggacgtgtgccagttccagaacctgagtagatttaacagggtctgcattctcacaaaggctcagataagtcactgaaagtctgtttatacctttcagagtatacaggttaaggaaatgacggaagctctccatgcactaaatgtttattctaaagcaacattgaagaagtatcaggtgccagtggagtgtttagcacaagttatcaccaagggcagagcaaaaggctggttgcgacttggcagaggctggtgtgccttcctggttgtttccactgacattgaccttgtacctctatcccagaggcatattatgtgtgtcagagaccctataaggttcataatgctactgatctgtgatgcagttcatggtaagcaccaggaacctggaagtgatgaagagctgaatacagagtgagggaaaagttaattcattgccatatataatacattcaaaactgatctaaatattttggtcattgacttccagattatgaatactactatttgtctttcattaaagctgataatcagttggctgtttgtatttttgtgcctctcacttaatttttacccttattgacatgtaaaaagtatgaaaagatatatttttatactattacaagatgacattttatttaaaaatcagtgtgttatgaaatgcttcttagcgcaggacctaaaacaagtgttttataggcataatttgttttctacttggagtaaaggtttttttgttgttgttttttttgttttttttttgtttgttttttttttgagacaggctctctgttgcacaggctagagtgcagtgatacagtcttggctcactgcaaactctgcctcccgggctcaagccatc

SEQ ID NO: 136492 - DNA, 1068 bp, Homo sapiens
gctggtgatgatgactgtgagcatgataataaagattttctggaaagatgatttgaaggtgtgactctcatgtgtgtccatgagagggcagcctaaaatcatgcatgtctgtggaacaagcagcctctgtaaagcctcaaggtaatgtgggcagtttcaagtgtgtttggccctttttcttctctgtttttcttttttccctctgtttgaagagcgctttcagccattttcaggcttactttagatacggagcaggcccatgaacacctagagggcagcatgggcagtacagagctaggttcaggccctgcctgggtgggtgagtttgtgtaggtgccaatgagagcgtctgtctaggcgtcctaggcttttctttgtaacttttcacacagaactaattcttattaatcagactcttgaggtagacactagaacctgactgtgtttagagaaaaaagaaacttgattttctatgcttgttccccttccactaacttcacacctgcctctgagcattgtgtgcatgcattggtgccaccatgtaaggggacagtggccggagctgtatagacccagagttgcatcagccacacatggctctggaacacaccaggggagactgagttacagagagagcagaataagagtcctcaaaccatgtgggagcacagagcatcatagggctgggggacagtgggggtcttgaagatgggcagggtttaaacagatggagcagggtagaataaaggatggcatgagctagaaggtgcatgggagaaagggcagtgctgaggtaaagttgggaaaagagtttggagtcagattgcggggtggctggaatgagctgaggagttggcctttaaatttttgatgacgttcatattgttgatagtgtcataatgattaagagatgaccaaaaacaaaatgaagaatggcacttggatttttctagtacttatctcattttaatatccctgatatttaatctaggctgcaaaaccagatgtatgtggggaatcatgacaatccagtgtttgtcacgccatcccccttcctcattcccactg

SEQ ID NO: 136493 - DNA, 1107 bp, Homo sapiens
tatttttagttaataaggcaggctatttttaaaacattttttattgcagtctaatatgcatttaaaaaaccacacaaaactataattcgatgaattatcacatagtgaagatgggagtattttatatacgatgggccaagaaaaggaaagaaatcaagagaaatcttcttaaaacacgctttttcactggggttgagggggcgaggtagtattttctgactgggccttcagttgcatcattcttaggaggaggagatagcttaaatcatttccagtttgtatttttcattatgctattttaaaggcagaattcattaactgtcacaggataacgttataactacctttgaaatgtgtgcttttgtttttatcctttttgcttgaaacactcaagctgcatctgctagggaagaacctggaaactacccaccagaacgaccctccgtggcagaggcgaccttgtataataaaacactgaaaaggagaggttgtttcagtttgcatttttatttggttgagagcttaaataatagtttgtttcgatgttctgttgtactcatgagaggtggggaggggcggtatgattgggttttcagtgtatcttggattttatttgaaggaacttaaggggtttttttttttttttttttaatggaaacaaaattggggaaggggaggaggtacttttgcgggggagattcttaataagttctgtttggaaactattgtagaatcatttaatgcactcttctgatattaagattagcttaaggatatcttccttcatttgaaattggaaatatagaaaaatatgtgtgaaggtttaaaatgtgaaataagcacctatgtgcattaaggttggtatggtaaaattggaatgtttaatttaggtgccaggtgataccaccatttgttgtttgggggagttagcaaggccaggtacttaagtaaagtctccttagaaaaattatgattttgaggttttataattatctgtcctggatactgatcattcttggttacccaggcccttagcatttgggacccattcctaatgagacttaacctgcttttctagagagtcaaccattgttcctaagcttgggc

SEQ ID NO: 136494 - DNA, 1026 bp, Homo sapiens
acttcgtaagggtaagttttatttatactctttggactcccatgaacttttgcacactgctttgtgtttttggtttaccctaaactaccatcctttttatctttgctttttttcttcctattcagaaaagagcaaaatgtgaaaagacacaagactctcaggtatagaatgaactgagcaatttggagaatgtattggactttgtcctctcttattcccccctcctagccctgcaagttgctaggtacttgtgaggcagtgtactggagaggggagagcatggatcctggggtcaaagggcctttgcccccacccttacttggccctctacctgcaggtgaccactggcacattctcctgcttgtctcagcttcaggttcttcacctctaagatggggatgatgaaaacagtacctgtcatgcagaattgttgggaggattgataatttagatgtttatacatgtaatgtacttagatcagtgtctgctcttttcacttgatatccagtactatgtaagatagaaggtgcatgtcttctgtattctgtatttcccatttcttttgcgtgcagtctttgattcgtacaatagaaggaacacgtagaatgtatatttgtacattcatgtcaacatagtatttgaaattgctaccaaactcatttaatttggcataagactaacagatgaagtctctcatttgcttgaagatattttacaaaataccaactgttctatatttctttagaaaaagattatagttattaatattgatacctctgataatattttattcttaaatcttcagtgattccttttactatagattcatgacagctaattagtactaactgatttagaggtttcctttcccatcatatggaatgatgtaaagaaatcagatacaaactactgcaattagaaaataaaatatgaacaactttcaacaatgtatacaattgattcttttctaactttataacattttaaactatttattcatatgactcttttccaaaaatttgctgt

SEQ ID NO: 136495 - DNA, 2472 bp, Homo sapiens
aactataaccagattgactcaggagaattaggtcagtatcacactgaacgggatcaatcatatcatgcttcctgtgtctgctcccatccatgagatacaaaaatctcaaattacaagcattaaaggaaggagacagtaaattttattaagaatattttgcataacatgtaacattacaaaggagatcatcacgatttacttatagcaggccagaattataggaatttcttcttcaaactggatttgtttctcacatagcctaaggaggtgaaagtctcccttatatatggagtagactgttggaatataagaattctttttcctttcatctgatgttcttttcccttccagatctaaattgaactcaacattttacattccatcttttctgaagattgtcctacaatttggattttgatcatgacaaagaagattaaaatttcattagcatgaatgcaatttgttaaagcagactgatttgtttctaagatatttttggtttttttaaaactgataataatgctgaattatcttaagtgagatgttaagcccactttgttcttttaatgtaatggagcttatgggtagaagaccatgtctactaattacaaaaaaaaaaaaaaaccatgcattgctgcttttcctaccacttccagtaagaaaatgggtgttttgaagaaatcatttgccttgtcctcacggaatctgattaagccctggcctcttgattgtatagagtcattgtgtatattccagttacctagatattcccttgagattttgatacaatttgagggaggcagaagtctgcagttgaagaaaaaaaataagtctgtttgtcatatttaagtagcctgtggctatttttatactgattttgatatcatgttcttttcatagtcgtattttgccaccgtaaacataaaaaaaaaaaaaaagatttccaaaatgccgttttcagaacctgggttttaatagcagtattgaatttgtaagcttagtagttgcagaaattgaacactaggtggcactcagttatcttaacaggggaagtactgatacaattgttgacttttcttttactatgtgtaagaaataccccaaacatgaaaagattgttttgatcatatgcatgtatgtagaatatttttgcagagcagaaagattatgttagaagtgtgatttttattttcagaagtcatatacatgtaagctacaattttgagtgctttataaacacttaagatatatatataaattttaatttcatagcaacttgtaaaaaataaaatacttgttgaaaagcctttttcaacatatccctaagctaagggaagaggaaggaataacaactcagtgaaaagatggtctccagtttctgaatgaaaaagctacagctgagaaataaaataaaatgtcatgctgcagaatatgttatacccttattttgtgttaaggatatattttattatgtgaatggttttgtttttgttttttgtttttgttttttgcttgtattgggaattagctttactggtaacttccttatttagtttttagtggtcaactctaataaaatgaaactagggctgagctagttagccctcactagccaaactgaaactctatgcaacattaaaagaagagatccatcatgtagcttgtgacacttttattttattagtcaccggggaacttttcagtgatgaaaatacacagggtaataaaccttcacatggcttcaaaaggaaaacaagcaaatcttctctaatctactcttactataatttcctaagtgtacaccaaactctggatttaaaaatctgaagtactatagaacattaagttgaagaatggaaattaagagtacgtattcatggtttatatttcttattctatggagttcgtgaacacatctaggtggaatgcatctgagactaagggctggtttttaatcctcataagaaaccagccttgaagaattaacaattctcttcattggtattctaaacctcctaagatatttaggcttctgtacataaaagtgtttttgctaaatttacagtatatatagatcctttcatattattttactaagaatgtttgaactttgcatatttgatatagttcctggtaggaatagcacagctcaaacattagtttttctacttacctcctctaacacgtggtttgtctggagagtttctaaaaattcagctataaccccagttcatgtatttactggtgattgttcttgctgaggtagtaacagcccaatcttgggctgttaaatcctaggaaatctcgaatcatagtgattaaaatagttggggtaaagttgtagcttatatgcaatactacttggaggaattcttctactaatttgtatttaatgtggaaattgtatagtttcattgatttaatcataaataatggaaatggtctccaagaagttttatttttcattttttt

SEQ ID NO: 136496 - DNA, 1048 bp, Homo sapiens
accagatctttctgattgatgagtctatctgatgattagtgaaccagctattcttaaggaaatacgttgttaccatatttccttgtatgttgagaagtatacctgaaagttataatagcttcagaattagtgtaattagggccttccttactaaaaatacctttgcaaacaaaagaaaatggtaacacagatactcccatcttgacttagcagtgacactgcaggaattttttttcataaaatattctttatagttattgtcttatataaaaggaatgctcttatgatgaaactttgagtaaattacagtgctgacttatgagtatttcttactgtgtccttagctaaaatcaatgaaactgatacatttggtcctggagatgatgatgaaattcagtttgatgacattggagatgatgatgaagatattgatgacgtaagtagatgtaccttgtgttttccaatttttgttattatccatggagaaaccaactttcccctaacatccattaattttaagaacatgggacacttaaataaggttgtattttgagaattgtctgaattaaataatattatttagaagacacctggtcaaactgtttatattttgagaattctttttttttttttttttttttttttttttgtgatggagttttgttctgtcacccaggctggagtgcagtggtacaatctcagctcactgcaatctctgcctcctgggttcaagcgattctcctgcctcagcctcctgaatagctgggactacaggcgcgtgccaccacgcctggctaattttttgtatttttagtagagacgaggtttcaccacgttggccaggctggtctcgaactcctgacctccggtgatctgccctcctcggcctcccaaagtgctggggttgcaggcgtgagccaccatgcccggccctattttgagaattcttataaccctcttcaatttctcttcctgaaaaggtcagtgtttgcattggcaatattaacgccagccactctaatcataacttgtttaattaagagtctct

SEQ ID NO: 136497 - DNA, 1032 bp, Homo sapiens
cctcggcctcccaaagtgctgggattataggcgtgagccacaatgccagcccaaactaaaatctcttaatttcttttctttttttttttcttttaaagaagtttatttatttgtttttttgagacggagtctcactctgttgcccaggctggagtgcagtagcgcagtcttggctcactgcaacctccgtctcccaggttcaagtgattctccagcctcagcctcccgagtagctgggactacaagggcatgccaccacgcccagctaatttttgtattttttagtagagacgggtttttgccatgttggccaggatggtctcgaactcctgacctcaggtgatccgcccaccttggcctcccagagtgctgggattacaggcatgagccaccgctcctggcctaaaatctcttaatttctaaactaattgattgttactctggaatttcttgattcttcgttattttaaatgtgacgggcagtgacttttcttttgtaggtttggataaatacctcggacattattttggttggtctccgagactaccaggtaaaatttacatgtaaatttttcctattttactggcttgaatttgatgagccatttcttaagagccagttttgtttcaggcattgtgctaggtatcccagggatttatgtttaaatcaaaatctgggagccattattctaggggatacagctgaatgagttaagtgcccatcccacaaaaggctcatagcctggtagtggagagagttaagcacacaagtaattacaatacacatcacaacataggtatgtgctataaatctaaaggagcacttgggaaagaaagaaagtggtggttgcctttcgtgatggtaacccttgactctgtagactcattgtgggtctgtgagatccatttgacatccacctattggaaatcatccctgtatgatactatctctatttgtatagcctcgatcatactttgatttaaaaaaaaaaaaaacccagaataaataatttaaatcttcactttaagcca

SEQ ID NO: 136498 - DNA, 1076 bp, Homo sapiens
gatctctacagttctgagaagcagaactataaaacaatgtaaaacaataagggcatatgtctggtgtgtgtgtggggggtgtgtgtgtgtgtgcacgcacacgtgtttataaaggtagcagttgtaggaatgaatgagattgggggtgagggggtgcatatgtatgtctatgaaagcctaatcatttctgggcaatgatgtaaaggttttacgactgacctttgtaactatgaagttttctacacttgacctgagctcagaaaaaagaaagaaagaaagaaatgtcatcatagagtcttagttctagctctgccgttaactaacttgatgtttatcactcccttatgtttgtttatagttttactatatgtatttattcccaactggtgcaactttattctcttgacagttttatgtggactttaagttgctgttatcaaaagttgaacaatattccatacccttttcctttctccccgctagagtatgctcaggtaatcaaaatgttgggaaatggacggctagaagcaatgtgtttcgatggtgtaaagaggttatgtcacatcagaggaaaattgagaaaaaaggtaggtgtgatttgttttactttaatataaaattggttaagggggaaaatccctctacagtttttaactgtccatggacttcatttttggaaattcccaaaagacttaccttggtaaacagtgatttacctataagtaaaatagcaaggtctgtaatggtaattttatacaggttctaatgttaaagaagcatttgtatcacttgtattgtattcctgcccaaaaagtccaaattgagagacattctgcaaaaacaaacggcccagttttttttttccttgtcttttttttgatacagggtctcactcttatcacccagcctgtagagtagtggcatgatctgggctcactgtaacctcaccctcattggttcaagtgatcctcccacttcagcctcccgtgtagcaggggctacaggcctgtgccaccatgcctggctaatttctgtattttttgtagagatggggtttcttcatgttgcttaggctg

SEQ ID NO: 136499 - DNA, 1068 bp, Homo sapiens
cgcacaccactgcacccagtgagatttcaatatttatggtactctgctaccaaaagtttgaaaaccacagttctctgtccagacactgtcttcacttaattttgaaagtatcgggttccttgcatagggcctggctttagaagacacccaagatttccgcttagaagaatatgtatagaattgcatttttatttcaaaaggatgggtgctaaagtgaaatgtttttctatattttttaacataatatctgctatttatgtgtattttatgtcagaaaaatccccaaaggaaattccaagaagggtagggaggtgataatgtgttaatgttgggattggagattgtaaatttaatatgattgtgtagctaaaatagatgaattttttaatttaagtgatcttttaaaaaatggttttataagccttaatttcattttatttcatactgttttacagataattaatgtcatttacctccttttcttttttttaaaccatcaggtaaaggaggtaaaaacagacgcaggggtaagaatgagaatgaatctgaaaaaagagaactggtattcaaagaggatggtcagggtaagtgttttcataaattacgctttttaaaataacatcctttcttttttagctggggactttatttttttgagacagcgtcttgcccatcgcccagggtgaagtgtggtggcacgattacagcccactgcagccatgacctcctgggctgaagcagtccttccacttcagcctcccgagtatttgggactacaggcacacaccaccacgtctggctaattttaaaaatttttttaggctgggcgcagtggctcacgtctgtaatcccagcactttgggaggccaaggcgggcggatcacgaggtcaggagttcgagaccagcctgaccaacatgatgaaaccccgtctctactaaaattacaaaaattagctgggtgtggtggcacgtgcctgtaatcccagctactcaggaggctgaggcaggagaattgtttgaacctgggaggcggaggttgcagtgagccgagatcacaccactgcact

SEQ ID NO: 136500 - DNA, 1530 bp, Homo sapiens
gagatcgcgccactgcactccagcctgggcgactctagagcaagactccgtctcaaaaaataaaataaaaataaaaatatacatattttttaaaaactgagctaaccacgaggttaacgagtcagccacttgtgaaaccgggagacgcgcgtttgctacaaagcagcagaggtctggtcttaaccagcagcaagcgccacctcaacccgcccttttctatgacgcagagtctctccccctccctccctgactccgccttttccctgcttgaggccctgcccctcgcgtcctctctggcttgctgcgcaccctcccacaacgcgtctccctcggctctaacaataggagtcagtcggccacgcctgcgtcataaagcctgggggcgggcccagccggcgacgggaggcggggaaaagcgacgcaaagagtcgcggcgccatttgctgccgccgagcgtggacgcaggcggatctctgaagagctgggtcgccagcctctcccgcgcacgttgcctggcctccagcacctacttggtcccgcgcgctccctcgtgtcgcccctcggagcagcagccgccgcggtcgccgctacccggaaagaagtcagagacgccgcgaggtcgccgccaccgccatgcccaagaataaaggtaatgccgcccggacccccggaccacggctctgctcggccgggtctcccaggtcctgcccgtagattgcaggtcacccaggccgcagtgaccctttttccttcccgccctgcctgcccgcggctgggcgccccacacgcgactctgagctcgggagaggagctgggaagttaactcctgttgcccagtttggtcacattggggtggagccggcgccatttttgtagggcctcctgcgggagaatgtgggcttttgctcctgattcgcgccagactgaccgctgctcggtggggacggtggcgggaaccttccccggggcggcctaggtttagtagataggcccctttggccttcccgggcatgaggggttataatccctggaagccgttctgaactttcagagtgctgtctgcattcgtgagcaccaggtactcctgcatgggtttctttatggacagttcagtattgttgaggctactcgctgtcccttgtgaacagtgggtgaaaccttgatacatttctaaggctcacctctagagatttactctctccatccctttacaggatatagcttatgtttgtttgctgaagacttattccatattgagccaagttttctacttttgcttcagatgatgcatatgttgtgagaataaagacctaatttaagtgtcctccattctgaggctaagcgttcacaaatgatcagacttgaggataactttatttgggatttccaaaacggaaggcctaatcttaaaaaaaaaaaaacaaaaacaaaaaacagaacactcctaaagaaattacttttatagatttacagtgttcctgtcatttttaatagccgtataacttgaagaaaattgtgcaagtaaatata

SEQ ID NO: 136501 - DNA, 1016 bp, Homo sapiens
attgttagcaagttagattttcctggagcttcggaagaaatgaaaatggaaacatgatgaagatatagtcactgaatcaatgagaaaaataatgaacatatgaataccacctaaaaatacactgaataaagtacaccatatagcattatttttataggaaatatttcatgtcccttaaatattctttgttagttatagggatggacagtttatgttaagcacttagcttaaacaatccgtttatattagcactgtatcccttgtgccatccaacattttgtatgtttttgtaaacagttcatatacagtacatttctgtactgctttctttaatgtatacatgccttgtttaacttggaatctattattattaatcaattgactattaaatctggttaaatagttcacctggattaacagtattgttggacagtcctaaaaatggccagattgtggaacagctgttgaatgtaatacttccaaaatgtacatatctttccccacgtctgtttcactggttcgttcatttgtttgtttcttaaagtcaggtgctctgtcagactaacctagagagctgttatggtagagaaagttatcatatgtgtgtggcatgaaatcaagaatacacctatgaagttagtccatatactttgcaactccttagagtacttttttccttaattaaggaagtagtccttgcacttctaatcttacatagcatccatacttagaatttggcatatcatctgggattttgccaatatacgtcaaagccctttaagagtcatggtaaggagatgggtgaaggaaaatttagcaacaggtaattgaagtcctattggatatttcatgtttaaatagatattctatattaaacactaatttaaatgtaataaaggccaaaggcctctgtatgaaattggatttaaactttcttattttagggaataaaacattattgatcaaacagtatctgttctaacctaaaattataggtagggcaggctaagtgaaca

SEQ ID NO: 136502 - DNA, 1060 bp, Homo sapiens
ccaaatttctcccacgcccagcccaattttctccattacatacacctccctgaagctgtcatctttcaccagtccattttcctccacactcagtgaatgtgatctttttacttaaccgcatcactccctaactttaaacactttattaccatcaaataagtccacgtttgcaaatatggcttacagggactttcctgatctggtcccttctcatctctcccactttatccactgccacattctccttcacggtaaatttatgctgtagccgcattgtactgctgccagttccttaactgtgtcgtcttctctcccacctaagagcgttcctccaaactcactctccattctctctactctacctgaggcagtgtttcccccttcctttctctaatctagctcctgcttatcctacaggtcttatcttcctcttaaaaagtcccttttaagccacctcacacagtacagtcaggtatctctgtgtccctccagctgcacctggtgtttgttcatcctgtcaaagaacttacttgctttgtgattattgattctttatctctccttcactgaactgaaaacttcatgaagtcagagttcattttgtcttttttttttttttttttgagacagggtctcgctctgttgcccagactagagtacagtggttcaatcacggctcactgcagccttgacttcctgggctcaaatgatctctgcctcagcctcccaaatagctgggacctcaggcatatgccaccacactcagctttaaaaaaaaaaaaaattgtagatacaggacctcacaatgttgcctagacttcatttctgtgttgttcattgctaactacccagtgcctagcagaatgcctggcctttactggatacttaacaaatgtattttgaatgaaaaatttaaaaaatggtggcttttataaatgacagtggtgttattttgaagagtgtaaaaccatgtagtgattatatgcatctacattgcatgcataggaatggcatttagatagatatgcagtgctaacagtgactgtctctggaagagtgg

SEQ ID NO: 136503 - DNA, 1045 bp, Homo sapiens
actaatttgtttatgttgtatgtttgttggtgtttgtttttagcggggagtagatatttgttttgtggtggaattattaactatttagacaaggctaggcctggtggctcacgcctgtaatcccagcactttgggagaccaaggcgggagaattacttgagtccaggagttcaagaccagcctgggaaaaatggcaaaacctcatctttacaaaaaatacaaaaattagccaggcatggtggtgcgtgcctgtagtcccagctactcaggaagttgaggtaggaggatcacttgagcctgagaggttgaggctgcagtgaactgagatcacaccactgcgctccagcctgggtgacagagcaagcccttgtctcaaaattaattaattaattaattaattaattagacaagtattgaaaacaaaggctgagcaatatgtatatttctccttgaaataaaattatcagtgaatccatttttgataggtgcaggaccagatggagttgaagaaattaaaagacattcatttttctcaacgatagactggaatgtaagtatagaatgaaaacttgcttgaaatatttctttataattaaaatatgtctaagtctcttttttttttcccctccagaaactgtatagaagagaaattcatccgccatttaaacctgcaacgggcaggcctgaagatacattctattttgatcctgagtttactgcaaaaactcccaaaggtaaggagaaaatgtgaaaatccaaatataagacaacaaatatgtttttttcttgtttcatcagaaaatcttttccagactctgggcgcggtggctcacacttgtaatcccagcactttgggaggctgaggcgagcagatcgcttgaggccaggagttggagaccagcttggccaacatagtgaaacgctgtctctactaaaaataccaaaattagccaggtttggtggcatgtgcctgtaatcccagctacttgggtggctgaggcacgagaatcgcttgaacctgggaggtggaggttgcagtgcatca

SEQ ID NO: 136504 - DNA, 1009 bp, Homo sapiens
ggtggatcacttgaggtcgggaattcaagactagcctggctaacatggtgaaaccctgtttctacttaaaatacaaaaaaatgagctgggcatggtggtgcacgcctgtaatcccagttacttgggaggctgaggcaggagaatcacttgaacccgggaggcagaggatacagtgagccaagatggcgtcactgtactccagcctgggtgacagagcgagactctgtctcaaaaaacaaacaaacaaaaaaaacttgtattagaaattttaaatgattaatgtcagaactcaaagtttaaaatttacatgtgcaaatttatgtaggatatttatgatatttgttttggcagatttcggcctaagtaaagagtctattgaccatgaaaagaaggcatattctttttgtggaactgtggagtatatggctccagaagtagttaatcgtcgaggtcatactcagagtgctgactggtggtcttttggtgtgttaatggtaaggtttgaatttgggattttttagaggggaaggagattgttaagtgaggatcagcagtgaatgttaaagaaactggtgtttttattttctttattttatgccatatgtaataaataaccaagaaacattattgcatgcagtatagaaggactatgaaatctgttagctgcgtctatctcatcctaatttgaaagggcaaaaaaaaatattaccatagatttcctgctaatagtaacaatctaaagcattaatggtgtttggtcttttggagaaactggtccagaaatctgttagtaagtgacccttaaaataagttcgtttggccgagtgcagtggctcacacctgtaatcctagcactttgggaggctgaggcgggtagatcacctgacgtcaggagttcaagaccggcatggccaacatggcaaaaccccatctccactaaaaatacaaaaagtagctgagcaggatggcacacacctcaggaggctgaggctggagaatcgctagaacc

SEQ ID NO: 136505 - DNA, 1043 bp, Homo sapiens
agatttatatgcagcttttgtatacagaaaagaccctccatcagtgaatacttgtatcaacaggaaattgtggtcaagaaggaaccgccgtataacaattttgacgggctcagtagaattctgttttgttaaaagcaggacatcataccacctgtgttatactttaaacattttgggattttttccatctaattcatacatatgtagtttaaagggtttttttctgtcttaatgtgttacatgctctttgggaactggcaaacaacaaaatgaaaaaaatgtattcccttatattgacaccccaagttataacaaatgtttataactagtatttataattgatacattttaggggaaataatctacagtatatctgaatctatattataataataaactgtattatagcagggtcttattttaacaaggatatagtttatactactttgtaatatttattttctcttacttaaatgcaggttttcttagttaaaaaaatctcaggctctgatgctaggcagctttatgccatgaaggtattgaagaaggccacactgaaaggtaagtgttgctgctatttgtaatgttcatgtagtctaaacaaactgaaaggtctcaatagagctcatgggactccttggcatgttatttacattctgaataggttcctgttaccagctttaaatttaggctgacttttagtgaatttttcctgctaggctaggaatcatataactagtgagaaccagagttgccacgttataaaagacgtattataaattcatattgagttttatacaagtaaacatttagaagattaaaactgggtttgattcatcttcaaatttatatatttattttaatgtttttaaaaacgtactgatttactggctgcaaaatagcttttattctaaaggactttatgacttctggtctccaagtaagtttttattctgagcctatgatttgaaaaccctaatgcaggatttggctctcataggtaaaaagtagttaagaagaggccgggcgtggtggctcacacc

SEQ ID NO: 136506 - DNA, 1029 bp, Homo sapiens
cccgggtgagcattgccgtttgagcaccacctcctgtcagatcagtggcagcattcaattctcataggagcacgaaccctgatgtgaactgcacatgggagggatctaggttgtgcactccttatgagaatccaatgcctgatgatctgaggtggaacagtttcatcccaaaatcatctccccctcccaccgcgccagtctgtgaaaaaactatcttcatgaaaccagtccctggtgctaaaaaaggttggggatcactggtctagattgtttcttggcaagaggaaaatttggagattgtattcaactttgacgatgcagtgattccttaccacttctctgtaaggaaatatttgaatatatcatgctttgcaagtttcagaacagcaccagtttagctctcttgtgtattttagtgggggtatttagcaattcttggctaacataggtaatttgttacagttgttaacctcttttgaacccaaaaggatgcttttaatccaaataaagagtaagtagccatcagagcgtaatggttgtaagtttgggctctaggtcagccggacttcaattcaattttttttcttctatttattcactgtgtgtgcttgagcaagttacttaacctcttggatccccatttccttcctctagccagtcattaaatattgaagttcttcaaggttcgattctaggctgccttcttctctgttactaatactctcctaattgattttctctgtgcctgctatcttaattgtaactcacatacagctgacataacacatttatatctccaatctagattgcttctccaagctctgaattcttatgcacagctgcttactctttttctatgtcttaaaagcactttaaagtcaacatgtctgagaccaaactcatgatctttccctaagcctcaaactgttctatttcatttttctctcattaagcaatttagaaacttgggaagcgttcttgatgtatatttctagtccctacctcccctatcccactctgacctggcca

SEQ ID NO: 136507 - DNA, 1039 bp, Homo sapiens
gccaagattatttttcttctggaatttggtactaagccaaactatacaaatgggaagacaaaataacaacatttacagatgtgtgaggttcagaaagttttcttccacatcacctttctttggaagttacaagggggtaatctaagaaagagacatagaaaactgaaaacagtgaattcaaccagaaaatcactgaagacctatcccaagatgatagctgtgcagcgggcctacagaaccaccaatcccgatgggagggtaagagaggtctccaggatagaaaggagctctcagaagaaaggaaaatattgctaagggctaagaaaacattaagaatagtggtcaaattacttttccctttccccaagaatggtggaaggctgttaaaaataggaaaaaatagaaaagtgcatgataaattcatgatccaaatgggaatcaaagtaaaatttatcatgaatttaaacatttaatgaagttttgttttttttttaagtcccctcagattggcctgggagtcgttgttatgggcccatataaaaggaaatttagtatattacctagccttcatttgaaccatatattgtcatgataatgtggatgctgttgtctataggctttcaactttagaatcaggctatagagagagcatgaaggatttggttgtggctgcaggaggaaatgttaattttcttttttttttctttattttattttattttattctattattatactttaagtttcagggtacgtgtgcacaatgtgcaggtttgttacatatgtatacatgtgccatgttggtgtgctgcgcccattaactcaggaaatgttaattttcttaaaattaatagctttaatattaataaaattacatacagctagcagcaaatgggaagaagtttaagaggaagaatatatgggcactattagcctccttttgcaaagggaagagttaggattctgtccaaagcagagaaaagataagaagtgtatgtaaaggtaatataattaccaaacaatagagaggaagatgatg

SEQ ID NO: 136508 - DNA, 2057 bp, Homo sapiens
actctatttgtgttttacagcagtaccacactgttttaattaaggtatcatttcaacttggagacttatttcagattttggtgtctgaaatattgcttcattttagtgctgattattaaaaaccataacacacgcaaaatgtgaattattaacctgagcactggtagtaattaaagccaattttcactaatcctttaagtttaaaaaagggtatttggttgctcatgtttaaaaatattacttgaataaagtcaatgactgctacttaacagagatatcctacttcatgagttgtgcagtaaagatgatgctttttcctgacatagtctcaagagccacctcatgttcagactgccattctgtgttaggcggttgtcctagccttgctgcccttttggagctccattgtaaggagtcttaagtaattccttttgggagatgggagagttcctaagtgtctgccttgctgaaaaactgaagcatgcgtttttaaacaagaggagtgcacagttttccgggcggaattcaaagttctatcttagatatttatttgggtccctgttgctgctaatgtatttgattgtataagataattttttaaattgagcaaggttttttttttagttactcttcaacttccattaggtcatttatagaacattttcataaaaatttgatagaggaggaagagccctggcttttcatgtagaatctgtagcacaaaatggtctctctaatgtttgctcaataaatgggtactaaactgaactcccattatagatagctctatcaccaaatatgggcctaccttgaccacagtttcttcatccagaaagtgagctgattattcttggtattttctagagtgtctttagattttgaaaattccgtgcttttattaaattcttacaggctgtgcagattaacacttgaggtttttgttggttccacatagattaaatgttcattaagcagagcattatcccacaactcttgaagctgttgtccttcggttgttttaaataccactattacagtgattatgttctgaatattggcatacctgtcattttccaaagtaaaaataccttagaaaaacttctataacgtattagaggatgaaatgaaatggagtaagggattatatggtagcttgacccctccttcttttccaacatggcttcttaagtgtttcattttgctaataacccaaggattggacttcttttttttaacttatattttatcaactaggaatgtgagtttttaactatgggcctttaagtctttaacctggttgataattaatgcttatgactaacataaattcaaaagtaatttactttcatttaagacaggtagcatttgtccttacatcacaattttaaaagtttcttgcctgtggtcttcattttctacctatagttatgaaactcttcctcattgacagggaacacccatgacatgcctgtgtataaccttaaaattatcttgagaccacggcttgagtgtgtgtataaacacactgcaaagggtcaaattccacttgtgcatcagtttagcaacttttagtagtggcaactagtttcagttgttttaaagggtcatatagttaagaaattctggcatttctcaggattctaaaataataacgtttgtttcactggttgtgaaaattgtccggattgctgggaactaggagaaaagaatatttcaacaggatttggctatcagcaaatctgttttggtttcctattctggcctccctacctatccagctacattagtgcccctgccggcaggtttcttctttcttttaccacaggaaaattgtccggcctctttttctagcattttcaggacccgcctgacaggaaattttctaattgccggaacagctggtaggagaaaactttgcaggggcttggccttccctttctaacttaagttttaccgtcagaaattcttttatcaccatcatggtttcgtagccatgtttaaatttttgtcttttcgtgttcgctctatacaggtaagctctgttcagcttcttttat

SEQ ID NO: 136509 - DNA, 1035 bp, Homo sapiens
ctatctctgtgctttggcatttgctgttcattctgtttgaggactctaccccatgagtcagcaaactttgtctataacgggccagatagtaaataaatatcttagactttgtaggccatatgatctctcttgcaaatactcaactcggcggtagccattgtgggcaaacacagttgaagataatatttaaacagagatggacatgggcagatttggcccttaggctggccaggcctggctgtagtttacccctgcccaaggtcttgatgtggttccttccttattattcaggttcttcctggaggacaacgtgccaaataagttaggatccaaaaccttaatgctgcatactcttgaatgtacagttctacttctagaaattatttctaaatgtgaatgtgtacaaaggatgggacagaccatcgtgtagagcaaagacccaacaataggagatttgtataatagaattttcaacagttcttaataatgcattgaagattagagaacaggggtcagcaaactacactcatgggcctgtcacctgtttctgtaaaagatgttttattggaacgcagccttacccattcgttttctcactgcactggcagagttgacagaaaccgtatgtcctgcaaagctgaaaatatttactatctgtccctttacagaaaaagtgatactatgtgtagtatggtccatatatgtgcatagaaaagactggaaagaaaatcaccaaaatagtgatttttttaaattttttccctttttgtttattatctaagttttctacaatgggcatccattatttttataatagtagttactttttaaataataaggtaaatgattaaatcaataaaatgtttaaaacaaaactttagtgagataaagtttaagaaattttagagatggaaaaaaagaacagtatctagtttcatgtgcacaaccacacaagtagcatccatttcagatttcagcatatgatatttattaaggcagccatttatttgaggtcttatgtgtgatatttggtat

SEQ ID NO: 136510 - DNA, 1048 bp, Homo sapiens
atagatcactctgtggtctttaagttgtcccaaaacataggaaaaaatctgccttgccttcttgttttatagaattagcatagtcccgaaaatgagttagcatagaaaaggaaaccatgtgccagtttaatttatgaatataaatgcaaaaatcctaaataaaatatttacaaattacgtatagaattatactaaaacaatggatttttcccggaaatacaagcataggtcaatattaagaaatttatttgtctaagttatcagtagatcaaaggaagaaaaattaagtgacaatattaatagataaaaagacattacacaaaacttagcactcattcctcttttagtaaagaggaaatagactttaacactatatatctaaaaccaaatattcacattatgtctgaatgaattagtgagtgtatctccaagtcaggatcaagatagcatttactactgcttactttaagctctgtagacgatgggaagtttggagtttgttctgtgatgggaagccattgaagaatttgaggtaggggcataaattagtctgctttctgttttaagattattctggctgctgttattaaactaatgataccgcattggacactatatctcataccctaaaccataatgatatatgtctagtcaataaccaatgttatttctttaaataaataaaaatttctgacaaaaaaaagattattctggctgctgtgaagataaaggatttcacagggaaaatttagaagcagagaaaccagtcttatggcaatagatgatagtttgtactgggaatggcagaggaaatagaaatagacagattttaggtttatttttgagataaaattagtagaatttattgaggggttaaatatgaaaggaaggaaattagataagaaaggaaagaccagaaaggactcataggtttttgagataggtaataatgtcattgcctaaaatgagcaagattagcttcccattacacttgaaataaaatccaaacccaaatttcttgggtctaaggcctcacttaatatggccc

SEQ ID NO: 136511 - DNA, 1049 bp, Homo sapiens
atcttcatgaaacttatttcccatttctggtttaaaaccttaggcttttaccactttataacactgtctattgatggatgtgtgcttaaaaaaattaactgtcctgcacttagatggaaatccttataaattaaatcttttagtgtctgaaaaaaggaatgatccacacacaaaaaagtatccagtggaatcaattaagaacatgttaattttaagtttttgtcgtatgggtcgatttttttttcaacagggttcagtcatcatggggtcatgaggatggttaataattgggttttatcatggttggggttttgccagacaggtgttatgtatggtgtagaaaagttttcaggaactctgtcacagtccccatactcagccctcttcctttggggtctgatgaaaaggttcagcacctcctgtttttttacctaagtcagtcaccgaccattcatgtgcactctccttccccaaaccaaattacctggttatgcgtccaccaacatcatgaccacttccacatccaaactataagaacttgggcagcagattatttaacttctctttaagccttagtctgtttcatccagtgtggataatagttcctacctcattggtgagaatcagctgagataatttcatgtaaagcacagtgcctagaatatagtagtatcttaaatgttattgttatacttgaaagaaaactttattaataaataagagaactcaaagcaactaaggactcagtgaaggaaactagaaaaaaagaactacaaagtaaacctataaaaagcaagaggaaggaattaaatataatttcaaaaatcagcgaattagaaaacaagggaaaacacacaaaagcaaatccacaacattaggaaagcaaaacaggatataagcacagataggaaggagattaaaacatcataacaacccaaatatttacagataaaatgatataacgtctgagatttgcttcaaaataatcaactacaggagttggggaagtgagcatatgaaacaagattggctgtgagttgaagattatt

SEQ ID NO: 136512 - DNA, 1071 bp, Homo sapiens
ggcatatgctgtggtcccagctacttgggaggctgaagcagagaatcacttgaacccagaagtttgaggctgcagtgagctatgatcatgccactgcactccagcctgggcaacagagtgagaccctgtctgaaaaaaaaaaagttatagttttttacatacagttcttgtgcatttgttaagacaaattatgggtattttatagttgtatagtctttgttatgtcataagtgggattttttttctgctatgttttccatctggttattgcgtatgtatatttaaaatgttaggtgtttctatctgttttttagcatcttaggagtgttaacttttcagaaatcaaacaaattgtcatgaacgttatgtcagttgtggaagaataagatcagtttaaccttctgcttaaaacacctccatagttttatggttcctttaaataaaaacccaacctccataacatgacctaccaggccctgcataataaggttttgcatacttctctccacatcctctctagccgcacacctctaccctctactgaaagtccagtcactcaaatgtatcagcttctcttttgcttatgggctttcaaaggcaatgttccttctcccagaattcttttcccttaccgccatccccactacttaattcctggtcatctttcagatctgtttagatgtcatttcaactgagatgtcttccctttacaactaccacttccactttgaccttgagttaagtgtttttcctttttgctgccacgggagcctatgcataccttaaatggcaacaccataccagattccattgcttatttacttggtctatattccctactaaactgtgaattgaatgaggcagtgaccaagtctgacttattccttgttttatgtctgtgcccagtacccagttggtgttcaataagtatttgttaattaaatgaatgaatggattaagttttagctagcatagggacccaggcatggggcctagtgccctgagctaccttcagattcctaccctctccaaaaccatttgaggcagtttacttcattagtctgtagtata

SEQ ID NO: 136513 - DNA, 3251 bp, Homo sapiens
acttgcctccctaccttttcctgaattttggcactgtttctgtgcttcatagtattatataggcattccctcatctaggaacatcttctatgagtggtgaaaatgaaaggtgccctttgtataaggtcagtagaccttctaagataggggctatgttttattaacttctgtctccagctcagtgcctagaacatagcttgaatgaaatgaatgaatggatggatggtaaatagggatgagaaaaacaaagaggggagttcatatttagagcagctgcctcatgtgaagtatgaggtgataggtgggctgccttttatttcccaggtgataatgttccaaagatggttagcttagatccttgtatacttgttgaattaatagtcgggactactcctttttccagtaagggaatgagagaagaagctacgtgttcctgacttccgtttttgtggtttttaaaaattacacaaataatacgtattcattgtagacattgtagacacattagaatattcaaataagcaaaaataaacaatttaaattgtctaaaattctaccacccagagataaccactgttaacattttggtgtatatccttccagagtttttcccataaaaatatatacattggaatatgtatatatttatttagaatgggatcattacaatccatattgttttgtagactgctttttcacttcttacatgtgactgtctttctatgtcaatgaatttacacctttatcatcattttaatgactgcatagtattccattataaggatgtaccataatatatttaactagttctctattgttaggaatttaggtttccaatttgaagttctttttggaataaaagttatggtgagcattcttgtatgtacatctttgtacacttgtctactttttttaaaaaagaagtagaattgatgagacatttcaaaattttatgtgtggtattttggtttttttaaaatatggactcggattgccttcctgaaagtttgtgctgattcacactttctccagcagtatgtccagagtgctctctcccccgtaccctcgttaatactgaatggttttttgtttttgtttttgtttttgtttttgttttgtaaatcattaccaatttgaaaggcaaaaggtgtctttgggttaaatgcatttctttgatgagtactaaggctgaactcttttttcccttattgctcatttctgttgaggttcatcgttttttcttacaggtttgtaaaacaaagctctttatgtattgaggataccaaccctttgttatatgttgccttttttttttgtaatcagtttgtcttttatctttttttgtgtctggcagaagttttaaacttttatagattcaaatgtcatttttttctttatgatttcaaccctccttaccccatgagtattgttcacctgtattctaatacttgtacaattttattttttcacatctaaatgtttaatccatctggaatttattttgatgtagagattgggcttaattttctctgaaataattaatcagttcccttgattaattatgaatggagttggaatttagagtgtgttttgccatacactgttgtaatgatgtttggtgaggcttaaatgagaccatttgtaatgcatttaactattaaactcaagggttcacgtggaaaggtaataatcatttattatatgatttccatgaaaaaatgtttttatagtttcaaataattaacttttgaagcacatcctgttgcaaatttagcaactgcatactcatatggtggttctacttcattagagccctttaggggtgaaaatcttcctcaattttttttttttttgtctgccttcatttaactttaactgatgtgaggtctgttttggtaacttcctgcttgctgtgcttttcacagaatggacagcaaattatggatgaacctatgggagaggaggagattaacccacaaactgtaagtaaaatattttatcacaaagggtatagataaatgaaatactgtaaagttattattatttttcagctgagcagagtaatcattttacagtgttagaaacttgtcgatcctttcacattaactttaccagactacattattgagtatgccagggacctttctaaaaactgtttgataagagtgattttaagagaatgataaaacaaattgctttatattgttgaaagtttttcattagtgcctaaagcttatgtttttttgtttcttggggatttttttgagatggagttttgttcttgtcgcccaggctggagtgcaatggcgcgatcttggctcactgcaacctcagcctcctgggttcacaggattctcctgcctcagcctcctgagtagctgggattacaggcgctcaccaccacacctggctaatttttgaatttttgtaattttagtagagatggggtttcaccaagttggccaggctggtctcaaactcctgacctcaggtgatctgcccacctcagcctcccagagtgctgtgattacaggcgtgagccatgtgcctagcctgaagcttatgtttttaaataaccaaattgaacgtaaatttgttaaagacaaaaatataaaggtcatactttacagatacgtttaacatagaaagtggacattcaccatttcctcatctggtttttttgttgttgttcactcctgaatccccagtaactaaaccaatgtgcctggcacataatggatactcattaaatattacataaatgaattaataaattgttccctaccaccacacacagaataaccattgtcagcagctaagttatagtcatcttgatattttgtacgtaagataattattatttacgtttacaaaatacatattctgcaacttgttctttttacttaacatgtcttgaacatctttgtatgacagtacatatagaactacctcttctttgttttgtttttttgttttggggggtttttgagacacggtctctctccctgtcacccaggctagagtgcagtggtagagtcatgactcactgtaacatcaaactcctgggctcaagcaaccctcccacctcagccttcttggtagctagtactacaggcacatgccacgacacccagctaattttttttttaatgtttgtgttttttgtacagatggggtcttgctatgttgcccaggctggtcttgaactcctggcctcaggcaatcctcctgcctcatcctcccaaagcatt

SEQ ID NO: 136514 - DNA, 1048 bp, Homo sapiens
ttttttggctggaaggcattatggtgggatgagagaggataaatacatttgcctcacttttaaactattttttgtccatactcattctctagctacattgtataaaaatatagcacatacataaatgatctcttccaccctgcttagtggaaaattgactgtagtgaatgatggaacaggtgtttcaacactctccgatacttcttcattgcattacatctttagaagttacctatagaaatgtaatgttacacagtcaattgaggcaaaagagaggagaagaagtaacatttactgaacatagactgtctcttggtggatctttttagttacaacatccctgtgaggtagatattatgtgcatcttgtgagtgaagaaactgaggctcaaaatgttaaataacttacccaagttcaggtaactacaccagtaagtgacagaattggggtttaaatgtggtactgaccagctttagaacacattttttcccacttgttttttaaaattagagaaatatattttcttgtttaacaagtactattccttaaacttaggaaacaatagaaagtaaaatactgagtaagactcataatccatgtaacctaatctctaataaaaccaaccgtcattttccaaatgggaaacttaactgtagaagtaactctgtgctcatttctaatagataacatttgaatccttgttttgatgaagtgatagaaaagtttcatttaaataaaggtgctttttttggtagaaaaagctttgtaaagctgcactggtatgtaggataatgttggctcgctgctttaaaaattaaattgttcaacattttaaattattgccaaactcaggaggtagctatttttacaaaaagtagagcataaaatacccttcagattatgtttcactcaatttttttcttaggttgctttgttagtatatactatactattagctgggtgagtatttgagaaaagaaagtttattgtaaaatttgagatgacgtgaagctgaaaatagtgaagaggctgattgacagatttggaa

SEQ ID NO: 136515 - DNA, 2645 bp, Homo sapiens
agttcgagaccagcctgaccaacatggtgaaacccagtctctactaaaaaaaaaaaaatacaaaaattagctggatgtggtggcacgcaccagtagtcccagttactcaggagactgagacaggagaatcccttgaacccgggaggcagaggttgcagtgagccaagattgtgccactgcactccaacctgggtgacagatccagattccatctcaaaacaaaaaacaaaagagtaggggttttagaattagatttgggtttgaatttcggctctacttattagccttaggcagtatattagactttctcatgtattcaacaaatatttattgaacacctactgtgtgtgccaggcattttgctaggggactggggatccagtgcttagaaagtttgacatacctatcttggcttaatttcctcatttgtaaactggtgataatacctcacagagtggttaagaagcatcaaagataacagtccttagcatttgcctggtatgtggagctcagtaaatgatagcaatcatttttactgtgtgtactcaatattgattatatctttaatccaaataaaatgacttttttaactcagcttaaggtttttgccttacattttatttttggtattaatgttataaacgcttgttttattttttttttatacttatctgtttggtttgggtttctctttaaagtagtaaatagttgttggtttactttttaaaaaatataacctgattattaaagttatgattatcaaacatttcaaacacataccagactggagagagtagtgtaatgaaccaacatattcccataacccagcctcaaggattatcaaactcatggccaatcttgttccatttctgtttcctcttctcattcccctaaccaccctccgataaacatttgcatttatacttcttaaaagatagacttttaaaattcataaggaccttactatcatcactcataaaacatcagtaattctttaatgacatctaatatccagcaagccacttccttgtataattaaacactttaaactttacatttcttacattattacttttggaatggtttccgtcatattattttacattttttattcttgtgaggtttttttcttcttccatataaattgttttgtttgaggagcttatgaaatatagaagaatgaattacggagctaaaaagatctgggtttgaatcctgcttctgccattcagtaattaactttgctgagccttggtttcctcaactataaaataggaataattatacctgactcatgttcttagggttgaatgtgatgcctgcataaagtattgttaatagtctctgccagttattatctttagtgattcgaactgtaatatctattcttggttactgtatggtttttcaaaacattccaaaatttgtatttactggataactactaaaactaatggttttaaaatatccttctaggaaagagaatttagaatcttggcttctcccactacctcttttattttgagttcacattaatttaacctgatgttacaaatcctactttgaactttctgaagtgttttttcttttatattgtttatatacttatatcaattattcttcactattgaacccttttcttttagtgggattaactgttttactcagttatttctagatattaggttggtgtcagtatacttcaccagttctttcctacctcaatattctttatctcttattctcttttgatggtctaggatgtacctttgaacaatttatttttttaaaaaactaccaggatggtgaaaatttgactttgcagatctaagaataatttcctgtgagctttgaacacgaaaaactagaatgaggtataaaattcttagatcataacttttccttttcaattctctgtaagtgattacttcaatgtcttctggcattttattgttgcagaggagaaatctgaggtcagtctgatttcagttcctttgaaataacctatttttttctgcttgtatgcttgtaggattatatctttatccttgaaatttaaaaacatttgccaggacatgtcttggtgttgatgatctctgttgaaccttctcagtctccagtctcaggtatttttttttcagaactggaaagttttcttatacttttgattgattaaactgcctgtttttttttttctttaggaacatctgttattcatagattatttctatgtctgtcttccatagtttctttaaatcttttctttctttctttctttcttttttttttcatttactcaagtttgtcctctgtggcatggattccgttttctgtagtgtcaattctaatacttgctattcacagtgcagatttaattttggctactatgttttcatttctttattcttatctcaacatactcttgtttcataagcagaatcccccttagacggtaacacttcaaaaaacatgaggtggatcccagcctgaaacttggccacaaccacaggaccaggaaaaaaaaaagtttctgaaagggtcctcttaaacataaaaatgtaaatataaccagaggtcattcctaccctcatctagaaaatagaacaatgttgggtactaacagaccttaagtagctagaggaata

SEQ ID NO: 136516 - DNA, 1086 bp, Homo sapiens
tgggatttccctttttttttttttttttttttcttttccgagatggagtcatgccattgcccatgctggagtgcaatgacgcgatctcggctcactgcagcctccgcctcccaggttaaagtgattcttctgcctcagcctcctgagtagctgggattacaagcatgcaccagcacgcctggctaatttttgtgtttttagtagagacggggtttcaccatgttggccaggctggtctcgaactcctgacctcatgatcctcctgcctcggcctcccaaggtgctaggattacaggtgtgagccaccgcgcctggcctcccagtcttgtgtaatcacaggcatcctctaaggtgcctgtttaaaaaataatatacttaacaatggggcttctgggaattctgattcagtgttgggctgagataggtccaggtaatatatctttaacaggaaccataggtaattttgatcatcaggcagattggaaaatattaccaatgccattgtgtactaagagggtttgaaggtattggagaagcaggaataggattaggagtagatcccaatttttttaattgatactttactaattttctctagtaaaataatagatcagattgtggaaattataaaattgctttaagttcccttaatctgcacaaaaaccaatattgtatttttttcttttatttgacaacattcgtacagtgagttctttggcattatctatgtttacattggggaacaaaagcaccattgacaggtatagataaaactattctaaatgcagaagtggaagaaaaagttatacttagaagtaacgttaaaaacagctttaaacatagaatcagtaacttccttgggtacgaaaaccccccaaaattttaaataaccttaatctaaaactttaatccttaaagttttatagaagatcgtaaaactttcaagctgggagagctcctggatagtcacatatttatggatgaagcaaccacaacttagagaggcttgggggcttgcccacagttagtggcagactttcaaatccatgctggccaagattccatagaactcatggattacagata

SEQ ID NO: 136517 - DNA, 2275 bp, Homo sapiens
ctttatagtgcagcaacaaagaagtttgagtcagccctctgctttcctcctccctgtcatcagtggggcccagcagggaggtgagcttacacccctactcagaggcagtgaggtgatacaggttggtgccctactttcattgggactaagagtggagctgaacttccgtcccacccatctgcaacaaaacagtgtgagtcattgctccacttttgcctgggtgatgttggtgcggcccagagggaagttgaacatacacactccacctcaacaggaggactgcctgcttcggggaaaaaaaaaaaaagattaaataggaaagagtcctataatctccaaatatccattagacagtaaaaaatcacttataccaaaaaccaggaaaatcgcaacatgagtgagaaaagacagtcaacacacatcatcactgtgataattcagatgttgtaattatcagaccagaattttaaagcagccatcacaaaaatgcctcagtgagcaatcacaaacactcttgaaacaaatgaaaaattagtctcagaaaagaaatggaagccataaggaagaaccaaatagaaattttagaactgaaaaatacagtaacaaataaacttactacatgggctagatagaagaatggagatgataggaaagaataacattggagataaagcaatagaaatgaacaatagagaaaaaataaactggaaaatgaacagagcctcaagagcctggtgaacattaacaaaagatttaacatttatgtcatcagagtcccagaaagggaaaaaagaaactggacctgaagaaataatggctgaaatttccccaaattttgcaaaagacataatcttacagattcaggaagctgactgaatcccaaataagataaatgcaaagtaatccactcctagacaaaatcaaaatcaaacttttgaaaatgagtagttattgtctaatagatacagagtttcaattttgcaagatagttctgaagattagttgcataatgtgaatatacttaatactactaaaccatacacttaaaatagttgagatagtgaattttatgttatgttttatgacaattgaaaaagtaaaatatcaaacttttgaaaattaaagaatctttaaagcagttagagagaaatgaactgttacctatagggaacaactcatgcgacagcagattttccatcagaatctatggacgtctgccaggcacagtggcttacgcctataatcccagcactttgggagacttacgcctgtaatcccagcactttgaggggcttacgcctataatcccagcactttgggaggccaaggcaagaggattgcttgagcccaggagttcgagatcggcttgggcaacatggcaagaccccatttctacaaataataacaataataaaaataaatagccaggcatggtggcacgtgcctgtaattccagctactggggaggctgaagctggaggatcacttgagcccagacagtcaaggccccagtgagccatcttcacaccactgcactccagcctgggcgacacagtgagacctcatctcaaaacatctatggatgccagaaggatatggcacaccatttttcaagtgctgaaagaagatactgtcaacccagatttctataccaagtgacaatatccttcaggaatgaaggtaaaatcagagtggtcttggatgcaggaaaactaagagaatttgtgagtagcagaccctgaaagagaatgataaaagaaggaaacttggactgtcaggaataaagaaatcacataaattctacatagtctcttccagaaaatagagaacagtttacaactcattttatgaggccagtattatcctgatagcaaaacctaaagatagtatagaaaactgcaggtcaatatccctgaagcacatagacacagaatcctcaacaaaaactagcaaaacaaatctaacaacatataagaattgcatgccatgaccaagtgggttttattccacatcagacacagtattcaaaaatcattcaaggtagcctaccatattaaaaggttaaagaagacaagtcacatgatactaatggagaaaacgtattttttcttgatcataaaatggcttatgggaaagagaaaaatttagctaagttaaacattcattcataataaaaactcagccacctaatagaggaggacttgctcaacttgataatgaacctacagctaacataaaacttaatggtgtagtcccagcaccttgggaggctgag

SEQ ID NO: 136518 - DNA, 2327 bp, Homo sapiens
cacctattctggacatttcatattaatggaatcctacagtatgtggcctttgtgtctgttttcaaggttcttgcatgtttcaaggttcatacatgttgtagcatgtaggaagacttcattcttttatgtggctgaataatctattttatggatataccacagtttgtttatccatttatcagttgatggacgttggaaattgtttctaccttttggctattatgaataatgctgctgtgaacattcgtattaagtttttatgtgaacacatgtttccagttttcttggatatatacctaggagtagaattgctgagtcatatggtaaatctatgtttagctttttgaggtactgccaaacttttccagctggcctgtaccattttacattcccatcagcagtgtatgagagttccagcttttccgtatccttgccatcacttattattgtcttttttactataaccatcctactgggtgtgaaatggtatctcattgtggttttgatttgcatttctctaatgactgatgatgttaaggatcttttcatgtgcttcttgtccattcgtatacataattcacgtgcttattttgttaccgttttagggacttaagttggcttttgttctaatgctgatagggaagttccttgtatatgtatttcttctcagaaaacttagtttcaatacgtgcttttaagatattttctttctttttagatttgataaatacaaggcttttcctaaaatagtggttttccaaatgggttaatagagctctaggttctatgaaagtgccttaggatacctctcacctagggcaccctttctctcagccagagtggaattcctagaggaacacaacaaagaattaaatattggttatagaacttaaaaaagaaagttacagaaagaaaacaaagattggggcagtgatatttttccttagagtctcctcggcctaaactagtctatagtttcttatttaaagcaaaagtgcaagagttaattgaagattaattattaatcttaataggaagataatatgcctagaatctctgaaattaaatataagtcaacagataaatgaattcaggaatccatctcaagtgaagtaacgtatacaggtatgttatttgaagaagtaaaaatgcaaataaaacaaaaccttatttgcctcttttccttcaagttcctgctggctgttggtataattcaagagtaatagctatcaaaatggatgttcatattaagtaatccttagagaaatgtcataggcaaattaaaaataagttttgccttggattaataaaaagaagagctcataaatgagttttaaagctatctcctgcccaccacctcccctcccccgccagctcttctgagtatgtatagtatactactaggtgaaaatgaattaaatggatttattttcttttggaacattaaagtctagaagtactagggtgggcaggaagtttaatagcatgaaacaaggtaaattagtaaagaataatataagcagatgtaattggatctttaggaggaaattatgacctataatgttacagcagttttctgtagtacattttcaaccataatgtggaaaattagaaaataaatgttattttcaacataaaaattaatcacttggaggatacatctggttctgccaagatagaggacccctattcctccttgatctcccttacagcgaaaacactgtagacataacaaacaagcacaggaacactctaaaggtggaaaaagaaggcaaacagcctgcagacctcgagactcaagaaaacccagggaattcactatttgtgttcttcctgtcacctcccatatatcctagacagggtgctatgaaagcctccaaactagaactgccaacagtcacagacaaaaagagctctgagaaaaagcctgtttcctttagacaaacaactgggggaaaggtagccaagtaagtctaaacctttttgacaatactcaccctaccctggccaaataccatcagaaaaaccccaccccaccccaccccaaagaagcaaataacagtgctctcactccccaacccagtggtgtgggctggggagatcagagacctaagcacccatttctttgcccagcaaaagcagacagcactttggttccccctgctgggtggttttggcagaccaggcaggaagcgttttccctcattccacttcaagctgaaggaagttatgctcttgccagggtggtgtctagcagcagtggggtctagtagcagattgagcctccaccccaacccagaagcaatgacacttaacaaggtgacgtg

SEQ ID NO: 136519 - DNA, 2505 bp, Homo sapiens
gtttagtacagtagctgctatctatatgtggctgttgagcacttgaaatgtggctagtgtggaagtgaacttttaaattttatctaatagtcaccagtggctattggctaccatgttgaacagtacaattccagattacaggattagtacaaattgaatgcattttttacaccagtgttttttcatttctaccttgtatgatttgtatcttgaaattaataggctaaaccttttctaaaaacaaatatttaacatgctttttcaaattatgtttaatcaggttagttttgtccttttctaccctgaagattctgataaaccctctagggtggtacataccccacaaatcaccattctactcttcctacagctttaatagttttactgtgacatctcattcaagtgataacactaaagcattggggcaaatttaaatatcaaaaaatgttgtaattacaagtttcctcttgtgcaccgagcttacagaccgagacataaacagtaagactaatgtctctggggagaaaaatatacaattatcttctatattattggataaataaattactgtatggtaatttgtttaaatattgtgttgcattcactgtactgtgctagttaaaacggaaaaagtggattggtgcattttgaaatatgaaagcatttaaatttttttagcatataattttagagaacaacttagccctaccctatttatgtaagaaaattgagacctgttcaggcagacctgctgcaggtgatatgttaacaaagtcagagttggcgtgtgcagcacatttatttcactaaaattcattttgtcatccacatcatatcaatacaactctttaattttatgtaaactatcttaaatacaaattctgaaagagccacaatgcacaaaagttcaaatattactttttctctactctctgctaattttaactcgtaagtctggaaaatacagtccttagtttacaaaaacaacttcagaatgttcctacctacaaaccaagggtgaggggtacgttaagatcactgctctttctttcccaagtgaagatggaaggaagctcacgtctattgagtgccccccttgacaagtcactttgtgtatatcaacttgaatgaagtatacagaattatcctcaacttacagatgaggaaactgaagcctagaagggttaaataacgtgctcatggttgcccagctagtaactgaaggagccagaattcaaacccaagtctcacagattgcaaattctaatgacttttcactacacagccctgtttgagttgagaacatccaggtgagtgactcagtctaaatgaaatctgctacaggggaaaaaggttccaggtagtttacatgggtagctattgtggagatgtagagaataacctagagagataggtgacttctcacatatataaatatatgtatgtatgtagcatgaagccctcttctcaccaaggaggcctgtagagatgatgtgatcctggcatgaactaggaatgctgttcacaatagagacagtgcttaagtagtcaataagtaaagtttaaaaagttagtaaaactgagtgaagttgatgttagtttccaaatacagtgggttaaataggcttttgtgagttggcctgaaaaacagcatttatggcattgtatgggaagattatttgagatttctaaccagctgtcttacaaataaaacaaaatgtctaacgtttgaaacaaaaattacagtacttggaaaaaggggggcctgcctagacattacttaacagctctctttacagaagcctctaggtgtatgcatgagtaaatgtgctctgttctttgattgcagcttattaaatcgttacctctctatctttgcatcctcttttcagaaaaatctacttgatgttccctcaaagtgccagaaaacagaatttggctcaacccaaaaatgttaacaattatcttgctatcgtataagaaaaggaaatttaaaaggaaagttatgcaatcatttttttttttcttagactgtcaggtcaaatagccctaattaattccttttttttttctttttttttttttttttttttttttttgagacggtgtctcactctgtcacccagagctttttgctctaatgctgatatggaaggtccttgtatatgtatttcttctctgtcacccaggctggagttcagtggctcaatcttggctcactgcaacctctgcctcctgggttcaagttattctcctgcctcagcctcccgagtagctggaactacaggtgcccaccaccacgcctggctaatttttgtatttttggtagaaatggggtttctccatgttggccaggctggtctcaaactcctgacctcagggtgatccatctgcctttgcctcccaaagtgatgagattacaggcatgagccactgcatccggcctaattccttttttttttttttttttttttttttttttgagacgaaattttgctctattgc

SEQ ID NO: 136520 - DNA, 2663 bp, Homo sapiens
agaacatgcagtatttgtctttttgtcatgtgacctattttaagcaaatacattagttactagtaattaagtaatttggtttttgctcattcttaaaacttagaagggactttgtggggttatttggattaatagcaaagtgttaaagaacataagctctggagccataaagacctgtgtttgagtcctggctctgccacttaataactttgtaaccctatgcaagttatatttaatatctctatacttcaacatcctaatttgtaaaatagggatgaaaataatgtctacctcatagagttttggtgagaattaaatgaaatgataatatatgtaaagtacttggttcagtacatggtttaagtttttaataaacaatagttacaatgaatcatccctcttaaagaactgtctcagttctttgtttttcctctggggtaattttttagaatccagcaaagcaattaaaagtgatttatttgattgatcagtttaaatagtcatggtaatatctgaacgtaattgaaagggcaaggggaacagaaatctctttaatcttaccctttttgcattgatcccttcctcagtattgtctttaaagggaaaaaacaacattgtgaagaatatatgtggaagaaggaagaaaggaaagtttgttcacatttttaacattgctcaaattggaagatgtctcacagtccatgggatgtcatagtttaattagcagcatgtttttccttaacaatatataaaataatagtgtatcttacacttgattgtatcttttaatcaatgaaatatagtgtattctgtatgtctacctcttgaagataatgtgtccctgaagaaatggttaaagtcagtttatagcatcaataggtagaattttaactttctttctaaaacataccaacacaaaatgtgcacacctttttatattttaggatgaatccgttctgttaatttttagggaaggaaattaatatgtcacacctccttccccattactataaatacatttgttttagttatttcgaaatgccatagggtaactgggttttcctgtctagaaatgtaatcctttagattttgtctgtaatgtggtgttggttcttacagaactctaaatagtatatatagtatttttcaagccgaaaagtctctggagatatgatgttaaaaggtgtatccatgcctcaagaatcacccccctccaaaaaataaggtagtgtggcataatcaagtaagttggggaaatgtggcattaaataagatttaacctgtctttactgtataatttagaacttttaagatgttgtatacaatgaatctgcaaaatggatatggcccacggcatttgagacttgatgtcagaaccccttttttgtaaaccatctattgaagtctcagtggacacaaagtgctttgcagaacacagttttggaaagtctgataactacagtaacgcgatccagtattgcctggaaatgagctgttatgtttaattgactatattgaagtgttttctttaactgtcaagagttttgtttcattttgaattgaaatctttctaaattaaattgtataaaaatgttccgtcttaatagtgaatataaatttaataataatttaaataaaagttaaaaataatttacacttttgattcactgttctgaaaattaatggtcatattctacttaatatcaagctaattgcccctactaaatggcctgtaccttgactgtttctgtaacttatgtctaatatttgtagtttaaaaattctcttatatgccactttatgccactgttaatctgcttttctctcccattttcctgtttaaattaattgcttcttgttttcacttactagagaatagatagctaggattagtaatataaaaaagttacagtttccaaataatgtaaaatagcatcctcactctttttctggtctctgctcatcatgtacaaatacctctggggtcaggggtatttgctgggcatattaccaaataataaatagtgattttatgttttacataccataacagaatggctcaattgctgacattacctgccctgcatatttaccttcctctcttgaagatgtcagctagaaagtagaacatgaatgaactaaaaaacaggcagctttaaattgaaagctagcctactgccctgcctggagtcacatctccacattgtgagtccttttctgttgttctcataaagtagtgctagtttcctaaatatttgttactctacacgtaggtgtaaatctaaaagcacttttagatttcttgtcatagtagaattacaaccataagttaaatcgaattttcccatcttaactaatatatccatggtctcttatataacttaaaaacttgttttgtccaccatataaattgatttttataatcttacatatggtgataatctcatcttcaaatctgacctggtcatttagatttctgtgagcttgtctctaattctttgggccacaaagcttgtcctaggaaacttggttcagtcatttgatatgtgttagaagcagatgtcaaatgatagcctgaagcaaaagatcattttgacattaatagattgaaatgcatctcaagtgcagtggtttgggataaatcttcactccagaaatcttgt

SEQ ID NO: 136521 - DNA, 2225 bp, Homo sapiens
attttccagaaacaaatagagtattataagaggtctcatttggtaaagccttgttatttcagttactatcatgttttccagaacttgacagataggattccacaatttgctgttttcaaagaattttcttgctatcctggcataaagtatgtcaaacagagccagtgttgccaagatttattaaaattaaattctaacaaattgcctttagatatttaatttcctttgcttgttcagctatttcaagtaaattacttctgatacaatttggaaatattgaagacagtgagggaaaggttgaaaagttccactcagaggtctaatattttcactattataccgtttcctcccccagtaggttcctatcagataattgtattttaccagagtaacatagttttttttagagtcatttacttgagtgaatacatcaaaatatttctctccaggttaaaagatttcaggattggtctgtgtaggagtttacatttatggtctcatccctagtacactgtgaattcttgaaagcagacatttttccccccctctctgaatcctcagcattcagcacaatgcctggccctgacatattgtggacttaataaatatctgctgaatgaatcatgaaagtcaggaataggatgattatgaatcttatctgttttttatcattttaatctcattaaaatatgaacaatttaaaaagacctcagtgcctcagtaaaaacacaggcagtttcttcagttcctttacactggccttcctgctttaagacctcacacgaatctcatggtgttcaaaacaaaaaaacccttgtggttaaactcaaacgtgggtcagaacatgataggctagaactaggccaaatgtttaaagaagcaaatttaggataataaaggaagtactatgtaagcaaagtaagggttggtacaagataaaaaacaaactagcttcctaactggtctaggtgaactctttagtgagttacttaaagatgctaatatgcttttgaatatttgactgtttagaggatggataggtaggaattatggctcttctgttgtacaaattctttgccagtgctgtcagagacagcatttagtggatcataagcctgacctagagtgatacttttttctccactgcaatagagtaggtataaatgatagtaaatctaaatatgaagttttcaaaatgataaaattatggaggttatttttgttttatagaaatgtgttatataaaatagccacaatataatgtgttgtatacaatgtgtattaaacaatgtgttgtatgaaaatagctacctcgacttcctttaaataacaggtacccatgatgcactgaaaaatatttaaaaaatcaactatataagtattttattatagaaaatgaggcctttgtgtgggagatcatgtttagtgaatgtgcagccatttttaacctcaaagattatgtagtattctatagtatagtacatagattttatagtatttctactatatcaatattatataggtttcttattttatctatagggaaaatgctctattaaagtataatcattgattttgaaaaaaaatgttttattgtttcttttccttttcctgttttatttttaccacctttcaggtttttttctttcccctaagtgaagatctgaggagaggacaggtattgttacatgtcaactgtcaagtaactgtgacccattactgaacacttcattgttttcagtgattatgatagaggatgtcagttttgtaaaatctagaaaactttgctttattttggcagcttgatcctgtagtaatggggtagattcaaaatgtgaaacttgctggatgcatttaaattttattaataaaacttttatctaattgcaggagcaaatataggcagactttgtcttctctttagtatacatttctggaaaccacaataagtatatcttatttttaataagacaggtggcataattggactgtgtactcctgaccaaggacttgacatttgctaaattatagaatgaccaaaaatacagatcacttatctagaagtctgagttgcagaacaattgtcctaaagtttttaaaaatttttattactaagaaattcataccattgtgataattaacaagatttgctctacagttcaatgctcagggacatgtgatctgccaggctgtgaatgatgggtaaggtcacacttgcctggttg

SEQ ID NO: 136522 - DNA, 1128 bp, Homo sapiens
ccctttgttcctgggaaagctgacgccccctcggcggccgcccttgccaggtgccttccccagcgccaactctcccaagcaacttttagcccacataatggggtcaggacgcggccgcccccattcggagcctggcatccccccacacccagatttggctgaggatgcccagggtgggggtatgtgctactttgagggtgaggacatcatgcttcccctgggacagcatccttgctgctgtctctgggctgcctccagcgcatcccctcgcatcctttgccttctctgctttctccctttcaagccagtcgaggttttggacctcacggctttttattaagggctcaacgccagatgtaaggtgatgcgcattcaggtaccttcacatttcttccatcttgaaggttcccccttttgtccctggcgatttataataaccacagttatagacactcaccctcctaatcgcaaacgtgagctttttttctgatccctgggctttcctgtctcactacctccctctgttgtctgagttaaggggcttgtagaggactcccccacccaccaaccccttggatcctcaggcccaactcttccctaagattttgggaattgaagaggggatggatgggatggaatggaataaaggatgcgtggccacacttgggaaatgttagcgctttgctcgaggtcatacctgagcaaactctaggtagatcagtcagggaccaaaggcttattatcgctgaaaatgcccgttcctacgatgaaggagccccttcttgggcttacttaacagtcagactttctaagctccagataatttagaacgaaaggtgaggtgattgggagggattgagagtgacagggagaaactgattttttttgctcattcttttccccagcctttttggccgcttgcttattcttgtggatttttctttattttgctttccttttattcccttacttgcccctttattcctcatttactttgcttttcttttctaatatgtggaaactgctttgtaactgctaagcagtacaaatgtgagtgaattgaattaaacctaatacattatttatcgactgcacccctgtgtgcagtgcattgtgctaaggtgccat

SEQ ID NO: 136523 - DNA, 1039 bp, Homo sapiens
tcttaaagcaatgataaattatcatttttatttataacagagcaaccctagattagggctcaatttgttctttttttttttttttttttttgagatagagtcttgctctttcacccaggctggagtgcagtggcacaatctcagctcactgcaacctccgcctcctgggttcaagtgattctcatgcctcaacctctcaagtagctgggattacaggcacccaccaccacccctggctaatttttgtattttttagtagacacgggatttcaccatgttggccaagctggtcttgaactcctgacctcaagtgatccacctgcctcggcctcctaaagtgttgggattacaggcgtgagccactgcacccagcctcaatttgttcttaatgacttttagctttctatgtgtcttccctgcagtacctcacacataagggttattgtgaagaataaagttattagcttctaaaaagagtactaaaagagtggatcatctgtactaattttaaaaaaggttgggggaagggagtataaagtaatttgaaaaaaattgagtctaaaagttttaattgttcatggctttttattgtttagtgtctgattaaaaacagcaagtatagtcttcaatgtggaatcattgtgttgaattacattcggtgagggaattcacagttttcatgtatagcataggcctgtattcctcaaaatggtatatttttgtggttgtggaagccaaatgatcaaaagaagccaaagagttgtgttttttttgttttttgctaagctttttaaaacattatattaaaacaaacatggatattatattcatgatgtagaaagcaaaattggcattatttcaaagatgagaccagagacttaacaggaattttaggcttgcaacaggctgtttaaagctgtattctccagacctcccagggctgagtacactcttttgagcaattacagatgcatcagtggaaaagttggagaagtggtggttgagtttaaaaaaggtaaaattaatgtactctgtttcc

SEQ ID NO: 136524 - DNA, 1033 bp, Homo sapiens
cttagtgatttggggatcccgagatttattttcccctcacaacagtttctcctgtctggtcaagataataagaactctctttttatttactatgttctgtccttggtccatggcctcactttgtgctgggttcagattctttacactaaagaaactgtcatgctaaatttcgctaattgtgctagtgctgtttgcatctgcttctcaagtctgtacttttattgtgtctatcagcccctcaagagagacagcctcatggtaccaatacccatagaaagaacatgggcttgatctgaagacagttgtgggcaatcaccacactgccaatgattgctgtgtgactataaacaagttattttatatccttgagattcactttcctcagatagaaaatgaaatgagctaataaagattactttatatggctgacatgctaagacatgataatgcattaaaaagagttcaatatggctcctatccaaaaaagacacccaataaatgctttttcctcctctgttgctttctcaacccttaaaatactgaaatcctattcatggtatgaattatctcattattcttaattgaattaccttgctgaccatcttacaatgatcagtaactacactggttagtctagctgcatggccatgatggacagttcacatctctttactctctctgacgctcaggtctcaatgctcttagatacaatgaaggtatttactctgaaaagctgctaggcaaagtgccaacaggaagatcattcccctgaaataggaaacccttcagggccagctttgtgggagggtgacttgtgcagttgcacatgggcctacacttggttttatgctctgctgttgctatcctagaattcttaattgtttttgaacaaggggcttggcattttcattttgtactaggtctcacaaattatgtggcccatcctggaatcccattctctgtatttttaaaaatttgtcttaaaaatatacatcagcagccatggagaaaggacagaatggcagtacttaac

SEQ ID NO: 136525 - DNA, 1178 bp, Homo sapiens
tgtacttgaaatggatttgttgaagttaatgtgaattatttatatcaaatggaaaggatcacaatacaaaaagatataattttttgaaatgcatttttgaagcacttacccactagagcctaggagagttgcttgtataaagtttacaaaggttaataccaattatcattttttcataatgctctcagaaacgtgttcttttataataaatatctatatattattttgcatttctgtttgttgtcattagctatgcatagaatgcaaactattttttattaatttttttctttctatgtttatttaactggctcagcaggtaaaaacagtgtattaaatactaataaccgtgtttattgctttaattccttgaaatttttaattaatttttaaatctaatttatggagatgaactttttgtagtgtttccagagacaggaaatgactgataaaatttatgttctttatcgtttcttttatattaaattcagtcacctgcagatcggtgcaagaaaatccatgctggcgatgaagtgattcaagttaatcatcagactgtggtatgtataattaacttaagagtcagtgggaggaactaattttgatttgctaaagctttaaaagaatgccaatgaaatgaaattcctgtttgtatacaaaatattgaacagccttttgaaaaaataactgaatatttattcttcttaattatttgatggaacgtaaagcatttttttaaaagaacctgaagagcattggtggtggttgaggttagatatacatttctgtatggaaaagtactagataatagtatatattccatgaactggaataacaattttggaatagaaattaaagtgacagtatgtataaattcaaccttttcttgatacaactttttgaaagtttcattttataaattattgaattacctagtagatgttttataacagcatacatccatttatctaacattgatttgttcattaaagtatctggtggttttggggggagtattttaaatgtagatctttgaaaattttaaaatttttaatagctgaattagctttttatttcctaaaagaggacaacagttttcattttaaaaaatgttcttgccctatgaacctcacaaatccctttgttatctacccttaaaaatctacagtaggcacaga

SEQ ID NO: 136526 - DNA, 1670 bp, Homo sapiens
tgtaacaactggagaatgttgattgcatttgatttcatatacatagagatatgaatggttaaagtcattctggaaaaatcaaaatacataagtaacaataaaatttaatattcaagttgcaggtcgttgtgactgaaaaaaaaacattagtgacaaaaaaatttatctgtttctgagagttttgttttaaggagagcaagaactagtattaggcatggcactagagaagaaaatcaatttttaactaaaaatgtaattgggctgactgggagccagaagcaattgtatgttttacatactcaaatgagtaaatacatgcaagtaattgtcaaattttagctcaccagtctttaagcaaatcagtcaaaggatctaagtcacatttgtatttttgagccacatgctttcaagattttaatagtggctacagataatcacctataatgtaaaaattgtccattctttctttagttaacatccccaaaatgatgtttactgtaatttgagaaaatggaagtccagttttaatgttgcagtttaattatgcccataagactggacaatgcaggattaaagacactagtgttagcctcaatacaatgtgcagtatttcatgatttgatggaaaaagccattttatagtgtgactcttaagtctttattagttatatgctttataagtaatacatgttttaggcatatatatctgtatttttaagcctaggtagatatggttttctgatcaaatctgtggtcagaaaaaaacacttgttttctctgtattctgacaggaaaggaaaaattatatgcttataaaaggatactcaaaccttttgtatttataaatttgcattctagaaaaagctgtgaaagaactgagagtgggagaattttgaatatatgtatttcccttgcttcagttcttttcaaataattgactacttatgaaaagcttggccagaaaaaagtattcccaataattttccaaattagatctaaccttctttacatggtcaagaaactaaaaattatatgtgaattcttgctgcttaaaattcaggatacattttctctgaagcatttgcttagattattaagagagtcaatataaaacaatgttcttgtactagtgttgggaattaaaaatgtgtttgaactgagtaaggacttatgtgaatgttctgtgctagaatgatggggtattgtgatccatttgagtctgtgtttatccccaagagtgaataaaataaatggccaggttttatacttgatgtaattatttgtatttcagtgggtatttcccccctggaaggcaaagcaagttctgtgtgatcttggcattagtgaattttagagctaactacataaatgtgtaatgcactgttttaatctttaacgctggagttgtctttatgtcattggtttcattcaagctgtatcaaagctgggtcacgtactagaaagagggacaactaaattaagatatgcttgcccagagatgttaaaatgtaaaatgttttggggaaaacctcaacatcaaatgtagtttcttaagtatagaagttcttttctcatggtctttaagactatagagatttcacagatacaccaataccttctatatgtgctcagttaccttagagatgttaaaattggggcgcacaaagaaa

SEQ ID NO: 136527 - DNA, 1053 bp, Homo sapiens
ctgtagatggtaaaagtaaagaagagaagtcctcaaaatagaaatagtgactccaggcgagaggaaagacaataaaaatttaagtttgattatgtttaaatgcttatgtttttagaacttgattttaagttcatttacagtgttaggatattttaaagtcagaaagctattagagcatttaaaaagcatactgaatattagtttttctctcacagtgtatctgtttcaaagaattggagaataatattctgttaagtgaatgttttctttgctacatttctattatggtgaacttttggtcagatttattgtttagcatcgtctgtatttaaaaccaagatgtcctgacagagaggaaaacagttataaacagagtcacatcacagtgactgtgtgtatgtattgttgaatctgccattcaaggatttgttgtagaggcatgaaatgcatccttagaaataaaatagttatttatttccttgggatttatggtattcatcagtacaggtgactcctatgattacctgtataatctcaggatttcccattgcctcaagttttgtttctaaaagacaggaatagttgaactggaccctattccaaaattagcatagtaaaacataatctttactgtgtaattttataatagcttacaattcttcaattaacatgtaaaacttctgacctttttaaaaatatcgtataaggtggaatattgtaaactcccaaattacattatcattccttttccctttctctctctctttctttaatttctacttcactacattagaatttaactgtcattttggtaggatgtatgatttcaagctattaaggtgagctgtataacagggaaggtcaaaaccgtgaactgagtcctaaattatgtagcctaccccagtgacttacattgtactttccattgtatttatgcttggctttttaagcgaattttgtttatctgtacaaaagtattgtcacaatacaaaatagttgtaatatgccactttttgagtgtctagcaatgcatattaaaacaatagaactgtg

SEQ ID NO: 136528 - DNA, 2061 bp, Homo sapiens
aggaaataagtttaatgtctagttccaaacgtttttctcagtttgccaagaaattaaaaataggaagtatcaggtggccaaaagaaataatggaagaaaacatgaaaatatagtctgtcatatgctttaagggtgaagaattatgtcatcaaccaaacctctttcttatcatttacgttttatcttaccttatatcacaatatatgttatatagtgcttatgagcttacagagcaatctaagaagcaagatatacctaaatccatgccttagctgtttttcattttccttatgggtatggaatttggccctgcttataaagtatatatttagccttccttagaacagacttcaatctgtgttctcgtagttgaactaccttttgccttattttgaaattcaattatttaactgagtcatactgtgattttcttaggctgaactcattttagtctgaaatggatggtactaaaagtacacaaatgagacctgtcttgttttcctttgactgaaaagtcagcttgcatattaattgtcttgacctgcttcactgacatttgagaaaagacaagtaatttcctgttatcccaattagcagtttcaaaccttacctggtatggacattataagacatcagctaaattaacttacaaattatgtcattctatgcacctttaaaggaatataaattatgaaagtatgggacaaaatatgaagatatatttcattcagaaataatctgccataacattaaaatactattttggttaatacagcttgaagtcagcttagaaaatctcgctttcctttgccgtatgtactagccaattcagatgaggttttgaaaaccattatcccttaatcctgctgattttcccctaagcaattataagggaactctcctggactcttgatgccttcatttactcggtgaagtcatgatgtcctttatcattgtcttgaagattacctaccagtattctcacttaatttacacgtatatgtagcttgggcttagaaatctaaagcaaaacctaggtcttttaagggggaataaaatctattaccttggagccactgtacacattagattatcaggctgaaatattattgacactttcaaaatgagatctgctgagaaatatattttaaggttatttttaaaaatctagactgagttttgtggctcacgcctgtaatcccagcactttgggaggccaaggcggaggatcacttgaggtcaggaatttgaaaccagcctggccaacatggcaaaaccctgtctctacgaaaaatacaaaaattagccaggcgtggtggcacatacctgtaatcccagctactaggtggctgagacgggagaattgcttgaacccgggaggtggaggttgcagtgagccaagatcatgccactgcactccagcctggatgacagagcaagactctgtctccaaaaaaaaaaaaaagaaagaaagaaaaaaaattagccggtcttataacctgctctataaataaacaaaataaataaataaataagtaaaaaatctaacattctttgtacactattaataacttaggagctgtgtagaatatgccactcagtagcctaaaatcttaaattattagggcataggggctagattatgagtacaaatacagagcagaagatacattaattcttgtcaatcattttaagggtcctatcttcatttcctgaagattttctaaaggtcatgaattctatttttaagaacattaaagtaggagatatgtagacaaggagaaggtattcccagaatatgaaattgtattgaaggaagaaaaggaacaagttgaaaataaaaatgttgcaacacttctcacttttttattatcaagataaattatatacacacacaaataattttaaagagcataatcatcattaatatcttaagttatagttcatgtctaaagggagtagatggagaaggatatacacagtgtgaagaaaaagacatgataaagtcaaagaaaaaatggcagagaaccttaactatatcacttttgtaaagttgagcac

SEQ ID NO: 136529 - DNA, 1024 bp, Homo sapiens
agatctcagatcccaccacaggcaactcacaacatcctcagtcccagccctcttccatattctggtctgtgaggccagaccaacttcttaaccaccttactgttttctttgcctcccaactctggctggcccagaggtgtatgccttacttcctgcagaacattttctacacttccctaagctttacttgggtcaggactgagctgctcagactttcttaacccctacttctccatcccaccttccacctgggaaattctcatcttccccaggtgatagttttaacttggtgagttataccaaaatgaagctcagtcttcagctgagacccagcttccaacatggaagggagagccattctccattacaggcccccagtgctacagaaagggagccataacattcacacagcaagaattatgtatttgtggtaacaggggggccatgctcagtctcattcaagtatgagaagcttaccataaagcaggagaaatagaacacatgcaaaagtaactcaagaaatagaatatgacaaatgtactcagtggcactgatggagtagtaaaggggcataaatgagggagaaaacttttctgagtgtttaagcacagcttgaagaaatgagaggcttttgaactggatcttaaagaacgaaaaaggtttccatagcagagatgggcaaaaggacaggcaaagagaaaaagcaaaccacacagtgggcaaaaggaggcgttcctcgggtgtagaaaaaagtacactaggacgtgagtctaaagagctgggtgggtgtgagtatccaaagccatctcctatgggcttcttaaatgttttgcctattaactttttattttaaacttgaataaaactttgtccctgtcttaattgttgaatcctttttcttttcaggccagagaaggggaagtagccattatcgataaagtcctagacaatccagacttgacatctaaagaattccaacaatggaagcagatgtacctcgaccttttcttggatatctgtcaaa

SEQ ID NO: 136530 - DNA, 1072 bp, Homo sapiens
tatgttcacttaaaaatatatgtacctgatggatgtgtcatgtttacagtggccaggttgtggcctgtaaacagcaagcagttgacgggaagactagctctgttgctactaagcagcttttacttttgtaaagtcagctctgttgttttaaatggtaaaaattaaactaatgaatttgacaagactcgtggctagcctagcatgaaagagaccttttaacactatataatatctgtacattttattgcattcgtttcaaatctaggagagaggcagcactgtaaactgaagtcaaataaattcagctcttaatgaatccttataaagcacctactttattcatgcaaagtccttaccacatttctttgtgacctaattatacagccaccaccccccaccctagtttcgagttctaactttgctgcctcattggtgatacaagccaaaagcagcacctgttcagtatatacaagtgtcttatctaagaccctgaaaaatcaagctcgtttcccatttacctgagacgaagtttaaaactttacctattcctctttcctttctctgtgattcttttgggggaagtgggggtaaccaccaaaaattgatttttttttacaaatataatctacagtatgtctgcagaatgaacatttaaaagagtatgaaagaaatcagtttttgttttgttttggttagacattccacttaaccagaggatcctgattattatggctaagggttgatgaaatgtgacttaaaaccagtgagctgtctaaagtcagggcaaaagcagcctagggtgacaccggtgacagaaaaatttaaggatactttctagattaaaaaaaagtgcttagagattttttttttccttctcagttccatatttatatcaaaccatcagagcagaactgtaaccatggctccggatcataaaatcatagttctccttacaatgatttcatggtatttaaccaaggcactctcctttcactatttattcagataatgccatctcctaggacttaattacagcctttatagccaacaattttctgagttttgtataaac

SEQ ID NO: 136531 - DNA, 1064 bp, Homo sapiens
acccaggcccccgacggccaggagcctctcgcccaccgcgccgcaccagaagtgggcccgcgcttcccgcatggcgggcacttccgtccaagcgtggaagcgcgggtcgtaacggtgcacttgggccgtgaccacccgcgagtcgtcggccaggggagaggatgcactgccggaagggctctccccacccaggacaaacaggaagttgcccgcggtgcacacgctgtgccccagcagtggtgtgggtagctgcgtaaggctgcgccagcggtgattgtacacatcgaaggccaccacgttctgggtgagctcccactcctcctcctcctcctcttcctccaactcttcctcttcttcctcgggctctggggcggcgacctggcccctagctgccctctgcggggccgcgacctcctcaatcaccacctcccgtgccctgcgcccccccaccaacaagatgcgggtctgggggctccggatgctggtctgctcgccctgcatgagcggctggcgggagggcgtcgtgtggtagttgagggcctggatgatgaggcccttgacccgggcgggcagcacgaggccagagcccgagtacacgcgccgcagtacgtcggcgggaaccaggccaaagcggacacgctccagcaactctgtacagtgtgccaggcgctcagttgtgggctcctgccgcaaccaagctaacgccaggcccagtagccgggcctcgggcacccgcgccacgtcgggggcacccagtacagccctcagcgatgtagggttgagctccaggagtcccgcggggcccgcgccccgcgccagcagctcctgcaagtggctcacgatgcagcgctcggccgcgtccagcgtgtgagccaggccaaagcgcgctgccacgttggcggcgaagcagcagttctctggagccagctggcgctccaagtagcgcccacagagccccagggcctcagtgacctgcaggtagctggcggcctccagagtgtcctctacagtgtccatggaaagcgacagccaggcagtgtagatgaagtccagcaggcgctgca

SEQ ID NO: 136532 - DNA, 1061 bp, Homo sapiens
tatcagcacctgcttattaatgtggaattgtaactccagctctcattttgtccctaaacaatttcccttacaattcgaactatgcatttaaaaggatatttcccttattttatccagtacttctcggcgttctgtagcagaagggttttcagattattcagtctgccatgtggcccaaagtagaagacctattgaagtctaggaagtatgtaaacataaatatgaccacacttcagccttagaattccaggcttgcatctagtaattctaatgtgcatctgtgcttaagactcaatgcgagagaaaataataagcttggatcattatatcattcgaggagactgttcatattttgctggaaaataatcttagactatttttcaaaagaatgaaacctttcttggcatctacaaagataaaatgcttttgctacaagtgattgccttttggtagttagttccttttatagctaattgtatgcagaagattttgttgaaattatgtattattatatagtggacaatttcattttctgaaagggtaagaaaaaaatagatgtttacatcatgtttcctgcatggaaaatttctttggccaaaattttgctgagctctgaaaacattttaaaacttttattatcatttgctttggcctgtcaatatgctgtaagccagtatcacagcatttgaactttggcagttttttagctgaatgaataataattcagcaatttttaattgtgtcactgataactaaacaagtagatgaaaaattttaagtaccaaatacagccgctgtctcgtttgcaattcttactaaaacccattgtcttatccattttgtgttgctataaaggaatgcctgaggctgagtaatttataaggaaaagagatttattgggctcacaatgttgcacgctgtacaagaagtatggcattgacatctgcttctagtaaaaacctcaggaagcttccactcatggtggaaggtgaagggggagcagatgtgtcacatggcaagagagaaagcaacagagagacaggaggggtacccacactctt

SEQ ID NO: 136533 - DNA, 1141 bp, Homo sapiens
tctccattttgattagggtacacgtatatatatatatatatatatttatcaaaactcacagaaatggacaattgagctctgtatgtatgatttcattacatgtaaatttacacttcagtaaaaaggataaacaattaaatctggatatctatgacagggtcggggagggagagattattacttcagacgaccccaaatcctcatgggttaaaagaaacagcaaacccctgaccagaactggcgagaatggagagtagacagcagggagggccaaagcctaagaaatcgctacaagactagatgccgagttcgaactactgcctggacggcagcgcccgagcgcccgcaaaaataagcccccgtgccatttccggtactagcaaatcctcctgtatgtccccactggaagagtccggtgggaaaccgtgccaccgcaaggaaggagccggcggtagcttggttcctgagcggatgctggggctgtaaggcgcgcgcggtcagctgttggcggtgcagggaggaggacgccggggctcgccttccctcctctgccgccgctgccgccatgattccggtgtcgctggtggtggtggtggtgggtggctggactgtcgtctacctgaccgacttggtgctgaaggtgagggccttgggcctaaggtccaagcccgcggtgcccatggccggagcgcaaggccttcttttctcttcccctgcctggcgcctcccgggctggacggtgcccacgtgcgacagtccgcgtggtggatcggcccggtggagtaaataaaacattgccggccgcgggagggttgtggcggcctgcgcggctgccactgtcgcagtgcggggcagtgcaggcccttcagccttcgggtcctgcccgggaggcgccagtggtgggatcgggagggccggggccctgccagacccagcagctgcagtgcagcagggaggaaaagaaaacgtctgcttagtaaagacagtgctttcccttattgtttttaagttcaaaacgctctagagactcagatattggaatgaatctaaatcaagtcgtgattgaaatcagtagtctcaaatttttaaatgcatatgatcatctggtttgcggtcaaaatgcagattccgattcagcagg

SEQ ID NO: 136534 - DNA, 2466 bp, Homo sapiens
catgttgcatatgtgaaaaaaatctaaaataaaaagaacttttacagtccctagtcacaagtgtgtgaggtgaccaagatgtcactggtttcagtaacaacccctagctccttaagaatgcaccaacctctgagcaaaagacctaacgcctactcagagtatctgcctgggaaatggagagacctcaacttttaggagcctgcacctttagtttctctgcctccagcttggtctgctgatccaccctgggcttttctaggatttctgcatagacatctgttagagaagttgtgtcactccttttccaagtcttggaaaacaagtacacttaaaatttaactacctgaagactgagagcagataatactacagatccaaagcaaacagctacctatattcagactatggtcattttttaagactatgatagggctaagatttccttcttggacagataagtttctcacatgggtgggcatgaatatgacaatacttactgtacttactgtgtcaggtatataacacagccttatgtcatccaaaatcctatattagtcaaggacttcaaacttccctaaaggtaaaactcttgttggggctgtgtataagcccctatccccacaaccccagagaatttaagggacattattgagcccaagatggctttagataagttttttactttttacatgatcgaggttggcctaacttcttagagttgttgctcagaagaagaaagcaaacactgatcgcaactgtcccttctcttggattggtagggtttttttttttttaaattataacacaaggcttctggaccagtgctgtccaatatggcagctattagccacatgtggttattgagcctttagtcagagctagtccaaactgagatgtgctgtaagtataaagttgatgttgaaattcaacgaagtaatgccccccccaaaagtaaagtatctcaccaatagtgtatgttgattacatgttgaaatatcttggatattttggggcataagtatacgaaaattaatatttaaaatttggctgttagaaaatttaaagttatatatgtggcttacatttgtggctcacattatatttctattggacaacactgttctaagcaggggtcagcgaactttttgtaaagtgcttggtagtaagtattttaggctttttgggccacagagggtctctgtcgcatatttttggtttttattgtctttttataatcccttaaaaatgtgaaaactattcttagctcacaagttgtgtgaaaacagtctgtagttcggatttggcctgtggcccatagtttaccagaccctaatctcagtagaccggttaggtctgtgacctttaatattctgaagaataaacataaagctttaagattataaacatttgggaagtcagcatcttaatttcctctagaaaatactttgtgttattttcttacacattataaattgttcttcaaaattgagtgatgtagaacttttctttctctcttagtcatctgtctattttaaacattcttatgaagactggctggaaaacaacggactgagcatctcccctttccacataagatggcaaactgctgttttcaatcgtgccttttacagttggggacggcggaaagcaaggatgctttaccaatggtattcttcatcttcttttgtttggtttaggttaatcattaagtgatcacgacagacagcttgttaaattaactatttccattactttgcagttttctgagttttaaaatattgacaatattaaaactttctggttttatataaccttatgggattgtatcattgtggcttgcatacattaaaaatcaaggcatttatggcaatttatagttaggggctttacaatgatctctgggacacccaagatacaggcaggttctgtagatgagagaatgtgagggtcaggggtggcatggtctagatttctttttgttaaaaatttagccccaaatggattagagctaaatgtaaacaatcagatcatcagagttagcagaaaatgcaatagcagatcaaagcatacaaagtggaaagaaggatataataaagataagaacagaaatcagtgaaatagaaaatatacaatagagaaaatcagcaaagccaaaagttggttctttgaaaatattaattgggccgggcgcagtggttcacacctgtaatcccagcactttgggaggctgaggcaggtggattgcttgaggccaggagttcgagaccagcctggccaacatggtgaaaccctgtctctactaaaaatacaaaaattagccgggcatggtggcgcacgtggtcccagctactcgggaggctaaggcacaagaatccttgaacttgggaggcagaggttgcagagagccaagatcacaccactgcactgcagcctgtgtgacacagcaagaccctatctcaaataaat

SEQ ID NO: 136535 - DNA, 1143 bp, Homo sapiens
gaaaaaagaaattattattaaattataccatgttaatatttaagctcattttatcacaaagtaaagctgaaatacgatgcagacaatagaagaggtagatgaaaaaggatggatgtctataacgtcaaaagggctttcataacgatataaggacaagatcaaaacaatattatgtaaatgagcaagtgcatgagaggaaacaaacttttttattgggaatgatattcagattctttagttatcagagaattataaattataaaactgcttaaactagtgctcatgctgcagtcaaatatttgaagttcatgtaggaaaaagaagcagagttactgaaattttttagccattattttaaagctatgaaatgtggctgcttagtgaatttgctagtccatgaattgagagaaattgtaaattaacatgatttttttcccttttgacaggttcaattttggaatggtgtttggcgtaattgccatgtttagctcattttttctccttggaaaaacgctgatgcagactttggcacaaatgatggctgactctccctcttcttattcttcctcctcttcttcctcttcctcctcttcttcctcttcctcttcttcatcttcttcctcttcctcgcttcacaatgaacaggtgttacaagttgtggtaagtatcgtcttttcgctttaaataactatcgaaatagagatgcaagataccacttatgatctagtgtaactcctatccataatataaatatgaaaataaattaaaagtctcataattttcaaattacctgcttacacaaaaaaattaataagaatacagcaaggaattgttgaaatatttggtagtagttgtaatattaatggtaaaagagaacaaatgaaccatcattaagactgtcagcaattaaacagatacgtgactgtctttttaagatattaaatgattgttattttcaaagaataggcatgctgatttaagatctctataatgtataagtaaattgcattctaattatatgcaaagtgtttccctttccttttcatggccttcagagcctaaccaataatatccttttaattaaagatataagacctttctgaatggtcactgtgatttcttaatgtgaagaataatgtgctg

SEQ ID NO: 136536 - DNA, 1316 bp, Homo sapiens
gagtgaagatgtggagatcatttaagagcagtaatttattttagaagtgataaagatataaaattagtggcaaggagaatgaaggggatggattcaagtaagcttttggagtggaattctcagacattggtgattaattaaatgtgaggctggagggagaaggaaaagtttaggatgactctcaggttacacaattggttcttgttcaacaagaaagagggtaagagagaaagaagccagttggagaaaatatgatcactggcttatctgcctgctagaattagaatggcaaaacgttgtttagagaagaaattatttcttctctttgccactcagtttattcatagtactcacaaaaatgtcagctctattaggagatccgtgctttggaaccattaagaagtcagctgccctctggagcccaccatgcatattcatgtataagtttaagaatgttatgaatcctgactttgacatgagctcttgtagcttaagtaacatactttctgtttactctataattcctgacagccttgttcagtattaattctccaaaccatggcactctgtgttgttgaaagtattctgtattcagtattctggtacatctgataccctgtgtgaatcatggcagagacagatgggcaatcgtgtactgttgccagcaaataagacctaccatctgttggtattatcacacattcaaattcttactttatctcactcactagtacatgcagaaaataataaagagaaggaagaaatatcctattggaccaagcttactgatttatttgaaataaaggtaaggtaagcaggatattttgtgatatagagggtatgtatgacagtcttaagtatgtaaatttagagaggggtcagagaaaagtataatactggaaagatgtctgacaacttaggaatggagcaggtatataaaaagggacatagaagttcttgagaaaagttgctcaatagggtccaagtaaagagaatttcagataatgaacattataaacatatccatttcctttgactctttacctccacatctgggactctagcttaaggaaacactttcaaatatagaaaaaatagtattcattaagctctttagcctaacattatttattattatgaagaattaaaagcaaccaaaatatctaattgaggaatggttaaattattggattgtcattcaattagatattatgcacacattaaaaatgattataactagtttcggccgggctcagtggctcacgcctgtagtcccagcactttgggaggccgaggtgggtggatcacctgaggtc

SEQ ID NO: 136537 - DNA, 1021 bp, Homo sapiens
agcactttgggaggccagggtgggtggatcacgaggtcaggagatcgagaccatcctggctaacatggtgaaaccctgtctttactaaaaatacaaaataaataaataaataaaaattagccgggcgtggtggcggacgcatgtagtcccagctactgtggaggctgaagcaggagaatgagatgaacccgggaggcggagcttgcagtgagccgagatcgcgcgactgcactccagcctgggcgacacagcgagactcgtctcaaaaaaatatataaataaaataaaataaaacaacaacaacaacaaaaatgattataactagtttcttaactagagaaaggacacttggaattaatggaatttagaaaatgattcaagcagcattgtttgaatcttcagttactaaaggaagctttttagatgagatttctgtgtccataaaaataaattccagttgaattaaaattaaaacttgaaaccataaaaggccttgaaagaaaagacccatgttatcatttttatgagcacagaatgaggaagacatagagcgaatagtagaaaccatgaatattttttatgtaacagtaacacctttattttttattttttaaatactttattagagcagttttagattcacagcaaaattaagaaggtacggagatttccccccttacaatgatgaaccgacgtgaatatgtcattaccacccatagtttacattagggttcactcttggtgttgtaggaaaccatgaatactaatagatttgactacctaaattttatatatcaaaaactaaaaacaaagtaaaattaaaaggcaaacaaactgtggaatacatttatgtcatgtattacaaaggaccaatgctgatatttgaagtgatcttacggatcagtaagaaaaagttgaatactttaggagaaaacaagtcaggttatcagtaggcaactcgcagaaggaccaaaaaatggtcaaaagtacggggaaagttcagctttacaaatggtcaaag

SEQ ID NO: 136538 - DNA, 1569 bp, Homo sapiens
ctaggaattttaacaaggattcccaaatcaggcatccagcccttgaggttgggtcagctgctgcctgcttcactgtcatcctgcattccttggcactttgctgggctccctcattctttcccaaggtgaagactccaggaagctaacatctcaactgtttaacctggtgtttctcattctctttagactggtggtgtgcttgttccagagaaactggctagttcgaaaaatgaaatagcgtttttgctttttattatgatagaaatggagaagtgaaccattgtcatattacttttagtttgcagaacattcagcttgaaggtttaatacagaatgaacatcatgtatcttagtgcccaagtgggactcccctgcacccccactgataattgctgccatattgtgtctatgaacaggttcctggtataaatttacccgtcaatcaactgacctatttcttcacggcagttctcattagtggtgttgtacatgaaattggacatgggatagcagctattaggtaatgatatttacctttttctttgtactacatgcaaaaaaaagcttttcatttaggaggatttattactaaaatctgctatatttgatacttcactatttttctttctgcggctattgcctagtgcatagccatcatttgttactttgaggaagcttctttttttatagagaagattaatatgttgatgaatatgctccattaaccatgggcatatctgtaatcagggtctttctatcctttgccttttccagtgtggttatcctcatgatgcctcaaagttttttaccaagtcctaaaagccaatctttctgttcatcgagtcagaatgataaccactgtactcaaaacccactcaccttagaacttgatttgacttatcagctgaaataatttcctgcttctgcttatgtcctctgctggctagagcaagaaaactgaaagcactgggtttaacaaatatcatagtctatctagaaacccaagtggaagataagaagacacctgggactagctttgagtatcactccctgttcttggtcttggcttcccaaatgtatcattgtaactatacctaagcatttagaagcctataacacatataaaatcatgatggggagagggccacgtcataactcccctgctacctccactgataattacggccataattagcaagcatgctaataggaatgtgttttatcctttcggtgtgtggaccagagaaaaggttaaaaacctctgttttggcagagaagatgtaatcacttcttattactttccagttgtttatgaacaagagtctatttattggcaataaatcctcatcttgacagagcatatactgttacacagatgtgcacaatagtggcttaaagtggtggctgctgggttttttttttcttttaaaatcgccttcagtgctttgcagcctttaggattttacctatagacacatcgttaataacagcttaacaatttacagtatgtttgtaaaaataacttgggtaatttttttttaagtcccaactgccaagaaaaaaaatgaa

SEQ ID NO: 136539 - DNA, 1030 bp, Homo sapiens
tttaaacatacttatttaacgttagcttgataggaatacacctagataaatctccaccattatttataattgctaagacaaatacaagttattaggtaatttacttgaattatatcgtctcctatgttcttctctgaaaatagttcagagtaaaccataaaaatgtttttcatttagtttctcataaaagccatttctgtatatatgtgactaacttcaattatttgctcaacatattggtttctaaaaattttgaagttatgtctatttcagtatgccctattttgcaaaattcaatttcacagataaccaaatctgtacattattataaaattaagattatatatagtatagatataatttttttggctgttcagagagactttctgttttttaagcaagaattcaaattacagtgaaaagttttaagattatgtacactattaatttgataaatataatagtattagtaaactcctttttcttatgtgatttcttagggaacaagttcgatttaatggctttgggatttttctcttcattatttatcctggagcatttgttgatctgttcaccactcatttgcaacttatatcgccagtccagcagctaaggatattttgtgcaggtaacagacttaattttgttttaatattcatctgtggttttggttttgattttctatggttagtgctttttggaaaatatatcacaaatgacaatatcttatcttttggttaataacttcagtttataagaccccttcaaaagtagaggagtaaaataatttacattccagttgcttccttaaaaccaactaaaaacaacataattttaaaaaatttaaaaacagaggaaaactttgttttgtccacaacatgaaatcacaaactatgaagaatgtcaactcagctgaaatagaatgaaatttgcatcaaatcaagggagaatatgaagaattgactaagagataaatcaaaagtatccaggaatggaaaaaaagggttatgaaaggatgagtagtgaactc

SEQ ID NO: 136540 - DNA, 4550 bp, Homo sapiens
cacaaccatccgccattgatggtgttgcagccgctcttcacgaacacgggctatggcgaccacgaccaggaaatgcttatgttgcagacacaagaggaagtggtgggctattgcgactcagacaaccagctaggcaacgacttggaggaccagttggccctcccggatagcattgaagacgagcacttccagatgaccctggcctctctgtcggcctcggcggcatcaacatcaacatcaacccagagccgcagcaaaaagcccagcaaaaagcccagcggcaagagtgccaccagcactgaggccaacccggcaggcagcagctccagcctgggcacgaggaagtgggagcagaagcaaatgcaggtcaaaacgctggagggtgagttttccgtgactatgtggtcccctaacgataacaatgaccaaggggcagtgggtgaaggccaggctgaaaacccacctgattattccgagtacttgaaagggaagaaacttcctcctggggggttaccaggcattgatctctcagatcctaaacagctggcagaatttactaaagtgaagcccaaaaggtccaaaggagaacctcccaaaacagtcccttgctcttatagcggctgcgaaaagatgttccgggattacgccgccatgagaaaacatctccacatccacgggcccagagtccacgtatgtgcagaatgtggcaaagcttttcttgagagctcaaagctgagacgacaccagctggtccacaccggcgagaagccctttcagtgcacattcgaaggctgcgggaaacgcttttcccttgatttcaatttgcgcacacacttgcgcatccacaccggcgataagcccttcgtgtgccccttcgatgtttgcaacaggaagttcgctcagtcaaccaacctgaaaacccacatattaacgcatgtgaagaccaaaaacaacccgtgaaaaggagaagacccctctcagacttgggaattatcttccaggactgcggtagggaataaatatgcctctcaaagctttgtatgttgtttctaagagttttaaaaaaaaatgaatcctgcacatttaaggttcgtgttttgttagagtagtaaaaatagaatttaaacgtttttaaaaaggtaaaccttgacataagataatagtgctaagatgccatagcttgttctgtaactatttttgtaaagtttggtcccaacaggagaaaaattcgtagacttcacatcaagagacggttcttacaaactgtttaaaatgggacttttcacattcttagaaataggaagttcatttattgtttacaatgtttttaaaaaacttgttaaaaaattcaaagtgttcatgtttatacttttaggaatatgcttaataagtctatgtatggtttttctggaggttgataactttgggaaagatttactttaaaagagtgaacaattatatgcatacgtgaagtattttcctgcttaaaaaagttatataggtgttatttgttttaatcttggttgtagtcttggatgttaacacatcttgcattttagctgtattaggtcatgtagtattgatattaggtgatttaatagtactagtttaaacctattttagtcattttattttccccaaaatactaccagatgctgttgtttagtgtaatttctttgcctgttcagttaaagtagtgcttgcttgtagaatatattgtgtatatgttgactttaacacttaagaagtacatcctgtgtaatagaaaaagcaaaataaaacacctcttctaaagaaggaaaaaagtagtttgcctatatcagtacagaagttagaactaaagaaaagggggagggtgctactggcatctggtgagtggagggagatcaggaatgccactaaacatcctacaatgcacagacagccccacgaaacacataattatttggctaaaatgccaatagtgtcaggtgcaggggctcaggcctgtaatgtcaacactttgggaggccgaggtgggtggatcgtttgagctcaggaattgaacatcagcctgggcaacatggcataactcggtctctaccaaaaataaaaaaattagctgagtgtggggcgcacacctgtggtcctagctactcaggaggctgagatgggaggatcactggagctggggaagtcgaggctgcggtgagccgtgatcgagccactgcactccagcctaggtgacagagtaagaccttgtgtcaaaaaaaaaaaaaaaaaagagaaaaaggggcagaggggctgggcgcagggctcctgcttgtaatcccagcactgtgagaggctgaggtgggtggatcacttaaggtcaggagttcaagaccagcctgtccaacatggtgaaaccatcccccggctacttaaaaatacaaaaattagccatagacttcgtagacttcacatcaagagacagttcttacaaactgtgtttaaaatgggacttttcacattcttagaaataggaagttcatttattgtttacaattttttttttaaattgtaaaaaaattcaaaatgttcatgtttatacttttaggaatatgcttaataagtctatgtatggtttttctggaggttgataactttgggaaagatttactttaaaagagtgaacaattatatgcatacgtgaagtattttcctgcttaaaaaagttatataggtgttatttgttttaatcttggttgtattattagatgttaacacatcttgcattttagctgtattaggtcatgtagtattgatattaggtgatttaatagtactagtttaaacctattttagtcattttattttccccaaaatactaccagatgctgttgtttagtgtaatttctttgcctgttcagttaaagtagtgcttgcttgtagaatatattgtgtatatgttgactttaacacttaagaagtacatcctgtgtaatagaaaaagcaaaataaaacacctcttctaaagaaagaaaaaagtagtttgcctatgtcaatacagaagctagaactaaagaaaaaggggagggtgctactggcatctggtgggtggagggagatcagaaatgccactaaacatcctacaatgcgcagacagccccacgaagcacataattatttggccaaaatgccaatagtgccaggtgcaggggctcatgcctgtaatgtcaacactttggaaggccaaggtgggtggatcgtttgagctcaggagttggacatcagcctgggcaacatggcataactcggtctctaccaaaaataaaaaaattagctgagtgtggggcgcacacctgtggtcctagctactcaggaggctgagatgggaggatcactggagctggggaagtcgaggctgcggtgagccgtgatcgagccactgcactccagcctaggtgacagagtaagaccttgtgtcaaaaaaaaaaaaaaaaagagaaaaaggggcagaggggctgggcgcagggctcctgcctgtaatcccagcactgtgagaggctgaggtgggtggatcacttaaggtcaggagttcaagaccagcctgtccaacatggtgaaaccatcccccggctacttaaaaatacaaaaattagctggggttgctggcatagcacctgtaattccagctacttgggaggctgaggcaggagaatcgcttgaacccaggaggtggaggttgcagtgagctgagagagtgccactgcactccagccggggtaacagagtgagactccgtctcaaaaaaaataaagtaaatgccaatagtgtccctgttaagaaaccctgctgtagaaaaagtaaaagtttataagaaagattccagaggtttgcagtacttataatccaatcattaatgggcaagaggttgttcagatgaaagaaatgtttgtgctccaccaccctcattgccgcttaaccagcatgggtaaatccagaatcagaggggtgatctggtactagctacatgcctgacgagataagagactacacaaatagtcaaggaatcagtgctgctgagtgtcccggcttttactcatttgttcatgtcttgtttctgtgactagcaactgagctggggttggggggaattcatagtagtatcctaaattagtttccccagagtaaattactgtgcatcaaaggattaggttttttaaattttgttttaattttgttaaggaagctatgaaagcagtacaagaaaacacaagtgaatatcttttataatcttgaggtggaaaaggcttagtacaaggaactatttgatcacacaaaaatttaaagtatctgtacaggcaaaacaacaaaccacatcaaacaacaaactggaaagataaaattataatacctgttacaaaggaccaaattcctccctatatagattataaataatagcatatacaaattagtaaattaataagacaactcaatcaaaaaatggcaatggatagaaataagtagctcttaagaaaatgggctttaatttttcacccagaagactggcaaagagtaaaattatg

SEQ ID NO: 136541 - DNA, 1920 bp, Homo sapiens
gaaagaggaaaattacctttgtgagcaattggcttacatatacattgtactgatggtattgcctgcatattggggatatgaaaggatgtgtcttattgttttatgcgttaaggatataggaaaggcaagacagtctgatgatactttcaccaaaaaatttttaattggcagtttgggaaaaaattttatcattttagtcttaacagtcagcaagtcggctttttttcaattgtgaaaaattcaaaatcttggagaatttgggaaaagcaactataattgttgggttttattttaattttctaggactatgtcttgaattcaaagctggattattttctgcattcaaactattcacttaattaactcagtgtctttattatttgctcagattaattatagcttgtcttcatgcattatctgatttggttttaccctcttcccaaggactctcctgccattggacccagaggcctttttgtgggagaccttgtcacccatctacaggattgtcctgttactaatgtgcaagattggaatgaatgtttagataccatcgcctatgagccccaaattggttactgtataagtgcatcaactttacagcagttaagtttcccagttagaggtgtgtatatttcctcaatataatataatgcttcaagcaccagtacctgccattcactaatccttaaaccatgtctatacatttattctgttctaatctgtttaaagcaaatcagtaaagtaaatagattccaaccaatagacatttttcttggtaagttggatgctaatatgtgtttcctttattatatattgttgaacttctaactattttcattatatcatatttaacttttaggactctaatattttctgctttcaaaacacttgtattaaatcatagccgggcgcagtggctcacgcctgtaatcccagcactttgggaggctgaggcgggcggatcacttgaggtcaggagttcatgaccaacctggccaacatagtgaaaccccatctctactaaaaatacaaaaattagcagggcatggtgacgggtgcctgtgatttcagctgctcgggagtctgaggcaggagaatcgcttgaacccgggaggtggaggttgcaatgagccgagatcgggacatggaaagagactctgtctcaaaaaaaaaaaaaaaaatcagcattcaaggtcaatcataaccaattaactaattccaataatcaaataccccaatataatattatctttatgcatgtctgtagatatattatagtactttaaacttttataattgaaaaagggaatataagtaataagaaccggttctactttgcataagcttatgtcagaacagataaacaacgatagttaacaactaaatatataaaaatcaaagcataaacattctgtattaatatattgttagcccaacacagacatgcaataaggaaagattacaagaaataagaaggaacttggcaaacaaaaaaccccatctgggatttagaaaaaattcccttacttcttaaaaattcccttaatacttaaacagttctagtggaatcagtgttggcatgtctgattctatctggggtagagttattttatgtattttatgtggcagccatcctaaagaagttgtcttggcttccaaaaataccatgtgaagtcagatatgttgctctgtgcagcagatgacagagctgaggcaagtttcttctcggatcctgccaaacttatttagagttatttcagctctgaaaaatcagcttcccaattctttatacaaaatcagcttcccaattctttatacaaaattggaggtgttagaaaatagaaattatgctcacagactatatctttaagtaaaaaaatatcctgatacttgtccacatctattggtgtagggaaa

SEQ ID NO: 136542 - DNA, 1757 bp, Homo sapiens
ttgggcatctctggttctctagggggagccccaaagtaagcctggggtagaatcggtatttggatataatggggatgtcttaggcaacctctggccccctctgtttaccagcaccacagtgcaggggttcagcagtaatgttggatcattggcattcaggcacataatagtagttcattaaatgtttgtgcttgaccagccagacttattattgtgaaacctactgagacactgcaactccggctttatgggtagctcagtttatatgaggacaactaacctagggtaactgctgcttcatgatttaaaattgaatggatctcttttggtaatgtaaaatcaaactgcagcaagtagccctcaagctgaactctgaattatacagttgcttctaaattcatatgccattttacttattctttttgtcttaaaggcattttttgttacaaatgtatttttatataagagactctaataaacagtgtatttctctttagcatacaaacgactagatggttcaactgaatgctgtaacaatcacagcctcacagatgtgtgcttttcctacagaaataattttaataagcgtttggtaagttgtccctgaagcagtcttgcttgtctgatataattactaaaaaataagcatatagagctaaaatggaatctatggaaacttctctcttttgctctatttgtatcattttattaaaatctctacatttcacatgtcacatttcatctgaaaatctttaaaaatttatagtgataatatcttatttgacccaaatggggtacttgaatctattttatagtagatgcacataaatggcatttcttttatatgaacctcattcctgatatgctaggtgacatgaaaaatattgaaggaatgtaacttaggtttttcttaatcatttttaatattgactgattaatattttatttatagcatacatgtcttcctgcccggaaagcagttgaagcaactcaagtttgcagaaccaataaagactgtaaaaaaagctcaagttcaagtttctgtataataccttctttggaaactcacactcgcttaataaaagtaaaacacccacctcagattgatatgttatacgtaggacatcctctgcatcttcactacacaggtgagtatttttgtggtagacccttagaaaatcattaagatcacatatagtctcagtggtagagactcactacaaatccttgaattaatacatttattataaatttgatcatttatcaaagtcttgttaacttgttcttaagcattaagtgaaaattatgcagtaggaaaataatctgaatttataaagtaaggtggagctgaatccatgcctgcctatggagagtgacacatttttccttccctaccatttatgcccaggtcaaataggtgatctctcagatgtcctctgagagtttattaaatttatacaagctccccaaaacaggcaagagcaacataccctagagaatgccaggatgcatggggatgtaactgtaatttatgtgtgacacatgattttcatatgaatatactttcaaaactgggccagcataatcattttagcagtggcagcatcattggactaagttctttatggctaaagatcatgtagtctaactcattttgttgtacaagatttttaaaatagtttaccatgcgatttacccattaaagtttacagttcagtggggttttgtttgtttgtttgtttttgttttgttttgag

SEQ ID NO: 136543 - DNA, 1175 bp, Homo sapiens
atatcctgagatacaaccgaggtcatttttcttatctattagtttgacactaaattactgtagactgtaactatgaaataaaacctcaacaaatgaataaatgtccctagtgggggtaattcaggaatgtgtactgtgagttctgactaattacaggatagttttaaaatgttttgaacaaaaacaggattatggaatccacagagtagatgagactttaaatcccctcatcttaatccttggtttagccatgaagaaaaaaaaaagacctgaaagaggttaagtagtataatagtaggagtaaatgtaattttaaggttatacctctttgaaagggtaaggactcttaatgtaaatttcttactctcgcctcaaaatgtaagtacacactgggacgtattttttcattctgctgtttttattagatgttctagaagtattgattgcttttatatatgaggtatatggcctgcatatgtttaggaagggctttctcaatcagtttaatctgctagcccaatttttaaccatatggtagaattcataatgctgttgattctctggtatgaataatatttattattccttatttttctttttcagtgagcatcaccagttttatcccacgttttaactttctaagcatagatctgccagtggttgtggagacatttgtcaagtatcctttctggtgtgaaacatgttttaaaagtgtgttacttggatcttgatcaattttaccttgaatacagcattacaaatatagacctcacaagtatcacttaattgctaacaactaaaaaagagtcttgaaagatgaaaaagatcagattgtacccaggagggaagaagtcagaggagaaagattaatcagagtgagaaaggtttagatgtagaagggaaagaacccagaatacaaattgagaattgaatttacaagtctaaaacattttagtaagtttataaaggatggaagcttcagttactactgaggtaatgaattctgccccatccgagattgttagttctgaccaaatagagaatgtaatcgcataaccaggaattatgtaaatcccagggaggaatgcacaagaaagatcgagctggtttcaactactaagatagcaattcagagggccaaatcttattgtggtctttcgcatattatgattgca

SEQ ID NO: 136544 - DNA, 3516 bp, Homo sapiens
cagctttgtcacaaagagacttatgctataaccttacagagggtagtaaaataaagtaggcttcaaggaccaaagtctttgtttcctaatataaagtaatactttgtaaggcccaaagagtaattttccccttatttcttattccttccacattcctttccctgttgtatcattaaaggattagaaagacttagtcttcctacgagttcattatagattggcttagtttataagtggttggcctttatttttctagtcaaggtttttgaactttgaaataatataaactcattttttttaagtagtagagatctaagaaggaatggcagagatttaaagaaagtagagaagtcaagtgtaatctctaattcagtcacagtaaaatatcttctgactcatagaaatatggtttctactcagacctctcacagttggttccttaactgattttaacccaggtacctgatttccctctcaggagctctggctattgttaatgcagtaccctgctttgctttggatggacaatggattctaaactctttcttggatgccacccttacctcagtgattggagacaatgatgtcaaagatctaatagggtttttcatcttgctgggtggcagtgtacttttggctgccaatgtgaccctgggactctggatggttacagcacggtaatgtttgcactcatctgacagaatccctgagttacagtatacagctatgtggtaatattcattgccattgaaattcttacttggtatgaaatataaagtgtttccttaaaattacatcttagccaacaaccctgagctcctcccatatccagagtacccaaactctgtggtagaagataagcagaagaaatgaaaggcatagtccctgactatattctaatttaggactgaatgtacccagatgcttgtggaataatatctaagcaagtgcaaattcatgtaataccgttttgtctgattacatattgtgttgaaatagtataaaggagaacagaactgggtggaattaattgggaaaaacttcttacaaaagcatcattaatcaaaatttgaaggagaccagactttggccaagtggaaggatgaccattgtcttggcctgtatctcttgtcctttgtcttgtttgaaaagtattttaaaacttaatggtgtattattttgtgctctgaaagctgaggtctgattacaattagtaaaattctatagaagaatctgctgacgtgaaagggaaaaatctttgtcaaatgataccaaataaatgaacaaaacaggaagtagggcctatgatatcgtgagacatgttttgccccacaagagttgcatcttttataaggtgtctctgccccctcataaagcagcactagctttgacatccacggtgagctgcaggaagcatcacacaccagcagcatgtgagcagagggaggcagttggggttgaacttcggaactaggccgggtctcctgacagatcacaagacaccccagaggatcttcagcagtcctacttcccattctctatagagctttgaagcttggaacccttccagggtaaacattttctcttgtgctgctcaggacatctggggcctagctcctgggttcctgtctccaagaagcaatgaccttaaactctgagccatactctgtcctcaccagcggctcccatgtttttctgtgtcaggttattaagtacctagtccttgttttctgtctctctcctaagctacctctctgggtccacagaagacttggtagtatagtgagaatggctatacgtgagtacaaacgtggattttccagggcttgggaactgattcttgagcccagaagagccacgcctgctttgaggtcttttggagtggagatgcagccctgggaaatttggggagtcagcaggccagtgtgaagctattggtcctaggagtatatgagcttgctgtttctttgatggaaaatacatgcttctcttgtatactcagaagtgactaagggcaataactcattaatagccatctatccaacttctttactgagtgatgtattccatggggttacctttttcagattattgagttgctctgtaagcactaaaactttttaatcatttttaagaaactttttagattgtattacaaatttgccttaacagtaattagatgttgaatataattttaacattttattaatgacttgggtcatcagttaataccagtactaaaaccatacgaattattggtttattccagaaaatacagtatttgttctatttttaggtagacaatcatttgggatcagagtacattagcatagtaatgctcagtcagacctgttcaagtagtagagcttggagaatgccatgaaatacttatataattaatttgattgcatgaactaagcaattttactaatgaaaaggttgtatatgtgcaagtcacttttttaaaaaccaagaaaaaactttaatagaggaaatcttattcattaatttatttttctgagtaaaaaaacgaaacccaaatctcattttatttcaactgttaaacattttgatctgttgacccataggatcaggatttgggaaccactttactaggaaagagcagatcagtaccatttgtataaaaccggcctcattatgtaagaaagaaaatgttacgtgttttcttctttagcttggttgtgggcacttctacagcaaggaccatatcatattcatctttgcatccctggcacagtgcatgagacataagtacttaataaatgcagttgaatggataatgattagtgttatttatggattagaaaaagcatgtttctatttaagtaagctgtaaaaagtattattgaatatttactgtaaatatatgttcacataaaaaaataacttggagggtctttgtgtccctggcatattatcatcttcatggaaagaatccactgtggtttctgtagagtgattggaaaaatggattattttgaggattgaagaaagtgttctttctgcgttgtcactttgttcaacagtaaaactttattctcagtgttcctactctgcattgtttacatttttgacagttttttttaatcacctacaatctgtaaagaatgtatatattcttttcagcatctcagtttgaaaagacatgcagttaaacttgaccttttgataatcgctcttacaggtcattgtctgttctaacagcaaattgtaaacatgtgcttcatagatattgtggctctcagtcatcactttgtcctatggtatttattgaatgttcacatactaatggtgcacaggtgtttttttctataaatcttctgactgtcctgtaattcattcttaagctttaacttgaaggtatcgtaattgccggcatttgatgtttagcaataaaagaataaatgtgtaccagcattttatgtttatcatcgtctatgtgttgtcttttttgaaactcttttctatcaaaattgttcctattacataaagcaa

SEQ ID NO: 136545 - DNA, 1475 bp, Homo sapiens
gtggaagtggcatcttaatttagttgtgcaaagaggaagtaaaaagattgacgataaagacgtgtatagatcagaatagaacgttcttaagagggaaagatgaaacataagctgttaatattttaattcccagtctgttcttaaagatgagaaagctttgatggcaaggcgaacattctagaaagaactattacgtgtgtgtgggggggtggggaatgtgtgtatgtatgcatctgtcagaccttgagtcattacaagtgttctgggcgtaagaactccgattcatattgcattctcttccatcactttatttggggtgaagcacatcgtcctgtcagtatccacatttgaaaaataaagagatcctggctagattgggatctaagttcacttagtttttagtaaggggaacttggtgaaaaatcgacttgtgaggtctccagaaacacttaattgataatgagtcaaaaggcattactcttggcatgtgaatattggatgtgactcaagggtgagtcaaatgcctgtggagcctggattcatgttcttttccccgtttgtcagtaatcctttctaatgttccagttccatgatgtgattttagtggaattaaacttgaaccacttagttatgatgttgttactgtgttgggaacgcagcagccaccagaccaccaagagcaactgtaggttgggcttggtggtgctggtttagtgttgtggctgatgaggtgtaacccaggaaatttttatttttgcttttaaaaaaacaactcatctgtggtcatcttgtaagtgaagtattggactataaggactcttgagcccgaaaaacattttgtgacttagcctgaggctaacaggaataaacttgtcccatgttcagatagtttaggcatatctgagttggtggaggaaatgtgatctgttcctagccctatgtgctaggcaggatgcctgggtatccagagagtgagtgagaggcccggcgcgatgccgcatgcctgtaattccagcactctgggaggcgaagcgcttgagcccaagagttcaagaccagcctgggcaacatgggaaaaacctgtctctacaaaaaaaaaaaaaaaaaaaaaaagaaaaaaaattagccaggtgtggtgagttttctgcacctgtagtcccagctagttgggaggctgaggcgggaggatcccctgagcccaggaagtggagactgcactccagcctggacagtggcgtgaaactctctcaaaaacaaaacaagggccaggcgtagtggctcatgcctgtaatcccagcactttgggaggctgaggtgggcagatcacctgaggacgggagtttgagatcagcctggccaacatgatgaaaccctatctctactaaaaatacaaaaatcagccgggtgttggtggcctgtgtctgtagtcccagctactctggaggctgaggcaagagaatggcttgaacgaggga

SEQ ID NO: 136546 - DNA, 1869 bp, Homo sapiens
cggtgattctcaatgtgggtgcttccctccgtgggtgacatctggcaatttctggagacagttttggttgtcacaactggggagatgctactagcatctagtacgtcctgcagcgcacaggacaactcccctgcggcattgacagcccaaaatgtccatagtgcccaggcagagaaaccctggtttaaattcatactagaccatttcagtaatttggatgacagatcatcagcaaaatttccctggtccttcttggaagtgtcagttatgcccacaaattgttaggcagggaaggaggatgggccctgtctttctctaaggttggcactgggctctgttaggagcttggtcattgcttcctactgaactgagcctgtggtttgaggtgaccttccctccctgatttcctgaaccatcgctctttttaaccagctcccacgctcccctgtatttgagctgccttctggtggaagcatgtcttctttgtgtgttttaaatagctataactgtctaaataataaaacctaaacaatgtagttcagattgcatctagctttctcaagagtagagaaagcttccttcctcccgctccttcagcattattatcctgtcccactacactttaatcccccattgtgataacaccgcaggcacagacgctgttgctttaacaatgcagcctttcggggctgatgactgggagtggggaatgcatgcttgggccctactctacacggactgaatcacagttggtggaggggggtgagttcctggattttgcatttttaatcatctgcctcacagtaattctgttgctgattaaagtatgagaactcctctagtaggttccttatttaaaacaacaacaacaaaaacttgtctgaaacctttggcacacctacctcactcagcccaaccagtcagcctagtcagtctcattaagtcctgtggcttctgcctgccaatgttctcaaatttgttgctcatcacctgttccttactttagtttcctggctacagtctccccatttgtctccgtttggggatgggcccgatcattaggaactcaacaggatccctgtcccttttcccatttaaaaactcttccgtgggtccctattaccccatggatgaagtctaaactctgtatcaacacatacaaggtcaatttctacccggtttttcctcttcccccagtatattccttgtgcttcccggtagccaggaagcacctggactcaggatttgacagctttggagaagacttttttgtgtgctttacataggaattctcatgcgttaattgtgtttgaaaatattttatgggctgcttccgggagatcccttgttggcattgccttcctttggcatgcgcttttgctttgtgattttttttttaaatgctcttttcccaactctgcaaaagattcttaattgcacaggttatgctctatatgactccaggctgaataacctcatgttgccgggaattagttttgtgggcttgccattaaaaaattgagtaaaccacaatgattctttttagattgtagtttccaagttataccgatttccttaaacctatggaggtagcatatggtaagattttagtttctacttcatatctgtaatcctcatctagttctcattgggtagttcagtatttaaaatgctttggaagggatgacagctgtttaagaaattgactccataatcaaggcgctaggagtgacccccatcctggctaacaagagaggggtactttttcaagtaatctgaagccccgcatgagacattctaatttaataaccagtagtcagtcaatgtgtctttttttttttttttttaagaaagtcacttttgcatttg

SEQ ID NO: 136547 - DNA, 1062 bp, Homo sapiens
caatgtaggaaagagctcttcaccttagccaaggcactattgacacaattgagaacaggcactgtttagtttcagtgggtttgcctgtagtgcagtaattgccgataggtggctggctgtcaaggagagggtagtcttcctcccctggaagtgagtgactttgtcgttcatccaatgccatgggtggctcactctcacctcactccccaccatcagccaggggtggaagaggcttcctccaagtcctgttcgcctgctctctagcagttgtcctgattggtgcttcacattttacaatttacaagaaaaaccctctagaatgcctcacattctgaaagctgaatttgttcacatggaaggtgaagaagtggttaaatgaagagttgtcaggatgacatgaatttatgggagtttgccttttcaatctcggtgttctttatagatgttagtattccctcatagaaagccttgttaacttgtaacaggtttagactgtactcttggaagctggtgagcagggaagggaaagagactcataagagtacgtcaggccgcatatcccagcattttacatgtctacagctgtacatcatggcgttttaatgttgaacactactgtgtttgagaacacatgactcacgcagttgtgttatgtatgcagtgagctctcgttttctttgtgtttgggttagacttgccaagccccttttccaggtcttttttttcctgtcatttagtgtcctctgctggtaccttctagtacattcatcctgtgaaaaataccgggtatttacaaaagaatgaatgaaaaaatcatcattttgcagcctctgtagtagtaactggttcaggccagaatcttctgcatgctaaaaccactggtaaaggtttgttggggggtgaggacttctacctagtttcagagcaccaccccacagcctgcttagtaatttcagagggtgaaaaaggtacctttgcaaatggagagagcccatgaataccactttaaccaagtgatcacagacttagcatcaccaataataggacagatacacatcttgt

SEQ ID NO: 136548 - DNA, 1034 bp, Homo sapiens
attcgttttgtgcttgtcaaaagtcggcagtcatgtggctttcttttgcacactcttcatcctagctccacttgtaaggcagtgttctagtaaggtacatttctgtttttctctttttccagattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttagtaagtattccatccctgccccgatcacgtaacaaagtggtgatgtgttgaatgatggtgttttcctgacaattactactgtcgtggatttgtttgagtttgtttttgacactgctggtttttgagatgcacatttatgtcatattaacctgtggattgtctgggctttcacataaactttgtcttgacattgcttccttagtgatgagtatttggattgtatttcaaaagaaaatgcatttgcatatttaaaaaaaaaaacctttttgttacagaacaattcaaacctaagtagacaaactagtgtgatgaacccacatgtacttaccatcgagtgtgaacaattaccacctcctagccagtcttattttacctaaaccccagtccactttgtccctctcatattattttgaagcagctcacagacatcatattatttcatttgtaaagatgtaattgcttttagttattcggtatattgacacatttttaaggctggattttcttcccactgactaatgtccatttgtattaggtgtcagatgatcagggttgatgaaaaagtcctcaatggaaaaaaagcttgcaaattgttcacagttttaaaaaattgaaaatgaaaaatttacattttggtctagatcccagctcttcagtgtggtggggccaggtggtttgtgtgttaaggtagactcaccatttggatctgtttctcctccctagatttggcagagag

SEQ ID NO: 136549 - DNA, 1286 bp, Homo sapiens
ctgaataaacttttgttctcttatacacagattctaggaaaaaaatgggggtgaatatagttctgtgtcaacattttagactcttaggagaattgtagtttaaaccattgtggaaatcaggaacactatatttttgatacttcatttgtaatataatggtgaccgttattgagaaaatttcctttgaatgagttatttgtatgaatctttgcaaattgcatggttttaattcagtgagtgtcactaataagaaattggtttcactgctttctatcatttcatattctaataatttgaaatggcttggtaaatgaggtagaaggataacgagctctaatgggtctataaatagaatgcagtgtgatttgtgaaaatacagaagccttatcttgtttttaaagatgaacttttatctaaagctagaattgttctcctttattaaagaccttcagatgagtggggcccttggaaggactcaagaatcccatttgcttatctctctttgatttaggggaactgtgtcaatctgacagaagcactgtcgctctatgaagaacagctggggcgcctgtattgtcctgtggaattttcaaaggagatcgtctgtgtcccttcatacttggaattgtatcctttgaccgtgacattctgttgccagatcaaagcacccaagtaaatcatatgccaatgaaaaaatttaaatcacaataataaacaattagcttagccatagagtatataaagccctggttctccagcttaggtgcacattggaatcccctgagaagctttaaataaaatctgagattctagacttccattctcaaaagttttggggtctggcttgccacagctttccaggtgcttttaatgatcaagcactactggtctaaagcattggttctcaaaggtgttgccagacctgcagcatcgctcaagaactagttagacatggacattctcaagccccaccccaacctgctgcccaatcagaggaattctggaggtgggggcccagtgacctgttctaccagccctcccagggatttatgtgcacctgaaaagtttgagaagccctagtctaaaataaccaccctacctgtggcaggtaaaatgtctaaagacactcattctactcttacattaaaataacctgacattaatactagtttctacacttgatgctaatttgcaacagaaatcgagaactagaatgatgttggggactgcacggttaacattggtgttctctgttagttccgcttagtaaagttagtctagagaag

SEQ ID NO: 136550 - DNA, 4345 bp, Homo sapiens
atttcagcccagtcccctctttctgacttgtgatctcatagagcaacagtatctcctggtctgtttttagttctgtcactcgatgtcatttatctctttataataggatggccccggggccttttttgaacagtagtaatgacttcatttgccaccgtgctaaatgatacacaacctattacattcaccagtccttcattataccattgacctgaggctagcaagagattttgtctgactgtaaagttgaaagtcaaaagcttatttctggtcccactcttagcagtgtattagatgtggaaataaaagtcattttgggtagctgctatgaaactttctgagcagattcttggctgcaccgatgtatgacagaatttatggagaggcctatggcaatatgagcaacttgaaaactcctaaggaagtgcaggtagctaacagcttggtgtggtgtgtgtgggtaacaatccacatcaaaagtgagctttacattgacttggattgttagacatcagtgggttattctgttgtttttataaaaggtttatactgtatcaatggaatgagtcatttatgatgaatttgcaataagcaaagcattaaaaatgaaatattcagtgtccattttgaggtagaattggtgtcaacacagaacgttcttcctctcaaggtgtaggaatcaatagtatggtatttaaaaaaaaaaaaaaaaattttttttttgagacagcgtcttggtctgtcacccaggctggagcgtagtggcctgacattttttttcttaaatgagtgaatgtctactttttctttttctttctttcttttttttttttttttttttttttttgagacagtcttgctctgtcgcccaggctggagcatagtggtacaatctctgctcactgcaacctctgcctcccaggttcaagcaattctcctgcctcaggctcccgggtggctgggattacaggcgccggccaccatacccagctaatttttgtattttttagtagagacggggttttgccatattggccaagctggtcttgaactcctgacctcaggcgattggcccacgtcagcctcccaaagtgctaggattacaggtgtgagccaccacacccggccgcctactttttctttgtattagattgtcatggaagaagatgaagaagaaaggagttagtcatgttgtaattagatagacttaacttaaatttttcttgtgcacataggttaaaaatagcattagtagacattctccccatcccctccaactctactatagtgctttgcaaagctctgtgtactgtgtaagatataaaatgatggtactgttactgtagaacactgtttgggagtcaatagaattggatttttttctactttataaaagaaaccaggtatatgtacctgctgtctggatatcgtgtttttaataactgggcatgactttgtacttgaagactagcttgaggctggggcagcagatccactgataaatctgttgacacaagtcctgcaaagacctgagaggtggaaatgagtggatcaggttgtgccaggccatgggagatagattcaggagacagtaagggatgtggaataggaaagaaaggaatggaaatatctgtcttttcatttagggtgataatagtgaattttgacccaactcacttctttgtgttggagaaaggatgatgtatgttttgaacatctttgttactgttttaaaacaaaagcatgcaaactgaactctgaaaactgaaaatcccctctgcttttgctgacttttaaagaaatgttataagatctagcattgttgttttactttaatggctgtagtgttatatagtattacagtctcctttataacttaaactggaatatactgtagtatcctatagctgctttttaattagagacaagacaaatatgactgtttaaaattccatttaacacatcagcagatgtcaataatttatttaaaaagtgaaatgctgctttctcgtagaagtgtgattgattgaatattttagagacttgactaatggtgatccagcggggctagaggaaggctgggttgacagtgtttttaatgggctggagcagtgctgatgtcgaaataaaaatgtgctagtacttcctgtacagtctgcatagtcacttccttgcttgcattaactattgctgacgcaagactttgcatttctaccatctgtctcagtagatacatcaatttcattctggtcccatgactcctgggatagggtggggaattgtgggggtgtgggttttatgttaaatatcactggcctgtgttcaaggctctagagcaggaccagtcaaaagtgtagtttgtcaaccagctctttgttttctaagcgctgcacttcagctgacctgtttttcacagcaagactctcattgaaagaagcagtgtgctgatttttccccgtggcacaagctccttaccacatcttggagcagcatttttttgagaccgagttttactctgtcacccaggctggagtgcagtagcgcgatcttggctcactgcaacttccgctagagttcaagcaaatttctcgtgcctcagcttcccgagtagctgggattataggcgtgcgctaccacacctgactatttttttttatttttagtagatacggggtttcactatcttggccaggctggtctccaactcctggcctcaagtgatctgcccgccttagcctcccaaagtcctgggattacaggtgtcagccactacgtctggccttggagcagcaatatgagtactactcttccagaagccagttgggccgcattattgaatacctagttcatagataagagctgatatgtgaccttgaagaagtactctatctccttcaattaccttcttgccgcgtgtctttgtactaaatctttaaccttgctgttctttgggctaataaaccactttcatttacattatcctgctctgtcttaaaacagctttgtgaaggagatgttaataacactaggcaggctagcagtccaagtttgaaatgtgcctgagggtcccgtgaatccgggttccagcattcttaatttctaacatggatgcttccatcagaggtgcttaactgtttttgtaccttggactcattcagcagctgcctggtgaaacctgtgaactccttctcagaaacattttaaatacataaaataggattccaagaaacaagttaaattttccaaaaacttacgatagaatatttgtgctgctttatttgttacatagctagatcaagtggtgggtcacacaccataattgtgaagtagtaatacgcataagatctgtagcaactgaaatgtgatgaaaacacatttgatttgttgacaaagttacaggaactgctgtgtactaacgtggtttgtcacccgtgttcatgcttaaaggaaatgctaaatttcagtgggagttagtaaagataaagatagaaacattttcccatccaagtttatggggtcacagaattctgtccataggccccaggttaagaaatcctgacctacagtttttgcttccattgttttcattgtatttgagcggtgggggaagggtaggtgggatcccttcaccgttctgtcagaacctgaaatcaacactggcagatcagttctcctcagccagaaccatttaaaatctcaattacctcatgtagtcatcctactgatttctgctttactcattatttcaaaaatgaaaaatagaacatgggcaagaaatagcccagtgcttttggaaagctatttgaatcctcttggatgtgatttccctgggaaattggatgataaatgtgactggacaggtagacttagctcctgtatctgggggtcctgggatgctcaggccaactaattaatgcagacagttttcccatgtaccaaccaaccatgtgatcatttcagtgagcaatttttttatgatgaagcatcagggaatagacccttctctgtgcaactttgcacaggaatgtaaaaataagtgaattaggcagcctttctaggaaagaagcaggccaggtatattttaatggaaggcctccaatatccagagaagggagggttgggggttgctccaccccatttcctaaaaaagactggcaggaggtcagtctctgtagcccttggctttgaccatagagttacttattagagatcattcctagttccacctattagggaatacttttttcttgactttgttctaaaatagtcctaatcttggtaagtgattatgatggtagcttaggttcttgctgagtgattcagactgctcctgtctgttcattgc

SEQ ID NO: 136551 - DNA, 1045 bp, Homo sapiens
gtgaagcaagatgacaaaaggcccttaagaatgtcccccagtctaaggagactaactcacaggcataaaacagtgggctgctgtctcctgatgctgcgtggtgtgccccatggacatttgaaacaatacaagtaaccatgtaaaatggccaaaaaagggctgggtgtggcagctcatgcctgtaatcccagcactttgggaggcagaggcaggaggatcgctagagcccaggggtttgagaccagcctgggtaacatagtgagacccccatctctacaaaatatcaaaaaatgacctgggtgtagtggcgcatacctgtagtttcagctactcaggaggctgaagcaagaggattgcttgagtctgggaggtcaaggctgcaatgagccatgattgcgccactgcactccagcctgggtgacagagtgagaccctgtctcaaaataaaatggccaaaaagggacagaggaaggagagcgtgagtgcttttaagcactcgaacggaaactctgatggttaggtggaagatacagtcaagggatagctgtatatttcccatgtttcttttttcctttttaaattcatcatccttttagatagaaatgtttaggggaaacagcagggaagggctgccaggaacatagcaatttggtttaccaagatcattatatttagtactttaatgtctagcttttgaggtgggggtgaggggtgttggatttaagaaaaagtaaacagttgttcttaattataccatactatgagacttggtgtgctagcttcaaacaaaataatacagtcttttcaccattacaggaacatcagtgactaaacagaatcgatcatctgggtggttatgattggaagttattgcagttaaataatgctaagtctttgagacaagcagtaaactccaaatggaattcatggctaatatcagtgaggcagtctactgtgtaatgtagtatttatcacctcctttggaagacgaatgatcttttcggtttgcataatgtattacatttttgaaattcatatatcatct

SEQ ID NO: 136552 - DNA, 1040 bp, Homo sapiens
tccaggatctctgtgagtctcttctggggcttcatttctctgagagttacactgaatatcaaggagctcaagaatttgaaagtattttgtaaatataacttttaaatatttagatagatgacatatgaacttctgtttccattagccttcactgtgaggcaaaccacccaaaccatagaggcctggaacaaaaatgattggatatttctcatgattttgtggatttggtggatggtttctctgccgatttttgcctaggctcatttgtgccactgcattcagctagatgggcgcctggactggaaggcgaatgatggcctcagtcaatgcctggcagttgtgctggcttggttcttctctatgtgtcctcttgtcctccaggaggctgcttcaaagggcagctaaagggctccattcaaagggagttaatatggaaggtgcaaggcctcttaaggcttagctttgaaactcacagaaagttacttctgccaattctgttggtcaaagcaagtgacaaggtcagtccaaattccaggcaggggaaatagactctaccacttgatgggaagagcagcaaggtcactttgcagaaggacaagcaggatagaagaaatagtcacagttatctttgcaaacaattgaccacacgctctatttgtattcttgtcccataccccacagatgttagggatggccctgcaaaaaccagtgatgataataccaccaaacttttatccattccctttttttttttttttttttttgagagacaggttcactctgtcaccccaggctggactgcagtggtgcgatctcagctcactgcaacctctgcctcctaggtttaagtaattctcctgcctcagcctctgagtagctgggattacaggcatgcatcaccatatctggctaatttttgtatttttagtagagatgggttttcaccatgttggccagactggtctcaaactcctgacctgaggtggtccacctgcctcggcctcctaaagtgctgggattacaggcatgagcccttgcac

SEQ ID NO: 136553 - DNA, 1017 bp, Homo sapiens
gattcacaccgagccaggaggctgtttgtaagttacatgtggtctctcctgtggagggtgaagaaagggaagctaaggacactgaagcatttagcaaagaggggccagacgtctgccagtcagccctctgtaatttttaccttgaaaaatcactgctagtaatgctcacttccatatcttacactacacatcactaggtacttttaaaattagtgggatacatagtcctatggaaacttctgaagctgggaagacaagacagtccagcccagccaaatacgtccttgtaattacaaccagggaagcatatacttaaccaatccagctagagagatgtgtgcacaaggagaggttttattgatggagtagcccttgtgattggaaccaagtggagtgtaattggaaaggcttgctagatgcagtgagtcttgggcagtcctgagtcatagttcaaaccatggaggtggtgatggtggataggagatgcaagagtcggagagtcatgtgtgcagtgggaaggtggcaagtttaatgcaagggaattagatgatggaaggcccgaaggcaaagtcatgacgtgattgaggggtggatatgtgagctactgctggtcaatggaagtgattaagatgatccttgaggaagataatcattgctgctgttcttaggttaaacatagtggaggctagaagctcagatttggtgttggccaaatggccaagagcatgagtattaggaattgaaagagtatagagccagggctagagagaggcaagttttgaaatgtgtgtccaggcggtgactaaatccatacccccagcaatggggctagggaaatctcaaggccaaagagacaagaggggaaatgagggaatgagctgttgacaaaatgatcacggggaacagtggcatccagatagtcttgtgttcatcagtgaaaatttgcccctagaggtgaagggatggtctgtggttcatgaaatattgaaatcattatctggagaccacaggtgacaa

SEQ ID NO: 136554 - DNA, 1064 bp, Homo sapiens
gcgttggtttcccctgaaggctacagggcaacgatgcattattaggcaaaagtgggtaggacctggtggtgctgataagggctcatgcagtaatttctgaacctctttacatacatgctgctcttcaaacatcttccttttcctagaaaattaaatttagctgattatatcttttaacagaagatccatgatgttcatctcaaagcaaatttcaaaggagggcctcacaagcttttatagatacgtttcgttgcgatcacctaaaatgaagtgtaagtaggtccctttgataattgatccaggctgttaacaaaacaattcttgatttattccggaatcatctatttaaagtgaagaatcagtacagcccagtacttatgataatgacatcatctttataggactttataggttagaaatatacagtatgtttaaatacagtaaattgggaaaaatgctatatcccattttacatatgagaaaactacttcttagaagttaactgacttgtccatgggaaaaaatacaaggctagaaccaggactggactggacccagggttttggactccaagcccagtgtgcttttcattgtaatttactttcatatgatacactactggaatgatttaaaatgtacatttttgttatccaaatgaagtacagttgaccaaagttttatatcccatcccatccagttgttctaatagtggtaattggatcataagaatatttttcttgactgattctgtctagtgtcaattaaaatccacatacagaaactccaaatacccaaagtaaagcataagatatttataattaacaatatacaaggatagaaagaagatttttttggaaaaaaaatctctggatgattgaatgtagctgcttcctgattgagtgctgctcattggcagggtccaggttgactgaactttagtgccttacacactccctggcacataatagctactcaataaatacttgttgaatagaccctccctagtttactcagacatttatgtgatgagttaaagaaaattccataaaaacgaatttgaaatg

SEQ ID NO: 136555 - DNA, 1001 bp, Homo sapiens
gggcagcataactgctagctcggggtcacaaagactgggtagctagatcaagatcatagtttttccaaatgctgtctcaacacttgcaatcactatgggaatcaccatcatttcttcctccacaatctaaggatcagcaaatttcagcctagtttttaacgtagactgagtttttacagttttaaaagattataaacacaacaaaacaaaaaccaagaaagctatatagcagaaattgtggctcgcgaagcccgagagatttgctatctgtacattcaaagttcctatgttgtattctaaaatgtcattactagagcactttcaagaagttaatactgtgaatctgtaaggcagtagttctcaaccggggctgactgtgcacccacccaggggacatctggcaatggctggagacatttttggttgtcacaacttggggaagaggcatgtgctactggcatctagtgggtagaggcacagcgtagcccccacaacaacaaaattacccagccccaaatgttaatagtgccaaggtggagaaactctctgctttgcatgtttcttttgttttataaagattctttttttgctactttgattatgtaaaatgaaaaaatgccaaagagaagttcatagaactctggggacaactattatgacctctgaggtgatgctctcttgggcagttgagcagagaccagattttccagtgtaatcgtccccaaaatgcagttatcttgctctcttcgatggctctgtcccttcaggtctaaatcccacctgctgtagaggagcccaagaaactgaatgcagtataactgcttgaatgacgaaggggctaagttgacactggcctttgagacttgtccattactagagtgcccattattggcatgccttaagcatcagtcagcagcagtcgcccacttaggtcgggcttcttctgacagtgtgtaagaccccactgtgagcagcgacctgaggaggcaggaggcagtgct

SEQ ID NO: 136556 - DNA, 1018 bp, Homo sapiens
aggacagtcaagcattgaactgatgactccttaaaaatacgagaaggagaagtaagctaacagaagttatttgttttctacctgagtgtttccagtcccttggcacaaaagccagggaaatgtgagatgctggtgagctgatcaactttgactttgtgggatgtgccatctggtacctgatttcggggctcagtgtgagccccaagtgatacttgagataggcttaaagcagacctttgaagtcacctgcttgatagcacatcacagcaagcaggcctgtctgcagcactgcctgtgtctccgccacatacccggaaggccacagaactaccgaggaatcctgccagactgatttaatgaccagcaggggaggtgagtaatcgctaacctttaaaagacaagaaaaggaaaaaaagaaaatcaacaccagttgttatttcttacgggaagccctgaataatatgttgtgcttgcaacttctgaattcatattttgaacaaaaggaggcagtgaggaactagaaaaagctatttttatcttcttgctctctaagaaatcctcttgagaatattgtttctgctattttgaaagatccccattgttaggtcttccactttaggtttaattcataggcttcaagtacagttaagatgatttatgtaagtgcagtcggttatcttgggaggtgatatcagaaaaggctgataggggagtggggaagtaaaacagtgagtagcaggaagccaatcaagagagtattattaagcaagtgtctactgtgggcaactggggctcagtctcactagggaactctgggagacactgtagaatgtgttggagaaatctcagttgtggataaagaagctgaatattttctccccaactccagccatcatcggctgattcaactacatttagaagcattaaatttctggcattttcatatgctgtgtttctccctatatatatatatatatatatatatatatatatatatatatatatttttttttttttt

SEQ ID NO: 136557 - DNA, 1072 bp, Homo sapiens
tgggaactgcaagtctgcatttctaacaagatctgaggtgatgctgatgctacagatcagcagaacacacttggagtagcaaggctcaaatttaactgttgtaaacagaaaactggatttagaatcaggaaagccaagttcaagttccagttctcctaagtatgtatctttgggcaagtcacctaacctccctgagaaacacgctccttatttgcactgggtgtaatagcatctctttcacccacttaaggtaaagatagaatgagataaagtatgtgaaggcactgtgtaaccatagccttctgtaaagtgtgttatcattattactatttactttgaaaatgactgctatttcctcacatgtgccagctctttcaaagccattattgcctgttgagtaatacacatgtagccacttttttctttgatccaacaggcaataatgggtgctcaagctacattcaatactcatattgccaatttgttggtctttaatgactccatctgagtcattacagacaattggattcaacctactgctgagcatgcagctcctctacctgcagaaagttcttaggcaggcagagctgcggatggggatgggtgcattgcattccagcacaccaacgtggttcctctgggctcagaacctactcttcatgcctgatggggctttgcacacaaaaaaagccttcacttcctgcccagggaagtgccttttgaattaaaggttctgagaggctgcgggctctggtttcagggctctcctcaccacatctcacagcacagcatgccaaagagggattctccagtgatttaggtgagaacgttgatcattctcctctcttactgaatttacatgactacagtgtttccctgggaaatctcgtccacataagtagatctgcaagcacttcacagggaagagtgtcatcagaattgccagagatcaggagcaccaggcaaagtgataattgtaaagtcctttgaaactggaatgttgcgaaattttgcagactgtgaattttgatcatttagttcagtgtgcttccccacctacccctttagaaaa

SEQ ID NO: 136558 - DNA, 1086 bp, Homo sapiens
gaggccaggagttcataaccaccctgggcaacatagcaagaccccgtctctacaaaaaaatttaaaaaatattaacagggcatggtggtacatgcctgtagtcctagattcttgggaagctgagacaggagggtcatttgaccccaggagtttgaggctgcagtgagctttgatcacaccactacattccagcctgggtaacagagtgagatcctgtctcaaaaaaaataaagtaacaatgattaatatgttaagggctttagtggaaaaagtagacatcaagaccacatgggtaatgtaagcagagaagtggaaacttaggatgaatcaaaaggaaatgctagagataaacactggaacagaaatgaagaaaggctttgatgaactcatcagtagacttaactgccaaggaaagaatcagtgagcttgaatatagggcaatataaacatcacaaactgaaacacaaagagttaaaagagaaaaaaaaaaaaacccaaacggaacatctaaaaattgtgagacagggttatcaaaatatatgacatacacataattggaataccagaaggagaagaatgaagcagaagacgtttgaagtaacaatggccaaaaactttctaaaattaaagacaccaaaccacagatccaggtagctcaaagaacaccaagacagataagtactcataaaaccacacttaggtgtatcataatcaaactacagaaaaccaaagacaaagaggaaatcttgaaagaagccagggtcggggggacaccttatatatagaggaacaaggaaaagaattacattagagttgtcagagaaaaaactgcaagaagagaatgaagataaatagttaaagggttaaaatgaaaaaaaaatcaacctaaaatgcaatagccagcaaaattatgcttcaaagtgaaggagatataaagactttctcagacagaaactgaatgagttcatcgccagcagtgttgtcccgcaaaaagtgttataagaagttgtttaagaaaaaggaaaattatataggtcagaaactcagatctatataaagaagagtattagagaaggaataaatgaa

SEQ ID NO: 136559 - DNA, 1001 bp, Homo sapiens
aaggtggaagagttagactaccatcccagcagtacagaacatccaacaatggtgagtaccaagaagaagaaaggcagcctgaatcttggcagacaaatcagcccagttttagtgacatccaactcactgccatcgtggggactttcagcacctgtactggcagcaatgccgatgcatggagaatttgtctccatcagcacatactccccaggcacatcactgcctgggaaggaatccagtgaacacatcagctgtctctcccacacacctactgccataacagcagaaatccagaaatgtaaagatagggactttcatccaacttgggcaatattccagcatttgctgtcaacagagaacactgaagcctgagaccttacctgttgagatgatccggaaggttgcaaagaggcttctaactatgtctctaagcttttattccaaataaagtaaaagccaaacaaatgcctgcttcctttatcatcagccagaagaaaaataagagatcatgccatctcacagctctccattcctggcaggatgcaggtctaagtacttcttgaagagttacggtacattctcatcagcagtgtaccctagacccaacaagtgattagccttaagccttaatgaaaagactggactgtgtcccaaatgagggtgaagtgcagttgacagcatcaggccatctacactcgtgaacttgtttgggccacttggagaaatatttattgcatacctactgtgttcatcgtcataaaaatgtgcctaccatcaaaagattgagtatgaagagaagctcacaagatcctagctttattccctaacggttgagtgttgtgtgttcaaatatggctgtgtgaaaataatacaagacattggggagttggttttagaatggcttagtgttttgaggacactaggaaactcgaattccagaggctatgagaattattggacattttcttagtttgtgtttcagaagccaatcctgaaacaag

SEQ ID NO: 136560 - DNA, 1010 bp, Homo sapiens
aatatataaaatatatttgaataggatatgccatatatacatatgtttatatatcacatttgtattctatacgaaaagaaattaagcaatgaccatagcatatattatgggccacatttatacttatacacactggtcttatataatgtacatacacacaatatctaaatactttaaacaaggaagagctataagcaaattcatttctagggctctcttttacagctatctagtgaagaaaaatcattcctaagactaaaacccaatgctctggttagaattttcaaaatgtgacaagtctctagtacaaagaataagatgtgtgtgttccccctgatgtgagcatctgtctttacttaaacagagtacacctttattcttactcttaactctgagacaaaacaggctgcaataaaccaaacaattcagcttgtaaagtaaatgtttataactggcaaagtgtaaatgtaacccaattaataaacttctccctgaaaatagatgttactcaacccagacatatatacactttaaatttcttctcaaaaacacaaaaatcatgaatttatgtggatgacattgaaaaacaggcatcttataaacatgagctacttagtgaagcttttctaagaataaaataggctttaagcagattttgcttatggattatagtctctgaatttttgagacgaatgtagtaattttatttccatatatgaaatttggcactgcccaggcatgctataaacagcttcattgactcatgatattaaatgttttcacactgaaactgaaagatcatccatcaatcagcaagccatcccatttcctccttcttagccattccttactttgaggaactcaggatgaggaaatcctgctagtgtggagaggtttaaaatgtgagtagcacccagcggcatctctcagctgctgtgttgtggctatgtatactgggacaggcgcgaaaatctgggactgaagaaaaatctgacttacaaaatccagaa

SEQ ID NO: 136561 - DNA, 1034 bp, Homo sapiens
gaccgatcttctgcactcccaccctcagcactgttttagaccctgttcatccttctgggcccatcttgtacacaaaacttcgcaggtgactggcctcgcgccctcagcactgttgtaggccttctcatccttcacacctatttcttccacaaagcttcgcccatggctgtcttcccaccattgaagtgccaacgaccctcgccgccagcacttgttagacatccttccacgcccatctctcccaaaaagcctcctcatcccacgccacccccgcccctcaaagggaaactgacctttctgcctctgaatagctcgcgttttatccctctaacagacatttcttattcttttccttgcagtgatctttgtgaacagccatgactcctctctcaagtcggagcccttttcaggtccccagaaaacttggagaagaaaagtctaacctgaaaagccatatccctagaccatttcttctcttccagctggaaaggaactatggggcaaacaggcaatgttgcaacttaaccctgtgttaggttgtttttttttttttttttttttttagacagagtctcgctctgtcgcacaggctggagtgcagtggcaatctcggctcactgcaacctccacctcccaggttcaagtaattctcctgcctcggcctgccgagtagctgggattacaggtgcgcgccaccatgcccagctaattgtgatccgcccaccttggcctcccaaagtgctgggattacaggcatgagcctgtatgatcccagggtgccctctgtcctcctgcaagtgcttgttatctttctttttaaattaaaaaaaattttttgtggctacatagtaggtatatgtatatatatatgtatatgtatatatatatatttatggggtatatgggatattttgattcaggcacacagtgtgtaacaatcacatcatggcaaatgggttatccatcacctcaagcatttatcatttgtgttacaaacaatccaattatactcttttagttattttagggtatac

SEQ ID NO: 136562 - DNA, 1784 bp, Homo sapiens
ataatttttaaaaacgttaagtgactttttaaaaagcttattagaagtataaaatgcaagccattcacaagcatataggttagattccgcttgtgaggggcttgtgtgcagtggtgaggctttgtggaagagatggacgtggaaagatgtctaaaacagcgcggaggtcaggagaccttgtcgctgccttcacagagttgggcaacgctcccggtcctggtcagccgcgggacgcaggcgcaaatgcaggcttgggatgggggaggtgcggccggcgcccacgtggcggggcggggagcagatagggggggtagggggaggagctggtctcgcgaggccgcgccccggttcgcgcgggcgtcgtgcacgcggttgtagctgcccggcggcggcagaagcggcgctcgcgccaagggacgtgtttctgcgctcgcgtggtcatggaggcgctgccgctgctagccgcgacaactccggaccacggccgccaccgaaggctgcttctgctgccgctactgctgttcctgctgccggctggagctgtgcagggctgggagacagaggagaggccccggactcgcgaagaggagtgccacttctacgcgggtggacaagtgtacccgggagaggcatcccgggtatcggtcgccgaccactccctgcacctaagcaaagcgaagagtaggtggtgtcccgccaaagggtgggaggggagattccggagacacgtgtaccccggttacacccccggaatctgggcttgggcggcaccccctgggctgcctccgggccctgggcgggcctggttctcacctaggagggcggggaggggaataaaggggagttctagctgtgaagaaaggtatggtttccactgatcagattttagaagaggtagtggttaccccaaaagccgcagctgagggaaagtgggtggccctagtcccgagtttgcatcgaggatgttgggcaaactgaaacagttcctgaaacatctcaaagtgccttcagcacatcctgtctttttcaggtactatttcagcgaaggaagacattgataggttgaataatgattcacaaaaagtttgattaaacagaaaagttgctaaacacagtgctcgggaggtcaaacatttcatttttctttcttcctttttgtttgcatcttacaaagattattactgaaagccaccttccccaaagcctgtgtagttaatggatattccttatgtttctcagacatgaagaacctattacagagtgtacttttgagggaaatgggggaaaaggttagaagtatgcatttgggttgatgataaacctcgtggcaaatttgtgtcctgccaatttggtttttgattatttgcatttctgtccagtgtacaaagctaatggccactttcaggaatgacacgtcagacgaagtagatactgtgaaagttgtagcctgctacatctggatgttaaaattaaccaaaagtgaacagtggctatagataaaggctgtctcttgcttgctattcagtaacctgcttttcctgcagatcatttgacattctgtaggtgtgtagttggtttttatggttcagttacagcatgttccatgccagtattcagtgaaaaaagtaatgcttcaaattctgaatccctagagttaaatggaatgttgttatgacttaggatgggttggttgggagtgataaatgagaaaaactgttttgtcctcttaaacatttacagttcttacttgctgaaagtaagtactttcagttaaccactttggg

SEQ ID NO: 136563 - DNA, 1115 bp, Homo sapiens
gaataggggaaaaaagtatttattttcactaatccccatctgaaatttagtgtttccttctattatgaatgtcagcaacaaactacactatcttcagcagcacttgcttgtacctttcaccaatagaatcacttattttcttgctacatatggttatcgcaggtatcctgaaacaccattttcactcatcattatcttacgtagttgtcagattacaactagatcttgcagttttgaagtgttatagagcacatgtattatgatatcaccaattttttttaatatttttataattgcatttaaatacaattggtttcttttgtaattctatgtattttcctttttgcattcaataacactcttttaagaagtctgtaagcttcaccagactgccaaagagatctaaaggtagccctgatttttagtgattttctaaagatgtccttctaccattccaccaactttctcagtgttacagaacatcatgtattttattttcttagtttccaagccagcgccctactgggaaggaacagctgtgatcgatggagaatttaaggagctgaagttaactgattatcgtgggaaatacttggttttcttcttctacccacttgatttgtaagtaatacatgtaaatagctagtaaaatctcagtctttatcaattatttttcaggagtatcaaacaaattattttgttcagctcttggtttttaaaaaggcaagctgaagtaaagaaatgtatttaaaaaggtaacatctaccatatatttcagagtcataacacaccgacctcaatacttatgtctacatgattatgttataatggaataattagaggaaagctacaatatattcattaagctatacctactaaggcaagaaaatggactgataatatattagaaagcatttaatagcaagacctatgccataattctttttactgtatctctcttgattagaaaattaattctgtaatcccagcactttgggaggccaaggcaggtggattacaaggtcaagagatcgagaccatcctggccaacatggtaaaaccccatctctactaaaaatgcaaaaattagctgggcgtggtggtacgcgcctgta

SEQ ID NO: 136564 - DNA, 1025 bp, Homo sapiens
atattttttagaactcagttaatttaaggagtccctaccacggtttgaaaaaatgccaccctagtaatattctgtaaacatggcctgacaacatgagggtattaaggtataaaatccctggctgcacaggactggtagacaaggtggaagaggaccttatcaagaaaggaggggtgggggtactggaaaacattgcctcctctccaaaatacacatagatgcatctaattcatagggttggtataggaatattaaaaaaaaaatagtgaaatgacataaaatttgtatagatcctttgaaagctataaaatactatataaataaaaggtattattaaataaaagtaataaaatgaggggtggctattgctataagggagaagggaacattggttgactactgatctattaagttgtaataagaaagtttattgagatgtagttgggaactctgtaatatgtttctgtcttaaatatttgattaaatgacagtcttttagactactccattttgaaaaggttcaaatataaaattgttcttaatgtgcatttttattattaaaggtatttgtaaaaattgtcatttgaaagtttaggtatatgcttatttggagaatactgaatatttttttttttttacctttcagcacatttgtgtgtccaactgaaattatcgcttttggcgacagacttgaagaattcagatctataaatactgaagtggtagcatgctctgttgattcacagtttacccatttggcctggtcagtatcttacacttatattcgtagaaaaaaaagaatggatttactcttaaagcatggacagataactcttgatatgatataagaatatagtcatttatcagacaattcaggaatagctttatctaagagtaatacatgtaactacacattttccaggttaaaaaaagagagaagagtaatataatcagctgctataataaaaatgcttaaggattttataggacatttcaaaataaggggaaaagttaaatgcaataga

SEQ ID NO: 136565 - DNA, 1103 bp, Homo sapiens
agcactttgggagggtgaagcaggaggattgcttgaagccaggagttcgagaccagcctgggtaacaaagccacaccccatctctacaaaaaagtgtttaaaacattagcccagtgggatggtgcacacctgtagtcccagcttctcagggggctgaggcaagaggatcgcttgagcctagaagttttaggctacgctgagctatgatcacgtcactgccctgcagcctgggagacagagcaagaccctgtctcaaaaacataaaataaaaatgtgttgtgtatatatatttttaatgtttaaaggatatgaatatattaaatgggaaaagcaagaaaatagaaagtatattagcctgtttttgttagtgaaagaatgtgtgtatttcatgtgtgtgcgtgtgcatgtatagagaaagagtgctgttttaatatatgccgtttacttagctctgagaggtaagcgttctgtttgttacaggattaatacccctcgaagacaaggaggacttgggccaataaggattccacttctttcagatttgacccatcagatctcaaaggactatggtgtatacctagaggactcaggccacactcttaggtacctttcagtggttttatattatgacaaatccaagcgtgtttataatcctccttgaaatagatgttatttatgaaatagaagaacaaattttgatcaagaaatataattttgaggccaggcacggtagctcaagcctgtaatcctggcactttgggaggccacggtgggcagattacttgaggtcaggagtttgagaccagcctggccaacatggtgaaaccctgtctctaccaaaaaatataaaaattacccaggcatggtggcgtatgcctgtagtcccagctactcgggaggctgaggtgggagaattgcttgaacctgggaggcggaggtttcagtgagcccagatcatgccactgcactccagcctgggcgacagagtgaaaaaaaaaaaaaagaaataattggctgggcatggtggctcacgcctataatcccagcactttgggaggccgaggggggcagatcatgatgtcaagatatcgagactatcctgg

SEQ ID NO: 136566 - DNA, 1096 bp, Homo sapiens
tctattcagtttcatatagaaacagaaaaagtcagttgctgaaggtaactgaattctgtttttaaaatgtcttctgcctctttttgtttcttttagtctgccctgctggctggaaacctggtagtgaaacagtaagtatatatatatgtttttatgttgagttgatggttagagttgaaaaaaatgctggccgggcgcagtggctcacgcctgtaatcccagcactttgggaggctgaggcgggcagatcacgaggtcaggagatggagaccatcctggctaacatggtgaaatccgtctctactaaaatacaaaaaaaaaaaattagccgggcatggtggtgggtgcctgtagtcccagctactcgggaggctgaggcaggagaatggcatgaacccgggaggtggaggttgcagtgagccgagatcatgccactgcactccatgctgggcgacagagcaagactccttctcaaaaaaaaaaaaaaaaaaatgctaaccttagaataatcttcccttgttactagaactgtcttgattttgtaaatgaagtaaacattgctaagcagaaatcagagtacagacattctttggcctgtaggaagagtagctgaaaccggagaaagcagaatatggggcgtgatgctgtgaattttaaagccaggtatacagataaatacaccgttcgaaaaaaaaaagtagggcagagtggagacttggtagaataattcagaggtcttataggtcatgtatcgaatttcttcctgtattgggacaaagaaaacagtcacaagcaaaacctttctatgcatagtaagaggttttgagaaaatctagctcaattaatactgaagataatgattctctccttgtcatgaagaaagaaaagattgaaacacgtatattctttcatttaggaggctgtataatttttttttcttttttgagacggagtcttgctctgtcgcccagactggagtgcagtggcatgatctgggctcactgcaacctccgcctccagggttcatgcaattctcatgcctcagccccctaagtagctgggactacaagcctgcaccaccacacccagctaattt

SEQ ID NO: 136567 - DNA, 1655 bp, Homo sapiens
aaaaaaaaaaactgatccagccaaaggaaggggacaggagtcatggcctgctcctttgggaatgtggcacaccccggcccaacagtgtatcttgttctgtcccagtgttcccaagtagtcttgtgtttgtatgatgatatgatggttttctacggtattacaagtttctccaaggttctctttcttgtgtttcagagtccatgttgtacttagatgggcagcggcatttcaactccatgagtggcccagcgaccttgagaaaggactaccttgtggagccctaagaacaccacatttgttgaaaactagcactctacccacagtgacgtggtatctgatgaagacctgatcgagtgtattgattttagtattgcttcgtgtcctccacacaggaggaggatgtattcagcctttaggatgatcagaaaagcagaaagagagagtggccggatggggctgaggggagaaagaattattaaacaataaatactttcaagacaattttaattgtgaacctaccatgttgcctcccatcttctgaaaaaacaaaaaaattgagaggctgggcgtggtggctcatgcctataatcccagcactttgggaggctgaggcgggcggatcatgaagtcaggagatcaagaccatcctggccaacatggtgaaaccctgtctctactaaaaatacagaaaattagccgtggtggcatgtgcctgtagtcccagctacttgggaggctgaggcaggagaattgcttgaacccaggaggtggaggttgcagtgagctgagattgcaccattgcactccagcctgggcgacagagagagactgtctcaaaaattaattaattaattaattaattgaggataccattggatgcattcttttcttacacatattgcaactgtcagtatacaaggtttcctgccagggtatttggatgacgttctttaaacctaaccacttgctctgtgctgtctaaatcccatcagccgtacatgattcctttgcttccctctatttcccagcttttgttgtcagagggtagatgaaaagttggggcgaagggatttaacaaaagttactgcatccgtaaagatttgtgggaagatttaggtctgaaaccataccattagaaggtgtttagagatgatctagataaggaaatacaggaccatttggtcattctttcattcaccagacagctatttagcacattctgctagtggctccgcaggatatatctgatttaaaaaataggaaccacaataataatagctgcttatgcttatggagcattgccatgtgctagataggcaccatcctcagcccttggcaggtctgagctcctttatttcttccaatcaacactatgaggcaggttctgtaaccccccttagggttaggccactcgggaaactgaagcacagagagtttaagtaacttcctggaggtccgacgcgtaacatgtggaggtgctgggattcaaaaccaggcaatgtgggtcccgggcactcttgaccagtgcctgtacttcttccaaggaatagagcaagggaggtcataccgaatatcacagtgtcacctaggaagcccaagggaggtattcccgttaatctgcagccaaggccgggcgcggtagctcatgcctgtaa

SEQ ID NO: 136568 - DNA, 1938 bp, Homo sapiens
ggactataggcacgtgccaccatgcctggctaattaaaatttttctttgtagagacaggggtctcactatgttgcccaggctggtcttgaactcctggactcaagcaatcctcctgcctccgcctcccaaagtgttgggattacaggcatgagccactgcacctggcctgttttctccgttttaatgaagtgagaaatgcatctcaatgggataactgcaggtcagggctctggatcaggatgatatcaagtgatctcacactgaaccaatataatttccatgtggaaccaaagactcactgggagttttatgtggcctctgcagttttctcttggatacgtgtataattttcagtgagattttgaaaggcatcccaggtcagaataccgtgtgctgtagtgcgaccgtcctgatcattgctccttattctcccttgttccagtgaacaaggggagaagaattgccttcagctccacgtcgttactgaaaatggcccccagcgctgaggagaggaccaccatacatgagatgtttctcagcacactggatccaaagtaaggatggtgagattccacgttgggaaaacatttaaaccttggccttttttttttttttttttttttgagacggagtttcgctcttgttacccaggctggagtgcaatggcacgatcttggctcactgcaacctctgcctcccgggttcaagtgattctcctgcctcagcctccgagtagctgggattataggcatgcacctccacgcctggttaattttgtatttttagtagagacggggtttctccatgttggtcaggcttgtcttgaactcctgacctcaggtgatctgcctgtctccacctcccaaagtgctgggattacaggcgtgagccaccacacccgaccttttttgtttttgagatggagtcttaccctgttgcccaggctggaatgcagtggcgtgatcttggctcactacaacctctgcctcccgggttcaagcaattctcctgtctcagcctcccaagtagctgggattacaggcgcccgccaccacgcctgctaattattttgtatttttagtagagacggggtttcaccacgttggccaggctggtctcaagctcctgacctcatgtgatctgcctgcctcggcctcccaaagtgttgggattacaggcgtgagccaccgcgcctggcctaaaccttggccttctccagagccacagttgtctgagtgtattgggagtgacttgcaaatgtttttacttttcaacaagagaaccatggcattaacagggtttaataaatattcatttgtacaggactataagttttcggagtcgagttttaccctctaatgcagtgtggatggagaattcaaaactgaagagtttggaaatttgccaccctcaggtattataatttagtgagaaatccgaataggatagcttccgttcatgatatttgtccaagatttgacacacctttaaactggcctttgtcctgtggcattgttaattcctctgttctgtatacaaaggtggccataagttttgtatttattgatatttatttatgtcctgtaggagcggaacattttcaatcggatctttggtggtttccttatgaggaaggcatatgaacttgcgtgggctactgcttgtagctttgggtgagttacatgtaaggcagccttaacttctgagaagcaatttatatcaccccactgaaatgaaacatttcggaccagtctgggtgtgtgtgggaatatgttatgtttttgaatgaataccacactgataccagctgaatttgatcttcattttagaaggttgtttctctgactttgtaagttcatacattaaaaaaactactgagaaaatacagtgatgatatgtagaaaggaaaagatatagttattttggccctaatctgc

SEQ ID NO: 136569 - DNA, 1166 bp, Homo sapiens
tagatggaaggatttacacttactcaacaagtatttattgagccacatatcttgtctgagagtttgtgatacaaatttgaatggatcatgggggaagcagggagccaatcaacatataatcatacaacttttttttttttttttttttttttgagacagtcttgctctgttgccaggctggagtgcagtggtacgatctcggctcactgcaacctctgcctcctgggttcaattgattctcctgcctcagcctcctgagtaactgggacgccaccacgcccggctaatttttgtatttttagtagacatggggtttcaccatgtcagccaggatggtctcgatctctcgacctcgtgatccgcctgccttggcctcccaaagtgctgggattacaggctgagccgccgcgcccggcccaacgtataattatacgactttaaatgagttgatatctgtaaggtgcatgaaccatgcatggcacatataaatgcttgttaaaatatggaaagtatacagataaccacagggtggtataggagtcaagggtgttatggggaaggagggataactgagtgaaataattgtttcatgattaattaggacaaagccaggaggaaaacaggtagccaagtccttgtgctttgtttctctttcctgaagatgtttgatactgtcagactcatgtgctgagttcttactctgatttgggcactgagtctctgtggagtggtaacaagctgtctggtgggtctgggcttgcttcgggctttgatttcttcaccaaatcttaaaattgagggggcagtcagattggaggatctcccaaatccttcaatttataaaagtgtttgatcctaggataagatgatcaatggaatattaggggctggatcttccaagcgagacaaggcttttcatggatctcagggaggaaattttaaatgttgggaaataattctgcctttttaaaatttggtacactcctgtttccctgcagttcttatttgttacatgcacaacaaaatccactccgccaagatgtctcctttatcgatagttacagccctggtggataagattggtaagtgatatcattttctatgcatacttagaattcttagtaatttcaagatattattgagattacaggacgtactctcctttt

SEQ ID NO: 136570 - DNA, 1349 bp, Homo sapiens
cgggaggctgaggcaggagaatcacttgaacccgggaggcggaggttgcagtgagctgagatcgtgctattgcactccaggctgggcaacaagagcgaaactctgtctcaaacaaaacaaaacaaaacaaaactacaaaaattagccgggtgtggtggcacagcgcctgtaatcccagctacttgggagactgaggcaggagaatcgcctgaacccgggaggtggaggatgcagtgagccgagattgtgccaccgaactctagcctgggtgacagagtgagaccatctcaaaaaaaacaacaaaaaagaagataggtgggaatcctgttcatatctccatcataatggctcttactggctaacactgatacagccccattaagtgaataattgaagttatccttttttgtttgtttatataaaccctagtgattggcacaaaggtattcatttgtgcacctttaaagagacagtatagttctttcaggtttttagggagcagaggcttgatcctgtccctgagctgtttgttgtggcattaaatggaaatctatggatctttaaatcttttgagtgcatgaattgctttttgtagttcttgagctcattgccataatccgtttctcatatttctttgtttcatggaatgacctctttatttttgtttcagttcgagataagttgcgggagatagtaggagcatccacaaactggaggtatgcatctttgttttcattcattcttttcatccccaaggtattatactacactgtatttaggctcagttgatggtctcacagtggggatggggagccctatgttcagagataggttgagaagtattttgcttgggggagaaggtcaacatttcaacatactcatcagatgacacctcattgtcatgaaagaagatgatttacgtatattctgcattttcaaagtgcatttaggtgtatattacttcactgattctcataacaaaacttgtgacgtgcttacgacatatgttcctgttcctttttttacacatgaaactgaaactcagagattgaatgattaaatgtcagggtttgggacttgaacccaagtcgctaagtttctctgtttcatgcaacttgactcctttattgcttcttgtcagttcaaaattagtcaggcctcccatattgtctttctctttctcgcagtatttccttgttgtaaagtaggatcatatccctcttggtgtacataattttgaggctaaaatgagatagaaaaaacacgagtgatcactagatatataataatctattgttggtatagaaattatctaatgacttatttttaaattctttatatgaaaaatt

SEQ ID NO: 136571 - DNA, 1079 bp, Homo sapiens
agggtatttagccattcagaatcagatcccatttcttatgttggatacatttaacgtgtctattatagttcctattaatgtgttgggggtcatgatttttttgctctttcagctaatggtagcaatagaaaggattagctttttccagtgtgttctttaaaaccagatatattcagttgtagaatgctagtttcttttttgagatggagtcttgctctgttgctcaggctggaatgcaatggggccatttcagctcactgcaacctctgcctcctgggttcaagtgattctgcctcagcctccagagtagctgggactacaggtgtgcgccaccatgcctggttaatttttatgtttttaatagagatagggtttcaccatgttggccaggctggtctcggactcctgacctcaggtgatctacccacctcagcctcccaaagtgttaggattacaggcatgagccaccatgcctggctgcttgtttctgagatggaagaatgaaggaatacttactctgtttccttcagtaaggcatatgaacctatagaagatacataaaacaaaataatgaaaaaaatggaaaattcaaatcacgttctgagaaaatgcagattagatggtcaaaaacaaaaagacggccaggtgcggtggctcatgcctgtaatcccagcactttgggaggccaaggtgggcagatcacagggtcaggagtttgagaccatcctggctaacatgatgaaaccccgtctctactaaaaatacaaaaaattagccgggcgcggtggcggcgcctgtagtcccagctactcgggaggttgaggcaggagaatggcgtgaacccgggaggcagagcttgcagtgagccgagatcgcaccactgcactccagcctgggcgacagagcgagactctgtctaaaaaaaaaaaaaaagacaaatattaatctgtatacgaaagtacaggaattgaatatttatcgtgaaaaagtgaagctaaaatatttaagagagaggcttgttagctgtgtgattgaagaataaacagatccaaaaccccaaaccctccagcaagaatttt

SEQ ID NO: 136572 - DNA, 1016 bp, Homo sapiens
gcccagccactgccgccgactgcagtgacatactgcggctgatcaaggtagcggagagccagagctcctcccggggcgtggggtggaggtggctccgtttcccagagtggggtgattcacgtcttgaggtctcggccggtgtgagagcccagcctgttcccctttctgcgcccatccccggctcggccgccaccccgcccgcccgccccattccgttcccctgagctggccgggccggagcctcattttgttttctacttttttctctcctatgtgcatccccccaggagctggctaaatatgaatacatggaagaacaagtaatcttaactgaaaaaggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatggttcttgtttgaccctaacgtaacagtttttgtaattgtgttaaatcacatttttttctttaatttgtcccaatcttcaggttacagtctctagcttcgccatgtacatggcccttccgtgtacatggatgggcggggaggtaactaaaagatcctttacacaataaagtaga

SEQ ID NO: 136573 - DNA, 1717 bp, Homo sapiens
ctgtttctgggcaatgctgcttcttctgactcaacaaatggggagagcaaattgaaaatgcgtaaattggaaggcaagttctgaaattaaacgttgtactttggcctgatgttctgacctttaaggaagcaagagtttgtaaacttccaaatatttactattctgaactgccgtgtaaacctgacgtattcccaagtcaacataccagtataccaataggatgtgaataatgtgtgtgttgagtttaaaaccatagcagttttgctctggcaagtaatgaaagcgttctcgcttcctgagtgtgagctccagcagactgcagagtggccagtccacagttgtagcctgacttcagtgagttctgatgtgtgctttttgcaaatacatgttctcagaacagtgagatcatccagcagtggcctggactgcactcacataaaaatcatgagacagccatggctacttgtttctgtaatacatgcatgtgtgttttttaaaacctatgataggcctctgattctgcagctgcaacttttatggaatgttttccttctccacatctcatgtgatgctcttattacaggacacagcattgttggttttgccatgtactattttacctatgacccgtggattggcaagttattgtatcttgaggacttcttcgtgatgagtgattatagaggtacgattgagttcggagcagagggtctgaagagagttcagagttataaatgcttacaatgactttttaaattgtactctttctttttaggctttggcataggatcagaaattctgaagaatctaagccaggtatgtcttagtttttggtttccaaatttgtaagtttactggattattttaatgatggaataaaaattgggtcttgagagcaggctgaaatgtcactgagtgtgtgttttactctctcataataggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaattgtttggtgtaagcatttttactagttctttatttcttacacatctttcttgctgttgaagacaaaaatgacccgcaaacatcattggatgaacagaattgctcaaaatagtttttaacccaatttaaagtttttatggtcatgtgttatgttagtattaacaaagtctggatagaagccagtttaccagttggctatcaaggttttatacatagcaacatgtaaaacatgacttttttttttttttgag

SEQ ID NO: 136574 - DNA, 1031 bp, Homo sapiens
ctattttgagcaattctgttcatccaatgatgtttgcgggtcatttttgtcttcaacagcaagaaagatgtgtaagaaataaagaactagtaaaaatgcttacaccaaacaattaaatcaaagagtagtttattaaaaaagaatcaaacagaaactctaagtaccagtgtgtacattgtacacatttaaatgactcacgagaatgaagtttttttcaaatatattaagatcacaccaccttgttgtttatcgaaagatattcaaggagaaagatctgactctccaaactgcatctgagattgccactttaaacagacctcatttcaaacatgcaacaacgccactggtaataaagctttggaatgggtgctcattctattatttcactacaaacagcatagaaagcaagagaagttgggaatttattctaaaatagaatggaggttgtcatctacagcagcactcctcactcctctgttgccatttttagcaagtactccttgtcgatcttgaacagtctccaaccctcttcactggacagatcagaagcacctcttcttttatagaagttgatggatggttcattccattctgctaccaagaagtgcatgctgctgcagcgacacctcattgcaacctattatgagagagtaaaacacacactcagtgacatttcagcctgctctcaagacccaatttttattccatcattaaaataatccagtaaacttacaaatttggaaaccaaaaactaagacatacctggcttagattcttcagaatttctgatcctatgccaaagcctaaaaagaaagagtacaatttaaaaagtcattgtaagcatttataactctgaactctcttcagaccctctgctccgaactcaatcgtacctctataatcactcatcacgaagaagtcctcaagatacaataacttgccaatccacgggtcataggtaaaatagtacatggcaaaaccaacaatgctgtgtcctgtaataagagcatcacatgagatgtggagaagga

SEQ ID NO: 136575 - DNA, 1056 bp, Homo sapiens
gggactacagctgcatgccaccatgcccagctaattttttttatttttagtagagacagggtcttgctaagttgcccaggctggtctcaggtcctcctgccttggcctcccaaagtgttgggattacaggtgtgagccatggcacctgaccaagataattttgaaggtaaagcggatcactgaaattagggtctcctatgtgtactgaaaaagtacacatttttttacaggaaatttgcaaacagaaaagctccagttggacacaagcataaatcagataaattaacatctcatttggagggtgaatttgtagtcctgtgttaatacaacggatttttagagcagagaaacaatagcccttaaaactgccagggggtaaagaagtaaacaagtgctttcttaaggactgaaatgaaaaagaaaaagaccatttccccctagatatgtgaactcctttcattattcatgacattggcccaaattcctaaaccgactaatttccacaataatgaaaacagtagttgataagaaccactgtagactaatgtccaagataaatgttttccaaaagaagtcagatacctgaaaacaatgctctgtatctctctgagttctccagcaaatcagtactgagctcctcagtcaaaggtaatgttgtcctgcaagcctttgtatcagtgtctgttatggcttcctagattagaaggcagccacatataaaaatgtagccctgtattatatttaatacaggagggctttgggatttattggtggctcagagagcatgccatgaaaatgggcttacagagtcaatgatcaaccaggggccctattaggcaggcaagtaactacataagagaaactctggcaaaaatgaaagggtaactaaacacaaagagccttgtggagaagtaagatattttgcaaattgtgttttggaaagtgagcctcttagaggaaaacaactacatgctgactgtggttaaatataggaataaattaaattaaccaccaagttacaatataactctttgtttcctcatctttcttagaact

SEQ ID NO: 136576 - DNA, 2054 bp, Homo sapiens
ctctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaattttttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttggggaaaaaaaaaaaaaaaagaaattaggctggggctgggcgtggtggctcacgcctgtggtcccagcactttgggaagctgaggtgggcggatcatgaggttaggagtttgagactagcctggccaatatggtgaaaccctgtctctactaaaaatacaaaaattagccagacatggtggcgtgcgcctgtagtcccagctactcgggaggccgaggcaggggaatcgcttgaacccgaaaggcggaggttgcagtgagccgagatcacgccactgcactccagcctgggtgacagagtgagactctgtctcaaaaaaaaaagaaaaaagaaaaaaaggaaattaaggccgggcatggtggctcatgcctgtagttcaaactactcaggaggctgaggcaggagaattgcttgaacccgggaggtagaggttgcagtgagccaagatcgtgccactgcacactcccagcctgggcaacagagagagactccgtctcaaagaaagaaagaaattgcactaattccttaacatcatctaatatccagttcaatgtacacattttcctggttgtttcatgaataactttttacagttggttcgtttgaaccaggatccaaacaagatctgcctgttgtgtttgactgataggtctcttagaactgtaatagtttccgctccctcattgtcccttgctatttatctgttgaaaaacctggcttatttgtcctttagaattcctgttttctacaaggattgagctgggaggggaaaaaaagaatttctcatgttctggctgtggccgaatgtatccatttagtatcattctgtttatctcttggtttctttcttctctatatttcccataaacttatagttggatccgaaggcttaattagacttaggttcattttttttttttgccatagacagtactatattaatctatgctgatgaatgaatgaacttgttttacataacatattgtgtaagtatttccctgtcagtacttaatagagctacgcattccttctctagttgcttaatgatttcctagtatggactaccatgatctacttaatccttaccaacataggttgtttccagtttttagtttttaacaatgcaataaatctatcaaattcctggggaagacaaaagcagattaataaactgagatagaaaaaataagctagtagtttacatgtttaagaatttttggttgtatattaaaagatcaagtgaatagtcactggcctctaaaatatttagaaatctccaattgtgccgggcacggtggctcatacctgtaatcccagcactttgggaggctgaggcgggtgaatcacctcaggtcaggagttcgagaccagcctgcccaacatggtgaaaccacatctctactaaaaatacaaaaaattagccgggcgtggtgg

SEQ ID NO: 136577 - DNA, 1025 bp, Homo sapiens
ttcaggaaataaaaggaagatatattgattttttaattagaatcaactgtttggctgaatctgcataatgaggattaatggagctttatttcctgctctctctgcccaagtcactctacagtagggccctcagagagccctagtaacttcttcaatttactgacagatggatcactttgcagtaaaataatatttaatggtcggtaactgcgagaatgtgggatctcattgtcctcctcagcctttcttcaacaaccccccaagtcctcaataaaatggtttgaccctgtcccccataataatttttaatgttcatgttcagccaaatactcaggacactaaggagttgcactatttcttttcaaactgcattcaagctctttcttttgttttaaaagccaggaaatgtgaagaattcacctggaactaagtagaaaactccatgctctgccatcttaatcaggtaaaaaacaagaaatttctgtgattattttcagcattgtagtgccagctgaaatgacttgtttttaattaatttaatttaattaattataacagtttcaatttgatgtgaaaatattttattccatcttttagtttctgggcttaaatgctgtgacttacttatttgtgtttgttccactaatgttacctgggttttttagacaagctagaaccagacagttgggatttgtctacaaatgtatttcaaacaattgaaaagtgtcattattccttaggtttttttcaaacaacactttattatagtaagtacacttgtatttatctaatactcagtgaacactggaatgcatgactgttacagagaggctcaaaacactagttatattgtttgtgtatatatgaaaaattgtataatagcacttgtgatttcctggtaattagaagactgtaattgaatttggaagcaacctagatattcaactacaggaaaatggcttaattatggtatatctataaagaagaatattattattctgtttctacagtatttaattgcatgg

SEQ ID NO: 136578 - DNA, 1028 bp, Homo sapiens
aggtcccaaatctggccacaaatcagaattattcaaggagacagtttccaagcccctgcgcatggttctgactgactttttagttggcgtccaggaactgctagttttgaaaaagccccccaaggtgattatgaaactttcatttcagaagctcacaatgcacttaccagcacagacattaaaggtccgttaacgatgcagtgggtctcaaccttgactgcatgttagagccacctggggagcttttaaaagtcccgatgcccagtctagaacctataccaatgacatcaagaatctctaggggtaggattaggcatctagtttttggagcaagcagccagccttgagatctactgacttagagggaagagcaacagcagggggcatcagaaggctttatagagaagaacatgcctatgctgatctttggagctaggcagacaaggttgaaagggccttccaaacagagaagaaaagcacatgcaaggacacagaagtgtgagagtgttcagaacagtgttaagaccttgggcttcactgtgttccttgtgagagatactaaagttttctgtagctgcttcctcatttgtaaaacaaggatgagatgcttaccaacctcaaattattgtgtggattaaattcattcctacgcaaagcttagaacagtgcttggcccaaagtaagggctgaagaaatgtgagctgttacttttagttggcatcttgtaagatggcatcttgtaactacctgtgttacggtggtgcacggtcttggggctctccaaaagtattttttatttcaaaacttggtagtcagttggatgtggtagatgagggagaaggataaattaaggtttctgcccaggcttttgacttttgactgtgggatctattcattgaggtgggaactattcattgaggtgggaaagtggaagaaggttgaatttggtttgagggggaggtgatggtttggttttgaacaggttgggcttgctgaaatatctgggcattggaagggggaaatcagtt

SEQ ID NO: 136579 - DNA, 1021 bp, Homo sapiens
tggaagaaatgctactggtttttaaaaagcaaagcttaactaatagaattattagcttttcttgagacagctttctgtgtcctcattactctgctctgtgtgagtgttactagaatttgtgaaatactgactgagcccttcacttatcttttctaaagcagcacctttggacacctcattctgggaagcctgctcgagtcatagtaaaggacacacgctttatgtggggagaagtggtaaaaatggagttttgtcttaattacatgaaactaagctttaaaatattttataacagattatttgagctgcataatctaaacatgtcaaacgttcagtgggactatttttatatatgtatatgtgggtgtaggtcataacatttcagtttataatataaattgttatttcagtttataagctatctctcagaggagactagctcttttgagaattcataatttaaagttttagactgaagtaaaatgcaacatagataatagtgtaaatcagatataattgagggctatatggcagtaaaactgctagtgccagttttcttgtttgcctgttatacatttttgatttttgtttttgtattctgaacattttgagagatcatatgtttgttcaattacatttagagttggtttgggaataaatatcttctaaaaagagatttatcttaaaaatggaagtcctaaaaattagtttatccagagtttataaagtcaaatattcagtaggcatagactggaatagataaattcatggaaatcatatcctttcagtacaccgtataacttcaatattacacaagtaacattgaggagaatgccatcagctttgttctcccttaaattctttggttttctttttacattttgggaacaactgcatttaaaatgttattagtcagtatatagtaaggattaggtgtttgctttctgaaggaatggtccagtgaggtgattgggagaggttattttctacctaacttgtatatgccctatacctcttgggc

SEQ ID NO: 136580 - DNA, 2049 bp, Homo sapiens
tggaatcacctcatcttccacctccaagcaagtgtgcgtgtttgaccccagcaaagaagggaccatagaacaacggaccaggagaactcaagtggttaccaactgttgggagaataagagcaagatgaattacgcgagatgctttcacaagatgatttcttacaatggcaagctttatgtcttcggtggtgtctgtgtgatcttgagggcctctttcgaatctcagggatgcccttctacagaagtatacaacccagagactgatcagtggaccatcttggcatccatgccgattggtagaagtggccatggtgtgactgtgctggacaaacaaataatggttcttggaggcctttgttataatggtcattacagcgattccatcctcacttttgatccggatgaaaacaagtggaaggaagatgagtaccctcggatgccctgcaagctggatggtttacaagtatgcaacctgcattttccggactatgtactggatgaggtcaggcgttgcaactaatgacatcctcctccctaaaaaaagaggcaaacaaagtatttgtttgcacagagtaattaattaaaacatataaagaaaaacctcaccagttttactatcaaagccattggtctaacattgtaagaatttttcattctgtgctagcatcctttttttcttttcagtggcctcaaactcatgcaataagttaattctaagtgctagctcttgaaactacttccagaagcagttgaatagaatgctccacttatctgggatattgattttctgctttaaacatttctttcagatgttagcgtaggagtcatgtgtcttctaagagaagacccgataagtgtcactggatgtgatttcagtctctgtctctatctgaaacctttttgaagatttatttcagtgtatttcagtctgttatactttttagttttattatttaaaagtttaaaactcttgacctttttgcatggctttttgctgaaaatgcaaaaatataaattttctacaaaattaactttttatattcaaaacactatttctaagctgccttctcttatccgcattgtgttagtgaaagcatattcatactcgcatacaacctataaatacacaaggcacatcccttttatgcgtggttaggattctatatttttaagctagtgcacttacttgcacacacagttcgccatacttgttgaattttagatgtaacgtcttttcacatattaacatttttagaaagttgaaataactggagtcctcatttgctatcaaagtagcctatcttcagtccatactgattcagtaatatttgaactccttatatttctgaaacatgtatggttatgaaaactaacactttatattttattttcaaaagtaaatgttagtgttctttgtcgatgtatgtcttttctttttgaaaatgtttttctttgcagtctgtttaacgttaccctgtttttagtgagaatcggagtggtatatgacaagttctggccctgcagcatgcaagcacttttaaagagcatttaggtaataccagactcctaaatcaaggccccttaaaagtaagtgcaactcccattttttacattcagtaaggctgctgcatttgttattgaatggaaggtagaaactcttagaaaatttgacctcagttttgacttagaggtaagaaatagaattataatgttactggttttatctacttgtttattttgtacaaaatacccagcgacactagggatgtaagccctcagtttttgttttatttactgaaagctattagcatgaaggatagtaaccacaaagttcagaatggatcaagaatagctgtttaaaagcatttataataagtgttttaggattagctgcacctttcaactctttaaatgcagaggaaaaaacatagttgacaaagttaagcaagaataacctgggagtggatcattgaaattgatgccatttgcgcatgagtagtctatatctgatacagactagatctatactggcaaaacttgccagatctt

SEQ ID NO: 136581 - DNA, 1010 bp, Homo sapiens
ctaaaatttaaaaaaaaaaaattttttttttttttttttttttttgagacagagtctcactctgttgaccaggctgaagtggaatggcacaatctcagctccctgcaacctccacctcccgggttcaagtgattctcctgcctcagcctcccgagtagctgggactacgggtgcacaccaccacgcccagataatttttgtatttttagtagagatgtggttttaccatgttggccaggctggtcttgaactcctgagctcaggtgttcacctgcctccctaagtgctaagtctacaggcgtgagccaccccgcctggccaaaaattttatttttttagagacgaggttttgccttgttgcccaggctgcagtgcagtggcaccatcatagctcactgctgccttgaatccctgggctcaagtgatcctcccaccttggcctcctgagtagctgggactacaggggcacaccactatgcccagccttttacatttctaatagtgttctattactattgcactgaaatttgaaggaaattagactttgtaagcacatttattctttaagtattttttactctctaaaagggttgaagggatagagaactttaccaaattgtgctaaaactctcttgccctgagggcacctctccctcacccctatttaccctggtcactttacttctgaagttcacttctgaagttcagttcatttttgactttgcctgcttggagagaagagggtgagtaaattcttactacgatttatctttatttaccatttggtattgactataaatacagtatgactgaaaggatttatgcttagcatgaactgatttttcatagctttatccttggtcattaactcagtttttcaggacaaagggattgattaaaggcatattgcacctagctttttttgtgatgattttgttttacgtaaatcaatataagctttagttctgagcaagattttacaaataaagacttctcataccagggtacat

SEQ ID NO: 136582 - DNA, 1073 bp, Homo sapiens
ggattacaggcatgagccaccgcgccaggcctctctttttaaattaaagatgaaaacaagcataggacaattggaaattaaaaaggaagacgtggaacagggacagctttcttgacatttaaaaggagaaaaccgtggccaagcgcagtggctcacgcctgtaatcccagcactttgggaggccaaggtgggcagatcacctgaggtcaggcgtttgagaccagcctggccaacatggtgaaactccgtctctactaaaaatacaaataaatttgctgggcttggtggcaggcgcctgtaatcccagctacacgggaggctgaggcaggagaatccgcttgaacccaggaggcggaggttgcagtgagccgagactgcaccactgcactccagcctgggcagcaagagcgaaactccgtctcaatcaataaataaatacatttaaaaaaatgaggaaactcttaagaaattggaagaaaaaaacaaatgataagcagaaattgaaaaggatcagagagtctggaaatgactggagaaaaggtttggagcaggaaaggaagaaggggaagtactatgagttaaggcttttaagttttagttccaaatttattattcagaaaatgccacttgtgtaataggtaagcattgttcattcaaaagttagttttaggatgaaaccttttatttggctttcctgttctatcataaataggaaaataaaatccctcataagttgtgaattctagaacttagttgtactatctaaatattaatataaccagaaaataaaaagatggtcctaagtcacacctgtaatcccagcactttgggacgccgaggcgggcagatcacgagttcaggagatcgagaccatcctggctaacacagtgaaaccccgtctctactaaaaaatacaaaaaattagccgggcatggtggtgggcacctgtagtcccagctactcgggaggctgaggcaggagaatggcatgaacccaggaggtggagcatgcagtgagccaagatcgcgccactgcactccagcctgggcaacagcaagactccgtctcacaca

SEQ ID NO: 136583 - DNA, 1026 bp, Homo sapiens
agcaaaaattgttaaaactctaagttaatattttcttctgaatgcatggaagtgtttaacattgttgtctttgatttttttccaggtgattcatggcaggggacgtggaaggattctgttcctccatccacgacaccagtgtctctgctgggttcagagcactgtatgaggagggattgcttcttgatgtcactctggttattgaagatcatcagttccaggcccataaagcactcttggccacccagagtgattacttcagaattatgtttactgcagacatgagggaacgagatcaggacaaaattcatttaaaaggtctaacagctaccggtttcagccatgtcctgcaatttatgtactatggaactatagagctgagtatgaataccgttcatgagattcttcaggctgccatgtatgttcaacttatagaagtggtgaagttctgctgctcttttctcttagcgaagatctgcctagaaaattgtgcagaaattatgagactcttagatgatttcggcgtaaacatcgagggagtcagggagaagttagacacctttctgctagacaactttgtgccactcatgtctaggcctgactttctgtcctatctgagctttgagaagctcatgtcttacttggataatgatcatctgagcaggttcccagagatagagctgtacgaggctgtgcagtcttggctgcggcatgatagaagacgctggagacataccgataccatcattcagaatatccggttttgcttgatgaccccaaccagcgtttttgagaaggttagtgcatttgaaagcaatagacagtactcatcatttagttaaggcagtgtatgtctttatagataagattcacagacttaagagccaagaatgaataacttcattttgttatttcttatgttattcaagaatgaataacataagagtactttatgtataagaagcctgatttgttgtgcatttaggttttgtaaaatacattttgtgggtgaaagataaaccacgt

SEQ ID NO: 136584 - DNA, 1038 bp, Homo sapiens
gggaaggcattgacagagtggtgacactggcagtgacagcctccctaaagaaggaggtgtagagcaagtgacagcagttgactgtagtgtccgctgcttctctggagggctcggggtccatataaatacctaaccaggggaaggacagaacttgggagattgggtcccagcagtgtcactggtggaaattcagagccgtagatgttggctgccacatccttagtgctcttttaggctagtgtggtttgtaggtcatgttctagaaaatagctgcaacatatgattccaagtcatgagatattctagaaagtgcttaaaaatggctgtagtatcccagagatttgtccatatctgctgtccttagtttgggaacatctttgatagtgcttcagtgttataccagcagggaatgcctcacaactgttcggtggacgaaactgccaagaggcactgaagattggcccaagattaaaggaccagttggcatagtttttgtttagcagggcagggatggaggacaggcagagagttaagggaaatgaaggccctggtaagaaagtggttgctctgatatggtaaggtctaagctggagaaggacagaggttaagttaggagatgatagaccaagtgaaaagagagtaggaaggttaagtaggaagttgacagttaagatttcagatgtagaccagttttggatcaggaacaggtccaagtggggtgggagtagggtttgcaatggaataagtggggaggttgtaggagttgagatggtcagggagttttgacttacagtttttggatggctgatcttatgtgaacattgaagaggtgtgaaagatgacttagccaggtgttgaagtctttttttttttttttttttgagatggagtcttgctctgttgcccaggctggagtgcagtggtgcgatcttggctcactgcagcctccgtctcccaggttccagcgattctcctgcctcagcctcccaagtagctgggattacatgtgccagccaccacacccagctaattttggta

SEQ ID NO: 136585 - DNA, 1073 bp, Homo sapiens
tatgttgagaagttggctgctttgagattgtcaaatttacatttttttactttatgggttacagaagtgagaaatgttatgactcagaaattaattctgtttttatccgtagtaagcctttgcattctcttttcgatatgcaactgtggcattttctgcataggcatcaattttggtaggagaacagtttggggatgaagatagtatgaaatcatttaaatttttcattgagggtaagtatattatatcaacctctgagaatctagcttttgcattgaataccttaagcttttgtatgaattttcaagcagctgtggaaggaatgtgaaagcaataaattattgcttatggcacaaacatagaggttaattttgaaatgtcttttaattgcctataattttgccttcacatcagaatggcagccttataactgaaaaggaagcatttaatttctttgcctttaatttcctgtccagttttacccccaccaaacttctttttttactggtcactagagagtttgaagtgttcaaaaattctgtgatataaatagcagtaatagtcttccagggcagaggtaggaagaggttgaggtttgtgcgtgcacgtgtgtgtgtgtgtgtgtgtgttgtcacttatctcttacactttcagttgttctcaagcctgtggtctcaggacttctttgtacttatttgtactcttaaaaattagtgggggccgggcttggtggctcacacctgtaatcccagcactttgagaggccgaggcgggtggatcgcttgaggccaggagttcgagaccagcctgggcaacatggtgaaactccgtctctactaaaaataaaaaaatgagctgggcgtggtggtgggctcctgtaatcccagctactcaggaggctgaggcaggagaatcgcttgaaccccggagcagaggttgcagagatcatgccactgtactccagcctgggtgcagagtgagactgtctcaaaaaataaataaacaaataaaaattaattctattacatggtaacctaaataacatttttttatgaaaaataacttttctaaaa

SEQ ID NO: 136586 - DNA, 1043 bp, Homo sapiens
cgagctaggcacgaattcgccggccctctctgcacggacccgagtcaaacatttggtagacgccgggacctcgtttgtcttcgagtttacttaaattgtttgaaatgtaatttttttttccagagagagcgagaaagaaaaaggaagaagcataattcagccattttttgcagcacacagctgcaggtaccatgattattttttgcctaacccgttccttccctttaacaattcaatttatgcctgaaatagaactatgcaaaatgcgaggcataaaactaggaatcggaaggtctgggttcgacttgggtgactctgagaaaaaatcgcgtaccgagccttggtttcttatctatgaaatatagtcggtactaccaacatcgcagggttgagaggactatatgaggtcatatatgtgaaaataatccttaactgtagagtgttgtaagaatgcaaggccgttttttaagtaacctttggtagagtggttaatgtagtggctaactgttgctgcctctttatttctatattataaatataagcaaataagtacggaataatagtaaagcagtgctgtgaatccatagatctgtaatagtcacgttgcttggccttcctcctacgaagtgctaactgcttatttaaataacggtattctttaattcaaatgtaacgttaccgtaggggctttgcttttcatcgttctaggccgctttaggccccttttcttactccaaatatttaacaccttacatttgttagtcttttctgttttccgaatttgtttgcctttgttaatctgattaagtggtaatttagaaaatgctttgcagacatatatgccctaattttaatgcctgtttttcatatctagggagcaggatgcttgaatacttctactaatttgaaaattggttttgaagagcttatcaatgcattcatgtttcagtaatccttaatagatctagaaatgtatagaacatttcaactttttagcacttaatgtaattatataattttattctcatttttaatcacaacac

SEQ ID NO: 136587 - DNA, 1056 bp, Homo sapiens
ataattatctctttctagcaaacttgaacataccatctttcccaagaggccaaaatagcacacggtgtactgttttgctgaagtagactacttcgtgggagagataacacaatcacttcaatcttttggaaatacgcttccttattccgatttaaactataacaagctttaaaaaaactgtaagacactgaaattcccaagttgttcacactttctttccatcttttccaatagctcctttaagatatttctgttcattatttaaaaatccctgcttgccatatttgtatctattactacatgacaaattaccccagaatttcacattaaaacaaatttttaaaattaaatcataaaataaactttaaaaatgcatacattccacttctgaatatttaaatgttcatgcattattcccgaacatctaaacgctgagtttggatttttgtacattaactaacattttaagctatacattactatgtggcactgacctgtctaaagagaggcttctgttcttgattcaagcaagagttgaaacgtttctgcgctctttgtaccaggtataaatgtagtgagtgtatgtcataagccattgtgtgatcaccgtgcttcccgtccctccttattttgacattgcaaggtctcgtggaatttcaaatgtgcttttttggatatttatgtagttttaaaactgggctgtgtctttcaatcaatctatacgtttactatatgaacccctccccaagttatcttcaatcaatgatgcctctttcactcttatttcttatttttatgttattattattattttttttttgagacagtctcactctcggccaggctggagggcagaggcatgatctcagctcactgcagccttgacctcccgggctcaagcaatccttccacctcagcctcccgaatagctaggaccacagacgtgccccaccatgctcggctaacttttcttttcttgtttttgtttgtttgtttgttttgtttttgtttgcttgtttttttctgagatggagtctgtcgctcaggctggggtgc
